United States Patent 11,931,406 (FLAVIVIRUS VACCINE) - sequence listing, part 68

SEQ ID NO: 23665 - RNA, 9867 nt, Artificial Sequence
  derived and/or modified CDS sequence (opt6) from DENV-4__JQ915086__SS-prME
aguacaaugacauuauugugccuaaucccuacuguaauggcauuccauuuaagcacuagggauggagaaccauuaaugauagucgccaaacacgaaagagggcgacccuuauuauuuaaaacaaccgaagggaucaauaaaugcacgcuaauagcgauggauuuaggugaaaugugugaagacacuguaacauauaaauguccacuuuugguaaacacggaaccagaagauauugacugcugguguaaccugacaaguacauggguaauguacggaacuuguacacagucaggugaacggagaagagaaaagaggagugucgcacuaacaccccauaguggaaugggucuagaaacacgugcugaaacauggaugagcuccgaaggagccuggaagcaugcacaaagaguggaaucauggauauuacgaaacccgggcuucgcacugcuagcagguuuuauggcauauaugauuggucaaacugguauacagagaacaguuuucuucguucucaugauguuaguagcuccuucguacgguaugagaugugugggcguuggaaauagggauuucgucgaaggaguuagugguggcgcaugggucgaccuaguauuagaacauggaggauguguaacuacaauggcacaaggaaaaccaacauuggauuucgaacuaacgaaaaccaccgcuaaagaaguagcguuacuucguacuuacugcauagaagcauccauuaguaacaucacuacugcaacucgcuguccaacacagggagaaccuuaucuaaaagaagaacaagaucagcaauacauuugcagaagggauguagucgauaggggcuggggcaaugguuguggucuauuuggaaaaggaggagucguuacuugugcgaaguuucuuuguucaggaaaaauuacagguaauuuaguccagauagaaaaccucgaauauacaguaguuguuacaguccauaauggggauacacacgcagucggcaaugauaccuccaaccauggggucacugcuacgauuacgcccagaaguccgucaguagaagucaaauugcccgauuauggggagcugacgcuagacugugagccacguaguggcauugauuuuaaugaaaugauacucaugaaaaugaagaagaaaaccugguugguccauaaacaaugguuucuagaccucccccugccauggacggcuggggcggauacaagcgaaguccacuggaacuauaaagaacgaauggucaccuuuaaaguaccacaugcgaaacggcaagacguaaccguacuggguucacaagaaggagcgaugcauagugcacucgcuggugcuacagaaguugauaguggagacgggaaccauauguucgcaggucauuuaaaaugcaaagugagaauggagaaauuacgaauaaaagguaugucauauaccauguguucaggaaaauucaguauagacaaagagauggcagaaacccagcacggaacaacagucgucaagguaaaauaugaaggagcaggagcuccauguaaaaucccaauugaaaucagggauguuaacaaagaaaaaguagugggaaggaucauaagcagcacgccuuucgcugaaaauacuaauucaguaauaaauaucgaacuggaaccaccauucggagauaguuauaucguaauaggaguuggggauagugcacuaacguugcacugguucaggaagggaaguuccauaggcaaaauguuugaaaguacguaucgcggagcgaaaagaauggcgauuuuaggagaaacggcaugggauuucgggagcguuggagguuuguucacaucuuuagguaaagcagugcaucaaguauucgguucgguauauacaacaauguuuggaggagugucauggaugauuagaauccuuauugguuuucuaguuuuauggaucggcacuaauucacgaaacacaucaauggccaugaccuguauagccguggguggaaucacacuauuuuuaggcuuuacaguacaagcugauaugggauguguuguuucauggaaugguaaggaauuaaagugugguagugguauuuuugugguugacaacgugcacacauggacagaacaauauaaauuccaaccagagagcccugcccguuuagcgagugcaauucugaacgcacacaaagauggugucugcggaauacguuccacuacuagguuagaaaacgugauguggaagcaaauuacuaacgagcucaauuauguguugugggaaggaggucaugacuugaccguuguagcgggagauguaaagggaguucuaaccaaggguaaacguguucuuaccccacccguaaaugaucuuaaguacaguuggaagacguggggaaaagcaaaaauuuuuacgcccgaggcgagaaacucaacuuuucugauagacggaccugacacauccgaaugcccuaaugagcggcgugcauggaacuucuuugaggucgaagauuaugguuuuggcauguucacuacuaacauuuggaugaaauucagggaagguucgucagaagucugugaccauagacugaugucggcugcaauaaaagaucagaaggccguucaugcugauaugggcuauuggauagaaagcuccaagaaucagacauggcaaauagaaaaagcaucauugauugaagucaaaacauguuuauggcccaagacucacacacuauggucgaauggugugcuagaaucccagaugcucauaccccggucauacgcagggccauucagucaacauaauuacagacagggauaugcgacgcaaacagcaggcccauggcaucugggaaaauuggagauagacuucggcgaguguccagggacaacuguuaaaauucaggaagauugugaucaccguggaccaaguuuacgcacgacaacugcuucugggaaguuaguuacucaaugguguugcagaucaugcaccaugcccccuuuaagauuucuaggggaagacggaugcugguacggaauggagauuagaccacuuucggagaaagaagaaaacaugguuaagagucaaguaacagcuggucaaggaacgagugaaacauuuucgauggggcugcuaugccuuacauuauucgucgaggaaugccuaagacgaagggucacgagaaaacauaugauauuaguaguaguaauaacguuuugugccauaauccuaggaggccuaaccuggauggauuuauuacgugcauuaaucaugcucggcgacacuaugagcggucgaaucgggggacaaauacaucucgcgauaaugacagucuuuaagaugaguccaggcuauguuuuagggguguuucuuagaaaauugacaagucgugagacagcauugaugguaaucgguauggcaaugacaacgguauucagcaucccgcaugaccugauggaauugauagauggaauuucauuaggacugauuuuauugaaaaucgucacccauuuugauaacacucagguagggacauuagcuuugucacucaccuuuauaagaagcacuacgccauuagucauggcuuggagaacaaucauggcaguauucuuuguuauuacacuaauuccccugugccgcacguccuguuugcaaaaacagucucacuggguugagauaaccgcacuuauacuaggugcacaggcauuaccaguauaucuaaugacguugaugaagggagcauccaggagaucuuggcccuuaaacgaagguaucauggccguuggcuuaguuagucuacuaggaucagcuuuacuuaaaaaugacguucccuuggcuggcccaaugguugccggaggcuuauuguuagcugcuuacguaaugagugggucgucagcagauuuguccuuggaaaaggcagcgaauguucagugggaugaaauggcugacaucacggggaguucacccauuauugaagucaaacaagacgaggaugguucauuuaguaucagagacguggaagaaacaaauaugauaacacuacuugucaaauuggcccuaaucacgguaagcggauuauauccacuugcuauuccuguaacaauggcacuuugguauauauggcaaguaaaaacucaacggagcggugcacuuugggacguaccuagcccugcagcgacacaaaaagcuacuuuaucggaaggcguuuauagaauaaugcaaagggguuuauucggcaagacucagguuggaguuggcauccauauggaagguguauuucacacaauguggcaugugacucgaggauccguaaucugucaugaaaccggucggcuagaaccuuccugggcagauguaagaaacgauaugauaucauauggagguggauggcgacuaggugacaagugggauaaagaagaagacguucagguucuagccauugaaccuggaaagaauccacgucaugugcagaccaaaccgggauuauuuaaaacgcuaaccggagaaauaggugcaguuacacuagacuuuaaacccgguacgucuggcagcccgauaauuaacaagaagggaaaaguuauagggcucuacggaaacggaguagugaccaaaaguggggauuacguaucagcaaucacucaagccgaacgcauaggagaaccagacuacgaaguagaugaagauauuuuccggaagaaaaggcuaacuauuauggaucuacauccaggugcuggaaaaacgaaaaggauuuuacccucaauaguucgcgaagccuuaaagagacgauuaaggacacuaauacuggcuccuacuagaguugucgccgcugagauggaagaagcgcuaagaggguuaccaauuagguaccaaaccccugcagucaaaucugaacauacgggcagggaaauuguugaccugaugugucaugcgacuuuuacuacaaggcuacuaucaagcacucgcguaccaaauuauaauuuaauugucauggaugaagcucacuucacagaucccuguaguguugcggccagaggguacauaucgacaagaguggagaugggcgaagcagcggcaaucuuuaugacagcaacucccccuggaagcauugacccuuuuccucaaaguaauucuccaauugaagauauagaaagagaaauucccgaaagaucuuggaauaccggauuugauuggauaacugacuaucaagggaaaacuguuugguucguucccucgauuaaggcagguaacgauauagcuaacuguuugcguaaaaguggaaaacgaguaauacagcucaguaggaagacauuugacacggaguauccuaaaaccaagcugacagauugggacuuuguugugacaacagauauaagcgaaaugggcgcgaauuuccgagcaggucgaguaauugauccaagaagaugccucaaaccaguaauauugacagauggaccagaaagaguuauccuggcugggccaauaccugucaccccugccagcgcugcgcaacgucgggggaggauugguagaaacccagcucaggaagacgaucaguacguauuuucaggagauccauugaaaaaugaugaggaucaugcccauuggaccgaagcaaaaaugcuacuagacaacauuuauacaccugaagggauaauaccaacauuauucggccccgaaagagaaaagacucaggcuauugacggugaauuuagauuaagaggagaacagagaaaaaccuuuguugaauuaaugaggaggggugaccuuccaguuuggcuuaguuauaaaguggcauccgcagggauaucauauaaagacagagaauggugcuucaccggagaaaggaauaaccaaauauuggaagaaaacauggaagucgagauauggacaagagaaggugagaagaagaaacuaagacccaaauggcuagaugccagaguauacgcugauccaauggcgcuaaaagauuuuaaggaauuugcuucuggaagaaagucaacaacgcucgauauucugacugaaauugcaacacuaccaacuuaucuauccagcaaagccaaauuagcacuugauaauauuguaauguuacauacaacagaaaaaggagggagagcauaccaacacgcauugaaugagcugccagagucauuagaaacgcuuaugcuuguugcauuauuaggugcuaugacagcuggaauuuuucuauucuuuaugcaaggaaagggaaucggcaaacuuucgaugggacucauagcuauugcuguugcaucgggucuacuuugggucgcugaaauacaaccucaauggauagcagccaguauaauccuggaguucuuucucaugguauuacugaucccugaacccgaaaaacaacgcaccccacaagacaaccaauuaauuuacguaauuuuaacuauucuaaccauuauuggguuaauagcugcaaaugaaaugggucuaaucgagaaaacgaaaacugacuuuggguuuuaccaagucaagaccgaaacaaccauuuuagauguggaucuucgcccugcuuccgcguggacuuuauaugcaguugcaacuacaauauuaacccccauguuaagacauacaaucgagaauacuucagccaaucuuagccuagcugcuauagcuaaucaagcagcgguccuaaugggccucgguaaaggauggccucugcaucgcauggaccuuggaguuccauuacuugcaauggguuguuacucccaaguuaaccccacaacacuaaccgcgucauuaguaauguuauuaauucauuaugcgauuauaggaccagguuugcaggccaaggcgacccgugaagcgcagaagcgaaccgccgcuggcauuaugaaaaacccaacuguagaugggauaaccguaauugacuuggaaccaauaaguuaugacccuaaauuugaaaagcaacuaggacagguuaugcugcuuguccugugcguuggacaacuauuauuaaugagaacaacuugggcuuuaugugagguucuuaccuuagcaacgggaccaauaaugacacuuugggaagggaacccaggaagguucuggaauacuaccauagcaguaagcacagcuaacaucuucagggguucauauuuagcuggagcaggccuagcuuucagcuuaaucaaaaaugcacagacaccuagaagaggaacaggaacuacuggagagacucugggugaaaaguggaaaagacaacuuaauaguuuagaucgaaaggaauuugaggaauacaaaagaucugguauucuugaaguagaucguacagaagcgaaaucugcuuuaagggauggaucuaaaauuaaacaugcuguaucacgaggaaguucuaaaauuagauggauuguggaaagaggaaugauuaagccuaaaggaaaagucguagaucuagguugcggacguggcggauggucuuauuacauggcaacacuaaagaauguaacugaagugaaagguuacacgaaaggagggccaggucaugaagaaccaauuccuauggcaacauaugguuggaaucuagucaaacuacauagcggaguagacguauuuuacaaaccaacggagcaaguugacacuuuauuaugugauauuggagagucuaguucaaacccgacgauagaggaagguagaacgcucagaauauuaaaaaugguugaacccuggcuuucaucaaaacccgaauuuuguauaaaaguccucaacccauacaugcccacagugauagaggaauuagagaaauugcaacgaagacacggcggaucauugguuaggugcccguuaucaagaaauucgacccaugaaauguacuggguaucaggcgcgagugggaauaucgugucaucaguuaacaccauaucuaaaauguuacucaaucgauuuacaacuaggcaucgcaaaccuacauaugaaaaagaugucgauuuaggagcugguacuagauccguauccacugaaacggaaaagccggauaugaccauaauagguagacguuuacaaagauugcaggaagaacacaaggaaacuuggcauuaugaucaggaaaaccccuacagaacgugggcauaucacggaucauaugaagcaccaucaacaggaagugcaucaucuauggugaauggaguaguaaaguuacucacgaagccaugggacguuauuccaaugguaacucaauuagccaugaccgauacuaccccguuuggacagcaacgcguauuuaaagaaaaaguugacacgaggacuccacagcccaaacuuggcacaagaaugaucaugacaacuaccgccaacuggcuuugggcccuacuaggaaagaagaaaaguccaagguuguguacucgugaggaauuuauauccaaaguacgauccaacgccgcaauuggcgcgguauuccaagaagaacaaggauggacuucugcaagcgaggcaguaaaugacucgcguuuuugggagcuuguagauaaagaaagggcgcuacaucaggaagggaaaugugagaguuguguguacaacaugaugggaaaacgugaaaagaaacuaggagaguucgggagagcaaaaggaagucgggcgaucugguacauguggcuaggcgcacgguuccucgaauuugaagcauuaggcuuccugaacgaagaucacugguuuagcagagaaaauuccuggucagguguagaaggggagggacugcauagauuaggguauauauuggaagauaucgauaagaaagacggugaucucauuuaugcugaugauacagcugguugggacaccagaauuaccgaagacgaccuauugaaugaggaacuaauaacagaacaaauggcuccgcaccauaaaacauuagcgaaagccauuuucaaauuaacauaccaaaauaaaguaguaaaaguauugaggccaacaccuaaaggagcaguaauggauaucauaucaaggaaagaucagcguggaagcggacaaguagggaccuacgggcuaaauacauuuacuaauauggaaguccagcucauaaggcaaauggaagcugagggaguaauaacacaagacgacaugcaaaauccaaaaggauugaaagagcguguagagaaaugguuaaaagaaugcggaguagacagacuaaaacgaauggcaauaagcggcgacgacuguguagucaaaccccuggacgaacgcuuuagcacgucucuuuuauuucuuaaugacaugggaaaaguacgaaaagauguaccccagugggagcccagcaaaggauggaagaauuggcaagaaguucccuucugcucucaccacuuucauaaaauauuuaugaaggauggaagaucauuggugguaccauguagaaaucaagaugagcucauaggcagagccaggaucucacaaggcgcgggauggagccuuagagagacggcaugucuggguaaggcauacgcacaaaugugguccuugauguacuuucauagacgugaccuucgacuagcaucaauggcaauauguucagcaguaccgacagaaugguuuccaacuucaagaacaacuuggucaauucacgcucaacaccaauggaugacuacugaagacaugcucaaaguuuggaaccgugucuggauugaagacaacccgaacaugacagauaaaacgccaguacacucuugggaagauauucccuacuuagguaaaagagaagaucuuuggugcgggagccuuaucggacuuuccuccagggcaacaugggccaagaacauacacaccgccauaacccaagucagaaaucuaauaggaaaagaagaauacguugauuacaugccugugaugaaacgauauagugccccgucagagucagagggcguauuauaa

SEQ ID NO: 23666 - RNA, 9867 nt, Artificial Sequence
  derived and/or modified CDS sequence (opt6) from DENV-4__JQ915087__SS-prME
aguacaaugaccuuauugugccuuauaccuacagucauggcauuccauuuaaguacaagagacggagaaccuuuaaugauaguagccaaacacgaacgcggacggccuuuauuauuuaaaacaaccgaaggaauaaauaaauguacccuaauagcgauggauuuaggagagaugugugaagauaccguuacuuacaaauguccucuauuagucaacacugaaccugaagauauagauuguugguguaaucuaaccucaaccugggugauguaugggacauguacucagucaggagagaggagaagagagaaaaggaguguagcauuaacgccccacaguggaaugggacuagagacacgagcggaaacguggaugucaagugagggugccuggaaacaugcucagagagucgaaucguggauuuuacgaaacccggguuuugcuuuacuggcugguuuuauggcauauaugauuggucagacagggauucaaagaauaguauucuucguucuaaugaugcugguggcgccgucuuauggaaugagaugcgucggaguggguaauagagauuuuguagaaggaguuagugggggugcauggguagauuuagucuuggagcauggagggugugucacaaccauggcacaaggaaaaccaacauuagauuucgagcuaacaaaaacgaccgcuaaagaaguggcauuacuucgaacauauuguauagaagcaaguauaagcaauauaacuacggccacccgauguccuacucagggagaacccuaccuaaaagaagaacaagaccaacaauauauaugccgucgagauguaguugacagaggguggggaaacggcuguggucuauucggaaaaggcgggguaguaacuugugcuaaauucuuauguagugguaaaauaacugguaaucucguucaaauugaaaaccuugaguauacagugguaguaaccguccacaauggagacacgcacgcagucggaaaugacacgucaaaccauggcguuacggccaccauaacaccaaggagcccaucaguagaaguuaaauuaccagauuacggcgaauuaacguuggacugugaaccgcguucagguauagauuuuaaugaaaugauuuuaaugaaaaugaaaaagaaaacauggcuuguccauaagcaaugguucuuagaucugccacuucccuggacugccggugcugauaccucagaaguacauuggaacuauaaagaaagaaugguaacguucaaagugccucacgcaaaaaggcaagaugugacgguacuaggcucacaagaaggcgccaugcauucagcgcuagcuggagcaaccgagguagauaguggugauggaaaccauauguucgcuggccauuuaaaauguaagguacgcauggaaaaacuccgcauaaagggcaugucauacacaaugugcucuggcaaguuuucaaucgauaaagaaauggcugaaacucaacaugggaccaccgucgugaaaguuaaauacgaaggggccggggcaccauguaaaauaccaauagaaauuagagacgugaauaaagagaaaguagucggacgaauuaucagcaguacacccuuugcagagaauacaaauucggucauaaauauugagcuagaaccaccguuuggagauucauacauugugauagggguuggugacagugccuuaacucugcauugguuuagaaaaggaucaucaauaggcaaaauguuugaaucuacauacagaggugcaaaacgaauggcaauacuaggagagacugcuugggauuuugguagcgucgguggacuguuuaccucacuaggaaaggcaguucaucagguuuuuggcucgguguauaccacaauguucggaggcgucucuuggaugauaagaauacucauaggauuccuuguuuuauggaucggcacuaauaguaggaauacgucgauggcaaugaccugcauagcaguaggaggcauaacucucuuccuaggauucacgguacaggcagauaugggauguguaguaucauggaaugguaaagagcugaagugugguaguggaauauucgucguagacaauguucauacauggaccgaacaguauaaguuucaaccagaauccccugcuagacuggcaucagcaauauuaaaugcucacaaggaugguguuuguggcauacggucaacgacgcggcuugaaaauguuauguggaaacagauaacuaacgagcuaaauuacguuuuaugggaaggaggacaugacuugacagugguggcaggagauguaaaaggagucuugaccaaagguaagagggcacucacuccuccuguuaacgaccuaaaauacagcuggaaaaccuggggcaaggccaagauuuucacgcccgaagcaaggaacucgacguuucuuaucgauggaccagauacaagugagugcccaaacgagaggagggcauggaacuucuuugaggucgaagacuaugguuucggaauguucacgacaaauaucuggaugaaguucagagaaggaaguagcgaaguuugcgaucaucguuuaaugucagcagcuauaaaagaucaaaaagcugugcaugcugacaugggauauuggauugaaaguuccaaaaaucagacuuggcagauugaaaaagccucgcuaauugagguuaaaacaugucucuggccgaaaacacauacacuauggucgaaugguguuuuggaaucgcaaauguuaauaccaagaucuuacgcaggaccuuuuagucagcacaauuauaggcaaggguaugcgacucaaacggcagggccauggcacuuggguaaacuagaaauagauuucggggaauguccagguacuacuguuaaaauccaagaggauugugaucaucgggguccgucucugcgcaccaccacugccucgggcaaacuggugacgcaauggugcugucguucaugcacgaugccucccuugagauuccuaggagaagacgguuguugguauggcauggaaauucguccguuaagcgagaaagaagaaaacauggucaaaucacaaguaacagcuggucaaggaacgucagaaaccuuuaguaugggccuauuaugucuuacucuguuugucgaagaaugcuuacgaagacgagugacccguaagcauaugaucuuaguaguagucauaacauuuugugcuauaauccuaggaggucuaacauggauggaccuuuuaagagccuuaauuaugcuuggcgauacaaugagcggacgcauagguggucaaauccaucuagccauaaugacaguuuuuaagauguccccgggauacguauuaggaguuuucuuacgaaaacucacaagcagagaaacugcgcuuaugguuauagggauggcuaugacgacgguguucucaaucccccaugauuuaauggaauugauugacgggaucagcuuaggucuaauauuauuaaagauugugacucacuucgacaauacgcaagucggcacauuagcguuaagucuuacguucauaagguccacgacaccacuuguuauggcauggcgaacaaucauggccguauucuuugucauaacacuuauaccccuauguagaacgucaugucuacaaaaacaaucacacugggucgagauaacggcauugauacuuggagcccaggcgcuaccuguuuauuugaugacguuaaugaaaggggcgucaagaaggucuuggcccuuaaacgagggcauaauggcaguaggucuuguuucccuacuagggucagcauuacucaaaaacgauguacccuuagcugggccuaugguugcgggcggucuuuuauuagcggccuaugucaugagcggaucgucugcagaccuaucauuagagaaagcagcuaacguucaaugggaugaaauggccgauaucaccgggaguucaccaauuaucgaaguuaaacaagacgaagaugguucauuuuccauuagagacguagaagagaccaauaugauaacauugcuagucaaacuagcucuuauaacaguaucuggguuauauccccuagcaauuccagugacaauggcgcuaugguacauuuggcaaguaaaaacccaacgaucaggagcuuuaugggauguuccaucaccggcggccacacaaaaagccacacuuucagaagguguauaucgcauaaugcagagaggucuauucggaaagacucaagugggcguggggauucauauggaagggguuuuucacacuauguggcauguaacgcgaggaucgguuauuugucaugaaaccgguagacuagaacccucgugggcagauguacgaaaugauaugaucuccuacggcggcgguuggaggcuuggagacaaaugggauaaggaagaagacguacaagucuuagcgaucgaaccaggaaagaauccccgacauguucaaacaaaaccaggccuauuuaaaacauuaaccggcgaaauaggagcggucacgcuugauuuuaaacccggaaccucuggaaguccaaucauaaacaagaaagguaagguuauaggauuauaugggaauggcguagucacaaaaaguggcgacuauguuagugcuauaacacaagccgagagaauaggugagccugacuacgaaguggaugaagauauuuucagaaagaaacgacugacgauuauggauuuacauccuggcgccggaaaaacaaagagaauccuaccuucaaucgugagagaggcacuuaaaagaagguugcgaacuuuaauauuagcgcccacgcgugugguagcagcagaaauggaggaagcgcuaagggguuuacccauaagauaccaaaccccagcaguaaaaagugaacacacugguagggagauagucgauuugaugugccaugcgacuuucacaacgagguuacuuaguaguacacgagugccaaacuauaaccuuauaguuauggacgaggcgcauuuuacagacccauguaguguggcagcaagagguuacaucucaacucgaguugaaaugggagaagcugcugcuaucuuuaugaccgccaccccgccaggauccauagauccauucccacaaucuaacucaccaaucgaagauauugaacgagaaauaccagagagaaguuggaacaccggauucgacuggaucacugacuaccaaggcaagaccgucugguucguaccgaguauaaaagcagguaacgauaucgcuaacugucuaagaaaaucagguaagagaguuauacaacuuucaagaaaaacauuugauacggaguauccuaaaacaaaacugacggacugggacuucgucguaacaacagauauaucagagaugggagcaaauuuuagagcugggcguguuauagauccaagaagauguuuaaaaccuguaauuuuaacagaugggccggaaagaguaauucuugcaggaccgauuccaguaaccccugcgucggccgcccagcgccgaggacgaaucggaagaaacccugcacaagaggaugaccaauauguauucaguggagacccguugaaaaacgacgaagaucaugcacacuggacugaagccaaaauguuacuggauaauauauauacgccugaagggauaaucccgacccuauuuggcccagaaagagaaaagacucaggcuauagauggagaauuucgcuuacguggggagcagcggaaaacuuuuguggaauuaaugagaagaggagaccuuccuguaugguuguccuacaaaguggcaagugcagguauaucauauaaagauagagaguggugcuuuacuggagagcggaauaaucaaauccuugaggaaaauauggaaguagaaauauggacacgggaaggagagaagaagaaacuuagaccaaaaugguuagacgcacgaguauaugccgauccuauggcucugaaagacuuuaaagaauuugcuucaggaaggaaaucaaccacuuuagacauuuugacggagaucgcaaccuuaccuaccuauuuaucguccaaagcaaaacucgcauuagauaauauugucauguuacacacaaccgaaaaaggcgguagagcuuaucaacaugcgcuaaaugaauuaccagaaagucuagaaaccuuaaugcuaguagcauuguuaggugcuaugacugcagggaucuuuuuauucuucaugcagggaaaaggaauaggaaaguuaaguaugggguugauagccauagcaguagcuagcggacucuuauggguugcugaaauacaaccacaguggauugccgcgaguauaauacuggaguucuuucuaaugguuuuguugauaccagaaccugaaaagcaaagaacaccgcaagauaaucaauuaaucuacguaaucuuaaccauacuaacgauaaucggacuuauagccgccaaugaaauggguuuaauagagaaaacaaaaaccgauuuuggguucuaucaaguuaaaacggaaacgacaauacuagauguagaccuccgucccgcuucagcauggacgcuauaugcaguagcaacaacuauccuaacaccaaugcucagacauacaauagaaaacacaagugccaaccuaucauuagccgcaauugcaaaucaggccgcagucuugaugggguuggguaaaggauggccuuugcaccgaauggauuugggaguaccucuuuuagcaaugggaugcuauucucaggugaaccccacaaccuuaaccgcaucgcucguuauguugcucauacauuacgcaauaaucgggccaggauuacaggcaaaagcaacaagggaagcucaaaagagaacggcugcggguauaaugaaaaauccgacgguagacggaauaaccguuauagauuuagagccaauuuccuacgauccaaaauuugaaaaacagcuuggccaaguaauguuguugguauuauguguuggucaacuacuguugaugagaaccacuugggcucuuugugaaguuuuaacccucgccaccggaccaauuaugacacuaugggaagguaauccaggaagguucuggaauacaaccauagcagucucuacugcuaauaucuuccgugggucauaucuagcaggcgcuggcuuggccuuuaguuuaaucaaaaacgcgcaaacaccaagaagaggaacaggcacaacaggagaaacccuaggagaaaaguggaagagacaacuuaacucacuagauagaaaggaauuugaggaauacaaacguucagggauuuuggaaguagaucgaacugaagcaaagagcgcucuacgagauggaucgaaaauuaaacacgcgguaucgcggggcuccagcaagauuagauggauuguugaacgaggaaugaucaaaccuaaagguaaaguaguagacuuaggaugcggaagggguggguggaguuacuacauggcaacguugaaaaauguaacggaaguaaaagguuauacaaaaggcgggccgggccaugaggaaccaauccccauggccacauacggauggaaccuaguuaaacugcacucuggcguugauguauuuuacaaaccaacagagcaaguagauacgcuauuaugugauauuggggaaucaucuaguaacccuacuaucgaagaaggccgaacauugcggauucucaaaauggucgaaccuuggcucagcucaaaacccgaauuuugcauaaagguuuuaaacccauacaugccuacggucauagaggaacuagaaaaauuacagagacgucaugguggaagccuaguuagauguccauuaucacgaaacucaacgcaugaaauguauugggugaguggcgcaagcggcaauauugucagcucuguuaauaccauuaguaaaaugcugcuaaacagauuuacaaccagacauagaaagccaaccuacgagaaagauguugacuuaggugcagguacucgguccguaucgaccgaaacugaaaaaccugauaugacuaucauaggucgcaggcuucagagauuacaagaagaacauaaggaaacuuggcacuacgaccaagaaaauccauauaggacgugggcuuaucauggaucauaugaggccccuagcacaggaucugcgagcucuauggugaauggaguuguaaaauuauuaacgaaaccaugggacguaauucccaugguaacccaauuggcaaugacugauacaacaccuuuuggacaacagagaguauuuaaagaaaaaguugauacaagaacaccacagccuaaacucggcaccagaaugaucaugaccacuacugccaacuggcuaugggcccuauugggcaagaagaaaucuccaagguugugcacacgugaagaguuuauaucaaaaguccgauccaaugcagcuaucggcgcuguguuccaagaagaacaaggauggacaucagcuagugaggcaguaaacgacucaagauuuugggaguuggucgacaaagaaagagcacuucaucaagaaggaaaaugugaaagcugcguuuauaauaugaugggcaagcgugagaagaaauugggggaauuugguagagcuaagggaucaagggccauaugguacauguggcucggggcccguuucuuagaguuugaagcauugggauucuugaaugaagaucacugguuuucuagagaaaauucauggagcgguguugaaggcgaagguuuacauucucuuggauauauacucgaagacauagauaaaaaggauggggauuuaauuuaugcugacgacaccgcagguugggauacacgaauuacagaagaugaucuacugaaugaagaauugauaacagaacagauggcuccacaucacaaaacguuggcaaaagccauauuuaaacuaacguaccagaauaaaguggugaaaguccuaagaccaacacccaagggugcagucauggacauuauaucuagaaaggaucaacgaggaucaggucaaguggggacuuauggccugaacacauucacuaacauggaggugcaauuaauccgacaaauggaagcagaaggggucauaacucaggacgauaugcaaaauccaaaaggauugaaagagagagucgaaaaaugguuaaaagaauguggaguagacagacucaaacgaauggcuauuucuggagacgauugugugguaaaaccauuagaugaaagauuuucaacgagccuucuauuccuuaaugauauggggaaagucagaaaagacguaccacaaugggaaccaagcaaaggauggaaaaauuggcaggaaguuccauucugcucacaucauuuccacaaaauauuuaugaaagauggacgaucuuuaguaguuccguguagaaaucaagacgaacugauaggaagggcacguauuagucaaggcgcugguuggagcuuaagagagacagcauguuugggcaaagcauaugcccaaauguggucgcuuauguacuuucauagaagagaucuuagacucgcuucgauggcuaucuguucagcaguucccaccgaaugguuuccuacaagucguacuacguggagcauacacgcucagcaccaauggaugacaacagaagauaugcuaaaaguguggaauagaguauggaucgaggauaaucccaacaugacagacaaaaccccaguccauucaugggaagacauaccauaucuaggaaagcgagaagaucuuugguguggaucauugauaggccuuucaucucgcgcaacaugggccaaaaacauccauacagcaauuacgcagguacggaaccuaauagggaaagaagaauauguggacuauaugccuguaaugaaaagguauuccgcgccguccgaaucagaaggaguauuauga

SEQ ID NO: 23667 - RNA, 9867 nt, Artificial Sequence
  derived and/or modified CDS sequence (opt6) from DENV-4__JQ915089__SS-prME
ucaacuaugacccuuuuaugucuaauaccuaccguuauggcuuuucaucuaaguacucgugacggagaaccacuaaugauaguagcaaaacacgaaaggggacgaccccuauuauucaaaacgaccgaaggaauaaacaaauguacucuaauagcgauggaucuuggagaaaugugugaagauacugugacuuacaaauguccacuauuagucaauacagaaccagaagauauagauugcuggugcaaccuaaccucuacuugggugauguacggaaccuguacgcagaguggagaaagaaggagagagaaaagaucaguugcauuaacgccucacucagguaugggucuagaaacccgagccgaaacauggaugucuagcgaaggugcauggaaacaugcacaaagaguagaaucauggauuuuacgaaacccagguuuugcucuacuagcuggauucauggcauacaugauaggacaaaccgggauucaacgaacaguauuuuucguauuaaugaugcuaguggcuccuucauauggaaugcgguguguggggguuggaaauagagauuucguagaaggcguaagugguggagcguggguggaccuaguauuagaacacggagggugcguaacaacuauggcucaaggcaaacccacacuagauuuugaacuaaccaaaacaacugcuaaagaaguagccuuacuacgaacauacuguauagaagcuagcauaagcaauauuacuacugcaacucguuguccaacccaaggugaacccuaucucaaagaagaacaagaucaacaauauauaugucgaagagacguuguagaucgagguuggggaaauggcuguggcuuguuuggaaaaggagggguagucacaugugcgaaauuuuugugcucaggaaaaauuaccggaaaccucgugcagauagaaaauuuagaauauacgguuguaguaacuguucauaauggagacacccaugcagugggaaacgacacaaguaaccacgguguaaccgcaacuauaacaccccgaucaccuaguguagaaguuaaauugccagacuacggggaauugacacuugauugugaaccacgauccgguauagacuucaacgaaaugauacucaugaaaaugaagaagaaaacauggcuuguccacaaacaaugguuuuuagauuuaccucucccauggaccgcuggugcugacacuucagaaguacauuggaauuauaaagaacgaaugguaacauucaaaguaccacaugccaaaagacaggauguaaccguucuggguucccaagaaggugcaaugcauucugcacucgcuggggcaacggaaguagacucaggagacgggaaucacauguuugccgggcacuuaaaauguaaaguaaggauggaaaaacuccguauuaaaggcaugucauacacgauguguucaggaaaauuuuccaucgauaaggaaauggcugaaacucaacaugggacuacaguagugaaaguaaaguacgaaggcgcaggagccccguguaagauccccauagaaauuagggauguaaacaaagaaaaaguaguuggaaggauaauaucuucgacgccauuugcagaaaacacaaauucgguaauaaauauugaauuagaacccccuuucggagauagcuauauaguaaucggaguuggagacucugcacucacccuccacugguuucggaaaggcucaucaaucggaaaaauguuugaaaguaccuauagaggggcuaagagaauggcaauccuuggcgaaacagcgugggacuuuggcaguguugguggucuuuuuacaucacuuggaaaagcgguccaucagguauuuggaagcgucuauacaacaauguuuggaggaguuucguggaugauuaggauauugauuggguuuuuaguucuauggauagggacaaacucgaggaauacgucuauggcuaugacauguauagccguaggaggaaucacucuuuuccuaggcuuuacagugcaggccgacaugggaugcgucguuaguuggaacgguaaagagcugaaaugcggaucgggaauuuuuguaguagauaauguacauacuuggacagaacaauacaaauuucaaccagaaaguccugcccgucuugccagugcgauacuaaaugcccauaaagauggagugugcggaauaagaagcacaacacgguuagagaacgucauguggaaacaaauuacaaaugaacuuaacuaugugcuaugggaagguggucaugacuugacagucguggcuggggacguuaaagggguauuaacgaaagggaaacggguucuaacaccuccuguaaacgacuugaaauacucauggaaaacauggggaaaagcuaaaaucuucacaccugaagcaagaaacucaaccuuuuuaauagacgggcccgauacuucugaauguccgaaugaacgacgagcauggaacuucuuugagguggaggacuaugguuuuggaauguucacaacgaauauauggaugaaguuccgagaggguaguucugaagugugcgaucaucgauuaaugagcgcggcuauuaaagaccagaaagcaguacacgcagauauggguuacuggaucgaaucuagcaaaaaucaaacauggcaaauagagaaggcaucccucauagaagucaagacauguuuauggccaaaaacgcauacacucuggagcaauggaguauuagaaagucaaaugcuaauuccuagaucauaugcggguccuuucagucaacauaauuacagacaaggcuaugcgacucaaacagcgggaccuuggcaccuaggcaaauuagagauugauuucggagaaugcccagguacaacuguaaaaauacaggaagacugugaucauagaggcccgaguuuaaggaccacuaccgcaagugguaaguuaguuacacaaugguguugucgauccugcacgaugccgccauuaagguuuuugggggaagaugguuguugguaugggauggaaauaagaccccugucggagaaggaagaaaauaugguaaaaucacaaguaacugcaggucagggcaccucagaaacuuuuagcauggguuuacuguguuuaacacuuuucguagaagaguguuuacgaagacgagugacccgaaaacacaugauccuaguggucguaauuacguucugcgcuauaauauuggguggccuuacauggauggauuugcuacgagcacuuauaaugcuaggagacacaaugagcggucgcauaggugggcaaauacacuuagccaucaugacgguauucaaaaugagcccgggguacguacuaggugucuucuugagaaaacuaacaagucgggaaacggcauuaaugguaauuggaauggcuaugacuacagucuucaguaucccacaugaccucauggagcuaaucgacgggauuucucuaggauuaauacuauuaaaaauuguuacgcauuucgauaauacccaaguugguacccucgcuuugucguuaacauuuauacguucgacaacuccucucgugauggcauggcggacaauaauggcuguguucuuuguaauaacauuaaucccguuauguagaacuuccugccuucaaaaacagagucacuggguagaaauuaccgcgcugauuuuaggugcacaagcacucccggucuaccuaaugacuuuaaugaagggggcauccucuagaucauggccguugaaugaaggaaucauggcaguuggauugguaucacuucuuggcuccgcauuacuaaagaaugacguuccgcuagcugggccaaugguagcugggggauuauuauuggcggcuuauguaaugagcggaucgucggcagaucuuucucucgaaaaagccgccaauguccaaugggaugaaauggcugacauaacaggaucuuccccaauuauagaaguuaaacaagaugaagaugguucauucucgauucgugacgucgaagaaacuaauaugauuacgcucuuaguaaaauuagcacuaauaacaguauccggccuuuacccucuagcuauuccaguaacuauggcauuaugguauauauggcaaguaaaaacccaacguucuggggccuugugggacgucccuagcccggcggccacccagaaagccacucuaucagagggagucuauagaaucaugcaacgagggcuguuuggcaaaacccaaguuggaguagguauacacauggaagggguguuccauaccauguggcacguuacaagagguagcguaauaugucacgaaacaggaagacuagaaccaucuugggcugauguaagaaaugauaugauaucauauggaggaggauggcguuugggugauaaaugggauaaagaggaagauguacagguucuugcuauugaacccggcaaaaauccucgccacguccagacaaaaccggguuuauucaaaacguuaacaggcgaaauaggugcuguaaccuuagacuucaaaccagguacguccgguaguccaaucauaaacaagaaaggaaaaguaauaggguuauaugggaauggaguagucacaaaauccggagauuauguaucggcaaucacacaggcugaacguaucggagagccagauuaugagauugacgaagacaucuuuaggaagaaaagacuuacuauaauggaucugcaccccggagcagguaaaacgaagaggauucuaccguccauagugagagaagcauuaaagcggagacuucgcaccuuaauacucgcuccuaccaggguggucgcggccgaaauggaagaggcuuugaggggccuaccaauacgguaucaaaccccagccguuaagucagagcauacgggacgcgaaauaguugaccuaaugugucacgccacauucacgacuagauuacuauccucgacacgcguuccaaacuacaauuuaauaguaauggaugaagcccauuuuacggacccaugcuccguggcggcucgaggauacaucagcacacgagucgagaugggagaggcagcagcaauauucaugacagcuacgccgccaggcagcauugaucccuucccgcaaucaaacucaccaaucgaagauauagagagagaaauuccugaacguaguuggaauaccggauuugauuggauaacugacuaccaagguaaaacugucugguuugugccaucaauuaaggcaggcaacgacauugcaaauugccugagaaaaucuggcaaacgaguaauacaacugaguagaaaaacuuuugauacugaauauccuaaaacaaaguugacagacugggacuuuguaguaacaaccgauauaagugaaaugggugcaaauuuuagagcugguagaguaauagauccucgacguugucuaaagcccgucauacuuacagacggaccagaaagggucauauuggcaggcccaauaccagucacuccagccucagcagcccagcgaagaggacgaauuggaagaaauccagcacaagaggacgaucaauauguauuuagcggagauccucucaaaaacgacgaagaucaugcacacuggaccgaagcgaaaauguugcucgauaacauauacacuccugaaggaauaauuccuaccuuauucggucccgaacgagagaaaacccaggcuauugacggugaauuuagauuaagaggugagcagagaaaaacuuuuguugaacuuaugcguagaggugaccuaccaguauggcucaguuauaagguggcuucugcggggaucagcuauaaagaucgagaaugguguuuuacaggagaaaggaauaaccaaauacuagaggagaauauggagguggaaauauggacuagagaaggagagaagaagaaauuaaggccuaaaugguuagaugcaagaguuuacgccgaccccauggccuugaaagauuuuaaggaauuugcgagcgguagaaaaagcacuacccuagacaucuugaccgaaauagcuacacuaccuacuuacuuaagcucgaaagccaaauuagcgcuugauaauauaguuaugcuccauacaacggagaaaggagggagagcauaccaacaugccuugaacgaauuaccggaaucacuugaaacacuaauguuaguugcacuauugggagccaugacagcagguaucuuucuauucuuuaugcaaggaaagggaauugguaaacuuucgaugggccugauugcgauagcgguugccagcggccuauuauggguugcugaaauacaaccacaguggauagcagccucaauaauacucgaauuuuucuugaugguccuauuaauaccagagccagaaaaacagcggacaccacaagauaaucaauuaauuuauguaauacuaacuaucuuaacaaucaucggucuaauugccgccaacgagauggggcuaaucgagaaaacuaaaacagauuuuggguuuuaucaagugaaaacagaaacgacuauauuagacguugaucuucgacccgcuucggccuggacuuuauaugcagucgcuacuacuauccuaacaccaauguugaggcauaccaucgaaaauaccucggcaaauuugagcuuagcugcuauagcaaaucaagcugcagucuugaugggauuagguaaaggauggcccuuacauagaauggaccuagguguaccuuuacuugcgaugggauguuacagucaaguaaacccgaccacauuaacagcaucauugguuauguuacugauucauuaugcaauuaucggcccuggucuccaggcaaaagccacgcgagaagcccaaaagcggacugcugcaggaauaaugaaaaauccuaccguggauggcauuacuguaauugauuuagaaccaauaucauaugauccaaaauuugaaaaacaacuuggacaaguaauguuauuaguacuaugcguagggcaauuauuacugaugagaacaacaugggcucuuugugaaguucuaacucuagcaaccgguccuauaaugacguugugggaaggaaauccugggcgauucuggaacacaacuauagcaguaagcacugcaaauaucuuuagagggucauacuuagcuggcgcagguuuggcauuuagcuugaucaaaaaugcccagacacccagacgagguacuggcacaacgggcgaaacucucggagagaaauggaaacgacaauuaaacucccuugacaggaaagaguucgaagaauacaaacguaguggaauacuagaggucgaccgaacagaagcuaagucugcacugcgugauggcuccaagauaaaacaugcuguuagccgaggaagcagcaaaauuagauggaucguagaaagaggaaugauaaaacccaaaggcaagguaguugaucuagguugugggaggggcggguggucauacuauauggcaacuuugaaaaauguuacggagguaaaagguuauacgaaaggagguccuggacaugaggaaccuauaccuauggccacauauggauggaaccuaguaaaguugcacaguggaguagauguauuuuauaaaccaacugagcaaguagacacuuuauugugugacauaggggaaaguaguuccaauccuacaauagaagagggucgaaccuuaagaauacugaaaauggucgaacccugguuaucuuccaagccagaguucuguauaaagguacuaaacccauacaugccuaccguaauagaggaacuagaaaaacuucaacgaaggcauggaggcucauuaguaagauguccucuuucaagaaauucaacgcaugaaauguacugggugucuggagcuucuggcaacauugucucgagugucaacacuauaucuaagaugcuucuaaacagauuuacaacacgacauaggaagccaacuuaugaaaaggaugucgauuuaggcgcaggaacuaggucuguaucaaccgaaacagaaaaacccgacaugacuauaauagggaggagguuacaacgcuuacaggaggaacacaaagaaacguggcacuacgaccaggagaaucccuauagaacaugggcguaccacggaaguuaugaagccccuaguaccgguucggcuucaucuauggucaacgguguaguaaaauugcuaacaaaaccaugggaugucaucccaaugguaacgcaauuggcaaugacagauacaacccccuucggccaacaaagagucuuuaaagaaaaaguagacacucggacaccacaaccaaaauuaggaacacguaugaucaugacaacgacggcgaauuggcuuugggcacugcuaggcaagaagaaaagucccagauuguguacgagagaagaauuuauaucaaaagugaggagcaacgcugcaauuggggcaguuuuucaggaagaacaaggguggacgagcgcgagugaagcgguaaaugacagccgcuuuugggagcuaguggacaaagagcgagcauuacaccaagaaggcaaaugcgaaaguugcguuuacaauaugauggguaagagggaaaagaaauuaggagaguucggacgcgccaaaggcucgagagcaaucugguacaugugguuaggcgcuagguuucuagaauuugaagcauugggcuuucuaaaugaagaucauugguucagccgggaaaacucauggucaggaguagagggcgagggacugcauagauugggguacaucuuagaagauauagacaagaaggacggcgauuuaauauacgcugacgauacagcaggaugggauacaagaauaacugaagaugaccuauuaaaugaagaacugauuacagaacaaauggcuccacaucauaaaacguuagcaaaagcaauuuucaaacuuacuuaucaaaacaaggucguaaaggugcuacggccgacccccaagggggccguuauggacauuauaaguagaaaggaccaaagagggucuggacaaguugguacuuauggccucaauaccuucacgaauauggaaguacaguugauccgacaaauggaagccgaaggaguaauaacacaagaugauaugcaaaauccgaaaggccugaaagagagaguagaaaagugguuaaaagaauguggaguugauaggcuaaaaaggauggcaauuagcggagaugacugcguuguaaaaccacuagaugaacgauuuucuacaucguuacucuuucuaaaugacauggguaaagugagaaaggacguuccgcagugggagcccucuaaagguuggaagaauuggcaagaggucccuuuuuguucgcaccauuuccauaaaauauuuaugaaagauggcaggaguuugguggugccuugcagaaaucaagacgaacuaaucggucgagcuagaauaagucaaggagccggguggucacucagagaaacugcauguuuagguaaagcguaugcacaaauguggagccucauguauuuucaucgcagggaucugaggcuggccucuauggccaucugcucagcaguccccacagaaugguuucccacgagucgaacgaccuggucaauacaugcucagcaucaguggaugacuaccgaagacauguuaaaaguauggaaccgaguauggauagaagauaaucccaauaugacggauaagacuccggugcacucuugggaggacauuccauacuuaggcaagcgcgaagacuuauggugugggucgcuaauaggccugucuucucgggccacaugggccaaaaauauacacacagcuauuacacaggugagaaacuugauugguaaggaagaguacguagacuauaugccaguuaugaaacgauauucagccccuagugaaagugagggcguacuuuaa

SEQ ID NO: 23668 - RNA, 9867 nt, Artificial Sequence
  derived and/or modified CDS sequence (opt6) from DENV-4__JQ915082__SS-prME
ucuacuaugaccuuacuuugccuuauuccuacuguuauggcguuccaucuaaguacaagggauggugagccauuaaugauaguagcgaaacacgaacgagggaggccacuauuguuuaaaacaacagaagggauuaacaaauguacauuaauagcuauggauuugggagaaaugugcgaggauacuguuacauauaaaugcccauuacucguuaauacggaaccggaggauauugauuguugguguaaucuaacaucuacauggguaauguaugguacaugcacgcagucaggagaaagaaggagagaaaaacgcucaguagcccuaacaccccauaguggaaugggauuagaaacuagggcugaaacuuggaugagcucagagggugcauggaaacaugcccagagagucgaauccuggauauuacgaaacccugguuucgcauuacuggcaggguucauggcguauaugauagggcaaacgggaauacagagaauaguauucuuuguuuugaugauguugguggcacccucauaugggaugcgauguguuggugugggaaauagggauuuugucgaaggaguaaguggaggagcgugggucgacuuaguucuagagcacggaggauguguuacuacaauggcacaaggaaaaccuacacuugauuucgaacuuacgaaaacuacggcaaaagaggucgcccuucuaagaacauauuguauugaagcaucaauauccaauauuaccacagcuaccagauguccaacccagggggaaccauacuuaaaagaagaacaagaccaacaauacauuuguaggcgugauguaguagaucgaggaugggguaauggauguggacuauucggaaaaggugggguaguaaccugugcuaaauuucuaugcagcgggaaaauuacugggaaccuuguacaaauugagaacuuagaauauaccguugucguaacuguccauaauggagacacacaugcuguuggaaaugauaccagcaaucauggagucacagcaaccauaaccccgcgcucaccgagugucgaagugaaauuaccugauuauggagaauugacguuagacugugaacccagaucuggaauagacuuuaacgagaugauuuuaaugaaaaugaaaaagaaaacauggcucguucauaaacagugguucuuagauuuaccacuacccuggaccgcgggugcagacacuucagagguucacuggaacuacaaagaaagaaugguuacauuuaaagucccccacgcaaaaagacaggacguaaccguucuagguagccaggaaggggcuaugcacuccgcacuagcaggggcuacugaaguugacucaggugacggaaaucauauguuugcaggccaucuaaaauguaaaguuagaauggagaaacuuagaauuaaaggaaugaguuauacaaugugcagugguaaauuuucaauagacaaagaaauggcggaaacccaacaugguacuaccguaguuaaaguuaaguacgaaggugccggagcaccauguaaaaucccgauagagauuagagacgugaauaaggaaaaaguuguaggaagaauuauaucaagcacuccguucgcagaaaauaccaacagcguuauaaauaucgaacuugaaccaccauucggagauucuuauauugugauaggugucggagacucugcucuuacacuacacugguuccgcaaaggaagcaguaucgguaaaauguuugaaaguacauaccggggagcuaaaagaauggccauacuaggggagacagcuugggacuuugguucaguaggagggcuguucacuucccuuggaaaggccgugcaucaaguuuuuggaagcguguauacgacaauguuuggcggaguuucguggaugauccguauauugauaggcuuccuuguucuuuggauagguacaaauucacguaauacaaguauggcaaugacuuguauagcuguugguggaauaacuuuguuuuuaggauucacaguacaagcggacaugggauguguagugaguuggaacgguaaagaauugaagugugggagcggaaucuuugucguugauaauguucauacauggaccgaacaauacaaauuccaaccagagagcccagcaagguuagcuucugcuauccugaaugcacacaaagacgggguguguggcauacgaucaacaacacgauuggaaaaugugauguggaagcagauaacaaacgaguuaaauuacguuuuaugggaaggaggucacgauuuaacaguaguagcaggagacguuaaggguguuuugacgaaagguaaacgugcacuaacuccaccggucaaugauuuaaaguauaguuggaaaacgugggggaaagcaaagauauuuacaccugaagcaaggaacucaacauucuugauagaugggccugauacaucagaaugcccuaaugaacggcgugcuuggaauuucuuugagguggaggauuacggguucgggauguucacuacaaauaucuggaugaaauucagagaaggcucaucugaagucugcgaucacagguuaaugagugccgcaauaaaagaccaaaaagcggugcaugcagacaugggcuacuggauagagucuagcaaaaaccaaacauggcaaauugaaaaagcaucccuaauugagguaaaaacauguuuauggccuaagacccauacucuauggucaaauggugucuuggaaucgcaaauguugaucccucgcagcuacgcagggccauucucccaacacaacuauagacaaggauaugcgacccagacugcugguccuuggcacuuaggcaaacuggaaauugacuuuggagaaugcccaggcacgacagucaaaauucaggaagacugugaccauagagguccuagucuaagaacaacaaccgcaagcggaaaauuagugacucaauggugcugucgcucauguacuaugccaccauuacgauuucuuggcgaggaugggugcugguaugguauggaaauuagaccucuaucggaaaaagaggaaaauaugguaaaaagucaaguaaccgccggucaaggcacauccgagacuuucaguauggggcuauuaugcuuaacacuuuuuguugaagaaugccuucgccguagaguaacacggaaacacaugauauuaguuguuguuauuacauucugcgccaucaucuugggaggauuaacuuggauggauuugcugagggcauuaauaauguuaggagauacgaugucuggaaggauaggaggccaaauacaccuagcuauuaugacaguuuucaaaaugagcccuggauauguacuuggagucuuuuuaagaaaauuaacaaguagagagacugcgcugaugguaauagggauggcaaugacgacuguguuuucaaucccgcaugaucuuauggaacucauugacggaaucuccuuaggcuuaauauuacuaaaaaucgucacacacuucgauaauacgcaaguuggcacauuagcccuuucucuaacauuuaucagaaguacaacuccuuuaguaauggcguggcguaccauuauggcgguauucuuuguuaucacacuaauuccgcuaugcagaacuucuugccugcaaaaacaaagucacugggucgagauaacagcacugauucugggcgcacaagcgcucccgguguaccuaaugacuuugaugaaaggcgcuagucgcagauccuggccauuaaaugaagguauaauggcggugggguuaguuagcuuauuaggcucagcauuacucaaaaaugacguaccauuagccgggccgaugguggccggaggacuacuguuggcugccuauguaaugucaggaaguagcgcugauuuaucauuggagaaggcggcuaauguacagugggaugaaauggcagacauuacugggaguucuccuauuauugagguuaaacaagaugaggaugguucuuuuagcauaagagauguagaggaaacaaauaugaucacucuguuaguaaaacuagcacuaauaacuguaucuggucuauauccuuuggccauaccugucacuauggcacuaugguacauuuggcaaguaaaaacacaacgcucuggagcccuuugggacguaccaaguccugcugcaacacaaaaagcaacucuuagcgaaggcguguauagaauuaugcaaagagggcuauuugguaaaacacaaguaggaguaggcauucacauggaaggcgucuuccauacaauguggcauguaacaagaggaaguguuauaugccacgaaacgggacgacuugagccaucuugggccgacgugaggaacgauaugauaucuuacggaggcgguuggaggcuuggagacaaaugggacaaagaggaagaugugcaaguacuggccauagaaccuggcaaaaauccgagacauguucaaacgaaacccggccuauucaaaacccuaaccggcgaaauaggcgccgugacguuagauuucaaaccuggaacaucugguucacccauaauaaauaagaaagguaagguuauaggccucuaugguaacgggguaguaaccaaaagcggggacuaugucucugcgauuacacaggcggagaggauuggagaaccagauuacgaggucgaugaagacauuuuucgcaagaagagacuaacaaucauggaucuucaccccggagcggggaagacuaaaagaauccuaccaucaauaguaagagaggcuuuaaagcgaagguuaagaacacuaauucuugcaccgacccgagugguugcggcagaaauggaagaggcucuccgcggccucccuauccgauaccaaacgccugcuguuaaaucagaacacacaggcagagaaauaguagaccuaaugugucacgcuacauucaccaccagauuauuaucaagcacaagggucccuaacuauaauuuaauagucauggaugaagcgcauuucacggacccuuguucuguugcugcaaggggcuauauuagcaccagggucgaaaugggggaagcugcagcuauauuuaugaccgcaacaccgcccgguucuauugauccauucccccaaucuaacucaccaauugaagauaucgagcgcgaaaucccggaacgaucauggaauacaggcuucgauuggauuacagauuaucaggguaaaacugugugguuuguaccuucaaucaaggcuggcaacgauauagcaaauugccuaaggaaaaguggaaaaaggguuauacaauuaucgcguaaaacauuugauacugaguauccaaaaacuaaauugaccgauugggacuucgucguaacaacugacauaucagaaaugggagccaacuuccgagcaggaagagugauugacccucguagaugcuuaaaaccaguuaucuuaacagauggaccugaaagagugauucuugcaggaccaaucccggucacucccgcuuccgcagcacagcgccgaggaaggauaggucgaaacccagcucaagaggaugaccaauauguauuuaguggggacccguugaaaaaugacgaagaucaugcucacuggacggaagcaaaaaugcuacuugacaauaucuacacuccugagggaauaauaccaacgcuuuuuggaccagagagggagaaaacgcaggccauagauggcgaguuccguuuaagaggugaacaaagaaaaacauuuguagaacuaaugcgacguggggaucuaccagugugguugucauauaagguugcaucagccgguauuagcuacaaagacagagagugguguuucacaggagagaggaauaaccagauacuggaagaaaacauggaaguugaaauauggacgagagaaggcgagaaaaagaaauuaaggccuaaauggcuggaugcaagaguauacgcagacccaauggcguuaaaggauuucaaagaauuugcgucaggccgaaagagcacuacacuggauauacucacugaaauugcgacacuucccacuuaccucucaucaaaagcaaaauuggcauuagacaauauaguaaugcugcauacaacagaaaaaggugguagggccuaucagcaugcguuaaacgaguuacccgagucgcuggaaacuuuaaugcuaguugcucuguuaggagcgaugacagcagggauuuuccuauucuuuaugcagggaaaaggcauuggcaaacuaagcaugggucuuauugcuauugccguagcaaguggguuacucuggguagcagaaauccaaccgcaauggauugcugcuaguauuauuuuggaguucuuucuaauggugcuuuugauuccagaaccugaaaaacaaaggacuccacaagauaaucaacuaauuuacguaauucuuaccauacucacaauaaucgggcugauugcugcaaacgaaaugggguugauagagaaaacuaaaaccgauuucggauucuaucagguaaaaacagaaacgacaauucuagauguggaucuacgucccgcaucagcguggacauuguaugccguagccaccacaauauuaacaccgaugcuccgccacacaauugaaaacaugucugcuaauuuaucucuagcagcaauugcaaaccaggcggcuguuuuaauggguuuggggaaagguuggccauuacauaggauggaccuugguguaccccuacuugcgauggguugcuacagucaaguuaaccccacgaccuuaacagcgucauuagucaugcuacugauccauuaugcuaucaucggaccaggucuacaggcaaaagcaacacgagaagcgcaaaagcgaacugcugcugguauuaugaaaaauccuacaguugacgggauaacagugaucgauuuggaaccaaucucguaugacccuaaauuugaaaaacaacuaggucagguaaugcuauuaguccucuguguugggcaauuacuacugaugcgcacaacaugggcacugugugaaguucuaacacuugcuacaggaccaauuauaacauuaugggaaggaaacccaggaagauuuuggaauacaaccauagcuguaucaacugcaaauaucuucagaggcagcuaucuugccggugcuggccucgcguuuucauuaaucaaaaacgcccagacuccucggagaggaacagguacuacaggcgaaacucuuggagaaaaauggaagaggcaacugaacagucuagaccguaaagaauuugaggaauauaaaagaaguggaauccuagaaguagaucggaccgaagccaaaucggcacuucgugaugguucgaaaaucaaacaugcuguaucccggggauccuccaaaauacgauggaucguggaaagaggaaugauaaaaccuaagggaaaaguagucgaccugggauguggaagaggagguuggucauacuauauggcaacauugaaaaacguaacugaaguuaaaggauacacaaaaggaggaccagggcaugaggagccuauaccaauggcuacauauggauggaaccuaguuaaauuacacagcggugucgacguauuuuauaagccuaccgagcaaguagacacuuuauuaugugacauuggugaaagcuccuccaauccuacgauugaggaggguagaacauugagaauacuaaaaaugguugagccauggcuuagcuccaaaccagaguuuuguauuaagguacuaaacccauauaugccuacaguuauagaagaacuugaaaaacuccaaagacgacauggagguucccugguccgcugcccauugagccgaaauucuacccacgaaauguacuggguaucuggagcaagcgguaacauagucaguaguguuaauacuauuuccaagaugcuauugaaccgauucacaacacgacauaggaaacccacguaugagaaggauguagacuugggugcagggacccgaucuguaucaacagaaacagagaaaccagauaugacaauuauugggaggcgauugcaacgccuacaagaagaacacaaagaaacuuggcauuaugaccaagaaaacccguauagaacaugggcguaccacggaucguacgaggcuccaucaacggguagugcaaguucuaugguaaacggaguaguaaaauuacuuacuaaaccgugggacgucaucccaaugguaacacagcucgcuaugacugauacuacaccauucggacaacagagaguuuucaaagaaaaaguugauacgcgaacuccgcaaccgaaauugggaacuaggaugauaaugacaacuacggcuaauugguuaugggcguuacucggcaagaagaaaagcccuaggcuaugcacacgugaagaguucauuucuaaaguaagaagcaacgcagcuauaggugcgguguuucaggaagaacaaggauggacaagugcgagcgaagcaguaaaugacagucgauuuugggaauugguagacaaggaacgcgcgcuacaccaagaagggaaaugugaaucauguguuuauaacaugaugggcaaacgagagaagaaacuaggagaauuuggcagagcuaaaggaucgcgcgcgauaugguacaugugguuaggcgcccgguuccucgaauuugaggcuuugggauuuuuaaacgaagaucauugguuuuccagagaaaacagcuggucaggaguggaaggugaagguuuacauagacuagguuauauauuagaggauauugauaagaaagauggagaccuuauuuaugcagacgauaccgcaggcugggacacacgaauaacggaagaugaucuguugaacgaggaacucauaacagaacaaauggcgccccaucauaaaacucuagcuaaggccauauuuaaacuaacuuaucaaaauaaaguaguaaaaguacugaggcccaccccaaagggagcuguaauggacauaauuucccgaaaagaucaaaggggcucaggacaaguagguacguacggauugaacacauuuacuaauauggaaguacaguuaauucggcaaauggaagccgagggaguaauuacacaggacgacaugcaaaauccaaaaggguuaaaagaacguguagagaagugguuaaaggaaugugggguagaucgguuaaaacguauggcaauaagcggugaugacugugugguaaaaccucucgaugaaagauuuuccaccucccuacuauuuuuaaacgauaugggaaaaguaagaaaggacguaccacaaugggacccaucgaaaggauggaagaauuggcaggaagugccuuucuguucccaucauuuucauaaaaucuucaugaaggacggccgaucuuuaguugugccuugccguaaucaagaugaauugaucggucgcgccaggauaucucaaggagcuggguggucccuacgugaaacggcgugccuaggcaaagccuaugcucaaauguggagucuaauguauuuucaucgcagagaucuacgauuagcuucaauggcuauaugcucagcgguuccaacggaaugguucccgacaucccgaacaaccuggucuauccaugcacaacaccaauggaugacaacagaggacaugcuuaaagucuggaacagaguauggauagaagacaauccaaauaugacagauaagacacccguccauucaugggaagacauaccauacuuggguaaacgcgaagaucuaugguguggcagcuuaauuggucucucaucgagggcuaccugggcgaaaaacauacacacggccauaacucaaguacggaaccucaucggaaaagaagaguacguugauuauaugcccguaaugaaacgcuacucugcuccaagugaaucagaaggaguucuuuga

SEQ ID NO: 23669 - RNA, 9867 nt, Artificial Sequence
  derived and/or modified CDS sequence (opt6) from DENV-4__JQ915081__SS-prME
uccacgaugacauuacuauguuugauaccuacagugauggcauuucaucugaguacacgcgacggcgaaccauuaaugauuguggcaaaacaugaaagaggacgaccuuugcuauuuaaaacgacugaggguauaaauaaaugcacuuuaauagcgauggauuuaggcgaaaugugcgaagauaccgucaccuauaaauguccucuauuagucaauacggagcccgaagauauugacugcugguguaacuuaaccaguacaugggucauguauggaacauguacucaaaguggggaacgcagaagggagaaaagaaguguugcacuaacuccacacucagguauggggcuagaaaccagggcagaaacuuggaugucuagcgagggggcauggaaacaugcacagcgagucgaaucguggauauuaaggaaucccgguuuugcuuuacuggcugguuuuauggcauacaugauaggucaaacggggauacaaagaauuguguucuucgugcuaaugauguuagucgccccauccuaugguaugcguugugucggaguugggaauagagacuucguggaaggggugucgggaggagcuugggucgauuuggugcucgaacacggugggugcguuacuacgauggcacagggaaaaccaacauuagauuuugaacucacaaaaaccacagcaaaagaaguugcuuugcugcgcacguauuguaucgaggcaucaaucucgaacauuacaacagcaacaagauguccuacacaaggagaaccauauuugaaagaagaacaagaccagcaauacaucugccgaagggaugucgucgaccgaggauggggaaacggcugcggucuauucggcaaaggaggaguaguaacaugugcuaaauucuugugcagcggaaaaaucaccggcaaccuaguacaaauagaaaauuuagaauacacaguaguaguaacaguucauaauggagauacucacgcgguaggaaaugacaccaguaaccauggaguaaccgcgacuauuacacccagaucgccaucaguugaaguaaaauugccagacuacggugaacuaacacuugauugcgagccaagaagugguauagacuucaaugaaaugauacuaaugaaaaugaagaagaaaacuuggcuaguacacaaacaaugguuccuagaucuaccauugcccuggacggccggugcugacacaucagaaguccauuggaauuauaaagaaagaaugguuacguucaaagucccgcaugcaaaacgacaggacguuaccguccuaggaucucaagaaggugcaaugcauagugcacuagcuggagcuacagagguagacucaggcgaugguaaccauauguuugcuggacaucuaaaaugcaaaguccggauggagaaacugagaauaaaaggaaugaguuauacaauguguaguggcaaauucucuauugacaaagaaauggcagaaacacagcauggaacaaccguaguaaaaguuaaauaugagggagcaggggcgccuuguaaaauaccuaucgaaauacgcgacguuaauaaagaaaaaguggugggaagaauuaucucuucuaccccauuugcugaaaauaccaacagugugaucaauauagaauuagaaccaccuuuuggagauuccuacauuguaauagguguaggcgacagcgcucuaaccuuacauugguuuagaaaagguagcucuauagggaaaauguuugagucgaccuacaggggagcuaaacgaauggcuauacuuggcgaaacagcaugggauuucgggucuguaggggguuuauuuaccucacuaggcaaagcaguacaccaaguuuuuggaucuguuuauaccacaauguucggcgguguaucauggaugauucgaauuuugauuggauuucuaguauuauggauaggaacaaacucuagaaauacgucaauggcuaugacauguauagcggucggagggauaacucucuuccuaggauucaccguucaagccgacaugggauguguaguuucauggaaugguaaagaauugaaaugcggcaguggaauauucgugguugauaacguucauaccuggacagaacaauauaaauuccagccggaaagcccugcucgacuagcgagugccauauuaaaugcucacaaagauggcguuugcgguauaagauccacaacuagacuagaaaauguaauguggaaacaaauaacuaaugaauugaauuauguccuaugggaaggaggccaugaucuaacaguaguagcaggcgauguaaaaggaguauugacaaaagguaaaagagcacuuacgccgccuguaaaugaucugaaauacucuuggaaaaccuggggcaaagcaaagauauuuacuccagaggcgagaaauuccacuuuucuuauugauggaccugauacuagcgaaugccccaaugaacggagggcuuggaacuucuuugaggucgaagauuauggcuuugguauguuuaccaccaacauuuggaugaaguuccgagaaggaagcagugaaguaugugaccauaggcucaugagugccgccauuaaagaucaaaaagcuguacacgcagauauggguuacuggauagaaucgucgaaaaaucagacauggcaaauugagaaggcaucacugauagagguaaaaacauguuuauggccaaaaacacauacacuaugguccaauggaguuuuagaaucacaaaugcuuaucccgagaucuuacgcagggccauuuucucagcauaacuaccgacaaggguaugcuacucaaaccgcugguccuuggcaccuagggaaacucgagauagacuuuggugaaugcccgggaacaacaguaaaaauucaggaagauugugaccauagagggccuucacuuaggacaacaacagcgagcggaaaauuagugacucaaugguguugcaggucauguacaaugcccccauuacgauuuuugggagaggauggcugcugguacgguauggaaauucggccacuaucagaaaaagaggaaaauaugguuaaaucacaagucacugccggucaaggaacaagcgaaaccuucagcaugggccuuuuaugccucacuuuauuuguagaagaaugccuacguagaagagucacuagaaagcauaugauauuaguggugguaauuacuuucugugcaauuauacucggagggcuaacuuggauggacuuguugcgugcgcuaauaaugcuuggagauacuaugagcggacguauugguggucaaauucaucuggcuauuaugacuguauucaaaaugagucccgguuauguuuugggaguuuuccuuagaaaguuaacuucaagagaaaccgcguuaaugguuauuggaauggcaaugacuacuguuuucucuauuccucaugaccuaauggaacugauagacgguauaucauuaggucugauauuauuaaaaauaguaacacauuucgacaauacgcaaguuggcacacuagcccugaguuugacauuuauacguuccaccacuccucugguaauggccuggagaaccauuauggcaguguucuuuguaauaacccuaauaccucucugccguaccucaugucuucaaaagcagagucacuggguagagauaacagccuugauauuaggggcccaggcccuccccgucuacuugaugacacuuaugaaaggugccucgcgacguucuuggcccuuaaaugaagggauuauggccguagguuuaguguccuuacuagguagugcucuacucaaaaaugacguuccguuggcagggccgaugguagccgguggguuauuauuggcagccuaugugaugucuggaaguucagccgaccugagccuagagaaggcugcuaauguacaaugggacgaaauggcugacauuacuggcaguucaccuauaauugaaguaaaacaggaugaggaugggaguuucaguauuagagaugucgaggaaacaaauaugauaacgcuucuuguuaaacuugcccucauuacuguaaguggauuauaucccuuagcgauacccgucacgauggccuuaugguacaucuggcaaguaaagacacagaggagcggcgcuuuaugggacgucccuucucccgccgcaacacaaaaggcgaccuuaagcgaaggaguauaccggauaaugcaacgaggacuauuuggaaaaacacaaguugggguaggaauacauauggaagguguuuuccauaccauguggcaugugacgagaggaucaguaauuugucaugaaaccggcagauuagaaccaucaugggcugauguuagaaaugacaugaucagcuauggggguggauggaggcuuggggauaaaugggauaaagaagaggauguucagguucuugcaauagaaccagggaaaaauccaagacauguucaaacaaaaccaggacuauucaagacacucacaggagaaauuggugcuguuaccuuagacuucaaaccgggcacaucugguuccccaauuauuaauaagaaaggaaaaguuauaggauuauauggaaaugguguuguaaccaaaucaggagauuauguguccgcuaucacucaggcagaaagaauaggagagccagacuaugaaguagaugaagacaucuuuaggaagaaacgucucacaauaauggaucuccauccaggcgcaggcaagacaaagaggauauugccaaguauagugagagaagcgcuaaagcgaaggcuuaggacacuuauauuagcaccuacucgagucgucgcugcugaaauggaagaagcacuucgagguuuaccuauaagauaccagacuccagcuguuaaaagcgaacauaccgguagggagauuguagaucugaugugccaugcaaccuucaccacacgacuauuaagcucaacacgagugccgaauuauaaucuaaucguaauggaugaggcacacuuuacugauccguguucuguggcugcccggggguacaucagcaccagaguagaaaugggagaggcagcagcaauuuuuaugacugccacaccaccaggcagcauagacccauucccacagucaaauucgccgauugaggauauugagagagagaucccagagagaaguuggaauacuggauuugauuggauuacggauuaccaagguaaaacaguuugguucguucccuccauuaaagccggaaacgauaucgcuaacugucugagaaaaucagggaaacgagucauacaacugucgcggaaaacuuucgauacagaauauccaaaaacaaaauuaacggacugggauuucguaguuacaacugacauaagugaaaugggcgcuaauuuucgagcuggaagaguaauagauccaagacgcugucuuaaaccugugauuuuaacugauggaccugaacgagucauuuuagcagguccaaucccggucacuccggcuuccgcagcccaaagacgaggcagaaucgguagaaaccccgcacaagaggaugaucaauacguuuucucaggugacccacuuaaaaaugaugaagaccaugcgcauuggacagaagcgaagauguuacuggauaauauuuacacaccggagggaauuauaccaacucuguuuggccccgaacgagaaaagacgcaggcgauagauggggaauuucgccuacguggagaacaacguaagacauucguagaacucaugcgacguggagauuuaccuguuuggcuuuccuacaaaguagccuccgcagguauaaguuauaaagauagagaauggugcuuuacaggagaacggaacaaucaaauauuagaagaaaauauggaaguggaaauauggacaagagaaggagagaagaagaaauuacgaccgaaaugguuagaugcuagaguguacgcggaccccauggcucuaaaagauuucaaagaauuugcuuccgggagaaaaaguacaacauuagauauuuuaacugaaauagcaacacuuccuaccuaucuuuccucaaaagccaagcuagcauuagacaauauagucaugcuucauacaacggaaaaaggaggacgggcauaucagcaugcauuaaacgaacuuccagagagccucgagacguugauguugguagcacuauugggugcaaugacagcaggaauauuuuuauucuuuaugcaaggaaaggguauugguaaguuaucuaugggauuaauagcgauugcuguggcaagugggcuauuguggguugccgagauccaaccccaauggauugcugcuagcauuauacuugaauuuuuccuaaugguacuacuuauaccagaaccugagaaacaaagaacaccacaagauaaccaacuaauauaugugauucuaacgauucuuacaauaauaggauuaauagccgcaaacgaaaugggucucauugagaaaacgaaaacagauuucggauucuaucaagugaaaacagaaacaacgauauuagauguagaccucagaccugcuucagcauggaccuuauaugcuguugccacaacuauacuaacuccaaugcuuagacauacuauagaaaauaugucagcgaaccuaucacuagcagcuauagccaaucaggcugccgucuuaaugggauuggggaaaggauggccccuccauagaauggaccuugguguaccacuucuagcaaugggguguuauagccagguuaaucccacuaccuuaaccgccucauugguaaugcuacuuauucauuaugcaauaauaggcccgggauugcaggcaaaagccacccgggaagcacagaaaagaaccgcggcaggaaucaugaaaaauccaacuguggauggaaucacaguuaucgaccuugagccuauuaguuaugaucccaaauuugaaaaacaguugggucaaguaauguuauuaguauuauguguaggacaauugcuguuaaugaggacaacaugggcuuugugugagguauugacuuuagcaacuggaccaauaauaacucucugggaagguaauccgggaagauucuggaacacgacaaucgcuguuucgacggccaacaucuuccggggaucauaccuagccggugcaggccuugcuuuuucuuuaauuaagaacgcccaaacgccuaggaggggaacuggaacaacgggugaaacgcuaggggaaaaauggaagagacagcuaaacagccuagauagaaaggaguucgaagaauacaaaagaucggguauacuggaaguugaccgaacagaagcgaaaagugcccuaagggauggaucaaaaauuaaacacgcugugucccgagguuccagcaaaauaagauggauuguggaaaggggaaugauuaagcccaaaggaaaagucguagaucuggguugcgggcgggguggcuggagcuauuauauggcgacuuuaaagaacguuaccgagguaaaagguuacacaaaaggcgggcccggccacgaagaaccaauaccgauggcuaccuauggcuggaauuugguuaaacuacacucuggaguagaugucuuuuauaaaccaacugagcaaguggauacauuacuuugcgauauuggagaaucgucuagcaauccaacaauugaagaagguagaacucucaggauauugaaaaugguagaaccauggcuaucuuccaaaccugaauuuuguaucaaaguacuaaaccccuauaugccuacugucauugaggaacuugaaaagcuacaacgucgacauggaggaucauuaguaagguguccacuaucaagaaacucgacucacgaaauguauugggucucgggagcaucagguaacauuguaucaucuguaaacaccauaaguaaaaugcuucuaaaucguuucacuacgcgacacagaaaaccaaccuacgagaaggacguugacuuaggagcugggacccgaaguguuucgauagagacagaaaaaccggacaugacaauaaucggcagacggcuacaacgauuacaggaagaacacaaggaaacauggcacuaugaucaagaaaauccauacagaacgugggccuaccacgggagcuacgaagccccuucuacuggcagugcuucaucuaugguaaauggggucguaaaauuguugacaaaaccuugggaugucaucccgaugguaacacaauuagcuaugacggauaccaccccauuuggacaacaacggguauuuaaggagaaaguagauacaagaaccccacaacccaaauuggguacgaggaugauuaugacaacuacggcaaacuggcucugggcgcuucuugguaagaagaaaucuccacgccugugcacaagagaagaauuuauaucaaaagucagaaguaaugcugcaauaggagcuguauuccaggaagaacaagguuggacgagcgcgucagaggcaguaaaugauucaagguuuugggagcuagucgauaaggaacgagcucugcaucaagagggaaaaugcgaaucguguguguacaacaugaugggcaaaagagagaagaaauuaggcgaguuugguagagcuaaaggaagucgggcaauaugguauaugugguuaggagcaagguucuuagaauuugaagcauuagguuuucugaaugaggaucauugguucuccagagaaaauucuuggucagguguggaaggggaagggcuacacaggcuuggauauauauuagaagacauagacaaaaaggauggggaucuaauauaugcugaugacacagcggggugggauacaaggauaacggaagaugaucuuuugaacgaagaacuuauaacugagcagauggccccacaucauaaaacacucgcaaaggcuauuuucaaacucacguaucaaaauaaaguugugaaaguauugaggcccacaccaaagggagcaguaauggauauaauaucuaggaaggaucaacgggguucuggccaagucggaacauauggcuugaacacuuucacgaauauggaaguacaacucauaagacaaauggaagcggaagguguaauaacccaggaugauaugcaaaauccuaaaggccuuaaagaacggguagagaaaugguuaaaagagugugggguugauagacugaaacgaauggcaaucagcggagaugauugcguagucaaaccauuagacgaacgauucucaacuucacuucuauucuuaaacgacaugggaaaggugagaaaagaugugccccaaugggacccauccaaggguuggaagaacuggcaagaagugccauucugcucacaccauuuccauaagauuuucaugaaggacggacguaguuuaguaguacccugcagaaaucaagaugagcucauaggucgagcacguauuucucagggugcugguuggucauuacgagaaacagcuugucuagguaaggcuuacgcacaaauguggucacuaauguauuuccacagaagagaccuaagauuggcuucgauggccauauguucagcaguuccaacagaaugguuuccgaccagcaggacaaccuggaguauacaugcacaacaucaauggaugacaacugaagauaugcucaagguauggaacagagucuggauagaagauaacccaaacaugacggacaaaacaccuguacacucaugggaagauauaccauacuuagguaagagagaagacuuauggugcggcucguuaauagggcucaguagccgugcuacgugggcgaaaaauauccauacggcaauuacccaaguuagaaaccuuauaggcaaagaagaguauguagacuauaugccgguaaugaagagauacucagcuccaagugaaagugagggaguacuauaa

SEQ ID NO: 23670 - RNA, 9867 nt, Artificial Sequence
  derived and/or modified CDS sequence (opt6) from DENV-4__JQ915084__SS-prME
uccacgaugacuuuacuaugucuaauaccgacaguaauggcuuuucacuugagcaccagagauggagaaccuuuaaugauuguugcuaaacaugaacggggacguccacuucucuuuaaaacaacggaagggauuaauaaauguacacuaauugcuauggauuuaggugaaaugugugaagacacuguaacauacaaaugcccucuacugguaaauacugaaccagaagacauugauuguuggugcaauuugacaagcacaugggugauguauggaacuuguacacaaucuggugaaagaaggcgagaaaaacgcucuguugcgcuaacuccacauagugguaugggacucgaaacaagagcugaaacuuggaugucaucggaaggggcuuggaaacaugcgcaaagaguagaaagcuggauucugcgaaauccagguuuugcuuuauuagcugguuuuauggcauacaugauuggucaaaccgggauccaacgaauugucuucuucguuuuaaugaugcuuguagcgcccucauacggaaugagauguguaggcgugggaaaccgagauuuugucgaagggguaaguggaggcgcaugggucgaucuaguauuagaacacggcggaugugugaccacaauggcacagggaaaacccacacuugacuucgaauuaacgaaaacuaccgccaaagaaguugcacuccugcguaccuauuguauugaagccuccauuucuaacaucacaacugcgacgagguguccaacucagggagaaccauaucuaaaagaagaacaggaucagcaauacauuugccgaagagauguaguagauaggggauggggcaaugguuguggcuuguuugguaaagggggagucguaacaugugcaaaauuuuuauguucgggaaaaauuacugguaaccugguucaaauagaaaauuuggaauacacggucgucguaacaguacacaauggagauacucacgcaguaggaaaugauaccagcaaucacgguguaacagccacgauuacaccacgcaguccaucuguagaggugaaauuaccagauuauggagagcuaacucucgauugcgaaccgagaucuggaauagacuucaacgaaaugauacuaaugaaaaugaagaagaaaaccuggcuugugcacaaacaaugguuccuagacuuaccacuaccauggacggcuggggcagauacaucugaaguacauuggaacuauaaagaaagaaugguaacguuuaaagugccucacgcaaaaagacaagauguaacaguucuaggaagccaggaaggagcaaugcacagcgcacuggcgggagcaacagaaguagacagcggggaugggaaucauauguuugcuggucauuuaaaauguaaaguacgaauggagaagcuaagaauaaaaggaaugucauauacaauguguucuggaaaauucucuauugauaaggagauggcggagacacaacacggaacaacugugguuaaaguaaaauacgagggugcaggcgcaccauguaaaauucccauagagauucgagauguaaacaaagaaaaagucguaggucgaauaauuaguaguacaccauuugcggaaaacacaaacucaguaauuaacaucgaacuagaaccuccauuuggcgauaguuacauagucauaggaguaggugacucugcacuaacacuucauugguuucguaaaggcuccucaauagguaaaauguuugagucuacauaucguggggccaaacguauggcaauauuaggcgaaacugcuugggacuuuggaucgguuggugguuuguucacgucauuaggaaaagccguacaucaaguuuucggaaguguauauacaacaauguuugggggcguaucauggaugauaagaauacugaucggauuuuuagucuuauggaucggcacaaacucuaggaacacuucaauggcaaugacgugcauagcuguaggcgggauaacuuuauuccuaggauuuaccgugcaagccgacaugggcugcgucguaucauggaaugguaaggaauuaaagugcggcucggguaucuuuguuguggacaauguccauacauggaccgagcaauauaaguuucaaccugagaguccugcacgacucgcuucggcuauacuuaacgcacauaaagauggcguauguggaauacgaaguacaacaagauuggagaauguuauguggaagcaaauaacaaaugagcuuaauuauguauugugggaaggugggcacgaccucacaguuguugcuggugacguaaaaggagugcuuacuaaaggcaaacgugcacuuaccccgccaguaaacgauuuaaaauauaguuggaaaacuugggguaaagcaaaaauauucacgccugaagcuagaaauucaacauuucugauagauggaccagauacaagugaaugcccgaaugagagacgagcuuggaacuucuucgaaguagaggauuaugguuuugguauguucaccacaaacauauggaugaaauuuagagaaggauccagcgagguaugcgaccacagguugaugucagccgcgauaaaagaucaaaaggcgguacacgcugauauggguuauuggauagaguccaguaaaaaucagacguggcaaauugaaaaggcgucauuaauugaaguaaaaacuugucuauggccuaaaacccacacacuauggagcaauggaguauuagaaucacagauguugauaccgagauccuacgcuggaccguucagucaacauaauuaucgucaaggguaugccacccaaacagcugguccauggcacuuagguaaacuagaaauagauuuuggugaaugcccugguacaaccguaaagauccaggaagacugugaucauagagggccaagccuaagaaccacuacagccucuggaaaacuuguaacucagugguguugcagaucgugcacuaugccaccgcuacgauucuuaggugaagauggaugcugguaugggauggaaaucagaccccucagugaaaaagaagaaaacaugguaaaaucccaagucaccgcuggucaaggaacgucggagacauucucuaugggauugcuauguuugacuuuauuuguagaagaaugucuucggagacgaguaacucgaaaacauaugauauuaguagucgugaucacauuuugcgcaauuauucuaggaggccucacuuggauggauuuauugcgugcauuaauaauguuaggggacacuaugaguggccgaauaggcggacaaauacaucuagcuauuaugacgguguuuaaaaugucucccggauaugucuuaggaguuuuucugcgaaaacuaacuagcagagagacagcauuaauggugauaggcauggcaaugacuacugucuuuucuauaccccaugaucugauggaguuaauagacgguauuaguuuaggauuaauacuauuaaaaauaguaacucauuuugacaacacacaaguugguaccuuagcccuaucccugaccuuuaugaggucaacgacaccauuggugauggcauggcggacaaucauggcaguauuuuucguaauaacgcucauuccauuguguagaacaucaugcuuacaaaaacagagccauuggguagaaauaacagcgcuaauauuaggagcacaggcccugccaguuuaucuuaugacgcuuaugaaaggagcaucaagaaggagcuggccauugaaugaggggaucauggcaguaggauuagugucucuacuagguuccgcauugcucaaaaaugacguaccgcucgcuggccccaugguugccgguggguugcuguuagccgcuuacguaaugaguggaagcucggcggaccugucacuugaaaaagcagcaaacguccaaugggacgaaauggcugacauaaccgguucaagcccgaucaucgagguuaaacaagacgaggacgguucauuuucuauccgcgacguagaagaaaccaacaugauuacucuguugguaaaacuugcauuaauaacuguaaguggucuauacccccuagcuauaccaguaaccauggcgcuaugguauaucuggcaaguuaagacucaacgaaguggggcccucugggauguacccucaccggccgccacgcaaaaagcaacauugucagaagguguauauaggauuaugcaacguggucuuuuuggaaaaacacaaguaggcguaggcauacacauggaaggaguguuucacacaauguggcauguaacucguggcagugucaucugucaugaaacugggcgacuugagccgucaugggcagaugugcgcaacgauaugauuucauacggcgggggcuggaggcuaggagauaaaugggauaaggaagaggauguacaaguacuggcaauagaaccugguaaaaacccaagacacguacaaacaaagccuggacuauuuaaaacauuaaccggggaaauuggagcaguuacucucgacuuuaaaccuggcacgagcggcuccccaauaauuaacaagaaagguaaaguaauaggacuuuacggaaacggcguuguaacaaaaaguggcgacuauguauccgcaauuacacaagcagaaagaaucggggagccagacuaugaaguagacgaagacauauuccgcaagaaaagacugacgauuauggauuugcaccccggagcaggcaagacaaaacgaauccugccaucaauaguuagggaggcucugaaacgacgccugcgcaccuuaauauuggcuccgacccgaguuguugcagcagaaauggaagaagccuuaagaggcuuaccuaucagguaucagacucccgcagugaagucugaacacacaggcagggagauagucgauuugaugugucacgcuaccuucaccacuagacuauuaucgucuacaagaguaccgaauuauaaccugaucgucauggaugaagcgcacuuuaccgauccuugcaguguagcagcaagagguuauauaaguacgaggguugaaaugggugaagcggcagcaauauuuaugacagcaacuccuccaggaucgauagacccauucccacaaucuaauucuccgauugaagauauugaaagagaaauuccugagcgaaguuggaauacaggauucgacuggauaacugacuaucaaggaaagacuguaugguuuguaccaucaauaaaagcaggaaaugauauagcaaacugucucagaaaguccggaaagcgcguaauacaauugucaagaaagacguuugacaccgaauauccaaaaaccaaacuuacagacugggauuuuguuguaacaacugauauaucagaaaugggcgcuaacuucagagcaggaagagugauagaucccagacgaugucucaaaccaguaauauuaaccgaugggcccgaacguguuauacuggcuggaccaauaccgguaaccccagcgagugccgcccagcggagagguaggauugguaggaauccggcucaagaagacgaucaauacgucuucuccggggauccccuuaaaaaugacgaagaccaugcucauuggaccgaggcuaaaaugcuacucgauaauauauacacuccagaagggauaauuccaacuuuauuugguccagaacgagagaaaacccaggcgauagacggugaguuccgacuuagaggagaacaacgaaaaacuuucguagaacuuaugagacggggagauuuaccuguauggcugucguauaagguagcaucugccgguaucuccuacaaagaccgcgaauggugcuuuacaggagaaagaaacaaucagauuuuagaggaaaauauggaaguagaaauauggacacgggaaggugagaagaagaaacuacguccaaaauggcuagaugcuagaguauacgcagauccaauggcucuaaaagauuuuaaagaguucgcgucugggcguaaaucaacaacuuuagauaucuuaaccgagauugcgacacuucccacauaucugucaucuaaagcaaaacuagcacuugauaauauagucaugcuucauacgacugaaaaaggagggagagcauaucagcacgccuugaaugaauuaccggaaucccuggaaacccuuaugcugguagcguuacucggggcaaugacggcaggaauauuuuuguucuuuaugcaagggaaagggauaggaaagcucuccauggggcuaauagcuauagcagucgcaagcgggcuauuauggguugccgaaauucaaccgcaguggauagcagcuaguauaauucucgaguuuuuccuaaugguacuacucauaccagaaccggaaaaacaacgcacaccacaagauaaccaacugauauaugucauccugaccaucuuagcaauaauaggucugauugcagcuaacgaaaugggucuuauagagaaaaccaaaacagauuuugguuuuuaucagguuaaaacggagacaacaauuuuagauguugauuuaagaccagcaagcgcguggacauuauacgcuguugcuaccaccauauuaacuccaaugcuacgucauacaauugaaaacacaagugccaauuuaucgcuagcugcaauugcaaaucaagcggccguacugaugggucuagggaaaggguggccacugcaucgaauggaucuaggaguuccucuccucgcuaugggauguuauucacaagugaacccaacuaccuuaaccgccagccuagugauguuacuaauucauuaugcgauaauaggaccaggccuucaagcaaaggcaacacgagaggcacagaaaaggacagcagcgggaauaaugaaaaacccaacggucgaugggauaacggucaucgauuuagagccaauaucuuaugacccaaaauuugaaaaacaauugggucaaguaaugcuacugguguuaugcguaggccaacuccuucugaugaggacuaccugggcacuaugugaaguuuugacccuagcgacugguccuaucaugacucuaugggaaggaaaccccggaagauucuggaacacgacgauagccguuagcacagccaauauuuuucgaggaucauaucuugccggugcuggucuggcauucagucuuauaaagaaugcccaaaccccacgucgagggacugguaccacuggugagacacuaggggaaaaauggaagagacaguuaaauucauuagauaggaaagaauuugaggaguacaaaagaucaggcauauuggaaguugaccguaccgaagcuaaauccgcccugagagacggaucaaaaauaaaacacgcaguaagucguggaucuagcaagauuagguggauugucgagagaggaaugauaaaaccuaaagguaaagucguagacuuaggcugcgggagaggggguuggucauauuauauggcuacucucaaaaauguaacggaggugaaaggguauacuaaagguggccccggacacgaagaaccuauccccauggcuacuuauggauggaacuuagucaaauuacauagcggaguugauguuuucuacaagcccaccgaacaaguggauacacuauugugcgauauuggggaaaguucaaguaauccaacaauagaagaagggcgaacauuacgaaucuuaaaaaugguagaacccugguugagcucgaaaccagaauuuugcauaaaaguuuuaaacccauauaugccgacagugauugaagaacuugaaaagcugcaacggagacacggugguucgcuuguacgguguccacucucucgaaauucuacacacgaaauguacuggguuucaggagcuuccggaaacauagucuccaguguuaacacaauaagcaaaauguuacugaacagauucacaacuaggcauagaaaaccaacauaugagaaagauguagaccuuggugcuggaacacguucagucagcacagaaacugaaaaacccgauaugacaaucauaggaagaagauugcagagauuacaagaagaacauaaagaaacauggcauuaugaucaggaaaaucccuacagaacaugggcguaccacggaaguuaugaagcaccgucgacagguucggcaucaucuauggugaaugguguaguaaaauugcuaacaaaaccaugggaugugauaccaaugguaacccaacuggcgaugacggauacuacacccuuuggacaacaaagaguauuuaaggaaaagguagauacccgaacuccacaaccaaaaaucgggacucgcaugauaaugacuacgacggcaaauuggcuaugggcgcuuuuaggaaagaagaaaagcccaagauuguguacaagagaagaauuuauaucuaaaguaagaagcaaugcugcaauuggugcaguuuuucaagaggaacaaggguggacaagugcaucagaagcgguaaaugacucuagauucugggagcuaguagauaaagaacgcgcuuuacaucaagaaggaaaaugugagaguugcguguacaacaugauggguaaaagagagaagaaacuuggagaguucggcagagcaaaaggaucucgugccauaugguacaugugguuaggugcacgauuucuugaauuugaagcacucggcuuuuuaaaugaagaucacugguucaguagagaaaauucuuggagcggcguagaaggagaaggauugcaccgccugggauacaucuuagaagacaucgauaagaaagacggcgauuuaauauacgcugaugacaccgcugguugggacacacguauuacugaagaugaccuacugaacgaagaauuaaucacagagcaaauggcuccgcaccacaaaacauuggcuaaagcaauauuuaaacuaacauaccaaaacaagguaguaaaaguacuacgaccaacuccaaaaggcgcuguaauggacauuaucucucgaaaagaucaacguggcaguggucaaguuggaacguacgguuugaacacauucacaaauauggagguucagcuaauacgccagauggaagccgagggcguaauuacucaagacgauaugcaaaauccgaaaggacuuaaagaacgaguagaaaaauggcugaaagaauguggugucgauaggcuuaaaaggauggcuauaagcggugacgacuguguuguaaaaccauuggaugaaagguuuaguacaucacuucuauuucuaaaugauaugggcaaaguacgaaaagauguuccgcaaugggaacccucuaaaggguggaaaaauuggcaagaaguuccauucugcagucaucauuuucacaaaaucuuuaugaaggauggacgcucuuugguagugccaugucguaaucaggacgaauugauagggcgugcacggauaagccaaggcgcagguuggucguugcgugaaacggcauguuugggcaaggcuuacgcucaaauguggucucuaauguacuuucaccgucgagaccucagguuagccucaauggcgauuugcucugcugucccgacggaaugguuccccacgucacguacaacauggagcauccacgcacaacaucaauggaugacaacugaagacaugcuaaaaguuuggaaccgaguguggaucgaggacaaucccaauaugacagauaaaaccccggugcauaguugggaggauauaccguaucuggggaagagagaagacuuguggugugggucucucauaggacuaagcucccgugcuacgugggcgaaaaauauacacacagcaauaacccagguucgaaaucuaaucgguaaggaagaauacguagacuauaugcccguaaugaaacgcuauaguucgccaucggaaucugaaggcguuuuauag

SEQ ID NO: 23671 - RNA, 9867 nt, Artificial Sequence
  derived and/or modified CDS sequence (opt6) from DENV-4__KM190936__SS-prME
ucaacaauaacuuuauugugucuaauaccaacuguuauggcuuucucauugaguacacgugauggagaaccuuuaaugauaguagcgaagcaugaaagaggaagaccuuuauuauuuaaaacgacagaaggaaucaauaagugcacacuaauugcgauggaucucggagaaaugugcgaagacacuguuacauauaaauguccacuacuuguuaauacagaaccagaagacauugauugcuggugcaaccuaacgaguacuuggguuauguaugggaccugcacucagucaggagaacguagaagagaaaaacggucugucgcuuugacuccacacagcggaaugggauuagaaacacgagcagaaacauggaugucuagugaaggagcauggaaacaugcucagcguguugaaucuuggauuuuaaggaacccuggauuugcauuauuagccgguuucauggcauacaugauaggacaaacaggcauucagagaacaguauucuucguucuaaugauguuaguugcaccaagcuacggaaugcguuguguuggaguggguaaccgggauuucguagaaggcguauccggaggugcuuggguagacuuaguauuggagcauggagguugugugacuacaauggcacaggguaagccaacauuggacuuugaauugacaaagacaacugcaaaagaggucgcacuacuacgaacguauugcauagaagcgucaauuaguaauauaacaacagcuacuagaugccccacucaaggugaaccuuacuuaaaagaggagcaagaccaacaauauaucugcagacgagauguaguagaccguggauggggaaacggguguggcuuguuuggaaagggcggaguuguuacgugugcgaaguuuuccuguucaggcaagaucacagguaaccuuguucagaucgagaaucuugaauauacggugguuguuacagugcacaauggugauacccaugcaguaggaaaugauacgucgaaucauggugugacugcaaugaucacaccaagauccccauccgucgaaguuaaauuacccgacuauggagaauugacauuggacugugaacccaggucgggaauagauuucaacgagaugauucuaaugaaaaugaagaagaaaacaugguugguucauaaacagugguuucuggaccugccguuaccguggacugcgggcgcugacacaucggaaguacauuggaauuacaaagaacgaaugguaacguuuaaagucccacaugcaaaacgacaagauguuaccguauuagguucccaagaaggagcuaugcacagugcuuuagcuggugcgacugaaguggacucaggugacggcaaccacauguuugccggccacuuaaaauguaaagugcgaauggagaaacuucggauaaaaggaaugaguuauacaauguguagcggaaaauuuuccaucgauaaagaaauggcagaaacacaacacggaaccaccgugguaaagguaaaauacgaaggagcuggggcaccauguaaaguuccaaucgagauaagggacguuaauaaggaaaagguagugggucgaauuauaucaagcacaccuuuagcagaaaauacuaacucaguaacgaauauugaacuugaaccuccauuuggcgauagcuauauuguuauuggagugggaaauucagcgcugacgcuacauugguuuagaaaagggucaaguaucgguaaaauguucgaguccacuuauagaggcgccaaaagaauggccauauuaggugagacggcaugggauuuuggcaguguaggcggauuauucacaagccucggcaaagccguacaucagguuuuuggaucagucuacacaacaauguuuggaggaguuaguuggaugauacgaauacugaucggguuucucguccuauggauaggaacuaacagucggaauacaaguauggcgaugacaugcauagcugucggcggaauaacgcucuuuuugggcuuuacaguucaagccgauaugggauguguuguaagcuggucaggaaaagaauuaaaguguggaaguggaauauucguuguagauaacguacauacauggacggaacaguauaaguuucagccugaaagcccggcuagguuagccucagcgaucuuaaaugcgcauaaagaugguguguguggaauuagauccacuacuagacuggaaaacguaauguggaagcaaauaacuaacgaauuaaauuauguccuuugggaagggggccaugauuugacuguagucgcaggagauguaaagggcguacucacaaaaggaaaaagggcucugacacccccaguaagugauuugaaauauaguuggaagacuuggggaaaggcuaaaauauuuacuccugaagcgagaaauucgacauuccuaauagauggaccggauacaagcgaaugucccaaugagcgcagagcauggaauagccuagagguagaagauuauggauucgguauguuuaccacuaauaucuggaugaaguuuagagaaggaucaucggaagugugugaucaccgccugaugagugccgccaucaaagaucaaaaagccguccacgcugauaugggauauuggauagaaaguuccaagaaccaaacauggcaaauugaaaaagcgagucuaauugaaguaaagacaugccuuuggccaaaaacacacacauuauggucuaacgguguacuggagucucaaauguuaauacccaaaagcuaugcugguccauuuucccagcacaacuauagacaaggauacgcaacccagacuguagguccauggcacuuaggaaaguuggaaauugacuuuggugaauguccagggacuaccguaacaauacaagaagacugcgaccacaggggucccucuuuaagaacaacaacugcaagugguaaacuugugacacagugguguugccgcucguguacuaugccaccacuaagauucuuaggcgaggauggauguugguacgggauggaaaucagaccauuaagcgaaaaagaagaaaauaugguuaaaagucaaguuacagcgggucaaggaaccucggagacguuuucuauggguuugcuuugucucacucucuuugucgaagaaugccugagacgcagggucaccagaaaacacaugauucuaguaguaguuauaacacuaugugcaauuauauuaggcgguuugacguggauggauuugcugagagcacuaauaaugcuuggcgauacaaugucgggcagaauugggggacagauacaccucgccaucauggcaguauuuaaaaugaguccaggauauguacuaggaguauuuuuacggaaauuaacaucgagggagacagcguuaaugguaauugguauggcaaugacgacuguauugagcauaccucaugauuugauggaauuaauagacggcauauccuuaggauugauuuuauugaaaaucgucacccaauucgacaacacucagguuggaacauuggcuuuaucacuuacuuucauacgaucuacgaugccacuuguaauggcguggaggacuauuauggccguucuuuuuguaguaacauuaaucccucuuuguagaacaaguuguuuacagaagcagagccauugggucgagaucacagcguuaauauuaggcgcgcaagcacuaccgguauaucucaugacacuaaugaagggagccucgaggagaaguuggccauuaaaugaggguaucauggcgguaggacuuguaagccuacuagguagugcucuacucaaaaacgauguacccuuagcagguccaauggucgcaggaggccuacugcuggccgccuacgucaugucugguuccucagcggaccugucuuuagaaaaagcggcaaacguucaaugggaugagauggcugauauaacuggcagcuccccaauuauugaaguuaaacaggaugaagauggauccuuuucaauacgcgauguagaagaaaccaauaugauaacucuguuagugaaguuagcccuuauuacaguuaguggacuuuacccccuagcaauaccagugaccaugacuuugugguacauguggcaaguaaaaacucagagaagcggugcuuugugggaugucccaaguccugcagcgacccaaaaagcugcacuaucagaaggggucuaucggauaaugcaaaggggacuauuuggaaagacacaaguuggaguugguauucauauggaaggaguauuucacacaauguggcacguaaccagaggcucugucauuugccacgaaaccgguagacuugagccuucgugggcugacguucgaaacgauaugauaucauacggaggcggcuggagacuuggggauaaaugggacaaagaggaagauguucaagugcuugccauagaacccgguaaaaauccgaaacauguacagacgaaaccaggauuauucaagaccuuaacaggggaaauuggggccguaaccuuagauuuuaaaccuggcacgucgggaagccccauuauaaaucgcaaggguaaaguaaucggauuauacggaaacggaguuguuacaaagucgggagauuauguaucagcaaucacacaagcggaaagaauaggagagccagacuaugagguagacgaagacauuuuuaggaagaaaagacuuacaauuauggaucuucauccaggugcaggaaaaacuaaacguauauuaccaaguauaguaagagaggcuuuaaagcggcgucuacggacauuaauauuggcaccaacaagagugguggcggcugaaauggaagaagcacuacgaggauuaccuauucgcuaucaaacuccagcaguaaaaucugaacauacuggacgcgaaauuguagaucuuaugugucacgcaacuuucacaacucggcuauuaagcucaacuagggucccaaauuacaaccuaaucgugauggacgaagcucauuuuacggauccaaguucaguagcggccagaggauacauaucaacaaggguagaaaugggagaagcagcugcuauuuuuaugacagcuacgccgccgggggcaacagauccuuucccacaaucaaacuccccuauagaagacauugaacgugagauaccagaacgaucguggaauacgggauuugacuggauaacggauuaccaaggaaaaacagugugguuuguaccaagcauuaaagcaggaaaugauauagcaaauugucucagaaagaguggaaagaaaguuauucaacuuucucgaaagacauuugacacugaauacccaaaaacuaaguuaacagacugggauuuuguuguaacaacggacauuucagaaaugggagcuaauuuuagagcagggcggguaauugauccucgaagaugccuuaaaccgguuauccuaacagacgggccagagagagucauauuagcaggcccgauacccgugacgcccgcaucggcggcgcaacgacgugguagaauaggacgaaauccagcacaggaagacgaucaauacguauucaguggcgauccuuuaaagaaugacgaagaccacgcacacuggacggaagccaaaaugcuucuugauaauauauauacuccggaaggcauuauaccgacacuauucgggccugagagggaaaagacacaagccauugacggugaguucagauuaaggggagaacagagaaaaacuuuuguagaauuaaugaggagaggggacuuacccguaugguugaguuauaaaguagcaagcgccggcauaagcuacaaagaucgagagugguguuucacaggcgaaaggaacaaccaaauucuagaggaaaauauggaggucgaaauuuggacuagagaaggugagaaaaagaaguugcggccucgauggcuagaugcucgugucuacgcggauccaauggcauuaaaagauuuuaaggaguuugcuucagggaggaaaaguauaacacuugauauucuaacugagaucgcaaguuuacccacguacuuaagcucaagagcaaaguuagccuuggacaacauaguuaugcuccauacuacagagcgaggagggagagcuuaucagcaugcgcuaaaugaauuaccugagagcuuagagacacuaaugcuaguagcauugcuuggggcaaugacugcaggcauuuuccucuucuuuaugcaaggaaaggguauugguaagcugucuauggguuuaauuacgauagcaguggcaucggguuuacuguggguugcugaaauccaaccacaguggauagcagcuaguaucauccuagaauuuuucuuaauggucuuauugauaccugagcccgaaaaacaacgaacgccccaagauaaccagcuaauauacguaauucuaacgauccucacaauaauaggucuaauagccgcaaaugagaugggacuuaucgagaaaacaaaaacugacuuuggguuuuaccaaguaaaaacagagacuacuauucuugauguggacuugcgaccugcaucagcuuggacuuuauaugcuguagcaacaacgauuuuaacacccauguuacgucauacgauagagaauacaagcgcaaaucuuucauuagcugcaauagcaaaccaagcagcgguacuaaugggacuagguaagggauggccccuacacaggauggaucugggggucccgcugcuagcaauggguuguuacagucagguuaaucccacuacccuaaccgcguccuuaguaauguuauuaguucauuaugcgauaauaggaccagggcuccaagcgaaagcaacaagagaagcucaaaaacguacugcggcuggaauaaugaagaauccgacuguugauggaauaacaguaauagacuuagaacccauaagcuaugauccgaaauuugaaaaacaauuaggacaagucaugcuauuaguguugugcgcaggacaacuauuacuaaugagaacuacaugggccuuuugugaaguguugacgcuggccacggguccuauucugacuuuaugggaagggaauccaggacgcuucuggaauacaaccaucgcagucucaacugcuaauauauucagggggucauaccuagcuggugcuggacuggccuuuagcuuaauuaaaaaugcucagacaccacgccguggaacugguacuaccggugaaacacuaggugaaaaauggaaaagacaauugaacucacuagaccguaaagaauuugaagaauacaaaagaucgggcauucuagaaguagauagaacagaagcuaaaagcgcccuuaaggacggaucaaaaauaaaacaugcaguaaguagagguaguucaaaaauaagguggaucguugaacgaggaaugguuaaaccgaaaggaaaaguaguagacuuaggauguggaagaggaggauggucauacuacauggcaacccugaaaaauguaacagaaguaaagggcuauacaaaaggugggccagggcaugaagaacccauuccuauggcuacauacggguggaauuuagucaaauugcacagcggggucgauguauuuuacaaaccuacagagcaaguagauacguuacugugugacauaggugaauccucuucuaauccuacaauagaagaaggcagaacacuaagaguauuaaaaaugguggaaccauggcuaucaaguaaaccggaguucuguauuaaaguacuaaacccauacaugccaacuguuauugaagaacuugagaaauuacaaagaaagcauggcggaaaccucguaagguguccgcugucgcguaacagcacacaugaaauguauugggugucuggagcgucgggaaacauaguuucuucaguuaacacuacaucaaagauguuguuaaauagauuuaccacuagacaccgaaagccgacauacgaaaaagauguagauuuaggugccggaacacgaucuguuaguacugaaacugaaaaaccagauaugacaaucauaggaaggcgguugcagagacuucaagaggaacauaaggaaacuuggcacuaugaucaggaaaacccuuaucggacuugggcauaucacgguaguuaugaagcuccaucaacgggaucagcgucaucaauggugaacggcguaguaaaacuacugacuaagccaugggacguaauaccuauggugacacaauuagcuaugacagauacuacacccuucggacagcaaagaguuuucaaagaaaaaguugacacucggacaccccaaccuaaaccugggacuagaauggucaugaccacgacagcgaauuggcuaugggcccuucugggcaagaagaaaaacccuagauuaugcacacgugaagaguuuaucucuaagguacgaaguaacgcugcgaucggugcaguauuucaagaagaacaaggcuggacaucugccucagaggcaguaaaugauucacgauuuugggaauuaguagacaaagaaagggcccuccaucaagaagguaaaugcgaaaguugcguauauaacaugauggggaagcgcgagaagaaacucggggaauuuggcagagcuaaagggucacgagcaauuugguauaugugguuaggugcaagauuucuagaguucgaagcguuaggauuucugaacgaggaccauugguucgggagggaaaacaguuggagcggugucgaaggagaggguuuacauagacuggguuacauacuugaggagauugauaagaaggacggggaucuaauguacgcagacgauacggccggcugggauacucgaauuacggaggacgacuuacaaaaugaagaacuaauaacugaacaaauggcaccucaucacaaaaucuuggcuaaggcgauauuuaaauugacguaccaaaauaaaguaguuaaaguacuaagaccaacacccagaggagcuguuauggacauaauuaguagaaaagaucaaaggggaagugggcagguagguacauacggccugaauacauucacaaacauggagguacaacucauuaggcaaauggaagcagaagggguaauuacacaggaugacaugcaaaauccaaaaggacuuaaagagagaguggaaaaaugguuaaaagaaugcgguguggauagauugaagaggauggcaauuucuggugaugauugugucgucaaaccacuugacgaacguuucggcacuucuuugcucuuucuuaaugacaugggaaaaguacgcaaagacauaccucaaugggaaccaaguaaagguuggaaaaauuggcaggaaguaccuuucuguagucaucauuuucauaaaaucuuuaugaaggauggcagaaguuugguaguaccauguagaaaucaggaugaguugauugggagggcaagaauaucucaaggggcuggcuggagcuuaagagaaaccgcuugcuuaggaaaagcauaugcacaaaugugguccuuaauguacuuucaccggagggaucugaggcuggcgagcauggccauuuguagugcagugccaacugaaugguucccaacaucacggaccaccuggaguauacaugcacaucaucaauggaugacaacagaagauaugcugaaaguauggaaucgaguauggauagaagauaauccaaauaugacagauaaaacaccgguacauaguugggaagauauaccuuaccuaggaaaacgagaggauuuaugguguggcucacucauaggucuaucuucacgugccaccugggcuaaaaacauucacacagcuauaacacagguaagaaaccugauagguaaagaagaauacguagacuauaugccuguaaugaaaagauacagcgccccaucggaaagcgagggcguacuauaa

SEQ ID NO: 23672 - RNA, 9867 nt, Artificial Sequence
  derived and/or modified CDS sequence (opt6) from DENV-4__JQ915090__SS-prME
agcacgaugacucuucuuugucuaauaccuacuguuauggcauuccauuugaguacuagggauggggaaccccuaaugauaguugcaaaacacgaaagggggcguccacuucuguucaaaaccacggaaggaauaaauaaaugcacuuugaucgcaauggauuuaggugaaaugugcgaagacacgguuacauacaaauguccauuauuaguuaauacugaacccgaagauauagacugcuggugcaaucuuacaucuacuuggguuauguacgggacuugcacucaaucgggagaaaggcggagagagaaacgaagcguagccuuaacuccacauucgggaaugggacuggaaacaagagcagaaacauggaugaguagugagggugccuggaaacaugcccaacgagucgaaucauggauauuacggaauccaggguuugcacuacuggcgggcuucauggcauauaugauuggacaaacuggcauucaacgaauuguauucuuuguauugaugaugcuuguugcaccgucauacgggaugagaugcgucggaguagggaauagagauuucguagaagguguuagcgguggcgcuuggguugauuuaguacuagaacauggugggugcguuaccacaauggcccaaggcaaaccuacccuagauuuugaacuagcgaaaacaacagcaaaggagguugcacuauugcguaccuacugcauagaagcgaguauuuccaauaucacgaccgcaacgagauguccaacccaaggugaaccuuaucuuaaagaagaacaggaucaacaguauauauguaggagagaugugguugaccggggcugggguaauggcuguggccuauuuggaaaaggaggaguaguaacaugugcuaaauuccuauguucaggaaaaauaacagguaauuuaguacagauagaaaaccuagaauauaccguaguugugacgguucacaauggugacacucacgccgucggaaacgacacaucgaaucaugggguaacagcaacaauaacaccaagaaguccgucaguagaaguaaaacuaccagauuauggcgagcuuacacuagacugcgaaccaagaagcggaauagauuuuaacgagaugauucucaugaaaaugaagaagaaaacgugguuaguucacaaacaaugguucuuagaucuuccgcugccauggacagcaggagccgauacaagugagguacauuggaacuacaaagaacgaauggugacuuucaaaguuccgcaugcaaagagacaggauguuacgguauuaggaagucaagaaggagcaaugcauagugcacuugccggagcgacagaaguugauaguggggauggcaaucauauguuugcaggacauuuaaaauguaaaguacggauggagaaacugcgaaucaaggggaugagcuauacaauguguuccggaaaauuuagcauugacaaagaaauggcggaaacccaacauggaacuacugucguaaaaguuaaauaugagggugcuggagccccgugcaaaauaccgauagaaauuagagauguuaauaaggagaaaguggugggcagaauaauaucuuccacaccauucgcagaaaauacaaacuccguuauaaacauagaacuagaaccacccuuuggagauagcuauauagucauaggugucggggauucugcgcucacgcuacacugguuuaggaagggaucgucaauugggaaaauguuugaaaguaccuauagaggggcaaaacgcauggcaauuuugggugaaaccgcaugggauuuugguagcguuggaggcuuauuuacaucacucgguaaggcgguucaccaagucuuuggaagcguuuauacgacaauguucggaggggugagcuggaugaucaggauacuuauugguuuucuaguguuauggauagguacuaacagucgaaauacuucgauggccaugacuuguauagcaguaggagggauaaccuuauuuuugggguucacaguacaagccgacaugggauguguaguaucuuggaaugguaaagaauugaagugcggcuccggaauauuuguaguugauaauguacacacuuggacagagcaguacaaguuccaacccgaaucgccagcacguuuggcaagcgcaaucuuaaacgcacauaaagacggugucuguggaauacguucaacaaccagauuagaaaacguaauguggaagcaaauaacaaacgaacuuaauuauguucuaugggaaggugggcacgaucugacagugguugccggggaugugaaaggcguacugacaaaaggaaagagagcguuaacgccaccggucaaugaucuuaaauauaguuggaagacuuggggaaaagcaaaaauuuuuacaccggaagcaagaaauucuacguuuuugauugauggaccagacacaagugaguguccuaacgagaggagagccuggaacuucuucgaaguagaagauuaugguuucggaauguucacuacaaacauauggaugaaauuucgagagggcucaagugaagugugugaccacagacucaugucagcugcaauuaaagaucagaaagccgugcacgcugauaugggauacuggauagagaguuccaaaaaucaaacauggcaaauugaaaaggcaagucugaucgaaguaaaaacuugucuuuggccuaagacacauaccuuauggaguaacggaguguuagagagucaaauguuaaucccucgaucuuacgccggaccauuuucacaacacaacuacagacaggguuacgcuacacaaaccgcaggcccguggcauuuagguaaauuggaaauugauuuuggcgaauguccggguacaacuguaaaaauacaggaagauugcgaccaucgcggcccgagccuucggacaacaacugccucugggaaguuagugacccagugguguugucgaucguguacuaugccaccucuucgauuuuuaggugaagacggaugcugguaugggauggaaauaagaccgcuuucggaaaaagaagaaaacaugguaaaaucacaaguaaccgccggacaagggacuucggagacauuuucgauggguuugcuaugccuuacccucuuuguugaagaaugccuaagacggcgaguuacccgaaagcacaugauacugguaguggucaucaccuuuugugccaucauacucggagguuuaaccuggauggacuuguuaagggcgcuaauuaugcuaggagacacuaugaguggaagaaucgggggucaaauacaccuugcaauaaugacggucuucaaaaugucgcccggguauguuuuagguguuuuucuucgcaagcugacaucaagggaaaccgcauuaaugguuaucggcauggcaaugacaaccguguuuucgaucccccacgaccuuauggaauuaauugauggaauuucauuaggauugauacuucuaaaaauaguuacacacuuugauaacacacaaguuggaacgcuugcucuuucuuuaacauucaugcgaucuacuacaccuuuaguuauggcuuggcgaacaauuauggcaguguucuuuguaauaacacuaauaccgcuaugccgcacaucuugcuuacagaagcagagccauuggguugaaaugaccgcguuaauucucggagcgcaagccuuaccgguauacuuaaugacauuaaugaaaggugccucacgucguucauggccacuaaaugaaggaauaauggcugugggauuaguaucacuccuaggcucagcccuucuaaagaacgacguucccuuagccggaccgauggucgccggugggcuacuauuagcagcauauguaaugucuggaagcucagcggacuuaucacucgaaaaagcugcaaacguacagugggacgagauggcagauauaacgggaucuaguccaauaauagaaguaaaacaagaugaagauggaucuuuuucaauaagagauguagaagagacaaauaugaucacacuauuaguuaaauuagcacuuauaacgguaucuggauuguauccgcuugcaauaccuguuacuauggcauugugguauauauggcaaguaaaaacucagcgcagcggugcauugugggauguaccgagcccagcagcaacccagaaagcaacuuugagcgaaggaguuuauagaauaaugcaaagaggacuuuucggaaaaacacaaguaggaguugggauucauauggaaggaguauuucauacaauguggcaugugacuagggggaguguuauaugccacgaaacuggaaggcuagaaccgucgugggcagacguacgcuccgacaugauaucguauggagguggauggcgccuaggagacaaaugggacaaagaggaagauguacaaguguuagccauagaaccuggaaagaacccuagacauguacaaacaaagccaggauuguuuaaaacauuaacuggcgaaaucggugcaguaacgcuagacuuuaaaccaggcacgagcggcucaccgauaauaaacaagaaaggaaaagucaucggauuauauggaaauggugucgucaccaaaucuggugauuauguuagcgcgauaacgcaagcggaacgaaucggagaaccugauuacgaaguagaugaagacauuuuucggaagaaacguuuaacuauuauggaccugcauccuggcgcaggaaagacaaaaaggauauuaccuagcauaguuagagaagcauuaaaacguagguugagaacacugauuuuggcuccuacgcgugucguugcugcugaaauggaagaggcuuuacgaggccucccgauucgauaccagacaccagcgguaaaaucagagcauacaggaagggaaauuguagauuuaaugugccaugcaacuuucacaacucgauuauugucaucuacuagaguaccuaauuacaauuugaucguaauggaugaagcccauuuuaccgauccuugcucgguugcggcccgcggcuacaucagcacgagaguagaaaugggagaggcagcggcuauauucaugacggcaacuccaccagguaguauugaucccuuuccucaaucaaauagcccaaucgaggauauagaacgagaaaucccagagcgaaguuggaauacaggauucgacuggauaacugauuaucaaggcaaaacuguaugguuuguaccaagcauaaaagcgggcaaugacaucgcaaacugccugagaaaguccgggaaaagagugauacaacugucucggaaaacuuucgacacagaauacccaaaaacaaaauuaacggauugggauuucguaguaacgaccgauauaucagaaaugggagccaauuucagggcuggacgcgugauagacccaagacgaugcuuaaagccaguaauauuaacggaugguccugaacggguaaucuuggcaggaccaauaccaguuacgccggcuagcgcagcucaacgaagaggccgaauaggaagaaaucccgcacaagaagaugaccaauacguguuuucaggcgauccccucaaaaaugaugaagaucacgcucacuggaccgaagcgaaaaugcuguuagacaauauuuauacgccagaaggcaucauuccaacacucuuuggaccugaaagagagaaaacccaagcaauagauggggaguuuagguuacggggcgaacaacguaaaaccuucguugaacuaaugaggagaggagaucugcccguauggcugagcuauaaaguggcuagugcaggaaucuccuauaaggacagagaauggugcuucaccggugaacguaacaaucaaauuuuagaagagaacauggaagucgagaucuggacgcgcgaaggugagaaaaagaaacuucguccuaaauggcuagaugcucguguauaugcggaucccauggcuuuaaaagauuuuaaagaauuugccucgggaagaaaaagcaccacauuggacauccuaacggaaauugcgacgcuccccacuuauuuauccucaaaagcaaaacuagcguuagauaacauugucauguugcauacuacugagaaaggagggagagcuuaucagcacgcacuaaaugaauugccagaaagccuagaaacauuaaugcucguagcuuuacuaggggcuaugacagcugguauuuucuuguuuuucaugcagggaaaagggauugguaaauuauccaugggguugauagcuauagcaguugcaucuggccuacuuuggguagccgaaauccagccacaauggauagcggcgaguauaauuuuagaauuuuucuugaugguacuacucauuccagaaccagaaaaacagagaaccccucaggauaaucaauuaauauacguuauccucaccauccuaacaauaauaggacuaaucgcugcaaaugaaaugggauuaauagagaaaacaaaaacggacuuuggcuucuaccaaguaaaaaccgaaacaacgauuuuagaugucgaucuuagacccgccagcgcauggacacuauacgcuguugcaacaacaauucuaacaccuaugcuucggcacacaauugaaaacaugagcgcaaaccuaagccuggcagcgauugcgaaucaagcugcuguuuuaaugggauuagguaaaggauggccacuccaccgcauggaucuaggggucccucuccuagcaaugggcuguuauagucaaguaaacccgacaacucugacugccucucucguaauguuauuaauucauuacgcaauuauaggcccgggacuucaagcaaaagcuacgcgugaagcccagaaacguacagcagcugguaucaugaaaaauccaacgguugacgggauuacagugauugauuuagaaccaauaagcuacgacccaaaauuugaaaaacaauuaggucaaguaauguugcugguacuauguguaggacagcuuuuauuaaugagaacuacuugggcgcugugcgaggucuuaacccuagcuaccggaccgauuaugacucucugggaggguaacccaggcagauuuuggaauacaacaauagccgucaguacagcuaacauauucagggggagcuaccuagcuggugcaggucuagcuuuuucacugaucaaaaaugcgcaaaccccuagaaggggcacugguacaacaggcgagacauuaggcgagaaauggaaacgccaauuaaauagucuugaucguaaagaguuugaggaguauaaacgaucuggaaucuuagagguagaucgaacugaagcaaaaucagcacucagggauggaaguaagauaaagcacgcuguaaguagggguucuuccaaaauuagauggaucguggaaaggggaaugauaaaaccaaaaggcaaggucguagaucucgguuguggacgcggcgguuggucuuacuauauggcaacccucaagaacguaacagaaguaaaggguuacacgaaaggggguccagggcacgaagaaccgauaccaauggccacauauggguggaaucuagugaaacuacacucaggaguugacguauuuuacaagccuacagaacaaguagauacguuacugugugauaucggagagucgaguaguaaccccacuauagaggaagggagaacacugcggaucuuaaagaugguagaaccuuggcugucauccaaaccagaauuuuguaucaagguguugaacccuuauaugccaacuguuaucgaagaguuagaaaaauuacaacgccgucaugggggaucccucgugagaugcccuuuaagucgaaauuccacucaugagauguacuggguaagcggugccucaggcaauauaguuucaagcgucaacacaauaucuaaaauguuacuaaacagauuuacgacacgucacaggaagccuacauacgaaaaagacgucgauuuaggugcaggaacuaggucaguauccacagagaccgaaaaaccagauaugaccauaauaggacgaagacuucagagauugcaagaagaacauaaagaaaccuggcauuaugaucaagaaaaucccuaucguaccugggcauaucauggaucauacgaagcgccuagcacgggaagugcaucuagcaugguaaaugguguaguuaaauuacuaaccaaaccaugggaugugauuccaaugguaacccaauuagcaaugacggacacuacgccuuuuggacagcaaagaguguuuaaagagaaaguagauacuagaaccccucaaccaaaacuagggacaaggaugauuaugacuacgacggcaaauugguuaugggcacuccuggggaagaagaaaagcccaagauugugcacaagggaagaauuuaucucaaaaguacgaucgaaugcagcuaucggagcagucuuccaagaagaacaaggauggacgucugcuauugaagcaguuaaugauagcagguuuugggagcuaguugacaaagaacgugcauuacaucaagaaggcaaaugugaaaguugcguauauaacaugaugggaaaaagagaaaagaaacuaggugaguuugggagagcaaaaggaaguagagcaauuugguacaugugguuaggggccagauuuuuggaguucgaggcuuugggcuuucucaaugaggaucauugguucucuagagaaaauucauggaguggugucgaaggggagggucuacaccgacugggguauauacucgaagacauagauaaaaaggauggggauuuaauuuaugcugaugacacagcuggcugggauacccgaauaacugaagaugacuuguuaaaugaggaguuaauuacagaacagauggcgccucaucacaaaacauuggcuaaagcgauauucaaacuuacauaucagaacaaaguuguuaaaguacugcguccaacuccuaagggagcugugauggauaucauaucuagaaaagaucaacguggaagcggacaaguaggcacguacggucuaaauacauuuacgaacauggaaguccaguuaaucagacagauggaggcggaaggaguuaucacacaggaugacaugcaaaacccaaaaggauuaaaagaaaggguagaaaaauggcugaaggaaugugguguagauagacugaaaagaauggccaucucgggagacgauugcguuguuaaaccucucgacgaaagauucucaaccucccugcuauuucucaaugacauggggaaaguuaggaaagaugucccucaaugggaaccaucaaagggauggaagaacuggcaagaagucccauucugcucccaccacuuucauaaaaucuuuaugaaagauggcaggucccuuguaguaccuugccguaaucaggacgaacuaauaggacgggcuagaauaucucagggagcaggcuggagucuccgugagacggcgugucuagggaaggcuuaugcccaaauguggucuuuaauguacuuccauaggcgagaccuaagacucgcgucuauggcuaucuguucagcgguaccgacagaaugguucccgaccagucgaaccacauggaguauacaugcacagcaccaauggaugacuacugaggacauguuaaaagucuggaaccggguguggauagaagauaaucccaauaugacagacaaaacuccgguccauaguugggaagacauuccguaccuaggaaaacgggaggauuugugguguggcaguuuaauuggauugagcagcagagcgacgugggcuaagaauauacauaccgcgaucacacaaguaagaaaccugaucgguaaagaagaauauguagacuauaugccuguaaugaagagguacucuucacccucagaaucagaaggagucuuguaa

SEQ ID NO: 23673 - RNA, 9867 nt, Artificial Sequence
  derived and/or modified CDS sequence (opt6) from DENV-4__KJ160504__SS-prME
ucuaccauaacccuauuaugucuuauacccacgguaauggccuuucaucugagcacacgcgauggagaaccccugaugauuguagccaaacaugaaagaggacgaccccuucuauuuaaaacuacagaaggaauaaauaaauguacuuuaauugcgauggaccuaggagaaaugugcgaagauacuguuacauauaaauguccguuguuaguuaauacagaaccagaagauauagauugcuggugcaaccuaacuuccaccuggguaauguaugguacauguacccaaaguggagaacggaggcgagagaaaaggagcguagcucucacaccacacucaggaaugggauuagaaacucgcgcagagacuuggaugaguagcgaaggagcuuggaaacacgcucaaagaguggaaagcuggauuuuaagaaauccuggauuugcuuuauuggcaggguuuauggccuauaugauuggacaaacgggcauacaacgcaccguauucuucguauuaaugaugcuaguagccccgucauacgguaugagaugugugggaguggguaaucgugauuucguugaaggaguaucagguggugcuuggguagauuugguauuagaacauggaggauguguaacgacaauggcccaaggaaaaccgacuuuagacuucgaacuuacuaaaaccacagccaaagaaguugcacuauugcgcaccuauuguauagaagcgucuauauccaauauuacaaccgcaacaaggugucccacgcaaggcgagccguauuuaaaagaagaacaggaccaacaauauauaugcagacgagauguuguagaccggggaugggguaauggaugcgguuuguuuggcaaagguggugucguaacaugugcuaaauuuucuuguucugggaaaauaacagggaaucuugugcagauagaaaaccuugaauacacuguaguggugacgguacacaacggcgacacccaugcuguaggaaaugacacuucaaaucauggcguaacagcaacuauuacuccgcgaagccccagcguugaagucaaauuaccugauuauggagaacuaacacuagauugugaacccagaucggguauagauuucaaugagaugauuuuaaugaagaugaagaagaaaacaugguuaguucauaaacaaugguuuuuagaucuuccauuaccuuggacagcuggggccgacacgagugagguccacuggaacuacaaagaaagaauggucacuuucaaaguuccucaugcaaagagacaagacguuaccguuuuaggaagucaggaaggcgcaaugcauucagcuuuggcgggagcaacugagguggauucaggugaugguaaccauauguucgcagggcaucuaaaauguaaaguucguauggagaaacucagaauuaagggcaugaguuauacaaugugcagcggaaaauuuucaaucgacaaggaaauggcggaaacucaacaugggacgaccguagucaaaguaaaauaugaaggcgcgggugcuccguguaaagugccgauagagauucgcgaugugaacaaagaaaaaguaguuggacgggucauaucaagcacaccccuugcugaaaacacaaauucaguuacaaauauugaacuagaaccucccuuuggagauucguauauaguaauagguguggguaauagugcauuaacauugcauugguucagaaaaggcucaaguauuggaaaaauguuugaaucaacauauagaggggccaaaagaauggcgauuuuaggugaaacugcgugggauuucggaaguguuggcggguuauuuacgucccugggcaaagcaguucaucaaguguuugguucgguauacacaacgauguucggcggaguguccuggaugauacguauuuuaauagguuuucuaguuuuauggauaggaaccaauuccagaaauacuagcauggccaugacauguauagcaguuggugguauuacauuauuuuuagguuuuacgguacaggcugacaugggauguguaguaucauggucuggaagagaauuaaaguguggaagcggaauuuuuguugucgacaacguccacacuuggacggaacaauacaaauuucaaccagaaagcccagcccgauuagcuagcgcuauauuaaaugcgcauaaagauggaguuugugggauucgcucuacaacuagauuagaaaacguaauguggaaacaaauaaccaaugaguuaaacuacguucuaugggaagguggacaugaccucacagucguagcuggugauguuaagggugugcuuacgaaagguaaaagggcacuuacuccuccaguuuccgacuuaaaguauagcuggaagacguggggcaaagcuaaaauuuucacaccagaagcccggaauagcacauuucugauugaugguccagauacaagugaauguccaaaugaaagacgagccuggaauaguuuagagguugaagauuaugguuuuggaauguucacaacuaauauauggaugaaauuuagagaaggcagcagugaaguaugcgaccauaggcucaugucugcagcuauaaaagaccaaaaagcagugcacgcagacaugggauauuggaucgaauccuccaagaaucaaacauggcaaauugaaaaagcgucccuaaucgagguaaaaacaugccuuuggccuaaaacgcauacguuauggaguaacggagugcuagagagccaaauguugauaccuaaaucauaugcaggaccauuuucacagcauaacuacagacagggcuaugcgacgcaaacgguggggccauggcaucuuggcaaacuugaaauagacuuuggagaauguccgggcacaacagucacaauacaggaggauugugaccaccgagggccgucauugcggacaacaacggcuuccgguaaacugguuacucagugguguugcagaaguuguacaaugccaccccugcguuuucuaggcgaggauggaugcugguaugguauggagaucagaccccuaagugagaaagaagagaacauggugaaaucccaaguuacugcuggacaaggcacgagcgagacauucaguaugggacuauuaugucugacuuuauucguagaggaaugccuccgacgaagaguuacacgaaaacacaugauccuuguaguuguaauaacucuaugugcaauuauucuagggggacucacauggauggaucuuuugcgagcacugauaauguugggugacaccaugucuggccgaaucgguggucaaauucacuuagcgauuauggcuguauucaaaaugucuccaggauacguccuuggaguguuuuuacgaaaauuaacaucacgugaaaccgcauuaaugguuaucggaauggcaaugaccacaguucucucgauuccacaugacuugauggagcuaauugaugggauuucacucggacuaaucuuacuaaaaauuguaacccaauuugauaauacgcaaguagguacucuugcauuaucacuuacauucauacguucaacgaugccacucguuauggcguggagaaccaucauggccguccuuuucgucgugacucuaauaccccucugccgcacuucauguuuacaaaagcaaagucacuggguagaaauaacugcuuuaauuuugggagcgcaagcguuaccaguguaccuuaugacauugaugaaaggugcgucaagaagaaguuggccacuaaaugaaggcauaauggcagugggauuaguaagucuacugggaucggcccuacuaaagaacgauguuccacuugcuggcccuaugguagcgggcggauuauuguuagcagcuuacgugauguccggcaguagugcagauuugaguuuagagaaagcagcgaacguacaaugggacgagauggcagauauuacaggcagcucgccaaucaucgaggugaagcaggaugaggacggaaguuucucaauuagagauguugaggaaacuaauaugauaacucuauuaguaaaacuagcauugauuaccguuagcggauuauacccucuagcaauuccuauaacaaugacauugugguauauguggcaaguaaaaacacaaagaaguggggcuuuaugggacguuccaagcccagcagcaacacagaaggcagcccuaagugaaggagucuaucguauuaugcagagaggccuguuugggaaaacucaaguugguguuggcauucacauggagggaguauuucauacaauguggcauguuacccgaggcagcguaaucugccacgaaacgggacgguuggaaccaucaugggcagacguaagaaaugauaugauaucuuauggcggaggauggagguuaggcgauaaaugggacaaggaagaggauguccaaguucuagcaauagaaccaggcaaaaacccaaaacauguacagacaaaaccaggacuauuuaagacauuaacaggggagauuggagcaguaacccuagauuuuaaaccagguacaaguggcucucccaucauaaaccgaaaaggaaaggucaucggauuauacggaaauggggugguaacgaaaagcggcgacuauguaagcgcgauaacacaagcggaacggauaggggagccugauuaugaaguugaugaggauauuuuccggaagaaacgacucacaauaauggaucuacacccuggagccggaaaaacaaagcgcauccuaccuagcauugucagagaagcacuaaaaagacggcuacgaacgcuuauacuugcacccaccagggugguugcggcggaaauggaggaagcauuaagaggguugccaauucguuaucaaacuccugcggucaaaagcgaacacacaggcagggagauugucgaccuuaugugucacgccacuuuuacuacgcgacuacucaguaguacaagaguucccaacuacaaucuaauagugauggacgaagcacauuucaccgauccuucaucaguggcggcaagagguuauauuucgaccagaguagaaaugggcgaagcagcagcaauuuuuaugacagcaacaccaccaggagccacggauccuuucccccaaucaaauucaccaauagaagauauugaacgugaaaucccggaaagaagcuggaauacuggauucgauuggauaacagauuaucaagggaaaacuguaugguuuguaccaaguauuaaagcaggaaaugacauagcuaauugcuuacgaaaaagugguaagaaaguaauucagcugucuagaaaaacuuucgggacugaauacccaaaaacaaaauuaacagacugggacuucgucgugaccacugacaucuccgaaaugggagcaaauuuccgcgccggcagaguaauagacccacguagaugccuuaaacccgucauuuuaaccgacggaccugaaagaguaauuuuagcuggaccuauuccagucacgccagcaagcgcagcucagcguagaggaagaguaggaaggaauccagcucaagaagaugaucaauacguuuucaguggugauccucucaaaaaugaugaagaucaugcgcauuggacugaggccaaaaugcuacuagacaauauuuauacaccagaggguauaauuccaaccuuauucggaccugaaagagagaaaacccaagcaauagacggagaauuuagauuacgaggagagcagagaaaaacguucguagaacuaaugaggcgcggugaccuaccgguuuggcuaagcuauaaaguagcgucagccgggaucucuuauaaagacagggaauggugcuucacgggagaacgaaacaaucagauacuagaagagaauauggaaguagaaauuuggacaagagagggagagaagaagaaacuacggccucgauggcuagaugcccgaguguaugcugauccaauggcucuaaaagauuucaaagaguucgcaucagguagaaaaucaauaacacucgacauccuaacagaaauagcgucacucccugcguaucuaagcagucgugcuaaacuugcccuagauaacaucgugaugcuucauacgacagaaagaggugggagagcauaccaacacgcucuaaaugaauuaccugagagucuagaaacucuaauguugguagcacuucuaggugcuaugaccgccgguauauuccuauucuuuaugcaggggaaaggaaucgggaaacuuaguaugggucuaaucacaauagcaguugccucagguuuguuguggaucgcugaaauacagccccaauggauagcggcuuccauaauucuggaauuuuucuugaugguucuucuaauaccagaaccagaaaagcagcgaacaccucaagacaaucaguuaauuuauguuauacuuaccguacuuaccauaauaggauuaauagccgcaaaugaaaugggccugauagagaaaaccaaaacagacuuuggguuuuaucagguuaaaacugagacaacuauccuggacgucgauuuaagaccagcuuccgcuuggacuuuauaugcaguggccaccacaguacuaaccccaauguuaagacacacaauagagaacaccucagcuaaccugucauuggcggcaauagcgaaccaggccgcaguccuaaugggucugggaaaagguuggccgcuacaucggauggaccuagggguaccucuacuggcuauggguuguuauucucaaguaaacccuacgacauugacugcaagccuugugaugcuauucguacacuacgcgauuauuggaccaggacugcaagcuaaagcgacccgagaagcucagaaaaggacagcggcgggaauaaugaaaaaccccacuguugacggcauuacaguuaucgaucucgaaccuauaucuuaugaccccaaauuugaaaaacaacuugggcaaguuaugcuucuaguucucugugccggacaacuacuauuaaugagaacaacuugggcuuucugugaaguauuaacgcuagcgacgggaccaauuuugacacuaugggaaggcaaucccggaagauuuuggaauaccacaauagcagucaguacugccaacaucuuccguggcagcuaucuggcaggagcagguuuagcguuuuccuuaauaaagaacgcgcagacucccagaagagguacaggaacaacuggggaaacuuugggcgaaaaauggaaacgacaauugaacucguuggacaggaaagaauuugaagaguauaaaagaagugguauacuagaaguggauagaacagaagcaaagagugcacucaaggauggaucgaaaauaaagcaugccgucucaagaggaucaucaaaaauucgauggaucguagaacgaggaaugguuaaaccaaaagggaaaguaguagaccucggcugcgggcgagguggauggucauacuacauggcaacccugaagaauguaacugaaguuaaaggcuacacaaaaggcgggccuggacacgaagaaccgauaccuauggccacguauggcuggaacuuaguuaaacuacauaguggaguugacguuuucuauaagcccacggaacagguugauacccucuuaugcgauauaggagaguccucaaguaacccaaccauagaagaaggaagaacacuuagaguuuuaaagaugguugaaccuuggcucuccucaaagccugaauuuuguaucaaaguacuuaauccauauaugccuacaguaauagaggaauuagaaaaacuacaaaggaaacacggcggaaauuuagugagaugucccuuaaguagaaacagcacacaugaaauguacuggguuagcggagccucgggaaauauagucaguagugugaauacaacaaguaagaugcuccuuaaucguuuuacaacgagacauaggaaacccacauaugaaaaagauguugaucugggugcagggacacguaguguaaguacagaaacagaaaagccggauaugacuauaauaggcaggagacuacaacgccuacaagaagaacacaaagaaacauggcacuacgaucaagaaaauccguaccgcacuugggcguaccaugggaguuaugaggcgcccuccacagggucagcuaguagcaugguaaacggagugguuaaauuacuaacaaaaccaugggaugucauaccuauggucacucaacuggcaaugacagauacgacacccuucggccaacaaagaguguuuaaagagaaaguagauacaagaacuccucaaccaaaaccaggaacgaggauggucaugacuaccaccgcgaauuggcuuugggcucuguuggguaaaaagaagaauccacgauuauguacccgagaagaauuuaucucaaaagugcggucaaaugcugccaucggugcuguauuccaagaagaacaaggauggacaucugcaucagaagcggucaaugauucgagauuuugggagcugguagauaaagagagagcacuucaccaagaaggcaaaugcgaaagcuguguauauaacaugaugggcaaaagagagaagaaauugggagaguucggcagagccaaagguucccgcgccauaugguacaugugguugggcgccagauuucuggaauuugaagcucuagguuuucucaaugaggaucauugguuuggucgcgaaaacucuuggucaggggucgaaggcgaaggguuacauaggcuuggauacauacuugaagaaaucgauaagaaagauggggaccugauguaugcugacgacacagccggcugggauacaagaaucacggaagaugauuugcaaaaugaagaacuaauaaccgaacaaauggccccacaucauaagauccucgcaaaagcgauauucaaguuaacguaucaaaauaaaguaguaaaaguacuuagaccaacuccacgaggggccguaauggacauaauaaguaggaaggaucagagggguucaggucaaguagguacauacgguuuaaauacuuuuacaaauauggaaguacagcucauaaggcaaauggaagccgaagguguaauaacucaagaugacaugcaaaauccgaaaggucugaaagaaagaguugaaaaguggcugcgagaauguggaguugacagguugaaaagaauggcuauaagcggugaugauuguguagugaaaccguuagaugaacgauuuggcaccucauuacucuuucucaaugauaugggcaaaguaagaaaagacauuccacaaugggagccaagcaagggauggaagaacuggcaagaaguuccuuucugcucacaccauuuccauaaaauauucaugaaagauggaagaucuuuagugguaccuugccgaaaccaagaugaacuaaucggcagagccagaaucagucagggugcgggcuggagucugagagaaacagcauguuuaggaaaggcauaugcacaaauguggucacuaauguauuuccacagacgugacuuacgguuagcaucaauggccauaugcuccgccguaccaacggaaugguucccuacaucuagaacuacauggucaauacacgcacaucaucaauggaugacuacggaagauauguuaaaaguauggaacagagucuggauugaagauaacccgaauaugaccgauaagacuccaguccauaguugggaagauauaccuuauuuaggcaagagagaagauuugugguguggaucccuaauaggauuaagcucaagagcuacgugggcgaaaaauauacauaccgcuauuacacaaguaagaaaucuaauagguaaagaagaauauguugauuauaugccgguaaugaaaagauacuccgccccaagcgaaucugaaggagucuuauaa

SEQ ID NO: 23674 - RNA, 9867 nt, Artificial Sequence
  derived and/or modified CDS sequence (opt6) from DENV-4__GU289913__SS-prME
ucgacgaucacacuuuuaugcuugauccccacaguuauggcauuucaucuaaguacaagagacggagaacccuuaaugauaguagcgaaacaugaacgcggucgaccucuucuauucaaaacuaccgaaggaauaaacaaaugcacacuaauugcaauggacuugggagaaaugugugaagacaccguaaccuacaaauguccacuauugguaaacacagaaccagaagacauugacuguuggugcaauuuaacgucgaccuggguaauguacgguacuuguacacaaucaggagaacguagaagagaaaaacgaucgguugcauuaaccccucauucagggaugggauuagaaacuagagcagaaacauggaugaguucugaaggagcauggaaacacgcccagcgcguugaaucuuggauucuaagaaauccggguuucgcuuuauuagcaggcuucauggcuuacaugauuggucaaaccgguauacaacgaacagucuuuuucgugcucaugauguuaguugcaccuaguuacggcaugagauguguaggaguaggaaacagggacuuuguugaaggagucagugguggcgcauggguggaccuuguauuggaacauggcgguugcguaacaacaauggcacaaggaaaaccuacgcucgauuucgaacucacgaaaacaacugccaaagaaguugcauuacuuaggacauacugcauugaagcaucaauaucgaacauuacgacagcuacaagaugccccacucagggagagccguaucucaaagaggaacaagaucaacaauacauuugcagaagagaugucguagaccggggauggggaaacggcugugggcuauuuggaaaaggagggguaguuacgugugcuaaauuuagcuguucggguaaaauaacagggaaucuaguacaaaucgaaaacuuggaguauaccguuguggugacaguucauaauggagauacucaugcaguuggaaaugauacgucaaaucauggagugaccgcaaugauuacaccucgaucuccaagcguagaaguaaaacugcccgauuacggagaacuuacauuagauugugaaccacgaucaggaauagauuucaacgaaaugauuuuaaugaaaaugaagaagaaaacuuggcuaguacacaaacaaugguucuuagauuuaccauuaccauggacagcaggagcugacacaagcgaaguucacuggaacuauaaagagcgaaugguuacuuucaaaguaccacaugcgaaacggcaagauguuacaguucugggaagucaagaaggagcaaugcauucggcauuagcgggugcgacugaaguggauucuggggacggcaaucacauguucgcgggccaucugaaaugcaaggugcguauggaaaagcuaagaauaaaaggaaugaguuauacuaugugcucuggcaaguucaguauagacaaagaaauggcagaaacucaacauggaacaacgguugucaagguaaaauacgaaggggcaggcgcaccguguaaaguaccuaucgaaaucagagaugugaauaaagaaaaaguggucggaagaaucauaucaucaacaccccuagcggaaaacacuaauucuguuaccaacauagaauuagaaccacccuuuggugauuccuauaucguaauagguguugguaacuccgcguugacgcuacauugguuuagaaaaggcucuagcauugguaaaauguuugaaucaacguaucgaggagcaaagagaauggcaauccuaggagaaacugcaugggauuucggcucagucgguggucuauucacuucacuagguaaagcagugcaccaaguauucgguucugucuauacaaccauguucggaggcgucucguggaugauuaggauucuaauaggguuucuaguucucuggauagguacaaauucuaggaauacaucuauggcaaugaccuguaucgcuguagguggaauuacacuguuucugggauuuacaguacaagcugauauggguuguguagucuccuggucuggaaaggagcuaaagugcggaagugggauauuuguaguggauaacguacauacauggaccgaacaauacaaauuccaaccagagucucccgcacgucuggcuucagcaaucuuaaaugcucacaaggacggcgucugcggaauccgaucgacuacucgauuagaaaauguaauguggaaacagaucacuaaugaacugaauuauguccuuugggaaggaggucacgacuuaacaguagucgcuggggacguuaaaggcguacucacgaaagggaaaagggcccugacgccacccguaucagaccuaaaauacaguuggaagacguggggaaaggccaaaaucuucacaccagaagcacgcaauucaacauuuuuaauagacgguccugauacaagugaauguccaaaugaacgacgggccuggaacucauuagaaguugaagacuacggguuugggauguucacaacgaauauauggaugaaauuuagagaaggaucaucagaaguuugugaccaucgguuaauguccgcugcaauuaaagaccaaaaggccguacacgcggacauggguuacuggauagagagcuccaaaaaucaaacuuggcaaaucgagaaagcuagucuaauugaggugaagacaugucuuuggccaaaaacucauacucuauggucaaacggugugcuagagagucagaugcuaauuccaaaaaguuacgcagguccauucagucaacauaacuaucgacaaggcuaugcaacccaaaccguagggccauggcauuuagguaaacuagaaauugacuucggagaaugcccaggcacuacuguaacaauacaagaagacugcgaccacaggggaccuaguuuaaggacaacaaccgcaucuggcaaacuuguaacccaaugguguugucgaucuuguacaaugccacccuugcgauuucucggcgaagacgguuguugguacggaauggaaauaagaccauuaagugaaaaagaagaaaauaugguaaaaagucaaguaacugcaggacaggguaccucugaaacuuucaguaugggccuacucugucuaacauuauucguagaggagugucuaaggagaagaguaacgagaaaacacaugauucuaguuguagucauaacauuaugcgcaaucauauuaggaggauuaacauggauggauuuacuaagagcacucauaaugcuaggcgacaccaugucaggaagaaucggagggcagauacaucuugcaauuauggcgguauuuaaaauguccccggguuauguccuaggagucuuuuuacggaaacucacaagcagagaaacagcgcuuauggucauaggcauggcaaugacaacaguauuaucaauaccacaugauuuaauggaacucauugaugguauaagccuuggccugauacuccugaagauagucacccaauucgauaacacacaagucgguacacuagcuuuaucgcuuacuuuuauucggaguacaaugcccuuaguuauggcauggagaacgaucauggcuguucuuuucguaguaacucugauaccucuaugcagaacgagcugccuccaaaaacaaagccacuggguagaaaucacagcuuuaauucuaggugcgcaagcacuuccgguuuaucuaaugacauuaaugaaaggagcuucccgacguaguuggccuuuaaacgaagggauuauggcaguuggccuaguuucacuacucgguucagcguuauugaaaaaugacguaccacuagcaggcccaaugguagcgggugguuuauuacuagcagccuacguuaugucuggaucaagugcagaccuuucucuagaaaaggcugccaauguacaaugggaugaaauggcggacauaaccgggucgagcccuaucauugaagugaagcaagaugaagauggcucauuuucuauuagagacguagaagagacaaacaugauaacucugcugguuaaauuagcgcuuaucacuguuuccggacucuauccuuuggcuauacccguuacaaugacauuaugguauauguggcaaguaaaaacacaacgaaguggagcucugugggacguuccuaguccugccgcaacccaaaaagcugcucucuccgaaggcguuuaccguauaaugcagagaggacuauuuggaaaaacccaggucggcguggggauucauauggaagggguauuucacacaauguggcauguaacgagagggucuguuaucugccacgagaccggacgacuggaacccucaugggccgauguucggaaugauaugauaucauacggaggcggcuggcgauugggcgauaaaugggacaaggaagaagauguucagguucuagcaauagaaccagggaaaaacccuaagcauguucaaaccaaacccggguuauucaagacauuaacaggugaaauaggcgcgguaacacuagacuucaagccggguaccucagggucaccgauaauaaaccggaaagguaaagucauugguuuauacggaaaugguguggugaccaaaucuggagauuauguaucagcgauaacgcaggcggaacguauaggagaaccugauuaugaaguagaugaagauauauuuaggaagaaacgucuaacuauaauggauuugcacccaggagcagguaaaacaaaaaggauauuaccgucgauuguucgagaagcacuuaaacgacgucuaaggacuuuaauauuagcucccacaaggguuguagcggcagagauggaagaggcacuucgagguuuaccaauucgguaccaaacaccagcaguuaaaagcgagcacacuggacgcgaaauaguagacuuaaugugccaugcaacuuucaccacuagauuauuaucauccacuagaguacccaacuauaaucuuauaguaauggaugaagcccacuucacagacccgucaucaguagcugcucguggguacauuagcacucgcguagaaaugggggaggcugcagccauauucaugacagccacuccaccgggugccaccgauccauuuccucagaguaacucaccaaucgaggauaucgaaagggaaaucccagagaggagcuggaauacaggauuugacuggauaacugauuaccaagguaagacuguaugguuuguuccuuccauuaaggcuggaaacgauauagcaaauuguuugagaaagucgggaaagaaaguuauacaacuaaguagaaaaacauuugacacagaguauccgaaaaccaaacugacugauugggacuuuguaguaacuacagacauaucagaaaugggggcgaacuucagagcaggaagaguaauugaccccagaaggugcuuaaagccaguaaucuugaccgaugguccggaacgcguuauucuagcaggaccuauuccaguaacacccgcaagugcugcccaaagacggggucguaucgggagaaauccagcccaagaagaugaucaguauguauuuagcggugacccccuuaaaaacgaugaggaucacgcccauuggacugaagcaaaaaugcuucuagacaacaucuauacuccagagggaauuaucccaacacuuuucggaccagagagagagaaaacucaagcuauagauggugaauuuagguuaagaggggaacaaagaaagaccuuuguugaauuaaugaggagaggugaccuuccaguuuggcuauccuacaagguugcaucagcagguauuucauauaaggaucgggaauggugcuuuacgggugagaggaauaaucaaauccuagaagaaaacauggaagucgagauuuggacgcgagaaggggagaaaaagaaacuccgaccccguugguuggacgcacguguauacgcagauccaauggcgcuuaaagauuuuaaagaguuugcgaguggucggaaaagcauaacuuuagacauccuuacugaaauagccagccucccaacauacuuaucuucucgagcaaaauuagcuuuagauaacauugucaugcuccauacaacagaaaggggcggcagagcauaucagcaugcuuuaaaugaguuaccugaaagccuggaaacauuaaugcucguggcauuacuaggagcaaugacugccggaauauuccuauucuuuaugcagggaaaaggcauaggaaaauuaucaaugggauugauaacaauugcuguagcgaguggacuccuauggguugcggaaauccagccgcaauggauagcugcaucaauaauuuuagaguucuuucucauggucuuacucauuccagaaccagagaagcaacguacgccccaagauaaucaacuaauauacguaauccucacgauuuuaaccaucauaggauuaaucgcagcuaacgaaaugggucugauugagaaaacuaaaacugauuuuggcuuuuaucaaguaaaaaccgaaacuacaauuuuagauguagacuuacgaccggccagugcauggacacuguaugcaguagccaccacgauccuaacuccaaugcuccggcauacaaucgaaaacacuuccgcaaaucuaucacuagcugcuauugcuaaucaagccgcuguacuuaugggucuuggcaaaggauggccacuucaucgaauggaucuuggagucccucuauuagcaaugggcugcuauagccaaguaaaucccaccacucuaacagcuagccuggugaugcugucaguacacuacgcaauaaucggaccgggccuucaagccaaagcaacccgugaagcacagaaacgaacggcugcuggaauaaugaaaaauccgacuguugauggcauaacuguaaucgaucuagaacccaucucauaugauccuaaauuugaaaagcagcuuggacagguaaugcuccuaguguugugugcaggucaauuacuuuuaaugagaacuaccugggcauuuugugaagugcucacucuugcgacaggaccuaucuuaacuuuaugggaagggaauccaggacguuuuuggaacacgaccauagcuguaagcacugcuaacauauuucgggggucauaucucgcaggagcuggccuugcauuuaguuugauuaagaaugcucaaacuccaagaagaggcacuggaaccacaggagaaacguuaggcgaaaaguggaaaagacaacuuaauagucucgaccgaaaagaguucgaagaauauaaacgaagugguauauuggaaguggauagaacugaagcaaaaucugcguuaaaagaugguucgaagauaaaacacgcugucagcagaggcaguaguaaaaucagguggauagucgagaggggaauggugaaaccuaagggcaaggucguugaucuuggauguggacgagguggauggucuuacuauauggcgacucuuaaaaauguaacagaaguaaaaggcuauacaaaaggaggaccaggacaugaggaacccauuccaauggccacauacggauggaaucuagugaaauuacauucaggaguagauguauuuuacaagccgacagaacagguugacacacuacuaugcgacauaggcgaauccaguucuaauccaacaauugaagaaggcagaacacuacgagugcugaagaugguagaacccuggcuuucuuccaaaccugaauuuuguauaaaaguauuaaauccauacaugccuacaguaauugaagaacuagagaaauuacaacgcaagcauggugggaaucucguacguugucccuuaagucgaaacaguacucacgaaauguauugggucucaggagcgucaggcaacauagucucuuccguaaauacgaccagcaagaugcuacucaaucgauuuacaaccagacaucgcaaacccacguaugagaaagauguagaucucggggcaggcacgagaucaguaaguacugagacugaaaaacccgacaugaccaucauagguagacguuugcaacgcuuacaggaagaacauaaagagacauggcauuaugaccaagaaaaccccuauaggacuugggccuaucauggcucauacgaagccccaagcacaggaagcgcuagcagcauggucaauggagucguaaaauuauuaacaaagcccugggauguaauaccaaugguuacgcaauuagcaaugacggauacgacuccauucggccagcaaagaguauuuaaagaaaaaguugauacaaggacgccacaaccgaaaccaggaacgagaaugguaaugacgaccaccgcaaauuggcuaugggcucuccuaggcaagaagaaaaauccacggcuauguacaagggaagaauuuauauccaaagugagaucuaaugcggcaaucggagccguguuccaggaagaacagggauggaccucggcuagcgaagccgucaacgauucaagauucugggagcuaguugacaaagagagggcgcuacaucaggaaggcaagugugaauccugcguguauaacaugaugggaaagcgcgagaagaaacuaggugaguuuggccgagcuaaaggaucccgugcgauaugguauauguggcuaggcgcaagauuccuggaauuugaggcauuaggcuucuugaaugaagaucauugguuugggcgugaaaauucauggucuggcguagagggggaaggucuccacaggcuggguuauauccuagaagaaauagacaagaaagauggcgacuuaauguacgccgacgauacagccgguugggacacgaggauaacagaagaugaucuacaaaaugaagaauuaauaacagaacagauggcaccccaucauaagauacucgcuaaagcgauuuucaaacucacguaccaaaacaaagugguaaaagugcugagaccuacaccaagaggagcggucauggacauaaucucaagaaaagaccaacgugguucaggucaagucggcacuuauggauugaacacuuucacuaauauggagguacaguuaauacgccagauggaggcggagggcgucaucacacaggacgacaugcaaaacccuaagggacuaaaagagcgaguagaaaaauggcuaaaagaaugugguguagaccgacuaaaacguauggccaucucuggcgaugauugugugguaaaaccucuugaugagagguuugggacauccuuacuuuuccuuaaugacauggggaaaguaagaaaagauauuccacagugggaaccgucaaaaggcuggaaaaacuggcaagaaguaccuuuuugcagccaucauuuucauaaaauauucaugaaagauggacguagccuagucguaccaugcagaaaucaagaugaguuaauugggagagcacguauuucucaaggugcggguuggucauuacgagagacagcgugcuuagguaaggcauaugcacaaauguggucucucauguacuuccauagacgggaucucagacuggcaucgauggcaaucuguucagcgguccccaccgaaugguuuccuacgucucguacgaccuggaguauccaugcgcaccaccaauggaugaccaccgaagauaugcugaaaguauggaauagagucuggauagaagacaauccuaacaugacugauaagacuccagugcacucaugggaggacauaccauauuuagguaagagagaggauuuauggugcggcucauuaauuggucuaucaucuagagccacuugggcuaaaaacauucauacugcaauuacacaaguuagaaauuuaauagguaaggaagaguaugucgauuacaugccuguaaugaagcgauauucggcacccagcgaauccgaaggaguauuguga

SEQ ID NO: 23675 - RNA, 9867 nt, Artificial Sequence
  derived and/or modified CDS sequence (opt6) from DENV-4__KJ579243__SS-prME
ucuacuauuacucucuuauguuuaauccccaccgucauggcuuuucaccugaguacuagggauggagaacccuuaaugauaguugcgaaacaugaaagagguaggccuuugcuauuuaaaacuacugaaggaauuaauaaauguacgcugauagcaauggauuuaggagaaaugugugaagauacugugacuuauaaauguccccuauuaguuaauacugaaccggaagauaucgacuguugguguaaucuuacuucaaccuggguaauguaugggaccuguacccagucuggugaaagacgaagagaaaaacgaucuguugcuuuaacuccccacagcggaauggggcucgaaacccgagcagaaaccuggaugucuagcgagggggcuuggaaacaugcccaaaggguugaaaguuggauucuuagaaauccaggauucgcguuguuagccggauuuauggccuacaugauaggucaaacuggcauucaacggacugucuucuuuguacuaaugauguugguagcuccaucuuaugggaugcguugcguggggguaggaaaucgagauuucguggaagguguuucgggaggugcguggguagaucuaguuuuagaacacggagguuguguaacaacgauggcacaaggcaaaccaacacuagacuuugaauugacuaaaacuaccgcaaaagagguagcacuacuaaggacuuacuguaucgaagcguuaauaucgaauauaacaacggccacgagauguccuacacaaggugagccuuacuuaaaagaagaacaggaccaacaauacauaugccguagagauguuguugauagaggaugggguaacggcugugguuuguuuggcaaaggcggaguaguaaccugcgcgaaauuuucauguucagguaaaauuaccgguaauuuagugcaaauugaaaauuuagaauacacaguaguaguaacuguucauaauggagauacucaugcuguagggaaugauacaagcaaccauggcgugacagcaacuaucacuccgagaaguccguccguugaagucaaacugccugacuauggugagcucacucucgauugcgagccuagaagugggauugacuuuaacgaaaugauacuaaugaaaaugaagaagaaaacuugguuaguacauaaacaaugguuuuuggauuugcccuuaccuuggacuacaggugcagauacaucggagguccauuggaacuacaaagaacgcauggugacauuuaaaguaccucaugcgaaaagacaagacguaacaguucuaggcucucaggaaggcgcgaugcauuccgcuuuagccggcgccacagaggucgauucgggagaugggaaucacauguuugcaggccaccuaaaauguaaaguuagaauggaaaaacuacguauaaaaggcaugaguuauacgaugugcagcgggaaguuuucuauagauaaagaaauggcagaaacacaacacggaaccacgguuguaaaaguuaaauacgaaggagcuggagcgccgugcaaaguaccaauagaaauccgagauguuaauaaggaaaaagugguuggccguguaaucagugcaacgcccuuagcagaaaacaccaacucagucacgaacauugaauuagaaccucccuuuggagauuccuauauuguaauagguguggguaauuccgcauuaacacuucauugguuucgaaaaggaucgucuauagguaaaauguuugagucuacuuacagaggugcuaaacgaauggcuauucuaggagagacggcgugggauuuuggaucuguaggagggcuauuuacgucucuaggaaaagcgguacaucaaguauucggcagugucuacacuacaauguuuggaggagucucauggaugauacguauauuaauuggaugcuugguccuuuggauagguaccaacucgaggaauaccagcauggcaaugacauguauugcaguaggugggauuacauuauuccugggauuuacaguacaggcggauaugggaugcgucgugaguuggagcggaagggaacuaaaaugcggaagugggauauuugucguagacaauguucauacauggacggaacaauauaaguuucaacccgagaguccagcacgcuuagcaucagcuauacucaaugcgcauaaggacgguguuugcggcauucgaucuaccacaagacuugaaaacguuauguggaaacagaucaccaacgagcugaauuacgucuuaugggaagggggccaugacuuaacgguaguagcuggugaugugaaagguguucuuacaaaagggaagagagcauuaacucccccagcaagcggucuuaaauauucauggaaaacaugggguaaagccaagauuuucacuccugaagcacgaaacagcacauuuuuaauagaugggccugauacuucagaaugcccuaaugagcgcagggcguggaacagcuuugaggucgaagacuacgguuuuggaauguuuaccaccaauaucuggaugaaauuccgagaagguucuuccgaagugugugaucacagacugaugagcgccgcuauaaaagaccaaaaggcuguccacgcagauaugggauauuggauagagaguuccaaaaaccaaacauggcagaucgaaagagcuagucuuauagaaguaaaaacuuguuuguggccaaaaacacacacuuuauggucgaacggcguguuagaaucgcaaaugcuaauaccaaaaaguuaugcuggucccuucucgcagcauaacuauagacagggcuacgcuacgcaaacaguuggaccauggcauuuaggaaagcuggaaauagauuuuggagaauguccaggaacaacgguaaccauacaagagaacugcgaccauagaggcccguccuugagaaccacaacagcgucaggaaagcuagucacccaauggugcuguagaucuuguacuaugccuccucugcgauucuugggagaagauggauguugguauggaauggaaauucgaccucuuucagaaaaagaggaaaacauggugaaaagccaaguaacagcaggacaaggaacaagcgagacuuuuucaaugggauuacuaugucucacacuuuuuguggaagaaugcuuacgucgccgcguaacaagaaagcauaugauacuggcagucgucaucaccuugugcgcuauaauccucggaggauuaacauggauggacuuguugagagcgcuaauaauucuaggugauacgaugucuggccgcauugguggacaaacacaccuagcaauaauggcaguuuucaaaaugucaccgggauauguucuaggcguauuuuugcgaaagcucaccucacgcgagacagcucuuauggugauaggaauggccaugacaacuacgcuaagcauaccacaugaucuaauggaauuaauugauggaauuuccuuaggacuuauauuauugaagauugucacacaauuugauaacacucaaguaggcacacuugcacuaucguuaacguuuauaagaagcacaaugucacucguuauggcguggagaacaauaauggcaguuuuguucgucguuacguuaauuccacuuugucggacaaguugucuacaaaaacaaucccauugggucgagaucacugcgcugauacuaggcgcacaggcguuaccuguauaccuaaugacacuaaugaagggcgccucgcgucgcagcuggccauuaaacgagggaaucauggcaguugguuuagucucacuacuaggaagugccuuauugaaaaacgauguacccuuagcaggccccauggucgcagggggacuucuauuagcggccuauguuauguccgguuccucagcagauuuaagucuagagaaagcugccaaugugcagugggaugaaauggcugacauuaccgggucaucucccaucauagaagucaaacaagaugaagaugggucauucucaauacgggauguagaagaaacaaauaugauuacacuauugguaaagcuagcacuaauaaccguaucuggacuauacccucuugcaauccccaucacaaugacuuuaugguauauguggcaaguaaaaacacaaagaucaggugcgcuaugggauguucccucaccagcagcgacgcaaaaggcggcgcugucggaggguguguacagaauaaugcaacgcggccuguuuggcaaaacucaaguaggaguagguauucacauggagggaguauuucacacaauguggcacguaacacgaggaagcguuauuugccaugaaacagguagauuagaacccagcugggcugacguacgcaaugauaugauuucuuacggaggaggauggaggcuuggagauaaaugggacaaagaagaagaugugcaagugcuagccauagaaccuggcaaaaauccaaaacacguccaaacgaagccuggauuauucaagacguugacgggagaaauuggagcaguaacacucgauuuuaagccugguacaaguggaucuccuauuauaaaucguaaaggaaaaguaauagguuuauaugguaauggaguaguaaccaagagcggagauuacgugucagcuauuacacaagcagaaagaauuggcgagccagauuacgaagucgacgaggauauuuuuagaaagaagcgguuaacuauaauggaccuucacccuggcgcaggaaaaacuaagcggauauuacccuccauuguccgagaggcacuaaaacgcagacuuagaacccucauucuagcuccaaccagaguaguagccgcugaaauggaggaagcauuacgcggauugccgauuagauaucaaacaccagcuguaaagucugaacacacaggaagggaaauaguggauuuaaugugucaugcaaccuuuacuacgcgauuauugucaucuacacgcguaccaaauuauaaucugauuguaauggaugaagcccauuuuacugacccuaguagcguugcagcuaggggauauauuagcacacguguugaaaugggcgaagccgccgccaucuuuaugacggcuacaccuccuggagccacagacccguuuccacaaucaaauucucccaucgaagauauugaaagagaaauaccagaaagaagcuggaacacaggcuucgacuggaucaccgauuaucaaggaaaaacagugugguuuguccccuccauaaaagccggcaaugauauagcuaauugucuaagaaaguccgggaagaaaguaauacaauuaagccguaaaacguuugauaccgaguauccuaaaacaaaauugacagauugggacuuuguaguuacgaccgacauuucggaaaugggagccaacuuucgagcagggaggguaauugauccuaggagauguuuaaaaccuguuaucuugaccgauggaccugaaaggguaauccuggccggcccaauaccgguaacgccagcaagugcagcgcagcgucgugggcguauugggagaaacccggcgcaggaggacgaucaguauguguuuucaggggauccccugaaaaaugaugaagaucaugcgcacuggacggaggcgaagauguuguuggacaacauauauacaccagaaggaauuauaccgacacuauucggaccggaacgagagaaaacgcaagccauagauggagaauuucgccuucgaggagaacaacgaaagacguucguugaauuaaugagaagaggggaucugccaguuugguuaucuuauaaaguagcgucagcagguauuucauauaaggaucgcgaaugguguuucacuggcgaaagaaauaaucaaauauuggaagagaauauggaaguugaaauuuggacaagagaaggagagaagaagaaauuacgacccaaaugguuggaugcgagaguauaugcggauccuauggcacuaaaagauuuuaaggaauuugcaucaggaaggaagucaauaacacuugauauucuaacggaaauagcgucucuccccacuuaucuuaguucccgagcuaaauuagcacuugauaauauuguuaugcuacauacaacagaacgaggaggaagggcauaccaacacgcacugaacgaacuaccagaaagucucgaaacucuuauguuaguagcacuucugggagcaaugacugcuggaauauuucuauucuuuaugcaaggcaaagggauaggaaaguuauccaugggcuuaauuaccauagcaguagcaucuggacugcuauggguagcggaaauacagccacaauggauagcugcgagcauaauacuagaguucuuucuuaugguccuacuuauaccugagccggaaaaacagcggacuccccaagauaaucaauuaauuuacguuauccuuacaauccugaccauaauuggucuaauagcagccaacgaaaugggacuaauagagaaaacuaagaccgauuuuggcuucuaucaagucaaaaccgagacaacaauccucgaugucgaucuccgacccgcuucugcguggacauuauacgcaguagcaacaacaauucuuaccccgaugcuaagacauacaauagaaaacacuucagcaaaucuuaguuuagcugcgauagcgaaucaagccgccgucuuaaugggauugggaaaaggcuggccauuacacaggauggaucucgggguaccauuauuagcuaugggcugcuacagucaagugaacccgacuacgcuaacggcaaguuugguaaugcuacugguucauuaugccauaauaggaccaggucugcaagcgaaagcuacgcgcgaagcgcaaaaacguacugcagcgggcauuaugaaaaaucccacuguagauggaauaacgguuauagauuuggagccuaucucuuaugacccuaaguucgagaagcaacuaggacaagugaugcuuuuaguucuuugcgcaggacaacugcuuuugaugcggacuacuugggcuuuuugugaagucuuaacacuagcaacugggccaauacugacauuaugggagggaaauccagggcgguuuuggaauacgacuauagcgguuucaaccgcaaauauauucagggguaguuaucuagcaggagcugguuuagcauucucauuaauaaagaacgcacagaccccaaggagaggcacaggaaccgcuggugaaacguuaggugaaaaguggaaaaggcaauuaaauuccuuagacagaaaggaauuugaagaguauaaaagaaguggaauauuagaaguagaucggacugaggcaaaaucagcauuaaaagacgggucgaaaauaaaacaugcuguaucgcgugguuccucuaaaauacgauggauaguagaaagaggaaugguuaagccaaaaggaaaagucguggaccuggggugugggaggggugguuggaguuauuauauggcuacucugaagaacguaacagaaguuaagggcuauacaaagggaggaccaggucaugaggaaccuaucccgauggccacauacggcuggaauuuaguaaaauuacauucuggaguugacguauuuuauaagccaaccgaacaaguugauacacuguugugugauauaggcgaaaguucuucgaacccaacuauugaagaagggagaacuuuacgagugcugaaaaugguagaaccauggcuaaguucuaagccggaguuuugcauaaaaguauuaaacccauacaugccaacagugauagaagaauuagagaaauugcaaagaaaacacgguggaaauuuaguaagauguccacuaaguagaaauaguacucacgaaauguauugggugucuggugcuaguggaaacauagugaguagcgucaacacuacaagcaagaugcuccuaaaucgauuuaccacaagacaccguaagcccaccuacgagaaagauguagaccugggagccgggacuagaucaguaaguacggaaacagaaaagccugauaugacaauaauaggccgaagacuacaacggcuucaagaagaacauaaagaaacauggcacuaugaucaagaaaauccauauagaacaugggcauaccaugguucuuaugaagcaccgagcacgggaucugcuaguuccaugguaaaugggguuguuaagcuccuaaccaaaccuugggacguaauaccaaugguaacgcaauuagccaugacugauacuacucccuucggucaacaaaggguauuuaaggaaaagguugacacucgaacgccucaaccgaagccuggcacgcgaaugguuaugaccacaacggcaaauugguugugggcacuuuuaggcaagaagaaaaauccucgucucuguacaagggaggaauuuauaucaaaagucaggucaaaugccgcuaucggagccgucuuucaggaagaacagggcuggacaucagcaucagaggcagucaaugacagucgauuuugggaauuaguggauaaagagagggcuuuacaucaagaagggaaaugcgaaucaugcguuuacaauaugaugggcaaacgugagaagaaauuaggggaauuugguagagccaaagguaguagggccaucugguacauguggcucggcgcuagauuuuuggaauuugaagcguuagguuucuugaaugaagaccauugguucggaagagaaaacucguggucugggguugaaggggaagguuugcacagauugggguauauucuggaagaaauagacaaaaaggacggcgauuuaauguaugcggacgauacggcaggaugggauacuagaauuacagaagacgaccuucaaaaugaagaauuaauuacggagcaaauggcgccacaucacaaaauccuagccaaagcuauuuuuaaacucacauaccaaaacaaaguggucaaagugcuaagaccuacaccacgaggagccguaauggacauaauaucuagaaaggaccagcggggcuccggacaagucggaacauauggacuaaacacauucacaaacauggaaguacaacuuauacgacagauggaagccgaaggaguaauuacucaagaugauaugcaaaauccgaagggcuuaaaggaacgaguagaaaaauggcucagggaaugcgguguggauagguuaaaaagaauggcuauaucaggugacgauugugucgugaaaccucuugaugaaagauuugguacuucgcuacuuuuucuuaaugacauggguaagguacggaaagauauuccacaaugggagccuucuaagggcuggaagaacuggcaagaaguaccauuuuguucccaccauuuucauaaaauauuuaugaaagauggaagaucuuuaguaguaccgugucgcaaucaagacgaguuaauuggacgggcgcgcauuucgcagggagcaggauggagucuacgggaaacugcgugucuaggaaaagcauaugcucaaauguggaguuuaauguacuuccauagacgugaucuucgacuagcgucuauggcgauaugcagugccguuccaaccgagugguucccaacaagcagaacuaccugguccauacaugcacaucaucaauggaugacuacugaagacaugcucaaaguauggaaucgaguuuggauugaagacaauccaaauaugaucgacaagacacccguacauucaugggaggacaucccuuaucuagguaaaagagaagauuuaugguguggaagccucauuggauugaguucccgagcuacgugggccaaaaacauucauacggcaaucacucaagucagaaaucuuauuggaaaagaggaauauguagacuauaugccaguaaugaagagguacucggcaccuuccgagagcgagggcguauuguga

SEQ ID NO: 23676 - RNA, 9867 nt, Artificial Sequence
  derived and/or modified CDS sequence (opt6) from DENV-4__KJ579246__SS-prME
ucgacaauaacccuucucuguuuaauucccacgguuauggcguuucacuuaucaacacgcgacggagaaccuuuaaugauagucgcgaaacaugaacgagggagaccacuacuauuuaaaacgacagaagggauaaauaaauguacacuuauagcgauggaucucggagaaaugugugaggauacagucacguacaaauguccacuauuaguaaauacagaacccgaagacauagacuguuggugcaauuuaacuucuacguggguaauguauggaacguguacacaaagcggcgagaggagaagagagaaaagaucaguagcucuuacuccccauagugguaugggauuagaaaccagggcggaaacauggaugucaucagaaggugcuuggaaacaugcacagcgagucgagaguuggauauuaagaaauccaggcuucgcgcucuuagcaggauuuauggcuuauaugauaggccagaccgguauacaaagaacuguguuuuucgugcuuaugaugcuaguugcaccgaguuaugguaugagaugcgucggcgucggaaacagagacuuuguugaagguguuagcggaggagcguggguagauuugguuuuggaacacggagguugcguaacuacaauggcucaagggaaaccaacacuagauuucgaacuaaccaaaacaacagcuaaagaaguagcucucuuaagaaccuacugcaucgaggcguuaauuucuaauauuacuacagccacacggugcccaacacaaggggagccuuauuuaaaggaggaacaagaccaacaguacauaugccgucgagauguaguagaccguggaugggguaauggaugcggauuauuuggaaagggagguguaguuaccugugcaaaauuuagcugcucagguaaaauaacaggaaaucuuguucaaauagaaaauuuagaguauacagucgucguaacuguucauaacggagacacccacgcagugggcaaugacaccaguaaucacggaguaacagcuacaaucacaccuagaucaccgucaguugaagucaaacuaccugacuauggagaacuuacauuggacugcgaaccucgcagcggcauugacuuuaacgaaaugauacuuaugaagaugaagaagaaaacaugguugguucacaaacaaugguuccuagaucuaccguugccguggacgacgggcgccgauacauccgaaguccacuggaauuauaaagaaagaaugguaacauuuaaaguaccucaugcaaagagacaagaugugacuguuuugggaucacaagaaggugcuaugcacucugccuuggccggugcuacugaaguggauaguggugaugggaaucacauguuugcaggacaucuaaaauguaaagucagaauggagaaacucaggauaaaaggaaugucguacaccaugugcuccggaaaauuuaguauagacaaggagauggcugaaacgcagcauggaacgacggucguaaaaguuaaguacgaaggagcaggagcucccugcaaagugccaauugaaauacgggauguuaacaaggagaagguuguuggaagagugauaagugcaacaccucucgccgaaaacacaaauucuguuacuaauauagagcuugaaccaccuuuuggggacucuuauaucgugauugguguugggaauagcgcguuaacauuacauugguucagaaaagggucauccauagguaaaauguuugaaucuacauaucgaggcgcuaaacguauggccauccuuggagagacggcaugggauuuuggaagcguaggaggucuuuucacaagucuagguaaagcaguacaucaaguguucggaaguguguacacaacaauguuuggaggcguaucuuggaugauacggauucuaauuggauucuugguacuauggaucggaacuaauucaagaaauacaucaauggccaugaccuguauugcuguaggugguaucacacuuuuucucggguucacuguacaggcagauauggggugcguaguaaguuggagcgggagagaauuaaaaugcggcagugguauuuucguuguugauaacguacauacuuggaccgaacaauacaaauuccaaccagaauccccagcuagauuggcuucagcaauacuuaaugcacauaaagacgggguuugcgguauaagguccacaacuagauuagaaaauguuauguggaaacaaaucacaaaugaauugaauuauguucuaugggaaggagggcaugaucuaacgguaguugcaggggauguaaaagguguguuaacuaagggcaaaagagcccuaacuccuccugcuucagaucuaaaguauucauggaaaacaugggguaaagccaaaauuuuuacgcccgaagccagaaauuccacauuuuuaauagauggaccugauaccucugaaugcccuaaugaacgaagggcuuggaacucauuugagguugaagacuacggguucggaauguuuacaacaaauauauggaugaaauuucgggaagguuccucagaaguaugugaucauagauuaaugagcgcagccauuaaagaucagaaagccgugcaugcggauauggguuauuggauagaauccagcaaaaaccaaacauggcaaauagaacgggcaaguuugauagaagucaagaccugcuuguggccuaagacacauacucuuuggaguaacggagugcuggagucccaaaugcuaauaccaaagaguuaugccgggccauuuagucaacauaauuacagacagggguaugcgacacagacgguuggaccauggcaucuaggaaaacuagaaauagacuucggcgaaugcccugggacaacagugacuauucaggaaaauugugaccauagaggaccaagucuacggacaacaacugcaaguggaaagcuggugacacagugguguuguagaucguguacaaugccgccguuacgauuucucggagaagacggaugcugguaugggauggaaaucagaccccuuucagaaaaggaagaaaauauggucaaaucacaaguuacagcuggacaagguacgucugaaacuuucagcaugggucuacucugcuugacacuauucguggaggaaugccuacgacguagaguaacuaggaaacacaugauauuagcaguuguaauaacacugugugcaauuauauuagguggucuaaccuggauggacuuacuccgugcacugauuauccuuggggacacaaugucgggacguauaggaggucaaacccaccucgcaaucauggccguguucaaaaugucgccuggauauguuuuaggaguauuuuugaggaaauuaacuuccagggaaacagcacuuaugguaauugggauggccaugacaacgacauugucaauuccucacgacuuaauggaauuaauagacgguaucaguuuaggguuaauccuuuuaaaaauuguaacacaguucgauaauacacaaguaggaaccuuggcccugucauuaacauucauaagguccacaaugagcuuggucauggcauggcgaacaauuauggcgguucuauuuguaguuacuuuaaucccucuaugucguacaaguuguuugcaaaaacaaagccacuggguugagauuacagcgcuaaucuuaggagcucaagcacuuccaguuuauuugaugacucuuaugaaaggggcaucuaggcgaucuuggccccuaaacgagggaauaauggcggucgggcuagugagccuacugggaucagcguugcuuaaaaaugauguuccgcuagcggggccaaugguggcuggaggucuccuccuagcugcauauguaaugagcgggaguagugcugauuugagcuuagaaaaagcugcaaauguucaaugggacgagauggcggauauaaccgguuccucaccaaucauagagguaaaacaagacgaggacgggaguuucucaauaagggauguugaagagacaaauaugauaacacuauuagugaaguuagcacugauaacagugucuggucuguauccacuagcuaucccuauuacuaugaccuuaugguauauguggcaaguuaagacacaaagaucuggcgcacuuugggaugucccaaguccugcggcaacacaaaaggcugcgcucagugaaggugucuauaggauuaugcagagaggacuauuuggaaagacacaggucgguguaggcauucauauggaaggaguguuucacacaauguggcauguuaccagaggcaguguaauaugucacgaaacgggccgucuggagccaagcugggcagacguaagaaaugauaugauuagcuauggaggggguuggagacuaggagauaaaugggauaaagaagaggacgugcaaguccucgcaauagaaccagguaaaaacccaaagcacguccaaacaaaaccaggacuuuuuaagacguuaacgggggaaauaggagcuguaacucuggauuucaagcccggaacauccggauccccaauaauaaaucguaaaggaaaaguaauaggacuuuacgguaacggaguuguaacaaaaagcggggauuacguuagugcaaucacacaagcggaaagaauaggagaaccagacuacgaaguagaugaagauauuuuucgaaagaaacguuuaaccauaauggaccugcauccuggagcuggaaaaacgaaacgcauacucccuucaauaguccgugaagcauugaagcgaagguuacguacucucauccuugcaccuacccguguggucgcggcugaaauggaggaggcuuuacguggauugccaauacgauaucagacuccugcugugaaguccgaacauacagggagagagauaguagacuuaaugugccaugcaacauucacaacuagacugcuaucgucuacgagagugccuaacuacaacuuaauaguaauggaugaagcacauuuuacugauccuuccaguguugcugcacgaggauacauaucaacccgaguagaaaugggagaagcugcggcaauuuucaugacagcuacaccacccggugcgacggacccguuuccucaaucgaacuccccgauagaagacauagagagagaaaucccggagcguaguuggaauacaggguuugacuggauuacagauuaccaaggaaagaccguuugguuugugcccucgauaaaagcuggcaaugauauugccaauugccuaagaaaauccgggaagaaaguuauucaauuaagucggaaaacauucgauacagaguacccaaaaacaaaacugacugacugggacuuuguagucacgaccgacauuagugaaaugggggcgaacuucagggcugggcgaguuauagacccgcggagaugucuaaaaccuguaauucucacugacggaccagaacguguaauauuagcgggaccaauaccuguuacuccugcaucugcggcacaacguagaggucgaaucggccgaaaucccgcacaagaggacgaccaauacgucuucucgggagacccacuuaaaaaugaugaagaccacgcccacuggacugaagcaaaaauguuguuagauaauauauacacaccggaagggauuauaccaacauuauuugggccggaaagggagaaaacgcaagcaauagauggugaguuucgauuacgaggagaacagaggaaaacauucguagaacuaaugaggcgaggagauuuacccgugugguuaaguuacaaaguagcaucagcagguauaagcuacaaagaucgugagugguguuucaccggagaaaggaacaaucaaauccucgaagagaauauggaggucgagauauggacaagagaaggagagaaaaagaaauuacgaccaaaauggcuagacgcuaggguuuaugcagacccgauggcauuaaaagacuuuaaagaauuugcaaguggcagaaaaucaaucacguuggauauucuuacugaaauagcaucccugccaacuuauuuguccucucgagcuaaguuagccuuagacaacauuguuaugcuacacacuacggaacguggaggacgcgcguaccaacacgccuugaacgaacugccagaaucucuagaaacauuaaugcuagucgcgcuguuaggagcaaugacugcagguauauuuuuauucuuuaugcaaggaaaaggaauagguaaacuaaguaugggauuaauaacgauagcaguugcaagcgggcuuuuauggguggcggaaauucaaccccaauggauagcggcaucgauaauucucgaguucuuucuaaugguauugcuaauaccagaacccgaaaaacagagaacaccccaagauaaucagcuaauauauguuauacuuacaauuuugaccaucauaggacuaauugccgcgaacgaaaugggacugauagaaaagacgaaaacagauuuuggauuuuaccaagucaaaacagaaacgacuauacuagacguagauuuaagaccggcaagcgcauggacauuauaugcaguugcaaccacaauacuuacuccaauguuaaggcauacaaucgaaaauacgucagcaaaucugucacuagcagccaucgcgaaucaagccgcuguauuaaugggucuagggaaagguuggccucuccacaggauggauuugggugucccuuuauuagcaaugggguguuacucacagguuaacccaacaacucuaacggcgucucuaguaaugcuacugguacauuaugcaauuauaggaccuggacuacaagccaaagcgacaagagaagcccaaaaacgcacugccgcuggcauaaugaaaaaccccacaguagauggaauuaccguaauagaucuagaaccgaucuccuacgauccgaaauucgaaaaacaauuaggucagguaaugcuauuagugcuaugugcgggccaguuacucuuaaugagaacuacaugggcuuuuugcgaaguauuaacguuagcaaccggcccaauccucaccuuaugggaagggaaccccgguagauuuuggaauacaacaauugcaguauccacagcgaacauuuuuagggggagcuauuuagccggugcagguuuggccuucagucuaauaaagaaugcucagacaccccgaagagggaccggaacggcaggagagacauugggugaaaaguggaaacggcaacuaaacagcuuggaucguaaggaguucgaagaauauaaaagaucuggaauacucgaaguugauagaacggaagcaaaaagcgcguugaaagaugggucgaaaauuaaacacgcaguaagccggggaagcucgaaaauuagauggauugucgaacgugguauggucaaaccaaaggguaagguaguagaucuggguuguggaagaggagguuggucauauuauauggccacucuaaagaaugucacugaagucaaaggauacaccaagggugggccaggacacgaagaaccgauaccaauggcgacauacgguuggaaucuaguaaaacugcacucagggguagacgucuuuuacaaacccaccgaacaagucgauacauuacugugugacauaggugaaagcaguagcaauccuacaaucgaggaaggaagaacgcuacgcguuuugaaaaugguugaaccgugguuaucaucuaaaccagaguucuguauuaagguacuaaauccauacaugccuaccgucauagaagaacuggaaaagcuccagcgaaaacauggggguaaucuaguacgcuguccuuuaaguagaaacagcacucaugaaauguauuggguaucaggcgcaucgggaaauauaguuucuuccguaaacacaacgagcaagaugcuucuuaaccgcuucacaacccgucauagaaaaccaacauacgaaaaagacguagauuuaggagcuggcacacgaucaguaucuacagaaacugaaaaaccagauaugaccauuauagggcgaagacuacaaagacuucaagaagaacauaaagaaaccuggcauuacgaccaggaaaaccccuacaggacuugggccuaucauggaucuuaugaagcuccaucaacggguuccgcuaguucuaugguuaauggaguggugaaacuccucacgaaaccuugggaugugauaccaaugguaacacaauuagcuaugacggauacuacgccuuuuggacaacaacgugucuucaaagaaaaaguagauaccaggacaccgcagccaaagccaggaacgcgaauggucaugacuacuacagcuaacugguugugggcucuccuagguaagaagaaaaauccucgucuuuguacgcgcgaagaguucaucucgaaagugagaucaaacgcagccauaggagcaguuuuucaagaggaacagggcuggacuucagccucagaagccgugaaugauagucgauucugggagcuagucgacaaggaaagagcuuuacaccaagaaggaaaaugcgaaaguuguguauauaacaugaugggcaaaagagagaagaaauuaggcgaauuuggcagagcaaaagguagucgugcaaucugguauauguggcuaggcgccagauuuuuagaauuugaggcauuagguuuccucaaugaagaucacugguuugguagggaaaauucauggagcggaguggagggggaaggacuacacagauuagguuauauucuggaggaaauagacaagaaagacggagauuuaauguaugcagacgauaccgcugggugggauacaagaaucacggaagacgaccuacaaaacgaagaacuuauaacagaacaaauggcaccacaucacaagauacuagcaaaagcaauuuuuaaguugacauaccaaaauaaaguuguaaaaguguuacgucccacaccacgcggagcgguuauggauaucaucagcagaaaagaucagagaggcagcggccaaguuggcacuuacgguuuaaacacauucacaaauauggaaguacaguuaauaaggcaaauggaagcugaaggcguuauaacacaggaugacaugcaaaacccaaaaggacuaaaggaaaggguagaaaaaugguugagagaguguggugucgacagacucaagagaauggcuauuagcggggacgacugcgugguuaaacccuuagaugaaagguuugguacaucccucuuauuccuuaaugacaugggcaaagugagaaaagauauuccacaaugggagccuaguaaaggguggaagaauuggcaagaagucccguucugcagccaucauuuucauaagaucuuuaugaaagauggucgcuccuuggugguacccugccguaaucaagaugaauuaauaggcagagcaagaauuucccaaggggccggguggagucuuagagagacugcaugucugggaaaggcuuacgcgcagauguggucucuuauguauuuucaccgaagagacuugagacucgccaguauggccauuugcucagccguuccaaccgaaugguucccaacaucacgaacgacauggucaauacacgcccaccaucaauggaugacaacagaagauauguuaaaaguauggaaucgcguuuggaucgaagacaacccuaacaugauagauaaaacgccaauucacaguugggaagacauuccuuacuuaggcaaaagagaagauuugugguguggaucacuaauugggcugucaucgcgcgcgacaugggccaagaauauucauacagcuauaacacaagugcggaacuuaauaggaaaagaagaauauguugacuacaugccgguuaugaaacguuacagugcacccucagaaagcgaaggaguacuuuaa

SEQ ID NO: 23677 - RNA, 9867 nt, Artificial Sequence
  derived and/or modified CDS sequence (opt6) from DENV-4__KJ579248__SS-prME
uccacuauaacucucuugugucugauaccaacaguaauggccuuucaccugucuacacgggacggggaaccacuuaugaucguagcaaaacacgaaagaggccgaccucuuuuauuuaaaacuacugaagggauaaauaaaugcacucugauagcgauggauuuaggggaaaugugugaagacacaguuacuuacaaaugcccacuauuagucaauacagagccagaagauauagacugcuggugcaacuuaacuucuacguggguuauguauggcacaugcacccaguccggugagcgaagacgggaaaaacguaguguggcauuaacaccacauuccgguauggggcuugaaacaagagccgaaacguggaugagcucugagggcgcauggaaacaugcucagcgagucgaaucguggauacuaagaaacccagguuucgcacuauuggcaggauuuauggcauauaugauuggccaaacggguauucaaagaacaguauuuuucguccuaaugaugcuaguggcuccaucuuacgggaugcgaugcguagguguggggaauagggauuuuguagaaggcgucucagguggagccuggguugaccuaguccuugagcauggugggugugucacaacaauggcucaggguaaacccacccuagauuuugagcuuacuaaaaccacagcuaaagaaguagcuuuacuacggacuuacuguauugaagcauuaauauccaacauuacuacugcaacaagguguccaacccaaggagagccauauuuaaaagaagaacaggaucagcaauauauuugccgucgggauguaguugacagaggauggggcaaugguuguggacuuuuuggaaaaggaggaguuguuacaugugcuaaauucucauguucuggaaaaauaacuggaaaucugguacaaauugaaaaucuugaguauaccguaguuguaaccguacacaauggcgacacccacgcaguagguaaugacacaaguaaucacgguguuacugcaacgauaacaccaagaaguccguccguagaagugaaacuuccugauuauggugaacuuacccuggauugugagccacgaaguggaauagauuucaacgaaaugauacugaugaaaaugaagaagaaaacuuggcucguacauaaacaaugguuucucgauuuaccucuacccuggacaacgggcgcugauacaagcgaaguucauuggaacuauaaagaaagaaugguuacauucaaagugccucacgcuaaaagacaagauguuacaguuuuaggaucccaggagggugcaaugcauagugcacucgccggugcaaccgaaguugauucaggagacggaaaucacauguuugcagggcaucucaaaugcaaaguaagaauggagaaauuaagaauaaaaggcaugaguuacaccauguguagugguaaauucagcauagauaaagagauggcggaaacucaacacggaacaacuguagucaaaguuaaauacgaaggugcgggugcaccuuguaaaguuccaauugaaauucgagacguaaacaaagaaaaagucguaggcagaguaaucagugcaacgccucuagcagaaaacacuaacucaguuacuaauauagaacuugaaccuccuuuuggggauucuuauaucguuauugguguuggaaauagugcacuaacgcuacauugguucagaaaaggaaguucgauuggaaaaauguuugagaguacguacagaggagccaaacguauggccauucucggagaaacugccugggauuuuggcucaguaggagguuuauucacuucucuaggcaaagcuguacaccaaguauucggaucuguauacacuacaauguuugguggagucaguuggaugaucagaauuuuaaucggauucuuaguauuauggauaggcaccaauucaaggaacacaaguauggccaugacauguaucgcggucggaggaauaacacuauuucugggauucacgguucaggcagacaugggaugugucgugagcuggagcgggagagagcuaaaauguggaaguggaauauucguugucgauaaugugcacacauggaccgaacaauacaaauuucagccugaaaguccggcacgucuugcuucagccauccucaaugcacauaaagacggagugugcggaauacguuccacaacaagacucgaaaauguaauguggaagcagauaacaaacgaguuaaauuauguccuaugggaagggggacacgaucuuacuguaguugcaggcgacgucaaaggaguguuaaccaaagggaagagggccuuaacucccccugcgucagaucugaaauacucauggaaaacauggggaaaggccaaaaucuucaccccagaagcgcgaaacuccacguuucugaucgauggaccagacacuagcgaauguccgaacgagcgacgugccuggaacucguucgaaguagaggauuacggguucggcauguuuacuacuaauauauggaugaaguuuagagaaggaagcagugaagucugcgaccaucgauuaaugagcgcagccauaaaagaucagaaggcuguccacgcugauauggguuacuggauugaaucgagcaaaaaucagacauggcaaauagagcgugcaagucuuauugaagugaaaacaugccuuuggcccaaaacacauacgcuuuggucaaacggcguacuagaaagccaaauguugauuccuaaaucuuaugcaggacccuuuucucaacacaauuauagacaggguuaugcaacacaaacgguuggaccuuggcacuugggaaaguuagaaauagacuuuggagaaugcccagguaccacaguaaccauacaagagaauugugaccauaggggacccucauugcgaacgacgacagcuagugguaaacucguaacucaaugguguugccgaagcugcaccaugccgccuuugagauuucugggagaagacgguuguugguauggaauggaaauaaggccgcuuagcgaaaaagaagaaaauaugguaaaaucacaaguaacagccggccaggggacuagcgagaccuuuagcauggggcuacuuugccuuaccuuguucguugaggagugccugagacgacgugucacgaggaaacacaugauacuugccgucguaaucaccuuaugcgcaauuauacuugggggcuuaacauggauggaccuacuaagggcccucauaauguuaggugauacgaugaguggacgcguugguggacaaacacaccuagcgauuauugcagucuucaaaaugagcccaggguacguuuuagguguauuucugcgaaaacuaacuuccagagagacggcccuuaugguuauugggauggcgaugacaacuacauuaucuauuccucaugaccuaauggaacuuauugauggcauaagucuugguuuaauccuauugaaaaucguuacacaauuugauaauacacaagugggaacauuagcauugucacuaacauuuauacgcucuacuaugagucucgucauggcuuggcgcacaauaauggcgguauuauuugucguaacacugauaccacuauguagaacgaguuguuuacaaaaacaaucacauuggguugaaaucacagcguuaauacucggagcucaagcacuaccggucuaucuaaugacguuaaugaagggagcuucccggagaucuuggccacucaacgagggaauaauggcggucggucuaguuucccuauuaggaucggcuuuguuaaagaaugauguaccacuagcuggucccaugguugcugguggguuauuauuagcggcauacguuaugucugguagcucagcagaucuuuccuuggaaaaggcagcaaauguacaaugggaugaaauggccgauauaacaggaucuucuccaauuauagaggucaagcaagacgaggauggcagcuuuaguauucgcgaugucgaagaaacgaauaugaucacucuuuugguaaaauuagcgcucauaacggugucaggauuauauccucuagcaauaccuaucacuaugacauuaugguauauguggcaaguuaaaacacaaagaaguggugcacuaugggacgugccaagccccgcagcaacacaaaaggcggcuuuaagcgaggguguauacaggauaaugcaaagaggccuguucgguaaaacacaaguuggaguggguauccacauggaaggcguauuccauacgauguggcacguaacaagggguuccgucauuugucacgaaacaggaaggcuggaaccaaguugggcugauguuagaaaugauaugauaucauauggaggugguuggagacucggagacaagugggacaaagaagaagauguccaagucuuagcaauugaaccagguaaaaacccgaaacauguccaaacuaaaccuggucuuuuuaaaaccuuaacuggcgaaauaggugccguuaccuuggauuucaaaccgggaacaagugggagcccuauaauaaaccgaaaagguaaaguaauuggauuauaugguaacggaguaguaacaaaaucuggugauuauguauccgcaauaacccaagcugagcgcauaggugagccagacuacgagguugaugaagauauauuucgcaaaaagagacuuacuauaauggauuuacauccaggagcaggcaaaacuaaacguauauugccuucuauaguacgggaggcucucaagagacgcuuaagaacucuaauauuagcacccacucgcguuguagcugcugaaauggaggaagcgcuccgaggauugccuauaagauaccaaacuccagcagucaaguccgaacacacuggaagggagauagucgacuuaaugugucacgcuacauuuaccacccgcuuguugucaucuacccguguuccuaacuauaaucugauagucauggacgaggcucauuucacagaccccaguucgguagcagcuagaggauauaucaguacgcgagucgagaugggugaagccgcagcaauauuuaugacugccacacccccgggggccacagauccguucccucaauccaauucuccaauagaagauauugaaagagaaauacccgaaagaucauggaauacggguuuugacuggauuaccgauuaccaggguaagacagucugguuuguuccaaguaucaaagccggcaacgauauugcuaacugucugagaaaguccggcaagaaaguaauucaacugagcagaaaaacauuugauacagaauacccaaaaacaaaauuaacugauugggacuucguagucacuacagauauaagcgaaaugggugcaaacuuuagagcuggaagaguuauagauccacgaagaugucugaaaccuguuauuuuaacagauggacccgaaagggucauauuagcaggaccaauaccagugaccccagcauccgcagcgcaacgaagagguagaauagggcgcaauccugcacaagaggaugaucaguauguuuucagcggagauccucuuaaaaacgacgaagaccacgcacacuggaccgaagccaaaaugcuuuuagacaacauauauacaccagaagguaucauaccaacauuauucgguccagaaagggagaaaacacaagcuauugauggagaguuuagguugcgaggagagcaacgaaaaacauuuguagaacuuaugagaagaggugaucuaccaguuugguuaucauauaaggucgcgagcgccgguauuaguuacaaagaucgugaauggugcuuuaccggugaaagaaauaaucaaauucuggaagaaaacauggagguagaaauauggacaagggaaggagaaaagaaaaaguugaggccgaaguggcuugacgcaagaguauaugcugauccgauggcauuaaaagauuuuaaagaauuugcuuccgggaggaaaucaaucacccuugacauacuuaccgaaauagcaucacuaccuacauaccuaucgaguagagcaaaauuagcuuuagauaacaucguuauguuacacacgacagaacgcggagggcgagcauaucagcacgcacuaaacgaauuacccgaaucucuugaaacuuuaaugcucguagcauuauuaggagcaaugacugcagguauauuccucuucuuuaugcaaggaaaaggaauagggaaguuaucgauggggcuaaucacuauugcagucgccucaggucuccuuuggguugcugaaauacaaccgcaauggaucgccgcaucgauuauacuagaauuuuucuuaauggucuuacugaucccugaaccagagaagcaacgaacgccgcaggauaaccaauugaucuauguuauacuaacaauucugacaauaauaggacuuauugcggccaacgaaauggguuuaauagagaaaaccaaaacagacuuuggauuuuaucaaguaaaaaccgaaacaacgauucuagauguagauuuaagaccagcgucagcguggacauuauaugcgguagcaacaacaauucucacaccaauguuacgacauaccauagaaaacacaagugcaaauuuaucauuagcugcuauagccaaucaagcagcgguucuaaugggauuagguaagggauggccauuacauagaauggauuugggaguaccauuacuggcaaugggcuguuacucucagguaaacccgacuacccuaacagcaagccuaguuaugcuacuggugcauuaugcaauuauaggaccagguuugcaagccaaagcaaccagggaagcacaaaaacgaacugccgcaggcaucaugaaaaauccaacuguagauggcaucacgguaauagaccuagaaccaaucagcuaugacccuaaauuugaaaaacagcuaggacaaguaaugcuauuagugcuaugugcugggcaacugcuacucaugagaacaaccugggccuuuugcgaaguucuuacauuagccacuggacccauucuuacucugugggagggaaaucccggcagauuuuggaauacgacaauugcagugagcaccgcuaacaucuucagagggucuuauuuggcaggcgcaggacuagccuuuaguuuaauuaaaaacgcgcaaaccccgagacgugguacaggaacggcaggagaaacccuaggagaaaaauggaaacgccagcuuaacucacuggacagaaaggaguucgaagaauacaagcgcagcggcauacucgagguugacagaacggaagcaaagagugccuuaaaagaugguucaaaaauuaaacacgcgguuucgagagggucaaguaaaauucgguggauuguggaacgcggaauggugaagccgaaagguaagguaguagaucuggguugcggaagaggagguuggaguuacuacauggcaacgcuaaagaacgucacagaagugaaaggauauaccaaagguggacccggacacgaagaacccaucccgauggccacauacggauggaaccuagucaaacuacauagcggagucgauguuuucuauaaaccaaccgagcaaguugauacauuauuaugugauauuggugagucuucauccaauccgacgauugaagaaggaaggacauuacggguuuuaaagaugguagaacccugguuauccucaaaacccgaauuuuguauuaaggucuugaauccauauaugccuacagugauagaggagcuugaaaaguuacaaagaaaacacgguggaaaucuuguuagauguccacuaucgcguaacaguacucaugagauguauuggguuuccggugcaucuggcaauauugucucgagugucaacaccaccaguaagaugcuuuugaauagauucacgacgcgucauaggaaaccgacguacgaaaaagauguagaucuaggcgcagguacccgaagugugaguacugaaauagagaaaccagauaugacaauaaucgggagacgauuacaaagguuacaagaagaacacaaggaaacuuggcauuaugaucaggaaaauccuuacagaacaugggcauaccauggaucguacgaagcucccuccacgggcagcgcauccucaauggugaauggaguaguaaaauuacuaacaaagccgugggacguaauuccuaugguaacacaauuagccaugacagauacuacaccuuuuggccagcaaagaguuuucaaagaaaaaguugauacaagaacaccccaaccuaagccaggaacgagaaugguuaugacaacaacggcaaacugguuaugggcauuacucgggaagaagaaaaacccacgauugugcacaagagaagaauuuaucuccaaaguacgaucaaacgcagcaaucggggcugucuuccaggaagaacaaggcuggacaagcgcaucugaggcagugaacgauaguagguucugggaguuaguugauaaagaaagagcucugcaucaggaaggaaaaugugaauccugugucuauaacaugaugggaaagcgugagaagaaacuaggagaguuugggagagcaaaaggaucacgagccaucugguacaugugguugggcgcaagauuuuuggaguucgaagcauugggauuuuuaaaugaagaccacugguuuggcagagagaauaguuggucggguguagaaggggaaggacuccaucgguuaggauacauauuagaagagaucgauaagaaagauggggaucuaauguacgccgaugacacugcaggcugggauacacggauaacagaagaugauuuacaaaaugaggaguuaauuaccgaacaaauggcuccucaucacaaaauauuagccaaggccauuuuuaaacucacauaucaaaacaaaguaguaaaaguuuuaagacccacuccucgaggcgccguaauggacauaaucucuagaaaggaucaaaggggaucgggccaaguaggaacauauggccucaacacauuuaccaauauggagguacaauuaauccggcaaauggaggccgaaggaguaauaacacaagacgauaugcaaaacccgaaaggacuaaaagagagggucgagaaaugguuaagagaauguggaguagauagacuuaagagaauggcaauauccggagaugauugcguaguaaaaccacuggaugaaagguuugguacuucuuuauuguuuuuaaaugauauggggaaagucagaaaggacaucccccagugggaaccuagcaaaggguggaagaacuggcaagaagugccuuucugcagucaucauuuucauaaaaucuuuaugaaagauggaaggagccugguaguaccuugcagaaaucaagaugaauuaauagggagggccagaauuagucagggagcaggguggucuuuacgugaaacagcuugcuuagguaaagcguacgcccaaauguggucguugauguauuuucacaggagagaucugagauuagcaucaauggcaauauguuccgcgguaccaacugagugguuuccgacauccagaacuacuuggucuauccaugcacaccaccaauggaugacgacagaagauaugcugaaaguuuggaacagagucuggauagaagacaacccaaauaugauugauaaaacccccguacauucaugggaagauauuccguaccugggaaaacgggaagauuuauggugcggcucucuuaucggguuaagcucacgugcuacaugggcgaagaacauucacaccgcuauaacacagguacguaaccuaauaggaaaggaggaauauguagacuauaugaguguuaugaagcguuauagugcaccaagugagagcgaaggagucuuguag

SEQ ID NO: 23678 - RNA, 9867 nt, Artificial Sequence
  derived and/or modified CDS sequence (opt6) from DENV-4__KJ579240__SS-prME
agcacgaucacguuacucugccucauaccuacugugauggcauuucauuugucgacccgugacggagaaccuuuaaugauuguggcaaaacaugaacguggacguccucuauuauuuaaaaccacugaagggauaaacaaauguacguugauagcuauggaccuuggagaaaugugugaagauaccguuacauacaaaugcccacuauuagugaauacagaaccagaagauauugauugcugguguaaccugacaucuacauggguaauguacggaacuuguacccagucuggagaaagacgacgagagaaaagaagcgucgcucuaacaccucauucaggaaugggacuagaaacaagagcagaaacuuggaugagcuccgaaggugcuuggaaacaugcgcaaagagucgaaagcuggauacuaagaaauccggguuucgcucuacuugcaggauucauggcauacaugauuggacaaacagggauucaaagaacgguuuucuucgugcucaugauguuaguagccccaaguuacgguaugaggugcguaggaguugguaauagagacuuuguugaaggaguaucagguggagcguggguugaucugguucuagaacauggagguugcgugacaacgauggcgcagggaaaaccuacauuggacuuugaacucacaaaaacaacugccaaagaaguugcucuauuacgaacauauugcaucgaggcuuuaauaucaaacauaacaaccgcuacuagaugucccacgcagggagaaccauaucuaaaagaagaacaggaccaacaauauauauguagacgggaugucguagaucguggguggggaaauggcugcggauuauucgggaaaggcggaguuguuacgugugcuaaauucaguugcucaggaaaaaucaccgggaacuuggugcaaaucgagaauuuagaauacaccguugugguaacaguucacaauggggauacacacgcuguaggaaacgacacuagcaaucaugggguuacggccacuauaaccccacgcuccccgaguguagaagugaagcuacccgacuauggagaauuaacccuugauugcgaaccaagauccgggaucgauuuuaacgaaaugauacuuaugaaaaugaagaagaaaacuugguuggugcacaaacaaugguuucuggaucuuccauuaccuuggaccacaggagcagacacuucagaagugcauuggaacuacaaggaaaggaugguaacauucaaagucccacaugcgaaacgucaagaugugacaguauugggaucucaagagggagcaaugcauucagcauuggcaggcgcaacagaagucgauucuggugacggaaaucauauguucgcaggacaucuaaaauguaagguccguauggaaaaacuucggauaaaaggcaugucauauacuauguguucuggaaaguucaguaucgauaaagaaauggcagaaacucagcauggcacgacuguugugaagguuaaauacgaaggagcgggggcuccuugcaaaguaccaauagaaauccgagauguaaauaaggaaaaaguaguagggagaguaauauccgccacuccgcuugcagaaaauacgaacagcgucacaaauauugaacuagaaccaccauuuggagauaguuauauaguuauuggaguaggaaauagugcguuaacauuacauugguuccggaaagggagcaguaucggaaaaauguucgaaucaacguauaggggagcaaaacggauggcaauauuaggggagacagccugggauuuuggaucaguaggaggccuuuuuacgagcuuagguaaagcaguacaccaaguauuuggaucuguauacacuacaauguucggaggcguaucuuggaugaucagaauccucauaggauuuuuaguauuauggauaggaacaaauucaagaaacacaucuauggcggucacgugcauagcgguaggagggauaacuuuauuuuuaggauucacuguacaagcagauaugggaugugucgugucauggucaggcagagaacuuaaauguggaucaggaauauuugugguugacaauguccacacguggacagaacaguauaaauuccaaccugaauccccggcucgccuugcauccgccauucuaaaugcacauaaagaugguguuugcggaauaagaucaacaacacgucuagaaaacguaauguggaaacagaucacuaacgagcugaacuacguauugugggaaggcggucaugauuuaacugucguugccggagauguaaaaggaguccuaacaaagggaaagagagcauuaacuccaccagcaagugauuuaaaauacucguggaaaacaugggggaaagcuaagauauuuacccccgaagcgagaaauagcacauuucuuauagacgguccagauacaucugaaugcccaaaugaaaggcgcgcauggaacagcuuugaaguagaggauuaugguuucggcauguuuacgacuaauauauggaugaaauuuagagagggcucauccgaggugugcgaucauagacuaauguccgccgcuaucaaagaucaaaaagcuguacaugcugacaugggauacuggauagaaucuaguaaaaaucaaacauggcaaauagaaagagcaucacuaauugaggugaagacaugucuauggccuaagacccacacacucuggucuaacggaguucuugaaucccaaauguuaauuccaaaaaguuaugcuggaccauuuucacaacauaauuaccggcagggauaugcaacccagacgguaggucccuggcaucuuggcaaauuagagauagauuuuggcgaaugcccaggcacuacaguaacaauucaagaaaauugugaccacagagguccgucuuuacgaacgacaacugcaucaggaaagcuaguuacacaaugguguugcagaaguuguacuaugccgcccuuaagguuucucggagaagauggauguugguaugguauggagaucagaccauugagcgaaaaagaagagaacauggucaaaagucagguaacggcaggucagggcacaagugaaacuuucaguaugggucuauuaugucugacacucuucguagaggaaugucucaggcguaggguaacaagaaaacauaugauauuagcuguaguaauaacacuaugugcuauaauucuuggaggacuuacauggauggaccuacuacgcgcacucauaauguuaggagacacgaugucaggaagaauuggcggucaaacacauuuggcuaucauagcgguuuuuaaaaugucaccagguuacguauugggaguguuccugagaaaacuuacauccagagaaaccgcacuaauggugauuggaauggcaaugaccacuacacucaguauuccacacgacuuaauggaacuuauugacgguauaagccucggucuaauacuucuuaagaucguuacgcaauuugacaacacgcaagucgguacacucgcuuugagcuuaacguuuauuagaucuacgauguccuugguaauggcauggaggacgauaauggccguuuuguucguuguaacuuuaauucccuuaugccgaacuucaugcuuacaaaaacaaagccacuggguagaaauuaccgcauugauccuaggcgcccaagcauuaccaguauaucuaaugacuuuaaugaagggugcaagucgucgaucuuggccucuaaacgagggcaucauggcuguagggcuugucaguuuacucggcagugcacuucugaagaacgacgucccccuugcugggcccaugguugccggcggacuuuuacuagcagcuuauguaaugucagggucuucugccgaucuaaguuuagagaaagcugcuaauguccaaugggacgagauggcugauauaaccggaaguucucccaucauugaagucaaacaggaugaggauggcagcuuuaguauacgagacguugaagagacuaauaugauaacuuugcuaguuaaacuagcgcuaaucaccguaucaggacuauauccccuggcaauaccgauaacuaugacucuuugguacauguggcaagugaagacacaaagaucuggcgcucucugggacguaccaucuccggcugcaacucaaaaggcagcgcuuucagaaggaguauacagaauaaugcaacggggauuauucgggaagacgcaaguugggguugggauucauauggaagguguuuuccauaccauguggcauguaacacgaggcucgguuauuugccacgagacuggacgauuagaaccgucaugggcugauguucgaaaugacaugaucucauauggugguggauggcgacuuggagauaagugggauaaggaagaagacguacagguccuugcaauugaaccuggcaaaaauccgaaacauguacaaacaaagcccggacucuucaaaacguuaacgggagaaauaggagcagucacacuugacuucaaaccaggaacuagcgggagucccaucauaaauagaaaggggaaaguuauagguuuguaugggaauggcguggugaccaaaagcggugacuaugucucugcgauaacucaagcggaaagaauuggagaacccgacuaugaaguagaugaagauauauuuagaaagaaacgauuaacuauaauggaccugcacccaggugcgggaaaaaccaaacgaauacuccccagcauaguucgugaggcacuaaaacguaggcuaaggacucuaauuuuagcacccacccgaguaguagcagccgagauggaggaagcccuaaggggcuugccaauaagauaucagacgcccgcgguaaaaagcgaacauacaggccgcgaaauaguagacuugaugugucaugcgacauucacgacaaggcuauuaucaucgacuagaguuccuaacuacaauuugauugucauggacgaagcacauuucaccgauccauccagcguugcagcacgaggauacaucucaacacgaguugaaaugggugaggcugccgcuaucuucaugacugccaccccaccaggugcaacugauccauucccacagagcaacaguccaauugaagauauagagcgugaaauaccggaaagauccuggaauacuggcuucgauuggauaacugacuaccaagggaagacggucugguuugucccgagcauuaaagcgggaaaugauaucgcaaauugcuugagaaagucaggcaagaaaguuauucagcugucgcgaaaaacauucgauacugaauauccaaaaacaaaguuaacggauugggauuuuguaguaacaacggauaucagugaaaugggagcuaauuuccgggcaggccgugucauagacccaagacguugucuuaagccuguuauauuaacugacggaccggaacguguuauccuugcuggcccuauaccugucaccccggcgucagcagcacaaaggagaggcaggauugguagaaauccagcgcaagaggacgaucaauacguuuucuccggugauccauugaagaaugacgaagaucaugcacacuggaccgaagcuaaaauguugcuugauaauauauauacuccagaagggauaauacccacacucuucggaccugaaagagagaagacacaagccaucgacggugaauuuaggcuacgaggcgaacaacguaaaacguucguugaauugaugcgacgaggagaucuaccgguauggcuaaguuacaagguugcuucugcgggcaucucuuauaaagacagagaguggugcuucacaggugagaggaauaaccaaauacuagaagaaaacauggaaguagaaauauggacaagggaaggggaaaagaaaaagcuaaggcccaaauggcuugacgcacgaguauaugcugacccaauggcauuaaaggauuucaaagaauuugcauccggucgcaaaucgaucacacucgacauuuuaacugaaauugccagcuuaccaacuuaucuaucaucaagagcgaaauuggcgcuagauaacaucguaauguuacauacgacagaacguggaggacgagcauaucaacaugcacuaaacgaacuaccugagucuuuagaaacucuuauguugguagcuuuauuaggcgcuaugacugcggggauuuucuuauucuucaugcaagggaaaggaaucggcaaauuaaguaugggguuaauaacgauugcuguagcuucaggauugcuuuggguggcagaaauacaaccucaguggauagccgcuucaauuauuuuagaguucuuuuugaugguacugcuaauaccugaacccgaaaaacagcgcacgccacaagauaaucaacugauauacguuauacugacaauacuuacaauaauuggauuaauugcugcaaacgagaugggauuaauugagaaaacgaagacagauuucggauucuaucagguuaaaacagaaacgacuauuuuagacguggaccuuagacccgcaagugccuggacauuauaugcaguugcuacuacgauacuaacuccaauguuaagacacacaaucgaaaauacaucagcaaauuuaucgcuagcagcgauugccaaccaagcugcuguuuugaugggacuaggaaagggcuggccgcuucaccgaauggauuuagguguccccuuguuagcuauggggugcuauucacaaguaaauccaacuacuuuaacggcaagccuuguuauguuacugguacacuacgcgauaauuggccccggacuccaagcuaaggcaacgagagaagcucagaaaagaacagcggccggcauaaugaaaaauccuacaguugacgggauaacaguaauugaucuugaaccuauuagcuacgauccuaaauuugaaaaacaauuaggucaagucauguuauuaguuuuaugcgcugggcaacuguuauuaaugcguacaacaugggcauuuugugaagugcugacucucgcaacugguccgauuuugacgcucugggaagguaauccaggaagauuuuggaacacgacuauagccgucuccaccgcaaauaucuuucgaggcuccuaucucgcuggagcaggacuugcuuucucauugauaaagaacgcccaaaccccaagacgagggacugguacagcaggagaaacgcuaggagaaaaauggaaacggcagcucaacucucuggacaggaaagaauuugaggaguacaaacggucugggauucuagaaguagaccgaaccgaagcaaaaagugcccuuaaagaugggucgaagauuaaacacgcaguaucuaggggaaguucaaaaauacgauggauugucgaaaggggaauggugaagccuaaaggcaaaguaguagauuuaggauguggccgcgguggguggucauauuacauggcuacccuuaaaaaugucacagaagucaaaggcuauaccaaaggagguccaggacaugaagaaccuauaccaauggcgaccuacggauggaaccuaguaaagcuacacucaggaguugauguauuuuauaaacccacggaacagguagauacauuguuaugugauauaggugaaucuucaucaaauccgacuaucgaggaagggaggacauuaagaguucugaaaaugguggagccauggcuauccucaaaaccagaguuuugcauaaaaguucuaaacccauacaugccaacuguuauugaagaacuagaaaaacugcaaaggaagcauggugguaacuuaguaagauguccacuuucucgaaauucaacgcacgaaauguauugggucucaggagcuaguggaaauauaguaucgucgguuaauacuacaucaaaaaugcuuuugaaucgcuuuaccaccagacauaggaaaccgacauacgaaaaagauguagaucucggggcagggacacguagcguaucuacagagaucgaaaagcccgacaugacaauaaucgguagacgccuccaacgauuacaagaagaacauaaagaaacguggcacuaugaucaagagaacccuuaucggaccugggcguaucauggcucauaugaagcuccaucuacugggagcgcgagcuccaugguaaaugggguaguaaaacuuuuaacuaaaccaugggacguuauacccaugguaacacaauuggcaaugacggacacaacaccauuuggacaacagagaguguucaaggaaaaaguugauaccagaacaccccaacccaaaccuggaacuagaaugguaaugacuacgacagcaaauugguuaugggcgcuauuaggcaagaagaaaaauccucgauuaugcacacgggaagaguucauaucgaaaguacguagcaacgcugcaauaggugcaguauuucaggaagaacagggauggacuucagcuucugaagccgugaacgauaguagauuuugggaauuaguugacaaagaacgagcgcugcaucaagaaggaaagugugaaaguugcguauacaauaugaugggcaaacgggaaaagaagcugggagaguucgguagagccaaaggaucacgagcgauaugguacaugugguugggcgcgcgcuuucuagaguuugaggcccuagguuuucuaaaugaagaucacugguucggacgggagaauaguuggagugggguggaaggcgaggggcuucaucgauuagguuauauucuagaggagaucgacaagaaggauggugaccugauguaugcagaugauacggcggggugggauacuagaauaacggaagaugacuuacagaaugaagaauuaauaacagagcagauggcaccucaucauaagauauuagcaaaagcuaucuucaaacuuacauaucagaauaaaguaguaaaaguuuuaagaccuaccccuaggggagcagucauggauauuauaucaagaaaagaucaaagagguaguggacaaguugggacguacggcuuaaauacauucaccaacauggaaguccaacuaauccgucaaauggaagcugaagguguaauuacucaagacgauaugcaaaacccaaaaggauuaaaagaaagaguagaaaaauggcugagagaauguggcguagaucguuugaaacgaauggccauaaguggugacgauugcguagucaagccauuggacgaaagguucggaacuagccuauuauuuuugaacgauauggggaaaguuagaaaggauauuccacagugggaacccucaaaaggauggaaaaauuggcaagagguaccguuuuguucucaccauuuucacaagaucuucaugaaagacggaagaucuuugguuguacccugucgcaaucaagacgaacuuauaggacgcgcaagaauuagccaaggugcaggauggucauuaagagaaacagcuuguuuggguaaagcguacgcacaaauguggagcuuaauguauuuccaccgccgugaccuacgcuuagcuaguauggcaauuuguagugcaguacccacagagugguuuccaacaaguagaacaacauggagcauacacgcccaucaccaauggaugacaacugaagauaugcuaaaaguauggaauaggguguggaucgaagacaauccuaacaugaucgauaagacgccuguucauucgugggaagacauaccguauuuaggaaagcgugaagaucuauggugcggaucgcuaauaggauuaucaucucgcgcgaccugggcgaagaacauacacacugcaauuacacagguucgaaaucuuauaggaaaagaagaauauguagacuacaugucaguaaugaaacgauacucagcucccucagagucagaaggaguccuauga

SEQ ID NO: 23679 - RNA, 9867 nt, Artificial Sequence
  derived and/or modified CDS sequence (opt6) from DENV-4__KJ596658__SS-prME
agcacuauuacguuauuauguuuaauuccaaccguaauggccuuccacuuaucaacaagggauggugaaccuuuaaugauaguugcuaaacacgaacguggaagaccuuuacuauuuaaaaccacagaaggaaucaacaaaugcacacuaauugccauggacuuaggagaaaugugugaagauaccguuacguauaaauguccucucuuaguuaauaccgaaccugaagauaucgauuguugguguaaccuaaccagcacuugggucauguauggaacguguacucagagcggggaacggagaagggagaaaaggucgguagcacuaacuccccauucggggaugggauuagaaacucgugcagaaaccuggaugucuucugaaggagcguggaaacaugcgcaacgaguggaaucuuggauacuacgaaauccggguuuugcgcuacuagcaggauucauggcuuacaugauuggacagacaggaauccagagaacaguauucuuuguuuugaugauguuaguagcaccuaguuaugggaugagaugugucgguguuggaaacagagacuucguagaaggaguauccggaggagcauggguugaccuaguccuugaacacgguggaugcguuaccacuauggcccaaggaaaaccaacuuuggacuucgaacuaacaaaaacuacagccaaagaagucgcacuucugcgaacauauugcaucgaggcuuugaucucuaauauaacgacagcaacucgcuguccaacucaaggggaaccauacuuaaaagaagaacaggaucaacaauauauauguaggcgagauguaguagacagaggcuggggcaacggaugugguuuauuuggaaaaggcggugucguaacuugugcaaaauuuaguuguucuggaaagaucacuggaaauuugguacaaauagaaaauuuggaauacaccguuguagucacagugcauaacggggauacucaugcaguagggaacgauacaucaaaccauggcguuacagcaacuauuacaccaaggaguccuaguguagaaguaaaauuaccagauuacggagagcuaacucuagauugugaaccgaggaguggaauagacuuuaacgaaaugauauuaaugaaaaugaagaagaaaacuuggcuuguacacaagcaaugguuucuagacuuaccacuacccuggaccaccggugcugacacaucagagguccauuggaauuacaaggagaggaugguaaccuuuaaagugccacacgcaaagagacaggacguaacaguauuaggaucucaagaaggcgcaaugcauucagcucuagcgggagccacagaaguagauucaggugacggaaaucacauguuugcgggucaccuaaaaugcaaaguaagaauggaaaaacuacgcauaaaagguaugaguuacaccauguguaguggaaaauuuucuauugauaaagagauggcggaaacacaacacgguacaacagugguaaaaguaaaauaugagggugcgggugcgccaugcaaagucccgaucgaaauaagagauguaaauaaagaaaaagugguaggccguguuaucagugcgacaccauuggcagaaaacaccaauucaguaacaaauauugagcuugagccgccauucggagauaguuauauaguaauagggguagggaacagugcuuuaacguuacacugguuuagaaaagggucaucaauugguaaaauguuugagaguacauacagaggagcuaaaaggauggccauccuuggugaaacugcaugggacuucggauccguaggugguuuauucacuucauuggggaaagccguucaucaaguauuuggcucaguauacacaacuauguuuggagguguuucauggaugauacggaucuuaauuggauuucucguauuauggauagguacaaacucaagaaauaccucaauggccaugacuuguauagcaguuggcggaauaacauuauucuuagguuuuacgguacaagcggauaugggauguguagucuccuggucugguagagaauuaaagugugguucagggauauuuguagucgauaaugugcauacauggacagaacaauauaaguuucagcccgaaaguccagcuagauuagccucugcuauccuuaaugcacauaaagauggcguaugcgguauccgcucuaccacuagacuggaaaaugugauguggaaacaaaucaccaaugaauuaaauuauguauuaugggagggcgggcacgaucuuacaguuguggcaggcgauguaaaagguguauuaaccaaagguaaaagagcacuuacaccgccggcaucugaccugaaauacucuuggaagacuuggggaaaggcaaaaauuuucacaccugaagcaagaaauaguaccuuucuuaucgacggccccgauacguccgaguguccaaaugaaagacgugcauggaacucauuugaaguagaagacuacgguuuuggaauguuuaccacaaacauauggaugaaauuccgcgaggguucaucagaaguaugcgaucacagauuaaugagugcagcaaucaaagaucaaaaagcagugcaugccgauaugggauacuggauagaaucaucuaaaaaucaaacguggcaaauugaacgagcaaguuugauagaaguaaagacauguuuauggcccaagacacauacguuauggagcaacgguguucuggaaagucaaaugcuaaucccaaaaucuuacgccggaccuuucucacaacauaacuauaggcaagguuaugcuacccagacaguaggaccauggcaucuagguaaguuagaaauagacuucggugaauguccaggaacaacaguuacaauucaagaaaacugugaccauagaggaccaucucugaggaccacuacugcaaguggaaaauugguuacgcagugguguugcagauccuguaccaugcccccauugcgcuuccuuggagaagaugggugcugguacgguauggaaauacguccucuaucagaaaaagaagaaaauaugguaaaaucgcagguaacagcuggacaagguacuucagagaccuucuccaugggguuacugugccugacccuuuucguggaggaaugucuaagacgccgugugacgaggaaacauaugauacuugccguagucauuacacuuugcgcuauaauacuaggcggucuaacuuggauggacuugcuaagggcucuaauaauacuaggggauacaaugucugguagaauaggaggccaaacacaucuagcuauuauggcagucuuuaagaugucaccagguuauguacuaggcguuuucuuaagaaaacuuaccuccagggaaacagcccuaauggugauaggaauggcaaugacaacaaccuuaucuaucccucaugaccucauggagcucaucgacggcauaucuuuaggauuaaucuuacuuaaaauuguuacacaguucgauaauacccaagucgguacuuuagcgcuuucucuuaccuuuauuagaucuacaaugucucuugugauggcauggcggacaauaauggcuguucuauuuguuguuacucucauaccgcugugucgaacaaguugcuugcaaaaacaaucacacuggguagaaauaacagcauuaauacucggcgcucaggcgcuaccuguguaucucaugacgcuuaugaaaggugcuucgcgcagaaguuggccauugaacgaagguauuauggcaguaggucuugucucacuccuagggagcgcccuacucaaaaaugacguuccucucgcugggccuauggucgcgggaggacuuuuacuggcugccuaugugaugucaggcagcuccgccgaucugucgcuagaaaaagcagcuaauguacaaugggaugaaauggcggauauaacaggaucuuccccgauuaucgaaguaaaacaagaugaagacggcagcuuuucgauucgugauguagaagaaacgaauaugaucacacuauuaguaaaauuggcacuuauaacaguaagugggcuguauccauuagcuauaccaauuacgaugacucugugguacauguggcaaguaaaaacacaaagaagcggugcauuaugggacgugccaagucccgcggcuacucaaaaggcagcauuaucagagggcgucuauaggauuaugcagcgagguuuauuuggaaaaacucagguaggugucggcauacacauggaaggaguauuucacaccauguggcacgucacgagggguagcgucaucugccacgaaacaggacgacuagaaccaagcugggcugaugugcgcaaugauaugauaucuuacggagguggauggcgacuaggagauaaaugggauaaagaagaagauguucaaguacuugccauagaaccaggaaagaacccaaaacacguacaaacaaaaccuggacuauuuaagacacuaacuggagaaauuggugcaguuacucuugauuuuaaacccggcacuagcgggucgccuaucaucaaucgaaaagggaaaguaaucggacuuuacggaaauggugugguuacaaaaucaggcgauuauguaagcgcgaucacacaagcagaacggauaggagaaccagacuaugaaguugaugaagacauuuuuagaaagaaacguuuaacaaucauggaccuacauccuggagcuggcaaaacgaaaagaauacuuccuucaauuguucgugaggcccucaaaagaagacugcggacucuuauauuagcgccaacgcguguuguugcagcagaaauggaagaagcauuacggggacuccccaucagguaccaaacuccagcgguaaagucagagcacacaggaagggaaauaguagauuuaaugugccacgcgacauucacgacaagacuguuaucaucgacucgaguccccaauuauaauuugaucgucauggacgaagcacauuucacagacccuucaaguguugcggccagaggcuauauaaguacgcgugucgaaaugggugaagcugcggccauauucaugacggcaaccccaccaggugcuacagacccguucccccaaucaaauuccccuauagaagacauagaacgagaaaucccggagcguaguuggaauacuggauuugacuggaucacggauuaucaaggaaaaaccguaugguucguaccaagcaucaaagcaggaaaugauaucgcaaauuguuuaagaaaaaguggcaagaaagugauccaacucagccgcaaaacuuuugauacugaauaccccaagaccaaauuaacagacugggauuuuguggugacaacagacauaucagaaaugggggcaaauuuuagagcuggccguguaaucgauccucggagaugucuaaaaccaguaauccuuacggauggcccagaaaggguuauuuuagcgggaccuauuccuguaacgcccgcauccgcagcacaacgacguggucggauaggcaggaauccagcccaagaagaugaucaauauguauucucaggagauccguugaaaaaugaugaagaccacgcacauuggacggaagcaaaaaugcuauuggacaauaucuauacuccagaaggcauaauaccaaccuuauucggccccgaacgagagaaaacucaagccauugacggggaauuucgcuuacgaggagaacaacguaaaacguuuguugaauuaaugagaagaggugaucuuccagugugguuaucauauaaaguagcaagugcagguauuagcuacaaagaucgagaaugguguuuuacaggggaaagaaauaaucaaauucucgaggaaaauauggaggucgagauuuggacccgcgaaggagagaagaaaaagcuaagacccaaaugguuggaugcucgcgucuaugccgauccuauggcgcuaaaagacuucaaagaauuugcuucuggacgaaaaaguauaacccucgauauauuaacugaaauugcuucccuaccuacuuacuugagcucgcgagcaaaauuagcauuagacaacauagugauguuacauaccacagaaagggguggucgagcauaccaacaugcacugaacgaacuaccugagagucuugagacauuaauguuaguugcauuguugggugcaaugacugccggaauauucuuauuuuucaugcaaggaaaggguauagguaaacuaagcaugggccuaaucacaaucgcaguggcaucaggauuacuuugggucgcagaaauacagccacaauggauagcugcaucaaucauacuggaauuuuuccuaaugguauuguuaauccccgaaccugagaagcaacgaacgccacaggauaaccaacuuauuuauguuauacuaacgauuuuaaccauuauaggauuaauugcagcuaaugaaaugggauuaauugaaaagacuaagacagauuuuggauuuuaucaagucaagacagagacuacaauauuagacguagacuuacgcccggccucugcauggacccuuuaugccguggcaacaaccauauuaacuccgauguuacgacauacaauagaaaauacaagcgcuaauuuaaguuuagccgcuauagcgaaccaagcggcaguccuaaugggcuugggaaaaggcuggccacuacaucguauggauuuaggcguuccuuugcuagcaaugggcuguuacucacaaguaaaccccacuaccuuaaccgccuccuugguaaugcuccuaguacacuaugcgaucauugggcccggucuacaagccaaggcuacacgagaggcucaaaaacgaaccgcagcugggauuaugaaaaauccuacagucgacggaauaacuguaauagaucucgagccaaucucuuaugauccaaaauucgaaaaacagcuaggacagguaauguuauuaguauugugcgcuggucaacucuuacugaugagaacaacgugggccuuuugcgaaguccucacccuagcuacugguccuauacuaacacuuugggagggaaacccaggacgcuuuuggaacaccacgauugcuguaagcacggcaaauauauuucgcgguucguauuuagcaggagcggguuuagcauuuuccuugauaaagaacgcacagacgccccgaagagguaccgggacugcuggugaaacacuuggcgaaaaauggaaacggcaacuaaauucucucgaucgaaaagaguucgaagaauacaaacgaaguggcauucuggaaguagauagaacugaagccaagagugcuuuaaaggacgguucaaaaauuaagcacgcuguaucucguggaucaucgaaaaucagguggauugucgagagagggaugguaaagcccaaggggaaaguuguugaccuuggaugcggacggggaggcugguccuauuauauggcgacccucaaaaacguuacugaaguuaaaggauauaccaaaggggguccgggacaugaagaaccaaucccgauggcgacauacggauggaaucuugucaaauuacacucugguguugacguauuuuauaagccuacugaacaaguagauacuuuauuaugugauauuggagaaucuaguagcaaucccacgaucgaggaaggaagaacgcucagggugcuaaagaugguggagcccuggcucaguucaaaaccugaguucuguauaaaggucuuaaauccuuauaugccaacuguuauugaagaacuagagaaacuucaaagaaagcacggaggcaaccuaguaagauguccgcucagucgcaauucaacgcaugaaauguauuggguaucgggggcuucugguaacauuguuagcucggucaacaccacaagcaaaauguuguugaacagguucacgacgagacaucguaaacccacauacgaaaaagacguugaccuuggcgcagggacgagaucuguuaguacagaaaccgagaaaccagacaugacuauaaucgguagacgauuacaaagacuccaagaagaacacaaagaaacuuggcauuaugaccaagagaauccauauagaacaugggcuuaucaugguucguacgaggcaccauccaccggaagugcgaguucgauggugaaugggguagucaaacuauuaacuaagccgugggauguuauuccuaugguaacgcagcucgcuaugacagauacuacaccauuuggucaacaaagaguguuuaaggagaaaguugauacgcgaacuccgcaaccuaagccaggcacgagaaugguuaugaccacuacagcgaacuggcuuugggcguuacuaggcaagaagaaaaacccucguuuauguacuagggaggaguucauaucaaaaguccguaguaacgcagcaauuggagcugucuuucaagaggaacagggauggacaagugcuucggaagccguaaacgauuccagauucugggaacucguagauaaagaaagagcauugcaucaggaagguaaaugcgaaucauguguuuacaauaugauggguaaaagagagaagaaauuaggagaguuuggccgagcaaagggcucaagagcuauaugguacaugugguuaggggcaagauuccuugaauuugaggcuuuaggguuucuaaaugaagaccauugguuuggaagagaaaauuccugguccgguguggagggcgagggcuuacaucgcuuaggauacauucuugaggaaauagacaagaaagauggugaucuaauguaugcggaugauacugcugguugggacacuaggauaacggaagaugauuuacaaaaugaggaauugauaacugaacagauggcgccccaucacaaaauucuagcuaaagcaaucuuuaaacucaccuaucaaaauaaagucgucaaaguccuucgaccaaccccucguggugcuguuauggauaucauaagucguaaagaucaaagagguucaggccaaguaggaacuuauggcuugaacacauuuacaaacauggaaguacagcucauaagacaaauggaagcugaaggcgucauuacgcaggacgauaugcagaacccaaaagguuuaaaagaacgcguagaaaaauggcuaagagaauguggaguugauagacuaaaacguauggccauuuccggggaugacugcgugguaaaaccauuggaugaacgcuucgggacaagccuucuuuucuuaaacgacaugggcaaaguuagaaaagauauaccacaaugggaaccgucaaaagguuggaaaaauuggcaagaagucccauucugcucgcaucacuuucauaaaauuuuuaugaaagaugguaggagccucguaguaccauguagaaaccaagaugaguuaauaggacgagcucgaauuucgcaaggcgccggauggucauuaagagagacugcgugccuaggaaaagccuaugcacaaauguggucccuaauguacuuccaucgccgagauuuacgauuagccucaauggcaauaugcuccgcgguaccaacggaaugguuucccacaaguaggacaacguggucaauccaugcgcaccaucaauggaugacaacagaagauaugcucaagguuuggaaucggguauggauagaagauaauccuaacaugaucgauaaaacccccguacauagcugggaagauauuccauaucugggaaaaagagaggaucuuuggugcgggucgcugauaggauuaagcucaagagcaacuugggcuaaaaauauccauacagcuauaacacaggugagaaaccuaauaggcaaagaggaauacguugauuacaugccagucaugaaacgguacucagcccccucagaaagugaggggguacuguaa

SEQ ID NO: 23680 - RNA, 9867 nt, Artificial Sequence
  derived and/or modified CDS sequence (opt6) from DENV-4__KJ596659__SS-prME
ucgacgauaaccuuacucugucucauuccaacggucauggcuuuucacuugaguacucgggacggugaaccuuugaugauaguagcaaaacacgaaagagggaggccacugcuauuuaaaacaacggaaggcaucaacaaauguaccuuaauagcaauggauuuaggugaaaugugugaagauacagugacuuacaaauguccgcuacuugugaauacugaaccggaagauaucgacuguuggugcaaucucaccuccacuuggguaauguaugguacuuguacacaaucaggggaaagaagaagagaaaaacggaguguagcacuaacaccucauucgggcaugggcuuagaaaccagagcagaaacauggaugucaucugaaggggcauggaaacacgcccaaagaguagaaaguuggauauugcgaaauccaggcuuugcacuucuggcaggauuuauggcguauaugauaggacaaacuggcauccaaagaacuguauucuuuguccuaaugaugcuaguagcgcccucauacggaaugaggugcguaggagucgguaaucgggauuuuguagaagggguuucaggaggcgccuggguagaccuaguacuagaacauggaggaugugucacuaccauggcacaaggcaaaccaacacuagauuuugaacucaccaaaaccacagccaaagaagucgcauuauuacgcacuuauugcauagaagcucugauauccaacaucacaacugcuacgagauguccuacacaaggugaacccuauuugaaagaagaacaagaucaacaauacauaugucgcagggacguggucgaucgcggauggggcaacggauguggcuuauucgggaaaggaggagucguaaccugcgcaaaauuuaguuguucagggaaaauaacaggaaauuuaguacagauugaaaaccucgaauauacagugguaguaacaguucauaauggggauacgcacgcagugggaaaugacacaucgaaccacggcguuacagcaacaauaaccccucguucuccaaguguggaaguaaagcucccggauuauggugaacuaacacuagacugugaacccagaucaggcauugacuuuaaugaaaugauauuaaugaaaaugaagaagaaaacgugguugguccacaaacaaugguuuuuggaccugccuuuaccuuggacaacuggagcagauacaagugaagugcauuggaaccauaaagaaagaaugguaacauucaagguuccccacgcaaaaaggcaagauguuacaguucuggggucacaggaaggcgcaaugcauucagcccuagcgggagcuacagagguggacaguggagacggcaaccacauguuugcuggacacuuaaaaugcaaagucagaauggaaaagcugagaauuaaaggaaugucauacacuauguguucaggaaaauucucaauagauaaggaaauggcugaaacacagcauggaacgacaguaguaaaggucaaguaugaaggggcaggcgcuccauguaaaguuccgaucgaaauacgggauguaaacaaggaaaagguaguuggcaggguuauuucagcaacaccgcuagcugaaaauacaaauucaguuaccaacaucgaauuagagccuccauuuggggauagcuacauaguaauaggcgugggaaauucagcgcugacauuacauugguuuagaaaggguagcaguaucggaaagauguuugaaaguacuuauaggggagcuaagcgaauggccauacucggggaaaccgccugggauuuuggauccguuggcggucuauuuaccagccucggaaaagcaguucaccagguauuugguagcguauacaccacaauguucggagguguuaguuggaugauaaggauucucauaggauuuuuagucuuguggaucggcaccaacuccaggaacacuucaauggcaaugacuuguaucgcaguaggugggauaacuuuguuccuugguuuuacaguacaagcagauaugggcugcguagugaguuggucugguagagaacuaaaaugcgguagugggauuuuuguaguagacaacguacacacauggacggaacaauacaaauuucaaccggaaagcccugcaagacuagcuucagcaauauuaaacgcucauaaagauggaguaugcggcauacggaguacaacacgguuagagaauguaauguggaagcaaauaacuaaugaacucaacuauguacugugggaagguggacaugaccuaacaguuguugcuggcgauguuaaaggcgugcucacgaaaggaaaaagagcacuaacaccaccagcaagugaccuuaaauauucauggaagacuugggguaaagccaaaauuuucacuccugaagcgcguaauagcacauuucuaauagacggaccagauacuagcgaauguccaaacgaacgucgagcauggaacuccuucgaaguagaggacuacggguucgguauguuuacaacaaauauuuggaugaaauuccgugaaggaagcucagaaguaugugaucaccgauuaaugagcgcagccaucaaggaucaaaaggcaguucacgcagauaugggauauuggauagaaucaaguaaaaaccaaacauggcaaauagaaagagcaucacucauagaaguuaaaacaugucuauggccuaaaacucauacacuguggaguaaugguguacucgaaagccagauguuaauaccaaaaucauaugcaggaccuuuuagucaacacaauuauagacaaggauaugcuacucaaacaguaggcccauggcaucuagggaaacuugaaauugacuucggugaguguccuggaacaacugucacaauacaggagaacugugaccauagaggcccuagccuuagaacgaccacggcuucuggcaaacuuguuacacaaugguguugucgaagcuguaccaugccgccuuuacgguuuuugggugaagauggaugcugguacggcauggaaauuagaccacuuucagaaaaagaggaaaacauggugaaaucacagguaaccgcuggccaagguacaucugagaccuucucgaugggcuuguugugccuuacguuauuuguggaggaauguuuaaggaggagaguaacuagaaagcacaugauccucgcaguugugauuaccuuaugugcaaucauauuagguggccuuacguggauggauuuacuacgggcacuaauaauauuaggugacacaaugucuggucgaauaggagggcaaacccacuuagcaauaauggcuguguucaaaaugaguccaggauauguauuagguguauuucuaaggaaacuuacuucacgcgaaacagcccuuaugguuauuggcauggccaugacuacaacgcuaucaaucccccacgauuuaauggaguuaauugaugguauaagccucggucuaauuuugcuaaaaaucgugacccaauuugacaacacgcaaguuggaacucucgcacuguccuuaaccuucauaagaaguacuaugagucuagucauggcuuggcgaacaaucauggcuguauuauucguuguuacguuaauuccucugugucguacuagcugucuucaaaaacaaucacauuggguugaaauuacugcuuugauacuaggugcgcaagccuuaccaguuuaucugaugacccugaugaaaggggcuuccagaagaucuuggccuuuaaacgaagguauaauggccgugggauuaguaucauuguuaggaagcgcauuauugaagaaugacguuccacuagcaggaccaaugguagccgguggauuauuacuugcugcuuaugugaugaguggaaguagugccgaucuaucuuuagaaaaggcagcuaacguacaaugggaugaaauggccgacauaacugguucauccccgauaauagaaguaaaacaagacgaagacggaaguuuuucaauuagggacgucgaagaaacaaacaugaucacuuuacucgucaaauuagcacucauaaccguguccggacuauauccccuagcaauaccaaucacuaugacucuaugguauauguggcaaguaaaaacacaaagauccggugcauuaugggauguaccgaguccggcagcgacacaaaaggcugcguugucugaaggcguuuacagaauuaugcaacguggucuguuugguaaaacacaaguuggcguuggaauccacauggaggguguuuuccacaccauguggcacgugacacggggaagcgucauaugccaugaaacgggaagauuagaaccgucuugggccgacgugaggaaugauaugauauccuauggcgguggcuggcgauuaggugauaaaugggacaaagaagaagacguucaaguucuugcuaucgaaccgggcaagaauccgaaacacguucaaaccaaaccaggucucuuuaaaacacuaacuggcgaaaucggagcagugacccucgacuuuaaaccagguacgagcgggucaccuauaauuaaucguaaagguaaagugauaggacuguacggcaauggggucgucacaaaauccggagacuaugugucugcaauaacacaagcugagcguauaggagaaccagauuaugaaguugacgaagauauuuuuagaaagaaaaggcuuacuauaauggauuuacacccgggggccggaaagacaaaaagaauccugccaaguauaguaagggaggcgcuuaagagacgacuaagaacguuaauauuggcaccaaccagaguggucgcugcugaaauggaagaagccuuacgaggcuuaccuauuagauaucaaacaccagcggucaagucugaacacacaggaagagaaauaguagaucucaugugccaugcuacauuuacuacucgacugcuaagcaguacaagaguaccaaacuacaauuuaauagugauggacgaagcacauuuuacagacccaaguaguguugcggcacggggcuauauaucaaccagaguggagaugggugaagcggcagcaauuuucaugacugcgacacccccuggagcaacugacccauuuccucagucaaacucgccaauugaagacaucgaacgugaaaucccggaaagaaguuggaacacaggcuuugacuggaucacagauuaucaaggcaaaacuguuugguuugugccaucaauaaaggcuggaaacgacauagcuaauuguuuaagaaaaaguggcaagaaagugauccaacuuucuagaaaaaccuuugauacagaauaucccaaaacaaaguuaacagacugggacuuugucgugacaacggauauauccgagaugggagcgaauuuccgagcaggccgcguaauugaccccaggagauguuugaaaccaguaauacuaacugauggaccagaaagaguaauacuggcggguccgauccccgugacgccugccagugcugcgcaaagaagaggccggauagguagaaacccugcccaagaagacgaucaguacguuuuuaguggagacccauuaaagaaugaugaagaccaugcucauuggaccgaagccaaaaugcucuuggauaauaucuacaccccggaaggaauuauaccaacucuauucgggcccgaaagagaaaagacgcaagcuauagauggagaguuccguuugcguggagaacaacguaagaccuucgucgagcucaugaggcgaggcgaccuuccgguuuggcugucauacaaaguugcaagcgcggguaucucauauaaagacagagagugguguuuuacuggagaacgcaauaaccaaauauuagaagaaaauauggaagucgaaauauggacaagagagggagagaaaaagaaacucagaccgaaaugguuagaugcuagaguauacgcagauccaauggcacuuaaagauuuuaaagaauuugcuucuggacgaaaaucgaucacauuagacauacuaacugaaaucgcaucacuacccacuuaucuuucuucaagagcaaagcucgcauuagacaauauugucaugcugcacacuacugagagaggugggagagcauaucagcaugcguuaaacgagcuaccugaaucccuagagacauuaaugcuugucgcuuuguuaggugcaaugacagccgguauuuuucuauucuuuaugcagggcaaagguauaggaaaacuuucgaugggauuaauaaccauugcuguagcaucuggguuauuaugggucgcagagauacaaccccaauggauagccgcuuccauaauacuggaguucuucuugaugguuuuacugauacccgaaccugaaaaacaaaggacaccacaagauaaccaacuaauauacguaauauugacaauccuaacgauaauuggacucauagcugcuaacgaaaugggccuuauagagaaaacuaaaacugauuuuggauucuaucaaguaaagacugaaaccacuauuuuagauguggaucuccgaccugcaucagcguggacuuuauacgcugucgccacgacaauacuaacaccuaugcuacgccacacaauugagaauacaagugcgaaccugagccuagcagcuauugcuaaucaggccgcagugcucauggggcuuggaaagggcuggccauuacaucgaauggaucuugguguuccauugcuagccauggguuguuauucacagguaaauccgacgacuuugaccgcaagccuaguuauguugcuaguucauuacgcuauaauuggacccggccugcaagcgaaagccaccagagaagcacagaaaagaacggcugcgggaauaaugaaaaauccaacgguagauggaauaaccguuauugauuuagagccaauaagcuaugauccgaaauuugagaagcaacuaggacaaguaauguuacuggugcucugugcaggucaacugcuauugaugaggaccacaugggcguucugcgagguuuuaacucucgccacgggcccgauccucacgcucugggaagggaauccugggcgguucuggaauacaaccauagcaguaagcaccgcuaauaucuuccgagguagcuacuuggcgggcgcuggauuggcguuuuccuuaaucaaaaaugcacaaacaccgcgacggggcaccggaacagcuggcgaaacacugggagaaaaauggaaaagacaauuaaacaguuuagauaggaaagaguucgaggaauauaaaagaaguggaauacuugaaguagaucgaacugaagcuaagagugcuuuaaaggauggaucaaagauuaaacacgcaguguccagggguuccagcaagauuagauggaucguggaacgaggcaugguaaaaccuaaaggcaaaguaguagaccucgggugcgggcgcggcggguggucauauuauauggccaccuugaagaacguaacagaaguuaaaggcuauacuaaaggaggcccggggcaugaagaaccgauaccaauggcgaccuaugguuggaaccuuguaaaacuucauucaggcgucgauguauuuuauaaaccaacagaacaaguagauacccuuuuaugugauauaggugaaucaagcaguaacccaacaauagaagaaggucguacacuacgaguccucaagaugguagagccuuggcugaguaguaaaccagaguucuguauaaaaguccuaaauccauauaugcccacgguuauagaagaacucgaaaaauugcaacgaaagcacggcggaaaucuuguuagaugccccuuaucgcguaauucaacgcaugaaauguacuggguauccggagcuucggguaauauuguuagcucagugaacacuacgucaaaaauguuacucaauagguuuacaacucgacaucgaaagccaacauaugagaaagacguugauuugggggcgggaacuagaaguguaucgaccgaaaccgaaaagcccgauaugacaauaauuggacgcagauugcaacgauuacaagaagaacacaaagaaaccuggcacuaugaucaagaaaauccuuaucggacaugggccuaccauggaaguuaugaagcgccuuccaccgggagugcaaguucaaugguaaacgguguggugaaauuguuaacuaaaccaugggaugugauaccaaugguuacgcaacuggccaugacagauacuacacccuuuggucaacaacgaguuuucaaggagaaagucgauaccaggacuccacaaccaaaaccagggacgagaaugguuaugacgacuacagcgaacugguugugggcucuuuugggcaagaagaaaaauccaagauuaugcacucgggaagaguuuauuucuaaggugcgauccaacgccgcaauaggcgcgguuuuucaagaagaacagggauggacgagugcaagcgaagcggucaacgauucuagguucugggaacuuguugauaaagaaagggcacuacaucaggagggaaaaugcgagucuuguguguauaacaugauggggaagcgagagaagaaauuaggcgaguucgguagagcuaaagguucaagagccauuugguacauguggcugggagcaagauuuuuagaguucgaagcguuaggauuuuuaaacgaagaccauugguucgguagagagaacagcuggucaggcguugaaggugaaggacuacaccgacuagguuauauuuuagaagagauagauaaaaaggauggggaccuaauguacgcggacgauacagcagguugggacacucgaauaaccgaggaugaucuacaaaaugaagaauugauaaccgagcaaauggccccacaucacaaaauacuagcaaaagccauuuucaaauuaacuuaucaaaacaaaguuguaaaaguacuaagacccacaccuagaggcgcaguaauggacauuauuagcagaaaagaccaaagagggagcggucaagugggaacauaugguuuaaacacguuuaccaauauggaaguacagcuaaucagacaaauggaagcugagggcguaauaacucaagaugauaugcagaacccaaagggacuaaaagaaagaguugagaagugguuacgggaaugcggagucgaucgacuuaagagaauggcgauuucgggugaugacuguguaguuaaaccacuagaugaacguuucgggacuucgcuauuguuucugaacgacaugggaaaaguaagaaaagacauaccucaaugggagccaagcaaaggauggaaaaauuggcaagaaguucccuucuguucgcaucacuuccauaaaaucuucaugaaagauggaagaagucuaguaguaccaugucguaaucaagacgaguuaauagggcgagcacgcauaucucaaggagcgggguggucauugagagaaacagcuugccuaggaaaggcuuacgcgcaaauguggucuuuaauguauuuccaucgaagggauuuaaggcuagcaucaauggcaauuugcucagcaguaccgacugaaugguucccaaccucucguacaacauggucgauacacgcccaucaucaguggaugacuacggaagacauguuaaaaguguggaauagagucuggauagaagauaacccgaauaugauagacaaaaccccgguucacucgugggaagauaucccauauuuaggcaaacgagaagaccuauggugcgggagucugaucggauuguccucaagagcaacaugggccaagaauauucauaccgcaauaacgcaaguuagaaauuuaauuggcaaagaagaauauguugacuacaugcccgucaugaaaagguauagcgcaccuucggagucagaagguguacuguaa

SEQ ID NO: 23681 - RNA, 9867 nt, Artificial Sequence
  derived and/or modified CDS sequence (opt6) from DENV-4__KJ596661__SS-prME
ucuacaauaacgcugcuaugucuuauaccgacggugauggcauuucacuuaucaacaagagacggugaaccucugaugauaguagccaaacaugaacgcggaagaccucugcuguucaaaacuacggaagguauaaauaaaugcacacuaaucgcaauggaucuaggugaaaugugugaagauacaguaacauacaaauguccucucuuagugaacacagaaccagaagauauugacugcugguguaacuuaacaaguacgugggugauguacggaacaugcacucaaucgggagaacgacguagagagaaaagaucaguagcuuugacaccacauucaggcaugggcuuagaaacccgugccgaaacauggaugucuuccgaaggagcauggaaacaugcccaacguguagaaaguuggauucuacggaauccgggauucgccuuauuagcgggauuuauggccuauaugaucggucaaacggguauacaaagaacaguauuuuucguacugaugaugcuaguugcaccuucuuauggaaugcguugcguaggcguuggaaauagagacuuuguagaaggagucucaggaggugcuuggguugaccuaguauuagaacacggugguugugugacaacaauggcucaaggcaaacccaccuuggauuuugaauugacaaaaacgacggcuaaagaaguagcccuauuacgaaccuacugcauugaagcacugauuucuaauauaacaacagcgacacgauguccaacgcagggggaaccuuaucuaaaagaagaacaagaucagcaauacauaugucgaagagauguuguggauagaggaugggggaaugggugugguuuauucggaaaaggagguguaguaacaugugccaaauuuuccugcagcgggaaaaucacaggaaaucuuguccaaauugaaaaucucgaauauacaguaguuguaaccguccauaauggugauacgcaugccguaggcaaugauacuucgaaccauggugucaccgcuacuauaacgccucgaucaccaagcguagaaguaaaacucccggacuauggagaacuuacucucgacugugaaccaagaagcgguauagauuucaaugaaaugaucuuaaugaaaaugaagaagaaaacuugguuaguacauaaacaaugguuucuggaucuuccauugccuuggacaacgggagcggauacuucagaaguccauuggaauuacaaggaaagaaugguaaccuuuaaagucccacaugccaaacgacaagaugucacaguucuugguucacaagaaggagcuaugcacucugcauuggcaggagcuacagagguggauucaggagauggaaaucauauguuugcgggacaccuaaaauguaaaguuagaauggagaaacuaagaaucaagggcaugaguuacacuaugugcagcggaaaguucucgaucgacaaagaaauggcugaaacgcaacaugguacgacagucguaaaagucaaauacgagggggccggagcaccaugcaaaguaccuauagaaauaagagaugucaacaaagagaaaguaguaggacgcguaauaucagccacacccuuagcugaaaauacaaauucaguuacuaauauugaauuagagccgccguuuggagauucauauauugucauaggaguuggaaauucugcgcuuacacuacacugguuccgaaaagguaguaguauugguaaaauguucgaauccacauaccguggagcuaaacgaauggcaauacucggagaaaccgccugggacuuugggucuguaggugggcuauuuacuucacuuggaaaagcuguucaccaaguuuucggcucuguauacacuacgauguucggcgguguuucauggaugauaagaaucuuaauuggauuuuuaguauuauggauagguacuaauucucgcaauaccucuauggccaugacauguauagcaguagguggcauaacauuauuccuuggcuuuacugugcaagcugauauggguugugucguuaguuggucugguagagaacuaaaauguggaagugggauauucgucguagacaaugugcacacuuggacugagcaguacaaguuccagccagaaucaccagccagacuggccucagccauacuuaacgcacauaaggacggagugugcgguauucguucaacgaccagacuugaaaacguaauguggaaacaaauaacaaacgagcuaaacuacguguugugggagggaggccaugaucucaccgucguagcaggagauguaaaagggguucuaacaaaaggaaagcgugcucucacgccuccagcuagcgacuuaaaauacaguuggaagacaugggguaaagcaaagaucuuuacccccgaggcucgaaacucaacauuuuuaauagaugggccagauacgagcgaaugcccgaaugaaagacgggcauggaacucauucgaaguggaggauuacgguuucggaauguuuacgacaaauauuuggaugaaauucagagaaggauccagcgaaguaugcgaccauagauugaugagcgcagcaauaaaagaucaaaaggcaguucacgcggacaugggauacuggauagaaucuagcaaaaaucagacuuggcagauagaaagagccucucucaucgaaguuaaaacaugcuuauggccaaagacccauacacucuggucaaaugguguguuagaaagccagaugcugauuccgaaaucuuaugcaggaccuuucagccaacauaauuaucgucagggauaugcuacccaaacgguaggccccuggcaucuagggaaacuggaaauagacuucggugagugucccggcacgacagucacuauccaagagaacugcgaucauagagggccuagcuuacggacaacaacggcgucgggaaaauuggucacccaauggugcuguagaucauguacuaugccaccuuuaagauuccuaggagaagauggcuguugguacggaauggaaauacgaccucuuagugaaaaagaagagaauauggugaaaucccagguaaccgcuggucaaggaacgagugagacuuuuagcauggggcuucugugucuaaccuuauuugucgaagaaugucuccgucgaagaguaacacgcaagcacaugauacuugcugucguuauaacacugugugcaauaauauugggcgggcuaacuuggauggaucugcuaagagcccuuaucaugcuaggugauacaaugaguggacggaucgguggucaaacccaucuugcuaucauggcaguauucaagaugucaccuggcuacguuuuaggagucuuucuaagaaaacucacgucaagagaaaccgccuugauggucaucgguauggcaaugacaacuacacuuucuauaccccacgaucuuauggagcuuaucgacgguauuucacuuggacucaucuuacucaaaaucgucacgcaauucgauaauacccaaguuggcacucuggcacuuucucuaacuuuuauuagaucaacgaugucucuuguaauggcuuggaggacuaucauggccguauuauucguuguaacucucaucccacuuugcaggacuucuugccuacagaaacaaagucacuggguagaaauaaccgcacuaauacugggagcccaagcucuaccaguauaucuaaugaccuuaaugaagggcgcaaguagaagaaguuggccacucaaugaagggauuauggcaguaggucuuguaucacugcucgguucagcguugcuaaagaaugacguuccucuagcaggacccaugguggccggaggauuacuuuuggcagcauauguaaugucgggcuccuccgcagauuuaucgcuagaaaaagcagcaaacguccaaugggaugagauggcagauauaacagguucgagcccuauuauagaaguuaagcaagaugaagauggaucuuuuucaauccgugauguagaagaaacaaacaugaucaccuuauuagucaaauuggcauuaauuaccguuucuggauuauauccacuagcaauuccuauaacgaugacacuaugguauauguggcaaguaaaaacacaacgaaguggagcucucugggauguucccuccccagcagccacccaaaaggcugcccucagugagggcguuuauagaauuaugcaaagaggccuauuugggaagacacaaguagguguugguauacauaucgaagggguuuuucauacaauguggcauguaacucgaggaaguguaauaugccacgaaacagguagauuagaaccaucaugggcggacguuaggaaugacaugauuaguuauggcggaggguggagauugggagacaaaugggacaaagaagaagauguucagguacucgccauugagccuggaaagaacccaaaacacgugcaaacaaaacccggucuguuuaagacuuugacuggggaaaucggagcaguuacacuggacuuuaagccuggcaccagugggagcccaaucaucaauaggaaaggaaaagucauaggauuauacgguaacggcguuguaacaaagucgggagauuacguauccgcaauuacacaagcagagcguauuggagaaccugacuacgaaguagaugaggacauuuuuaggaagaaaaggcuuacaauaauggauuuacauccgggagcaggcaaaaccaagcguauauuaccaaguauuguccgugaggcuuuaaaaagaagacuucgcacccuuauacuagcgcccacucguguuguagcggcagaaauggaagaggcuuuaagagggcuaccaauaagauaucaaacuccagcuguaaaaucggagcauaccgggcgcgaaaucguugacuuaaugugccacgcgaccuucacgacacgcuuacucuccaguacaagagucccaaauuauaauuuaauaguaauggacgaagcgcacuucacugauccuucuucaguggcugcuagagguuauauuagcacccgaguagagaugggugaagcagccgcuauuuucaugaccgccacaccuccaggugcuacugacccauucccgcaaagcaacucgccgaucgaagauauugaacgggaaauuccugaaagaaguuggaacacaggcuucgacuggauaacugauuaccaaggaaaaacaguaugguuugucccauccauaaaagcaggaaaugacauagcaaauugccuuagaaagucuggaaagaaagucauacaauugucuagaaagacauuugauacggaauacccuaaaacuaaacuaacagacugggacuucguagucacuacggauauaagugaaaugggugcaaauuuucgugcaggacgaguuaucgacccuagacgcuguuuaaaaccaguaauacuaacagacggaccugaacgggucauacucgcugggccaaucccgguaacuccggcaagugcggcacaacguagagguagaaucgguagaaaucccgcucaagaagaugaucaauacguuuucaguggagacccccuuaaaaacgacgaggaucacgcucauuggacagaggcuaaaauguugcuugacaauaucuauacucccgaagguaucauaccuacauuauuuggucccgagagagagaaaacccaagcuauagauggggaauuuagauuacgaggagagcaacgcaagaccuucguagaguuaaugcguaggggagauuuaccaguuugguuaucuuauaaggucgccagugcagguauaucuuauaaggaucgagaaugguguuucaccggagaacgaaacaaucagauauuagaggaaaauauggaagucgagaucuggacgcgugaaggugagaaaaagaaauuaagaccaaaauggcucgacgcuaggguauaugcagacccaauggcauugaaagauuuuaaggaguucgcaaguggacgaaaaaguaucacacuugacauauuaaccgaaaucgcuucguuaccaacuuaccuauccagccgagccaaacuugcacuggacaauauagucaugcuacacacuacggaaaggggugggagggcauaucaacaugcacuuaacgaguugccugagaguuuagaaacauuaauguugguagcguuauuaggugcaaugacggcaggcauauuucuauucuuuaugcaagggaaaggaauaggaaagcucaguaugggauuaauaaccauagcaguagcgucaggccugcuuuggguugcugaaauacaaccacaauggaucgcagccucuauuauauuagaguucuuucuaaugguuuuacuaauuccagaaccggaaaagcagcgaacaccccaagauaaucaguuaaucuacguaauccuuaccauuuuaacaauuauaggauuaauagccgcgaacgaaaugggauuaauagagaaaaccaagacagacuuuggguucuaccaaguuaaaacugaaacaacuauacuagacguugauuuaagaccugcuucggcuuggacucuauacgcaguugcaacuacgauacuaacuccuaugcuacgacacacaaucgaaaacacgagcgcaaaucugucuuuggcagcuaucgcaaaucaagccgcugugcuuaugggguuagggaaaggcuggccauuacaucguauggauuuaggggugccacuccuagcuaugggaugcuacucccaaguuaacccuaccacacuaacagcaaguuuggugaugcuauuaguucauuacgcuauaauugguccgggauugcaagccaaagcaacaagagaggcacaaaaacguacagcagcugguauaaugaaaaacccgacuguugaugguauuacuguaauugauuuagaacccauaaguuacgacccaaaguuugaaaaacaacuaggccaaguaaugcuccuaguuuuaugugcuggucaauugcuauuaaugcgcacuacaugggcauucugcgaaguccuuacccucgcaaccgguccaacauuaacacucugggaagguaacccaggacgauuuuggaacaccacaauagcagugucaaccgcaaacauauuccgaggcagcuaccuugccggcgccgguuuggcauucaguuuaauuaagaaugcacaaacgccacgaagagggacaggaacagcuggggagacacugggagaaaaauggaagagacaauugaacucccuugauagaaaggaguucgaagaauacaaaagaucaggaauacucgaaguagauagaacugaagcaaaaucagccuuaaaggauggaaguaaaauaaagcaugcagucucacguggcagcucaaaaauacgauggauuguagaaagaggaauggugaagccaaaggggaaaguaguagaccuuggaugcggacggggcgguuggaguuacuauauggccacucucaaaaacguaacggaaguaaaaggcuacacaaaaggagggcccgggcaugaagaaccgauccccauggccacguacggguggaacuuaguuaaacuccauucagguguagacguuuucuacaaaccuaccgaacaaguggauacccuccuaugugacauaggggagucgucaaguaauccuacgaucgaggaagguagaacuuugagaguuuuaaaaaugguggaacccugguuaaguaguaaaccagaguucugcauaaagguguuaaacccauacaugcccacaguaauagaagaacucgaaaaguuacaaagaaaacacgguggcaaucuugugaggugcccauugucaaggaacagcacgcaugaaauguacuggguauccggggcgagcggcaacauugucucaagcguaaauacaacaaguaaaauguuguuaaaccguuucacgacaaggcauagaaagccaaccuaugaaaaagauguugaccugggagccggaacaagaucaguuucuaccgaaacggagaaaccugauaugacgauaaucggacgaagauuacaaagauuacaagaggagcauaaagaaacuuggcacuaugaucaagaaaacccauaucggacuugggcauaccacggguccuaugaagccccaucuacagguuccgcgagcucaaugguaaauggugucguuaaauuauuaacgaagccgugggacguuauaccgaugguuacucaauuggccaugaccgacacaacgcccuuuggucagcaaagaguauuuaaagagaaagucgacacuaggacgccccaaccuaaaccagggacacgaauggugaugacgacaacugcgaauugguugugggcacuucuaggcaaaaagaagaauccccgacuguguaccagagaggaauuuauuucuaaaguucguaguaaugccgcaauaggcgcagucuuccaggaagaacaaggcuggacaucugcuucagaagccguaaaugauucgcgauuuugggaacuuguagacaaagaacgugcguuacaccaagaaggaaaaugcgaaucauguguauauaauaugauggguaagagagagaaaaagcuaggagaguucgguagagcaaaaggaucucgcgcaauaugguauaugugguugggagcacgguuccuagaauuugaagcacucgguuucuuaaaugaagaucauugguuugguagagaaaauaguuggucagggguagagggagaggguuuacaucgauuaggguauauucuagaagagaucgacaagaaagacggugauuuaauguaugcagacgacaccgcagguugggacacuagaauaacggaagacgaucuucaaaaugaagaauuaauuaccgaacaaauggcuccccaucauaagauuuuggcaaaagcuauauuuaaacuaacauaucaaaauaaaguagucaaaguucuaaggccuacuccuagaggugcuguaauggauaucauaucaaggaaagaccaaagaggaagcggacaggucggaacauauggauuaaauaccuuuacaaauauggaggugcaguuaauacgccaaauggaagcugaagggguaauaacucaggaugauaugcaaaacccgaagggcuugaaagaacgaguagaaaagugguuaagagaauguggagucgaccgauuaaagcguauggcuauaaguggagaugacugcguaguaaaaccuuuggacgagagauuuggaacauccuuauuauuucuaaaugacauggguaaagcaagaaaagauauuccgcaaugggaaccuuccaaagguuggaagaacuggcaagagguaccuuucugcucucaccauuuucacaagauauuuaugaaagacggaaggucgcuagucgucccaugccguaaucaagaugagcuaauaggccgugcccguauuucacagggcgcuggcuggaguuuaagggaaacggccugucuagguaaagccuaugcucaaaugugguccuuaauguauuuccauagacgagauuuaagguuggcuucuauggcuaucuguucggccguaccaacagaaugguucccuacaagucgaacaacguggucaauacaugcacaucaucaguggaugacaacagaagauaugcuuaaagucuggaaucgcguauggauugaagacaacccaaauaugauagauaagacuccaguacauuccugggaagauauacccuauuuggguaaacgagaggaucuuuggugcggcagccuaauaggccuaagcucaagggcgacaugggcgaaaaauauccacacagcaauaacucaaguaaggaauuuaauugggaaagaggaauaugucgacuacaugccuguaaugaaacgcuacagcgcuccgucggagagugaaggaguuuuauaa

SEQ ID NO: 23682 - RNA, 9867 nt, Artificial Sequence
  derived and/or modified CDS sequence (opt6) from DENV-4__KJ596663__SS-prME
ucuacuauuacguuauuaugccuaauaccuaccgugauggcauuucaccuaagcacgagagauggugaaccauuaaugaucgucgcaaaacaugaaagaggacgaccuuuacuguuuaaaacaacagaaggaauaaauaaauguaccuuaauagccauggaucuaggagaaaugugugaagacacgguuacauauaaauguccuuuacuuguuaacaccgaacccgaagauauugauuguuggugcaaccuaacgaguacuuggguaauguacggaacauguacgcaaagcggagaacgccgccgggagaaaagaagugucgcauugacaccacacaguggaaugggacucgaaacaagagcugaaacauggaugucaucugaaggagccuggaaacacgcacagcgaguagaaucauggauauuaagaaauccuggauucgcacuccuugcgggauucauggcuuauaugaucggucaaacagggauucaacggacgguguucuuuguauuaaugaugcugguugcuccuucguacgguaugagaugugugggaguuggaaaucgcgacuuuguagaaggggucucugggggagcuuggguugacuuaguguuagaacauggugguugugugaccaccauggcucagggaaaaccuacacuugauuucgaguugaccaaaacgacggcaaaggaaguugcacugcugaggaccuauugcauugaagccuuaauaucaaauauaacaacagcuacucgaugcccaacgcaaggagaaccguaucuaaaagaagaacaggaccaacaauauaucugcagaagagacguagucgauagaggauggggaaacggaugugguuuauuugggaaaggcggugugguuacaugugcgaaauucucuuguucaggaaaaaucacuggaaaccuagugcaaauagaaaauuuagaauacacgguuguuguaacaguucacaacggggacacccaugcgguaggcaaugauacaagcaaccauggagugacugcuacaauaacuccgaggucaccaucagucgaaguaaaguugcccgacuacggagaacuuacacuagauugugaaccgagaucaggcauagacuucaacgaaaugauauuaaugaaaaugaagaaaaagacgugguuaguucauaaacaaugguuuuuagaucuaccgcuaccauggacuacgggggcugauacaagugagguacacuggaauuacaaagaaagaaugguaacuuuuaaggugccucacgcaaaacggcaggauguuacuguacucggaucgcaagaaggugcuaugcacagcgcacucgccggugcaacugagguagacuccggcgacgguaaucauauguuugcgggacaucuuaaguguaaaguacgaauggaaaagcuacguauaaaagggaugucauacaccauguguuccggaaaguuuagcauugauaaggagauggcagaaacccaacauggaacaacagucgugaaggucaaauacgaaggagcgggugcgccaugcaaaguaccaauugaaauacgagauguaaauaaagagaaggucguaggucgcgucauuagcgcgaccccacuggcagaaaacacaaacucugugacuaacauagaauuggaaccuccauucggggacucguauauaguuaucgggguggguaauagugccuuaacuuuacauugguuuaggaaaggcaguagcauagggaaaauguuugaaucaaccuauaggggagcgaaaagaauggcgauuuugggggagacggcgugggacuucggcucuguaggcggacuauuuacaucauuaggaaaagcuguacaucaggucuuuggcucaguauauaccacuauguuuggcgggguaucuuggaugauaagaauauuaauugguuuccucgugcucuggauaggaacuaauucucggaacacaucaauggcaaugacauguauugcugucgguggcaucacacuguuccucggguuuacaguucaagcagacaugggaugcguugucagcuggaguggucgugagcuuaaaugcggaucggggauauucguaguagacaauguccauacuuggaccgaacaauacaaauuucaaccggaaagcccggccagacucgcuucagcuauuuugaaugcacauaaagauggaguuuguggaauacguucgacaacucgccuagagaauguaauguggaagcagaucacuaacgaacuaaauuacguauugugggaagguggacacgaucuuaccguuguugcgggagauguaaaaggugucuuaaccaaggggaaacgugcucuaaccccacccgcauccgaccuaaaauacucguggaaaacguggggcaaggcaaagauuuuuacccccgaggcacggaauaguaccuuccugaucgacggcccugacacgucugaauguccaaaugaacguagagcauggaacucguucgaaguggaggauuauggauucggaauguuuacgacaaacauuuggaugaaguucagagaagguaguucggagguuugcgaucacagguuaaugucagcagcaaucaaagaccaaaaggccguucacgcagacaugggauauuggauagaaucaucaaagaaucagacauggcagaucgaacgggcaucccucaucgaagugaaaacaugucuuuggccaaaaacacauacauuauggucaaauggaguacuagaaucccaaaugcuuauaccaaagaguuaugccggaccauucagucaacauaacuacaggcaaggauaugcaacacaaacagucggaccguggcaccuaggcaagcuagaaaucgacuucggagaaugcccgggcacaacagugacgauccaggagaauugcgaucaucgcgguccgucauuaaggacuacgacagcgucuggaaaauuagucacacaauggugcuguagaucuuguaccaugccaccuuuaagauuuuuaggagaagauggcugcugguauggaauggagaucagaccauuaagcgaaaaagaagaaaauauggucaaaucacaaguuacugcuggacaaggaacaagugaaacauucucuaugggucuauuaugcuuaacucuauucguugaggaauguuuaagacgaagaguaacuagaaagcauaugaucuuagcaguuguaauaacacugugcgcaaucauuuugggagggcuuacguggauggauuuguuacgugcucugauuauauugggcgacacaaugucaggaagaauaggagggcaaacacauuuagccauaauggcaguguuuaaaauguccccuggauacguacuagguguauuccuaaggaaacuaacuuccagagaaacugcucuuaugguuaucgguauggcuaugacuacaacacuuucaaucccccaugaucugauggaacugauugaugguauaagccugggucuaauucuacuuaaaauagugacccaauucgauaauacacaaguuggcacauuagcauugagcuuaacauuuauaaggaguacuaugucguuaguuauggcauggcguacuauuauggcaguacuguucgucguaacgcuaauuccauuguguagaacgaguugccuccaaaagcaaucccauugggucgagauuacagcuuuaauacuaggggcucaggcccucccuguuuaucuaaugacacuaaugaaaggggcaucuaggagaagcuggccauuaaacgaggguauaauggcgguaggauuagugucuuuacuuggaagugccuugcuaaagaaugacguaccgcuagcaggaccaauggucgcaggagggcuacuucuagcagcuuacgugaugucuggcucaagcgcggaccuaucucuagaaaaagcagccaauguacaaugggaugagauggcagauauuaccgggucaucuccaauaauugaaguaaaacaggacgaggacgguagcuuuucaauaagagauguagaggaaacaaacaugauaacacugcugguaaaacuggcauuaauaaccguaagcggacuauauccccuugcaauacccaucacgaugacgcuuugguacauguggcaagucaagacgcaacggucaggugcacuaugggacguaccaagcccggcagcaacccaaaaagccgcauuaagcgaaggcguguaccgaauaaugcaaaggggacucuuuggaaaaacacaagucgggguagggauucacauggagggcguguuccacacaauguggcacguaaccagaggaucagugauuugucacgaaacagguaggcuagaaccgucuugggcggauguucguaacgauaugaucaguuauggaggagguuggagguuaggagauaaaugggauaaagaagaagauguucaagugcuagcgaucgagccagguaagaaucccaagcauguacaaaccaaaccugguuuguuuaagacuuuaacuggugaaauaggcgccguaacacuugacuuuaaaccgggcacuucggguucgccaaucauuaauaggaaaggaaaaguuaucggauuguacggcaacgguguugugacaaaaaguggggauuacguaucagcaauaacccaagcugagagaauuggugaaccagacuacgaagucgaugaagauauauuuaggaagaaaagauuaacgauuauggaccuacacccgggagcagguaagacgaaacggauuuuaccaucgauaguucgcgaagcauuaaaacgaagacuaagaacacuuauccuagcucccaccagaguaguagcagcugaaauggaggaggcuuuaaggggguugccuauuagguaccaaaccccagcaguaaaaucagaacauacaggacgggagauaguugauuuaaugugccaugcgacauucacaacucgauuguuguccucaacacgaguaccuaauuauaaccucauagucauggacgaggcacauuuuacagaucccaguagcguagcggcuaggggcuauaucaguacaaggguggaaaugggugaggccgcagccauauuuaugaccgcgacuccaccaggggcuacugauccauuuccacagucaaacucaccaaucgaagauauagaaagagaaauaccugaaagauccuggaauacgggauuugauuggaucacagauuaucaagguaagacgguaugguucguuccaagcauaaaggccggcaacgacauagcaaauugucuuagaaagucaggcaagaagguaauucaauuaucaagaaaaacuuucgauacagaauacccaaagacaaaauugacagauugggauuuuguaguaacaacagacauaagugagaugggugcgaauuuuagggcggggagaguaauagauccucgucgauguuugaaaccagucauacuaacugaugguccggaaagagucauauuagcgggaccaauaccaguuacaccagcauccgccgcacaaaggcggggcagaauaggaagaaauccggcucaagaagaugaucaauacguauuuucgggugauccacugaaaaaugaugaggaucaugcacacuggacugaagccaaaauguuacuugacaauauauauacuccugaagguauuauuccaacauuauuuggaccugagcgggagaaaacgcaagcaauagacggugaauuuagacuuagaggggagcagagaaagaccuuuguggaacuuaugagaagaggagauuugccaguaugguuaucauauaagguggccucagccggcauaucuuauaaagauagagaauggugcuucacaggggaacgaaauaaccaaauucuggaagaaaauauggaaguagaaaucuggacaagagaaggggagaagaagaaacuaaggccaaagugguuagaugcccggguauacgcagacccaauggcgcuaaaagauuuuaaggaauuugcgagcggacgcaaaagcaucacacuagauauauugacugaaauugcauccuuaccaacauauuuaucaucgagggccaaauuagcgcucgacaauauuguuaugcuucacacuacagaaagggguggcagagcauaccaacacgccuuaaaugaguugccugaaagucuugaaacccuaauguugguggcucuuuuaggagcaaugacugcugggauauuucucuucuuuaugcaaggaaaaggaauagggaaguuaaguaugggguugaucacuauagcuguugcuagugggcuuuuauggguagcugaaauacaaccccaauggauagcugcuuccaucauacuugaguucuucuuaaugguacucuugauuccagagccugaaaagcaaagaacuccgcaagacaaccaacuaauuuacgugauauugacuauucuaacgauaauaggucuuaucgcugcaaaugaaaugggcuuaauagagaaaaccaaaacagauuuuggauucuaccaaguuaaaacagagacaacaauauuagacguagaccuacgaccagcuagugcauggaccuuauaugcaguagccacaacaauacuuacuccaauguugagacauacgaucgaaaauacuucagcaaacuuaagucuagcagcuauagcaaaccaggccgcugugcucaugggauuagguaaaggauggccucuacaucgcauggauuugggcguacccuuauuggcaauggguugcuauagccaaguaaacccuacgacauuaacggcaucauuggucauguuauuaguacacuaugcaauuauagguccuggcuuacaggcgaaagcaacgcgcgaagcucagaaaagaacagcggcgggaauuaugaagaauccuacuguugacgguauuacuguuauagaucuggagccaauuuccuaugacccuaaauuugagaaacaacuuggccaagucaugcuauuaguucuaugcgcuggacaguugcuucuuaugcgaacgacaugggcauuuugcgaaguguuaacucucgcaacgggaccaauucugacuuuaugggagggaaaucccggaagguuuuggaauaccaccauagcaguuuccacggcgaacauauuuaggggaagcuacuuggcaggagcaggguuagccuucucucuaauuaaaaaugcucaaacuccccguagaggcaccgggacagcaggggagacauuaggagaaaaauggaagagacagcuaaacagucuugauaggaaagaauuugaagaauauaagaggagugguauauuagaaguggacagaacggaggcuaaaucagcccuuaaggauggcaguaaaauaaaacaugcaguaagucgaggcagcaguaagauaagauggauaguagagagagguaugguaaagcccaaggguaaagugguugauuuaggaugcggaaggggcgguuggagcuacuacauggcuacucuaaagaauguaacagaaguuaaaggauauacgaagggcgguccaggucacgaagaaccaauucccauggcuacauauggauggaauuuaguaaagcugcacagcgggguugauguauucuauaaaccaacagagcaaguugacacauuacuuugcgauauaggggagucgucaucaaauccgacaauugaagaaggucggacacuucguguauuaaagaugguagagcccuggcuaagcucaaaaccagaguuuugcauaaagguuuuaaaucccuauaugccuacggucauagaagaacuagaaaaacuucaacgaaaacauggugggaaucuagucagaugcccauuaucuaggaacaguacgcaugaaauguacuggguuuccggagcaagcgguaacauaguaucuucuguaaauacuaccuccaaaauguuguuaaauagauuuaccacaagacaccgaaaaccgacuuaugaaaaggacgucgaccuuggcgcugggacaagaagcguaucaacggaaacggaaaagccagacaugacaaucaucgggcgaagguuacaaagauuacaggaggaacauaaagaaaccuggcauuacgaucaagaaaacccuuacagaacaugggcuuaucauggcaguuaugaggcgcccagcacuggcuccgcgagcucgaugguaaauggagucguaaaauuauuaaccaaaccaugggauguaauuccuaugguaacucaauuggcuaugaccgacacgacgccguuugggcaacaacgaguuuucaaagagaagguagauacaaggacgccacagcccaagccggguacacggaugguaaugacaacgacagcuaauugguuaugggcauuacuaggcaagaagaaaaacccgcgcuuaugcacaagggaagaguuuauaucuaaaguuaggucaaacgcagccauaggcgcuguauuucaagaagaacaaggauggacgagugcaucagaggcaguaaaugacagcagauucugggaacuuguagauaaagaaagagcccuucaucaggagggcaaaugugaaucaugugucuauaauaugaugggaaaacgggagaagaaacucggagaauuugggagagcaaaagguagcagggcaauaugguauauguggcuaggcgcucgcuuucuugaguucgaggcuuugggguucuugaacgaagaucacugguuuggacgagagaauagcuggaguggaguagaaggcgagggauuacauagauuggguuauauuuuggaagaaauugauaagaaagacggggaucuaauguacgcggacgauacugcaggaugggacacaagaauaacggaggacgaccuccagaacgaagaacucauuaccgagcagauggcaccucaucauaaaacuuuagcaaaggcaauuuucaaguugaccuaucaaaacaaggugguaaaaguauuaagaccaacgccucgaggugcaguuauggauauaauaucuagaaaagaccagcgggggucuggucaaguugggacguauggucuaaauacuuuuacaaauauggaaguacaauuaauuagacaaauggaagcagagggcgugauuacacaagacgauaugcaaaaucccaaggggcuaaaggaacgggucgaaaaauggcuacgugaauguggaguggauagguuaaaacgcauggcuauaaguggcgaugauugugucguaaaaccacuugaugaacgauuuggcacuucccuuuuauuuuuaaacgacauggguaaagucagaaaagacauuccacagugggagccaucaaaaggauggaaaaacuggcaagaaguaccuuuuuguucucaccauuuccacaaaauauuuaugaaagacgguagaucccuagucgucccuugucggaaucaagaugagcuaauugggcgagcacgaauuagucagggagcaggcuggagccuccgcgagacggcuugucugggaaaagcguaugcccaaauguggucauuaauguauuuucaccguagggaccuaagacuggcaucuauggcgauuugcucugcuguaccgaccgagugguucccuacuucuagaacuaccuggagcauacaugcacaucaccaauggaugacuacugaagauauguuaaaaguuuggaacagaguauggaucgaggacaauccgaacaugaucgauaaaacgccaguacacucaugggaagauauucccuauuuggggaagagagaagaucuuuggugcgggucauugaucggacucucaucaagagccaccugggccaaaaauauucauacggcaauuacccagguuaggaauuuaauuggcaaagaagaauacguagauuauaugccaguaaugaaaagauacagugcgccgucugaaagugaaggggucuuauga

SEQ ID NO: 23683 - RNA, 9867 nt, Artificial Sequence
  derived and/or modified CDS sequence (opt6) from DENV-4__KJ596664__SS-prME
aguacuauuacucuucuuuguuuaauuccaacuguuauggcuuuccaucuuaguacaagagauggagaaccguuaaugauaguugcuaaacaugaacgagguaggccucuucuauuuaaaacaacagaaggaauaaauaaauguacguuaauugcuauggacuugggagaaaugugcgaagacaccguaacuuacaaauguccucucuuaguuaauacagaaccagaagauauagauugcugguguaacuuaacuucuacuuggguaauguauggaaccuguacccagucaggagaacgacgaagagagaaaaggagcguggcauuaacuccacauuccgggauggguuuggaaaccagagcggaaacauggauguccagugaaggugcauggaaacacgcacaacguguagaaaguuggauacucagaaauccaggcuuugcgcuuuuggcaggguuuauggcauauaugaucggacaaacagguauacagcgaaccguauucuuugucuugaugaugcuaguagcaccaaguuauggcaugagaugcguuggaguaggaaauagagauuuuguugaagguguaaguggaggcgcaugggucgauuuaguacucgaacaugguggaugugugaccaccauggcacaaggaaaaccgacucucgacuuugaacucacaaaaacgacugcaaaagaagucgcacuacuaagaaccuauuguauagaggcuuugauaucaaauaucacaacugcaacaagaugccccacucagggagagccauaccugaaagaagaacaagaucagcaauauauauguagacgugauguaguggacagagggugggggaauggcugcggguuguuuggaaaaggagggguugucacuugugcuaaauucucuugcucuggaaaaauaacugggaauuugguccaaauagaaaaucuagaauauacaguaguaguaacaguucauaacggugacacccacgcaguaggaaaugauaccucgaaucacggaguaacggcaacuauaacucccaggucaccuucuguggaagugaaauuaccugacuauggugaacuaacguuagacugcgagccuaggucagggaucgauuuuaacgagaugauacucaugaaaaugaaaaagaaaacaugguuagugcauaaacaaugguuccucgacuuaccucuaccuuggacuacgggcgcugacacaagugagguucacuggaacuauaaagagcgaaugguuacauuuaaaguuccacaugcaaaacgacaagacguaaccguguuagguagccaagaaggggccaugcauagcgcauuagcuggcgcuaccgaaguagacucuggagacggaaaucacauguuugcagggcauuuaaaaugcaaaguacgaauggaaaaauuacguauaaaagguaugaguuauacaauguguucaggaaaauucagcauagacaaagagauggcagaaacgcaacaugguacaacaguuguaaaaguaaaauaugaaggggcaggagcucccugcaagguuccgauugagauaagggauguuaauaaggaaaaaguuguaggccgagucauuagcgcuacucccuuggccgaaaacacaaauagugucacaaacauagaacuggaaccaccguucggcgauagcuacauaguaaucggaguaggaaacucugcauuaacacuucauugguuccgaaaaggcucgagcaucggaaaaauguucgaaaguacauaucguggggcaaaacgaauggccauccuuggggagaccgcgugggacuuuggaucagucggcggucuuuucacaagucuaggaaaagcaguucaucaaguguuugggagcguuuauacuaccauguuuggagguguuagcuggaugauaaggauccuaauuggguucuuaguuuuauggaucggcacuaacucucgaaauacaaguauggccaugacgugcauugcagucggaggaauuacacucuuucuggguuucacuguccaggcagacaugggaugcgugguuuccuggucaggccgugagcugaaaugugguuccggaauuuuuguaguagauaauguucacacuuggacagagcaauauaaguuucagccagaaaguccugcgcgccuggcaucugcuaucuuaaacgcgcacaaagacgguguaugugggauaagaagcaccacaagacuagaaaauguaauguggaaacagaucaccaaugaacucaauuacguucuaugggagggaggacaugauuuaaccgugguagccggcgauguuaaagguguccuaacaaaggguaagcgggcuuugacaccgccagcuagugaucucaaauauaguuggaaaacgugggguaaggcaaagauuuucacacccgaagccagaaauucaacauuccucauagacggaccugauaccucggaaugccccaaugaaaggagagcuuggaacucauucgaaguagaagauuacgguuuuggaauguucacuacuaacaucuggaugaaauuccgagaaggaagcuccgagguaugcgaccaucgauuaaugucagcugcaaucaaagaucaaaaagcugugcacgcggacaugggcuauuggauugagaguuccaagaaucaaacauggcaaauugaaagagcaagucucaucgaaguaaagacauguuuauggcccaagacacacacccucuggucaaauggcguguuagaaagccaaauguuaauuccgaaaaguuaugcaggcccuuuuucgcaacauaacuaucgacaaggauaugcaacucagaccgugggcccauggcaucucggaaaauuagaaauagacuuuggcgaguguccuggcacaacaguaaccauacaggaaaauugcgaucaccgagguccguccuuaagaacgacaacagccaguggaaaauugguuacacaaugguguugccgaucuuguacgaugcccccguugcgauuccucggggaagacggguguugguauggcauggaaauaaggccauuaagugagaaagaagaaaauaugguaaaaagucaagucacagcgggucaaggcacuucugaaacuuucucaaugggauugcuuugccuuacauuauuuguagaggaaugccugagaaggcgagucacacguaagcauaugauacuagccguaguuauaacucuaugugcaauaauauuagguggacuaacuuggauggaucuauuacgcgcccuaauaauguuaggggauacaauguccgguagaaucgguggacagacccaccuggcgauaaucgccguauucaaaaugagucccggauacguauugggaguauuucuuagaaaacucacaucgagagaaacagcacuaaugguaauaggaauggcaaugacgacuacucuaucuauaccccacgaccuuauggaacuaaucgacgggauuucuuuggguuugauucuuuuaaaaauuguuacacaauucgacaauacacaagugggaacgcuggcuuuaaguuuaacauuuauacgcucaacaaugagucugguaauggcauggcguacaauuauggcaguccuguucguagucacccuuauaccacuguguagaaccaguugcuuacagaaacagucgcauugggucgaaauaacugcacuaauuuuaggggcccaggcguuaccaguauacuugaugacucucaugaagggcgcaagccgaagaucuuggcccuugaacgaaggaauaauggcaguuggauugguaucgcuacuaggaagugcccuacugaaaaacgaugucccgcucgcuggccccaugguugcaggcgguuuacuucuagcagcguaugugaugagcggaagcucggccgaucuaagucuugaaaaagcugcuaacguucaaugggacgaaauggcagauauuaccggaucaaguccgaucauagaaguaaaacaagaugaggacggcucuuucuccauuagagacguggaggagacuaauaugauaacauuacuuguuaaacuugcauuaauaacaguaagcggccuuuaccccuuagcuaucccaaucacaaugacauuaugguacauguggcaaguuaaaacccaaagauccggagcauuaugggacguaccaucacccgcagcaacacaaaaagcggcuuuaucagaaggggucuacagaauaaugcaaagaggauuguucgguaaaacucaaguugguguagggauacauauggagggaguauuccauacaauguggcaugucacgcgagggaguguaaucugccacgaaacaggccguuuagagccuaguugggcagauguuagaaaugacaugaucucguacgggggaggauggagguuaggugauaagugggauaaggaagaagauguccaaguccucgcuauagagccuggaaagaacccaaagcauguccaaacaaaaccuggacucuuuaagacauuaacgggagagauaggcgcaguaacuuuagacuucaaaccaggaacauccgguagucccauaaucaauagaaaagggaaaguuaucggacuuuacggaaacggagucgucacaaaaucaggagauuacguaagcgcuauuacccaggccgagagaauaggcgaaccagauuacgaaguugaugaagauaucuucaggaagaaacgauuaacaauaauggauuuacaccccggagcaggaaaaacaaaacgaauuuugccuaguauuguaagagaagcucugaaaaggagauuacguacuuuaauccuggcgccaacacgagucguggcggcagaaauggaagaagcacuaaggggauuaccaauaagauaccaaacaccggcaguaaaaucggaacacacaggacgagaaaucguagauuuaaugugucaugcaaccuuuacuaccagguugcuuucauccacccgcgucccuaauuauaaucucauagucauggaugaagcgcauuuuacugauccaaguucagucgccgcacguggguauaucagcacuagaguagaaaugggagaggccgcagcaaucuucaugacggcaaccccaccgggugcuaccgaucccuuuccgcaaaguaauucuccaauugaagacauugaaagggagauaccggagaggucauggaacacaggauucgauuggauaacugauuaccaagguaaaacgguaugguucguuccaucuauuaaagcaggcaaugacauagcgaacugucugagaaaaagcgggaaaaagguaauacaacuaagccguaaaaccuucgacacagaguaccccaagacuaagcuaaccgauugggauuuuguagucacuacugauauaagcgaaaugggagcaaacuuucgggcuggaagagugauagauccacgaagaugccugaaaccugucaucuuaacagauggcccggaaagggugauuuuggccggaccaauacccgugacacccgccagugccgcacaaagaagaggacggauuggucgaaacccggcucaagaagaugaucaauacguauucucaggugauccucuaaagaaugaugaagaccacgcacacuggacugaagcaaaaauguuauuagauaacauauacacaccagaagguaucauccccacacuguuuggaccagaacgagaaaagacacaagcaauugauggagaauuucgauugagaggagaacaaaggaaaacguucguagagcucaugcggagaggggauuuaccagucuggcuguccuauaaagucgcaucugcggggaucucauauaaagaucgagaauggugcuucacuggagagcguaauaaucaaauucuggaggaaaacauggaaguugaaauauggacaagagagggcgagaaaaagaaauuacgccccaaauggcucgaugcaaggguauaugcggacccaauggcuuuaaaagauuuuaaagaauuugcauccgguagaaaaucgauuacacuagacauauuaacggaaaucgcuucauugccuacauaucuaucaucaagagcaaaacucgcucuugauaauaucgugaugcuacacacaacagaacgcggugggagagcauaucaacacgcuuuaaaugaauuaccagaaucccuggaaacucuaauguuaguugcacuguuaggugcuaugacggcggggauauucuuguucuuuaugcaaggaaaggguauuggaaaacuaaguaugggacuuauuacgauugcuguggcaucugguuuacuguggguugccgagauucaaccacaauggauagcagcgagcauuauccuugaguuuuuccuaaugguucuacucauaccagaaccugaaaaacagcguacaccacaagacaaucaguugauauauguaauacugaccauucuuacgauaauaggacuaaucgcggcuaaugaaaugggauuaauagagaaaacuaaaacagauuuuggcuucuaccagguaaaaacggaaacaacuauauuagauguggacuugagaccagcgagcgccuggacacuguacgcgguagcgacuaccaucuuaacaccuaugcuccgccauacuauagaaaauacuucagcaaacuugucgcuggcugcuauagccaaccaagcagcugucuugaugggucuaggaaaagguuggcccuuacaucguauggauuugggcguaccucugcuagcgaugggauguuacagccaagucaauccgaccacucuaacggcuagcuugguaauguuacuuguucauuaugcgauuauagguccaggauuacaagcaaaagcuacacgggaagcgcaaaaacgaacugcugcgggaauaaugaaaaauccuacaguugacgguauuacaguaauagaccuagaaccaauauccuacgauccgaaauuugaaaaacaacuugggcaaguuaugcugcuaguauugugugcaggccaacuuuuacucaugagaacuacuugggcuuuuugcgaaguacuuacauuagccaccgguccaauacugacacuaugggaagggaauccuggaagguuuuggaauacgaccauagcaguuaguacagcuaacaucuuuagagggucauaccuagcaggcgcaggacuagcguuuucuuuaaucaaaaaugcacaaaccccaagacgaggaacagggacagcuggagagaccuuaggagaaaaauggaaacgacaacucaacucccucgauaggaaggaauuugaagaauauaaacguagcggcauacuugagguggaccgaacugaagccaaaucagcucuaaaggauggaucaaaaaucaaacacgcggugucgcgaggaagcucaaaaauccgcuggauaguagaaaggggaaugguaaaacccaaggggaaagugguugaccuagguugugguagagguggguggucguacuacauggcaacacuuaaaaaugugacagaaguuaagggguauaccaaaggaggcccaggacaugaagaaccuauuccgauggccacuuaugguuggaauuuagugaaauuacauucaggaguugacguauuuuauaaaccaacagagcaagucgauacuuuacuuugugauauuggcgaaucgucgaguaacccaacaauagaagagggaagaacccuacgaguacuaaagaugguagaaccaugguugucaucgaagccggaauuuugcauuaaaguauuaaacccauauaugccgacuguuauugaagaauuggaaaaguuacaaagaaagcauggagggaaucuaguuaggugcccucucagccgaaauaguacacaugagauguacuggguuucaggagcaagugguaauauaguuaguagcgugaauacaacuucgaaaaugcuacugaaucguuuuacuacaagacaucgcaaaccuacauaugaaaaagacguagaucucggugccggaacacgcuccgugaguacugaaauagaaaaaccugacaugacgauaauuggacguaggcuacaaagacuacaagaagaacacaaagagacuuggcauuaugaucaagagaaucccuauaggacuugggcauaucacggauccuacgaggccccgagcacugggucugcaaguaguaugguaaacggagucguuaagcuacugacuaaaccaugggauguaauaccaaugguaacucaacuugcuaugacagauacaacaccauuuggacaacagcggguauucaaggaaaaaguggacacucggacgccucaaccuaaacccggaacaagaauggugaugaccacgaccgccaauuggcugugggcacuucuaggcaagaagaaaaauccgagguuauguacacgagaagaguucaucucaaagguucguucaaaugcggccauaggagcggucuuccaagaggaacaagguuggacuuccgcgucagaagccgucaaugacagucguuuuugggaauuagucgacaaagaaagagccuugcaucaagaagggaaaugugagucaugcguauauaauaugauggguaaacgcgagaagaaauuaggagaauuuggacgagcaaagggaucaagggcaaucugguauauguggcuaggagcgagauuucuagaguucgaagcucugggcuuuuuaaacgaggaccacugguuugggagggaaaauucuuggagcggaguagaaggugaaggucuacaccgacuuggguauauauuagaagaaauugauaagaaagauggagaucuaauguaugccgacgacacagcuggcugggacacaaggauuacggaagacgaccuucagaaugaggaauuaaucacugagcaaauggcgccacaucauaaaauuuuggcgaaagcaauauuuaaacuaacuuaccagaauaaaguugugaaagugcuaaggccuacgccuagaggagcuguaauggauauaaucucgcgaaaagaccaaagaggaagcgggcagguaggaacauacggacugaauacauucacgaauauggaaguacagcuaauacgacaaauggaagccgagggugugauuacgcaagaugauaugcaaaauccaaaaggccuuaaggaaaggguugaaaaauggcucagagaauguggaguagacagacucaagaggauggccauaucuggagacgacuguguagugaaaccucucgacgagcgauuuggaacguccuugcuauuccuaaacgauaugggaaaagugagaaaagacaucccacagugggaaccuucaaagggauggaaaaauuggcaagagguaccauuuugcucccaucacuuucauaaaauuuucaugaaggauggcaggagccucguaguacccugcagaaaccaagaugagcuaaucggaagggcaagaauuagucaaggagccggcuggaaucuccgcgagacugcaugcuuggguaaagcauacgcgcaaauguggucauuaauguauuuccacagaagagacuuaaggcuagcuaguauggcuauaugcucagcaguuccuacggagugguuuccaacaucuagaaccacauggagcauacacgcgcaucaucaauggaugaccacggaagauauguuaaaagucuggaaucgugucuggauugaagauaauccaaacaugauagauaaaacgccgguucacagcugggaggacauacccuaccugggaaagagggaagauuuauggugugguucccuaauuggucuaaguucaagagccacuugggccaaaaauauacauaccgcaauuacucagguacggaauuuaauagguaaagaagaauauguggauuacaugagugucaugaaacgauauucagcucccuccgaaucagaaggaguauuauga

SEQ ID NO: 23684 - RNA, 9867 nt, Artificial Sequence
  derived and/or modified CDS sequence (opt6) from DENV-4__KJ596665__SS-prME
ucuacaauaacucuacuaugccuaauaccuacuguaauggcguuucaucuuaguaccagagauggagaaccacuaaugauagucgcgaaacacgaaagagggcgcccauuauuauuuaaaaccacggaaggaauaaauaaauguacucuuauugcuauggauuugggggaaaugugcgaagacacggucacauacaaaugcccauugcuaguaaauaccgagccagaagacauugauugcugguguaaucuaaccaguacauggguaauguacggaacauguacucaaucuggagaaagacguagagaaaaacguaguguagcguugaccccacacucaggcaugggacuugagacuagagcagagacauggauguccucagaaggcgcauggaaacaugcacagcgagucgagaguuggauuuuaaggaacccaggauuugcauuguuagcaggguucauggcuuauaugauaggucaaaccgguauccaaagaacgguguucuucguuuugaugauguuaguugccccgucauauggaaugagaugcgugggggucggaaaccgagacuuuguagaagguguaucagguggcgcaugggucgaccuaguccuugaacacggcgggugcgucacaaccauggcccaaggaaaaccuacguuagacuuugaauuaacuaaaaccacugccaaagagguggcgcuacugaggacguacugcauagaggcauuaaucuccaauauaacuacugcaacacggugcccaacgcaaggagagccguaucuaaaagaagaacaagaccaacaauauauauguagaagagacguaguugauagggguugggguaacggcuguggacuauuugguaaagguggggugguaaccugcgccaaauucaguuguagugguaaaauuacuggaaauuuaguucaaauugaaaaccuagaauauacagugguuguuacaguacacaacggagauacacacgcgguuggaaaugacacaucgaaucauggaguuacugccacuauuaccccgaggucaccgucuguggagguaaaacuacccgauuauggugaauuaacccuagauugugagccccgaucgggaauagauuuuaaugaaaugauccuaaugaaaaugaagaagaaaacuuggcugguacauaaacaaugguuccuggaccugccauuaccauggaccaccggagccgacacaucugaaguucauuggaauuauaaggaacgcaugguaacguucaaagucccacaugcuaaaaggcaggaugucacaguauuaggcagucaagaaggagccaugcauucagcacuagccggugcaaccgagguugauucaggagaugggaaccauauguuugcggggcaucucaaauguaaaguccgaauggaaaaacuacguauaaaagggaugaguuauacuauguguaguggaaaauucucaaucgacaaagaaauggcggaaacacaacauggaacaaccgucguaaagguaaaguacgaaggugcuggugcaccaugcaaaguuccaauugagauuagagacguuaacaaagaaaaagucguuggucgaguaaucucagcaaccccucucgccgagaauacuaacucuguuacuaauauagaauuagaaccuccguucggagauucauauauaguuauagguguagguaacucugcucuuacccugcacugguuucgcaaaggaaguaguauaggaaagauguuugaaaguacguaccggggugcaaagagaauggcuaucuuaggagaaacagcuugggauuucgguucaguuggcggguuguuuacaaguuuaggaaaagcagugcaccaaguuuuuggcaguguauacacuacaauguuuggcggugucucuuggaugauaaggauacuuauaggauuuuuaguuuuguggaucgguacuaauucuagaaauacaucaauggcaaugacguguauugcaguagggggaauaacucuauuuuuaggauuuacaguacaggcagacaugggcuguguuguuucguggucugguagagaacuuaagugugggucagguaucuuuguaguagacaauguacacacauggacugaacaauauaaauuucaaccagagagcccugcuagauuggcuuccgcaauacuuaacgcccauaaagacgggguuugcgggauucgcucuacgacacguuuggagaacgugauguggaaacagauuacuaaugaacuaaauuacgugcucugggagggcggccaugauuuaacagugguagcaggagacguaaaagguguauuaacaaaagguaaaagagcuuuaacgccacccgcgaguggucucaaauauuccuggaagacauggggcaaagccaaaauauucacaccagaagccagaaauucuacguuccugauagauggaccugacaccucagaguguccgaaugaaaggagagcguggaacucauuugaagucgaagacuauggauuuggaauguuuaccacaaauauauggaugaaauucagagaggguucuagugaaguaugcgaucauagacuaaugagugcggcgauuaaagaucaaaaggcugugcaugcugauauggguuauuggauugaaaguagcaaaaaucaaaccuggcaaauugaacgagcgagucuaaucgagguaaaaacauguuuauggccuaaaacacauacuuuguggucaaauggagucuuggagagucaaauguugauaccgaaauccuaugcaggaccauucagccagcauaauuauagacaggguuaugcgacgcaaacaguagguccguggcacuugggaaaacucgaaaucgauuuuggagaauguccuggaacuacugucacaauucaagaaaacugcgaucacagaggccccucucuaagaacgaccacggccucuggaaaacuugucacacaauggugcugcagguccugcacaaugccaccucuucgcuuucuuggagaagacggguguugguaugggauggaaauaagaccguuaagugaaaaggaagaaaauaugguaaagagucagguaacugcagggcaaggaacuucagaaacauuuuccaugggucuacuaugccuuacauuauuugucgaagagugcuugagacguagaguuacuaggaaacauaugaucuuagcaguagugauaaccuuaugcgcgauaauacuugggggauuaacguggauggaucuauuaagggcgcugauaauauuaggagauacaaugaguggccggauuggaggccaaacacacuuagcuauuauggcggucuucaagaugaguccagguuauguauuagguguauuucuccgaaaacuuacuucacgugaaacagccuugaugguuauaggaauggcaaugaccacaacauuaucaauuccacaugacuugauggaauugaucgacggaaucaguuugggauugauucuauuaaaaauaguaacccaauuugauaauacacaagugggcacacuagcucucaguuuaacuuuuauacguuccacuaugucccuagugauggcauggcgaacaauaauggcuguuuuauuugucgucacacuaauuccuuuaugucgaacaucuuguuugcagaaacaaagucacuggguugagauaacagcacuaauauuaggagcgcaagcauuaccagucuauuugaugacauuaaugaagggggcaagccgacgaucauggccguuaaacgagggcauuauggcaguugguuuaguuucgcuacuagguuccgcgcuuuugaaaaacgacguaccauuagcuggucccaugguagcuggagguuuauuacuagccgcauaugucaugucaggcagcucggcugacuuaagccuagagaaggcggcaaacgugcaaugggaugaaauggcagauauaacgggcagcuccccaauuauagagguuaagcaagaugaagacgguagcuuuucuauacgcgacguugaagaaaccaauaugauaacuuuacuggucaaacuagccuuaauuacgguaagcggauuauauccauuagcuauccccauaacaaugacucuuugguacauguggcagguuaagacacagcggaguggugcauuaugggauguaccaagccccgcugcgacccagaaggcagccuuaagcgaaggagucuauagaauuaugcaaagaggauuauuugggaagacgcagguaggugucgguauucauauggaaggcguuuuucacacuauguggcauguuaccagaggaucuguuauaugucacgagacuggaagauuagaaccuucgugggcagacguacgaaaugacaugaucucauacggcggcggauggagacuaggugacaaaugggauaaagaagaggauguucaaguuuuagcgauagagccagguaaaaauccgaagcauguucaaaccaagccgggacuauuuaagacucucacuggcgagauuggagcaguaacguuagacuucaaaccaggaacaaguggcuccccaaucauaaaucgaaaagguaagguuauuggauuauacggcaaugguguuguuaccaaaagcggcgauuaugucagcgcuauaacacaggcugaaaggauuggagagccggacuacgaaguagacgaggacauauuuagaaagaaaagauuaaccauuauggauuugcauccaggagcgggaaaaacgaaaagaauacuuccaucaauuguaagagaagcauuaaaaagacggcuucggacucucauauuagccccuacaaggguuguagcagcagaaauggaggaggcacuuagagggcuucccauucgauaucaaacuccugcuguaaaaagugagcauacuggcagggaaauaguugaccucaugugucaugcgacuuuuacaaccagauuauuaucuucaacgcgaguaccuaauuacaauuuaauuguuauggacgaggcacacuucacugauccaaguucaguggcugccagaggauauauuucaacacggguggagaugggugaagccgcagcaauuuucaugacagcaacaccaccgggggcaacugauccuuucccucaaucaaacucuccuaucgaagauauugagcgagaaauucccgaacgcucuuggaacacaggauuugauuggauaacagauuaucaagguaaaacuguaugguuuguaccgucuauaaaagcugggaacgacauagcaaacugucugcgaaaaucgggcaagaaaguaauccaauuaucuagaaaaaccuuugauacagaauacccaaaaacaaaauuaacugauugggacuucguagugacaaccgacauaagugaaaugggagcaaauuucagagcaggccgugucauugacccacgucguuguuugaaaccuguaauuuuaaccgauggaccagaacgagugauacuagccggcccuauaccggugacuccagcgucugcggcucaacgacgagggagaaucggcagaaauccugcucaagaagaugaucaauaugucuucagcggagauccacuuaaaaaugacgaggaucaugcccacuggacagaggcuaagaugcuucuugacaauauauacacacccgaagguauaauuccaacacucuuuggaccagagagagagaaaacacaagcuauugauggcgaauuuagacuuagaggagaacaaaggaaaacauucguugagcugaugcgacgaggagaucugccaguguggcuaagcuauaaagucgcaucagcagguaucucauauaaagaccgagaaugguguuuuacuggugaacgaaacaaccagauucuggaggagaacauggagguugagauauggacaagagaaggugagaagaagaaacucagaccaaaauggcuugacgcgcgaguauaugccgacccaauggcucucaaagauuuuaaggaauuugcuucgggaagaaaaucaauaaccuuagacauccuuacagaaauugcauccuuaccaacguaccuuucauccagggcaaaauuagcuuuggacaacauuguaaugcuacauacaacugaacgaggcgggcgagccuaccaacaugccuuaaaugaauugccugagucuuuagaaacuuuaaugcuggucgcccuucuuggugcuaugacggcagguauuuuucuauucuuuaugcaaggcaaaggaauagguaaacucaguaugggccuaauaacgauagcuguugcuucuggucucuuauggguugcagaaauacaaccacaauggauugcugccucgauaaucuuagaauuuuuccuuaugguauuacuaauuccagaaccggagaagcaacgaacaccucaagauaaucaacucaucuacgugauacuuacaauacuuacuauuauaggucuaauugcagcgaaugaaaugggauuaauugagaaaacaaaaacagauuuuggcuucuaucaaguuaaaaccgagacaacaauucuugaugucgacuugcguccugcaagugccuggacuuuauacgcaguagcaacuacaauacuuacacccaugcuacgucauaccauugaaaauacuucggcgaauuugagucuagcagcgauugccaaucaagcggcgguacucauggguuuaggcaaagguuggccacuacacagaauggauuuggggguuccucuucuagcgauggguugcuauucucaagugaacccaacaacgcuuaccgcuucccuaguaaugcuccuaguacacuacgccauaauagggccuggucuacaagcaaaggcaacacgcgaagcucaaaaacggacugcugcaggaauaaugaaaaauccaacaguggauggcaucacagucauugacuuggaaccgauaucuuacgacccaaaauucgaaaaacaauuaggacaaguaaugcuccuaguucuuugugcgggucaacuuuugcuuaugcguacgacgugggcauucugcgaaguauuaacccuugcaacaggaccaaucuuaacacuaugggaaggaaaccccggaagauuuuggaacaccacuaucgccgucuccacagcaaacaucuuucgcgguucuuacuuagcuggugcagguuuagcauucucgcugaucaaaaaugcccaaacuccucggagagggacugggaccgcaggagaaacauuaggugaaaaauggaaacgccaauuaaauagcuuagaccgcaaggaguuugaggaauauaaaagaagcggaauuuuggaaguagacaggacugaagccaaaucagcucugaaagauggaucaaaaauaaagcaugcuguaucaagggggagcucaaagauucgauggaucguagaacgagguaugguuaagccuaaaggaaaagucguugacuuaggauguggaagaggagguuggucuuauuacauggcuacccugaaaaaugugacggaaguuaaaggauacacaaagggaggucccggccacgaggagccgauaccgauggccacauacggguggaauuuagucaaauugcauaguggugucgacguauucuacaagccuacggaacaaguugauacacuucuaugcgacauuggagaaagcucaagcaaucccacuaucgaggaggggcgaacguuaagaguguuaaagaugguggaaccaugguuaaguagcaagccagaauuuugcaucaaaguucuuaacccguacaugccgacuguuaucgaagaacucgaaaagcuacaaaggaaacauggcggcaauuuaguuaggugcccccuaucuagaaauaguacucaugaaauguauuggguaucgggagcaucagguaauaucguaucauccguuaacacaacaagcaaaaugcuuuugaaucgcuucacgacucgucauagaaaaccaacuuacgaaaaagauguggaccuuggcgcaggcacacggucagugagcacagaaacugagaaacccgacaugaccauaauaggaagacgcuuacaaaggcuccaagaggaacauaaagagacuuggcauuacgaucaagagaauccguauagaacuugggcguaucaugguaguuaugaagcuccaucaacugggagugcgagcucaaugguaaacggaguaguuaaacugcuaacuaaaccuugggacguaauaccaauggucacucaacuagcuaugacugacacgacuccauuugggcaacaacgugucuucaaagaaaaaguugacacucgaacaccccaaccuaaacccggcaccagaaugguuaugacaacaacggcaaauuggcucugggcgcuccuaggaaagaagaaaaacccgagacucugcacgagagaagaguucauaaguaaaguccgcuccaaugcagcaauaggagcaguuuuccaagaggaacaaggauggacuucugcaagcgaggcuguaaaugacucccgauuuugggagcuaguagauaaagaacgugcacuacaucaagaaggaaaaugugaaaguuguguauauaacaugauggguaaaagagagaagaaauuaggagaguuuggccgcgcaaaaggcucucgagcaauaugguauauguggcugggagccagguuuuuagaguucgaagcauuaggauuucuaaaugaagaccacugguuugguagagaaaauucauggucagguguagaaggugaagguuuacaccggcucggauauauuuuggaagaaauagauaagaaagauggagauuuaauguaugcagaugauacugcgggaugggauacaagaauaaccgaagaugauuuacaaaaugaggaacuaauuaccgagcaaauggcuccgcaucauaaaauacuggcgaaagccauauuuaaacuaacuuaucaaaauaaaguugucaaggucuugcguccaacaccgagaggagcaguaauggacauuauaucaagaaaagaccaaaggggaucaggacaggucggaacguauggucuaaacacauuuacaaauauggaggugcaacuaauaagacagauggaagcggagggaguaauaacccaagacgacaugcagaauccaaagggucucaaagaaagaguugaaaaauggcuaagagaguguggaguggaucgacucaagagaauggcaauaucuggagaugacugcguugugaaaccauuggaugaaagauuugguacaucacuacuuuuccuaaacgacaugggcaaaguaaggaaggacauaccacaaugggaacccucuaaaggguggaagaauuggcaagaagucccauuuuguucacaccacuuucacaagauuuucaugaaagauggaagaucauuaguaguaccguguagaaaccaagaugaguuaauuggcagggcgagaaucucacaaggcgcaggcuggagccucagagaaacugcaugcuugggaaaggcuuaugcucaaauguggagccugauguauuuccacagaagagaucuacgauuggccuccauggcaaucuguucagcuguucccaccgagugguuuccaacaagcaggacaacuuggucaauacacgcucaucaucaauggaugacuacagaaaauauguuaaaggucuggaaucggguguggauugaggauaacccaaauaugauugacaagacgccuguccauucuugggaggacauccccuaccuaggaaaacgugaagaccuguggugugguucacuuauuggcuuguccaguagagcuacgugggccaaaaauauacauaccgccaucacacaaguaagaaaccucauagguaaggaagaauauguagacuauaugccgguaaugaaaagauauagcgcuccuagugagagugaaggagugcuuuga

SEQ ID NO: 23685 - RNA, 9867 nt, Artificial Sequence
  derived and/or modified CDS sequence (opt6) from DENV-4__KJ596668__SS-prME
ucgacaauuacucuucuuugcuuaauacccacuguuauggcauuucaucuaucuacuagagauggagaaccauuaaugauaguugcaaaacacgaaaggggaaggccccugcuauuuaaaacaacagaagggauaaauaaaugcacucuaauagcaauggacuuaggcgaaaugugcgaagauacaguaacuuauaaauguccuuuacugguuaauacagaaccagaagauauagacuguuggugcaaucuaacaucaaccugggugauguaugguacguguacucaaagcggcgaaagaaggcgcgagaaacguaguguugcauuaacgccacauagugguaugggauuagaaacaagagcagaaacguggauguccucugaaggugcauggaaacacgcacaacggguagaaucguggauauuaagaaacccaggcuucgcacuauuagcagguuuuauggcguacaugauuggucaaacgggcauacaaagaacaguuuucuuuguccugaugaugcuaguagcaccaucauauggaaugcguugugucgggguaggcaaucgagacuucguagaagguguuagcggcggggcuuggguggacuugguguuggaacauggaggcuguguaacuaccauggcucaaggaaaaccgacucuagauuucgaacuaacaaaaacaaccgcuaaagaagucgcucuauugcgcacuuacugcauagaagcccuaauaucaaauauaacuacggcuacgcggugucccacccaaggugaaccauauuuaaaagaagaacaagaucagcaguauauaugucgaagagaugugguagauaggggaugggguaacggcuguggguuguucggaaaaggagguguaguaacgugugccaaauucagcugcucuggaaaaauaaccgguaauuuaguacaaauagagaauuuagaauauacugucguggucacuguucauaacggugauacucacgcaguuggaaacgauacaucaaaucauggaguaacagcuacaauaacacccaggaguccgaguguagaaguaaaauuaccggauuauggagaauugacccuagacugugaaccuagaaguggaauagauuucaacgaaaugauacucaugaaaaugaagaagaaaacuugguuaguacauaaacagugguuccucgacuuaccgcuuccguggacuacaggugcggauaccagugaagugcauuggaauuauaaagagagaauggugacauucaaaguaccucacgcuaaaagacaggacguaacgguuuuaggaucacaagagggagcuaugcauagugcgcuagcaggcgcaacugaaguagauaguggagaugguaaucacauguuugcaggucacuuaaaauguaagguuagaauggaaaaguuaagaauuaaagggaugagcuacacuaugugcucaggaaaguucagcaucgacaaggagauggcagaaacccaacacggaacaacuguaguuaaagugaaguacgaaggugccggugcaccauguaaaguccccauagagauacgagacguaaauaaagaaaaaguuguggggcgaguuauaagcgcuacaccauuagcagaaaacaccaacagcguaaccaauauagaacuugaacccccauuuggagauucguauauagugaucggagugggcaacucagccuuaacuuuacacugguuccgaaagggaucaaguaucggcaaaauguuugaaaguacuuaccguggggcuaagagaauggccauucucggcgaaacagcaugggauuucggauccgugggcgguuuguuuaccagucuaggaaaagcagugcaucaaguauuugguagcguauauacaacaauguuuggaggagucucauggaugauaagaauacuaauaggauuucuaguacuauggauagguacaaacucucguaauacauccauggcaaugaccuguauagccguagguggaaucacucuauuucugggcuucacagugcaggcugacaugggaugugucguuucauggaguggucgggaacuaaagugcgguaguggcauuuucguaguggacaacguacauacuuggaccgaacaguauaaauuucaaccagaaagcccugcaagacuugcgucagcgauacuuaaugcgcauaaagacggugugugcggcauacggagcacuaccagacucgagaaugucauguggaaacaaauaacaaaugaacuuaauuacgugcuaugggagggaggacacgauuugacgguaguugccggugauguaaagggaguucuuacuaaaggcaaaagagcccuaacaccacccgcgucggaccucaaauauucauggaaaacauggggaaaagcgaaaauauuuacaccugaagcucguaauucaacauuuuuaauugauggcccugacaccagcgaaugcccaaaugaacgcagagcuuggaauaguuucgaaguagaagauuauggguuugguauguucacgacaaauauuuggaugaaguucagagaagguucuagugaaguaugcgaccaccgauuaaugucugcagcaauaaaagaucaaaaagcaguacacgcagacauggguuacuggaucgaaucaagcaaaaaucaaacauggcaaauagaacgagccagcuuaaucgagguuaaaacaugucuauggccgaaaacgcacacacuauggaguaacggaguauuagagucucaaauguuaauaccuaaaucauaugcgggcccauucucccagcauaauuaccgacaagguuaugcuacgcagacaguaggaccauggcaucuagggaaauuggaaauugauuuuggugaaugucccgggacaacagucacaauccaagaaaacugcgaucacaggggccccucccuaagaaccaccaccgcuagugguaaauuaguuacucaaugguguuguagaucuugcacuaugccuccacuuagauuuuugggcgaggacgguugcugguaugguauggaaauccgaccacuuagcgaaaaagaggaaaauaugguuaagucgcaagucaccgcgggacaaggaacuucagaaacuuucucgaugggcuuauuaugcuuaacccuauuuguagaggaaugccuacggaggcggguaaccagaaaacauaugauuuuggcgguaguaaucacgcuaugcgcaauuauuuuagggggccuaacuuggauggaccuacucagggcacuaauuauauugggugauacaaugagcgguagaauaggcgggcaaacacaucucgccauuauggcaguauuuaaaaugagcccuggauauguauuaggaguauuuuuaagaaaacuuaccucaagagaaacugcuuuaaugguaauagggauggcuaugaccacaacuuuaucaauuccucaugauuuaauggaauuaauagacggcauaagccuaggucuaauacuccuaaagauagucacacaguucgauaacacacaaguaggcacacuggcgcuaucacuaaccuuuauaaggucgacgaugagcuuagucauggcuuggagaacuaucauggcaguucuuuucguaguaacgcucaucccucuaugcagaacuucaugucuucaaaagcagucacacuggguugaaauaacagcacuuauccugggcgcucaagcauugccgguauaucuaaugacucugaugaagggagcgagcagaaggaguuggccucuaaacgaaggaauuauggcaguaggauuaguaucacuccuuggguccgcacuguugaaaaaugaugucccucuagcaggaccuaugguugccgggggauuacuguuggcagcauauguuaugucaggaucuucagcagaucucucacuagaaaaagcagcgaauguucagugggacgagauggcugacauuaccggaucuucgcccaucauagaaguuaagcaagaugaagauggcaguuucucaaucagggauguugaagaaacaaacaugauaacacugcuuguuaaacuugcacuaauaacggucagcgggcuauauccauuagcgauucccgucacaaugacccucugguacauguggcaaguuaaaacccaacgaagcggcgcuuuaugggacguaccaagucccgcugcaacacaaaaagcugcuuugucagaaggugucuauagaauaaugcaacgggguuuguuuggaaaaacucaaguuggaguugggauacauauggagggaguuuuucacacaauguggcacguuacuagagguagcguaaucugucaugagacaggccgacucgagcccucaugggcugacguuagaaacgauaugauuaguuauggaggagguuggcggcuuggagacaaaugggauaaggaagaagacguacaaguucuagcaauagaacccggcaaaaauccaaaacaugugcaaacuaaaccaggguuauuuaaaacacuaacuggugaaauuggugcaguaacauuagauuucaagccggguacaucuggcaguccaauuauuaauaggaaagggaaagugauugguuuguacggaaacggggugguuacaaaguccggcgacuaugucagugccauuacacaagcggaaagaaucggggaaccggauuacgaaguagaugaagauaucuuccgcaaaaagagauugacuauuauggacuuacacccaggggcagguaaaacgaaacgaauacuuccgaguauuguaagagaagcauuaaaaagaagacugaggacgcucauauuagcaccgacgagggugguugcugcagagauggaggaagcguugcgaggccuacccaucagguaucaaacaccagcaguuaaaagugaacacacgggaagagaaauaguggauuuaaugugucacgcgacauucacaacuagacuucucaguagcacaagaguacccaauuauaaucuaauugucauggacgaagcucauuuuacagacccaaguagcguugccgcgcgcggauauauuucaacgcggguagagaugggggaggcagccgcaauuuuuaugacggcuacgccaccgggugccacugauccauucccacaguccaauagcccuauagaggauauugagagagaaauccccgaaagaucauggaacacugguuucgauuggauaacagacuaucaggguaagacuguaugguuugugccauccauuaaggcugguaaugacauagcgaacuguuugagaaaaucagguaagaaaguaauucagcuuagucggaaaacauucgauacugaauauccaaaaacaaaacucaccgacugggacuuuguuguaacgacagacauaucagaaaugggugcgaacuuccgugcaggccggguaauagacccaagacgaugcuuaaaacccgugauccuuaccgacggccccgaacgagugauucuagccggaccgauucccguaaccccugcaucugccgcucagcgaagaggacgaaucggaagaaauccggcccaagaggacgaccaauacguauuuagcggggauccacucaaaaacgaugaagaccaugcacauuggaccgaagcaaagaugcucuuagauaacauauauacaccggagggcauaauuccuacauuauuuggcccagaaagagagaaaacucaagcaauugacggagaguucagauuacgaggcgaacaacgcaaaacauucgucgaguuaaugagaagaggagaucuuccuguaugguugucauacaagguagccucggccgguauaucauacaaggaccgggaauggugcuucaccggggaacgaaauaaccagauacuagaggaaaauauggaaguggaaauuuggacuagagaaggcgaaaagaagaaauugaggccuaaauggcuugaugcuagagucuaugcagauccaauggcacucaaggauuuuaaagaguucgcaucuggccgaaaaaguauaacgcuugauauacuuacugaaauagccuccuuacccacuuauuuaaguucgcgggcuaaauuagccuuggacaacauaguaaugcuacauacaacagaacgaggcggacgagccuaucaacacgcuuuaaaugaauuaccugagagccuugaaacacuaauguuaguagccuuauuaggggcuaugacugcagggauauuccuauucuucaugcaaggaaaaggcauugggaaacuuagcaugggucuaauaacuaucgcaguagcaucaggauuacuauggguugccgagauacaaccucaauggauugcggcaucaauuauauuagaguucuuucugauggugcuucugauaccggaaccagaaaaacagagaacaccacaagacaaccaauuaauuuauguaauccuaacaauauugacaauaauaggacuuauugcagcaaaugagaugggguuaaucgagaaaacaaaaacagacuuuggguucuaccagguaaagacugaaacuacgauacuugacguugauuugcguccagcgagugcauggacauuauacgcuguagcgacaacaauauugacaccaaugcuucgacauacuauagaaaauacaucagcgaaccuaucucuugcggccauagcaaaccaggcugcuguacucaugggucucggaaaaggcuggccccuucauagaauggacuuagguguuccccuauuagccaugggauguuacucucaaguuaauccgacgacacuuacugccucacucgucaugcucuuagugcacuacgccauaauuggacccgguuugcaagcgaaggcaacucgagaagcacagaaaagaacagcugccgguaucaugaaaaacccaacaguagaugggauaaccguuaucgaucuagaaccuauuuccuacgauccgaaauuugaaaaacaacuugggcaaguaaugcugcuaguacuuugugcuggacaauuacuacuuaugagaacaacaugggcauucugcgagguguugacguuggcaacaggcccuauucuuacccuaugggaaggcaauccuggucgauuuuggaauacgacuauagcagugucaacagcaaauauuuuccgagggaguuaucuugcuggagcuggacuggcuuuuucgcuaauuaaaaacgcacaaaccccacguagaggaaccgggacagcuggggaaacguugggagaaaaguggaaacgacaauuaaauagucuagaucgaaaggaguucgaggaguauaaacgcucuggcaucuuagaaguugaucgaaccgaagccaagagugcauuaaaagaugguucuaaaauaaaacaugcaguaagucgaggcucgucaaaaauucgcuggauuguagaaaggggaauggucaagccuaagggaaaggugguggaccuagguuguggucgugggggcuggagcuauuacauggcuacacugaagaaugucacggaaguuaagggcuacacaaaagguggcccaggacaugaagaaccaauacccauggcaacauauggauggaauuuaguuaaacuacauucaggcgucgacguguucuacaagccuacagaacaaguggacacauuacucugcgauauaggcgaaagcagcaguaauccaacaauagaagaaggccgcaccuuaaggguacuuaaaaugguggaaccuugguuaagcagcaaacccgaauuuuguaucaaaguacuaaacccauauaugccaacagucauugaagaauuggaaaaauuacaacgcaagcacgggggaaacuugguaagauguccucuaucucgaaacaguacacaugaaauguacuggguaaguggugcgaguggaaauauuguauccucgguaaacaccacaaguaaaaugcuauugaauagauucaccacuaggcacagaaagccaacauacgaaaaagauguagacuugggagccgggacgaggucuguaagcacagagacugagaaaccugauaugacuaucauaggaagacgguuacagcgacuacaggaggaacauaaggagaccuggcauuaugaucaagaaaacccuuauagaacuugggcguaccaugggucauacgaagcaccgucuacaggcucggcauccuccauggugaauggaguagugaagcugcucacaaaaccaugggacguuauaccgaugguuacucaauuagcaaugacggacacuacaccuuucggccagcaacgaguauuuaaagaaaaaguagauacuagaaccccucaaccuaaaccaggaacucguaugguaaugacaacuacagcuaacugguugugggcuuugcuuggcaagaagaaaaacccaaggcuuuguacucgugaagaguucauaaguaaaguaaggucaaaugcggcaauaggugcuguuuuccaagaagaacaaggauggacgagugcaagugaagcagugaaugacaguagauuuugggaacuuguugauaaagagagagcucuacaucaagaaggaaaaugugaaucaugcguauauaauaugauggggaagcgagagaagaaacuaggcgaguucgggagagcaaaagguucaagagcgauaugguauauguggcuuggggcaagauuucuagaguucgaagcauuaggauuucuaaaugaagaucauugguuuggccgugaaaacucuuggaguggaguagagggugaaggcuugcacagauuaggauauauauuagaagaaaucgauaagaaagauggagacuuaauguacgcagaugauaccgcagggugggauacacguauaacagaagaugaucuacaaaaugaagaguuaauaacagaacagauggccccgcaucauaaaauuuuggcgaaagcaauuuuuaaacuuaccuaucaaaauaaaguggucaaaguccuacgucccacgccuagaggcgcaguuauggacauuauuucacguaaggaccagcgugguucuggccaaguugggacuuacggucugaacacauucaccaacauggaaguucaguuaauuagacaaauggaagccgaagggguaauuacacaggaugauaugcaaaauccaaaaggucugaaagaaagagucgaaaaaugguuaagagaauacgguguagauagacuaaaacgaauggcaaucucaggggaugacugugugguaaaaccauuagacgagcgauucggcacaucucuuuuguuucucaacgauauggggaaagugagaaaagauaucccccagugggagccauccaaaggguggaagaacuggcaagaaguaccguuuugcucucaucauuuucauaagauauuuaugaaagaugguaggagucucguaguaccgugcagaaaucaagacgaacuaauaggucgugcucgcaucucucaaggggcaggguggagccuaagagaaacugccugccuagguaaagccuacgcacagauguggaguuuaauguauuuucacagacgagaccuacgacuugcuucaauggccauuuguuccgcagugccaacagaaugguuuccgacgucgcgcacaacauggaguauccacgcgcaccaucaguggaugacgacugaagacaugcuaaaagucuggaaucguguuuggaucgaagauaauccuaauaugauagacaagacgccaguucauuccugggaagauauacccuaucucgggaagagagaagaccucuggugcggaucacuuaucgguuuaagcucuagagcuacuugggccaaaaauauacacacugcgauaacgcaagugagaaaccuuauuggaaaagaagaauauguggauuacaugcccguaaugaagagauauagugccccaagugaguccgaagguguacuguaa

SEQ ID NO: 23686 - RNA, 9867 nt, Artificial Sequence
  derived and/or modified CDS sequence (opt6) from DENV-4__KJ596670__SS-prME
aguacuauaacuuuacuaugucuaauaccaacugugauggcuuuucaccuaucuacgagagauggagaaccuuuaaugauuguggcaaaacaugaaagagggagaccguuguuauucaaaacgacugaggguauuaacaaauguacucuaauugcuauggacuugggagaaaugugcgaagauacaguuacauauaaauguccccuuuugguaaauaccgaaccugaggauaucgacugcuggugcaaucuuacaaguacuuggguaauguauggaacuugcacucaaaguggcgaaaggagacgggagaaacgaagcguugcuuuaaccccgcacucagguaugggauuagaaacacgagcggagacauggaugucuagugaaggugcuuggaaacaugcucaaaggguugaaaguuggauucuuagaaauccgggauucgcgcuauuagcugguuuuauggcauauaugauuggacaaacagguauucaaaggacuguguucuuugucuugaugaugcuuguagcacccagcuacgguaugagaugcgugggaguaggcaaucgcgauuuuguugagggaguuucugguggagcuuggguugaccuuguucucgaacacggaggaugugucacuacuauggcgcagggcaaaccgacccuagauuuugaauuaacaaaaaccacggcuaaggaaguagcacuauuaagaacauauugcauagaagccuuaauuagcaacauaacaacagcuacuagauguccaacucaaggggagccuuaucuuaaagaagaacaagaccaacaauacauuuguagacgggauguaguugaucgaggcuggggaaaugguugcgguuuguuuggaaaaggagguguagugacgugcgccaaauuuucauguuccggcaagaucacgggaaacuuaguccagauugaaaaccucgaauauacgguaguugucacaguacauaauggagacacccaugcaguggguaaugauaccucuaaucaugguguaaccgccacuauuaccccuagaucgccaucaguagaagugaaacugccagacuauggugaacuaacgcucgacugcgaaccaagaucaggaauagauuucaaugaaaugaucuugaugaaaaugaagaagaaaacuugguuaguccauaagcaaugguucuuagauuugccauugccuuggacaacuggagcugacacauccgaaguacacuggaacuauaaagaacgcauggucacuuuuaaagugccccacgcgaaaaggcaagacgugacugugcuggguucacaggaaggugcaaugcauagugcauuagcgggcgcaaccgaaguagacuccggugacggaaaucacauguuugcuggccaccuaaaauguaagguuaggauggaaaaguugaggauaaagggaaugucuuauacuauguguucaggaaaguucucaauugauaaggaaauggcugaaacacagcauggaacaacagugguaaaagugaaauaugagggcgcuggggcgccauguaaaguuccaaucgaaauuagggaugugaauaaggagaaagucguuggcagaguaauaucagcuacuccauuagcagagaauacaaauaguguaacaaauauugaacuagaaccuccuuuuggggauaguuacauaguuauaggaguggggaacucagcauuaacuuuacacugguucaggaagggaucuucuauagguaagauguucgaaucaacguauaggggugccaaacgaauggcuauauuaggugaaacugcuugggauuucggaaguguagggggauuguucacaucguuagguaaagcuguacaucaaguguuuggaucuguauacacaacaauguuuggaggcguaucguggaugauacgaauccuuaucggauuccugguacuguggauugggacaaacucaaggaauaccucaauggcaaugaccugcauagccguuggugggauuacccuuuucuuaggauucacggugcaagccgacaugggguguguuguuagcuggucagguagagaauuaaaaugcgguuccggaauauucguaguagacaauguacacacuuggaccgaacaguauaaauuucagccugaaagccccgccaggcuugcuagugcgauacuaaaugcgcacaaggauggcguaugugguauuagaagcacuacucgucuagaaaaugucauguggaaacaaauaacaaaugaauuaaauuauguuuuaugggaggguggacacgacuugacaguaguagccggugauguaaaaggaguucuuacuaaagguaaaagagcacuaacgccuccugcuagugauuuaaaguacucauggaagacaugggguaaggcaaaaauauucacaccugaagcaagaaacagcacuuucuuaaucgacggaccggauacaucugaaugcccaaaugagagaagggcuuggaacuccuuugagguggaggacuauggauucggaauguuuacaaccaacauuuggaugaaguuuagggaagggaguagugagguuugugaccauagauuaaugagugcugcaauaaaagaucaaaaagcaguccaugccgauaugggauacuggaucgaaucgucuaaaaaucaaacauggcaaaucgaaagagcaucucuaauagaagugaaaacuugccuuuggcccaaaacacauacauuaugguccaauggcgucuuagaaucucagaugcucaucccaaaaucguaugcaggaccauucucgcaacacaacuauagacaggguuacgcaacgcagacagucggucccuggcauuuaggaaaauuagaaaucgauuuuggcgaaugcccugguacaacuguaaccauucaagaaaacugugaccacagaggaccguccuugcguacgacuacagcauccgguaaacugguaacacaaugguguugcaggucaugcacgaugccuccacugcguuuucuaggagaagauggcuguugguauggaauggagauucguccgcucuccgaaaaagaagaaaacaugguuaaaagccaaguaaccgcaggacaagguaccagcgagacauucucgauggguuuacuauguuuaacguuauuugucgaagaguguuugcgacggaggguuacgagaaaacauaugauacuagcuguaguuauaacacuaugcgcgauagugcuaggaggacucacauggauggauuuauugcgagcccucauuaugcuuggagacaccaugagugggagaaucggagggcagacgcaucuagcuauaauugccguguuuaaaaugucgccaggguauguacuagguguauuuuuacguaaauuaacaucgcgagaaacugccuuaauggucaucggaauggccaugacaaccacuuuaagcauaccgcacgaucucauggagcuaauagacgguauaagccuaggacuuauacuacuaaagauaguuacgcaauuugacaauacacagguaggaacucucgcuuuaucgcuaacauuuauacguagcacaaugagucuggucauggcauggagaacgauaauggccguacuauuuguaguaacacuuauccccuugugcaggacaucaugcuugcaaaaacaaagccauuggguagaaauuacggcccucauucuuggagcucaagcgcuaccaguauacuugaugacacugaugaagggugcuucucggcgcucauggccacuuaacgaaggaaucauggcgguuggauuaguaaguuuacucggaagcgcacuauuaaagaacgacguaccacuagccgguccuaugguggcaggaggacuuuuauuggcggcauauguuaugagcgguaguucggcagaccuaagucuugaaaaagcagccaauguucaaugggacgagauggcugacaucaccgguucaagccccauuauagaaguuaaacaagacgaggacggaucauucaguauucgugauguagaagaaaccaacaugauaacccucuuggugaaauuagcacuaauaacugucucaggucuauacccuuuagccauaccaauaacgaugacguuaugguacauguggcaaguaaaaacgcaaagaagcggagcguuaugggacguuccaagcccugcagcuacgcagaaagccgcccuauccgaagguguguaucgaaucaugcaaaggggucuauuuggaaaaacucaaauuggcguggguauucacauggagggcguguuucauacaauguggcauguuacacggggauccguaaucugccacgagacuggaagacuagagccaucuugggcagauguuagaaaugacaugauuucuuauggcggaggguggagauuaggggauaagugggacaaagaagaggacguucaaguacuagcaauagaaccuggcaaaaacccgaaacauguacaaaccaaaccgggguuauuuaaaacacuaacaggagaaaucggagcagugacucuggauuuuaaaccggggacauccggcagcccgauaauaaacagaaaaggcaaaguaaucggguuauaugggaauggaguagucacuaaaaguggagauuauguaucagcuauuacgcaagcggaaaggauuggggagccugauuacgaaguagaugaggacaucuuuagaaagaaaaggcugaccauaauggaccuacaccccggggcagguaaaacaaagaggauucuuccaucaauagugcgugaagcauuaaaacggagguuaagaacacuuauucucgcuccuacccgcguaguagcugcggaaauggaggaagcauuaagagggcuaccuauuagguaccagacuccggcaguuaagucagagcauacagggagagagauuguugaccuuaugugucaugcuacauuuacaacgcgauuguuaagcagcacccgcgugcccaauuauaauuuaaucguuauggacgaagcacauuucacugauccuuccagcguagcagcgcgaggauacauuagcacucgcgucgaaaugggagaagcagcagcgauauuuaugacagcgacgccucccggugcuacugauccuuucccccaaucaaacucuccaauagaagauauagaaagagagauaccugagagaucuuggaauacgggauuugauuggaucaccgauuaucagggcaaaacugucugguucgucccgucaauuaaggcaggaaaugauaucgccaacugucugagaaaaucuggcaagaaagucauacaacuuaguagaaaaaccuuugauacggaauauccgaagacaaaacuuaccgacugggacuuugucgucacuacagauauaucugaaaugggagccaauuuuagagcgggaagagucauugauccacgacgcugucuaaagccagucauuuuaacugauggacccgagcgaguaauauuagcuggaccaauacccguuaccccugccagugcagcacaaaggcgcgggagaauaggaaggaacccugcccaagaagaugaccaauauguauucucaggcgauccauuaaagaaugacgaagaccaugcucacuggacagaagcuaagaugcuuuuggacaauauuuauacgccggaagguaucaucccuacauuauuuggaccagaacgggagaaaacccaggcuauagacggagaauuucgacucagaggcgaacagagaaaaaccuuuguagaacuuaugagaagaggggauuuaccugucuggcuaucauauaaaguugcaucugcuggcauaaguuauaaagauagagagugguguuuuacaggcgagcgaaacaaccaaauccuugaagagaauauggagguggaaauauggacccgugagggcgagaagaagaaauuacgcccgaaaugguuggaugcuaggguuuaugcugaccccauggcacuaaaagacuuuaaagaauuugcaagcggccguaaaagcauuacauuagacauucuuacugaaauugccucacuaccgaccuaccuaucuagccgagcaaaacuagcucuggauaacaucguaaugcuacacacaacggagagaggugguagagccuaucagcacgcccugaaugaauuacccgaaucccuagaaaccuuaaugcuuguggcauuauuaggugcuaugacugcgggaaucuuucuauucuuuaugcaaggcaaaggcauagguaaacucucuaugggcuuaauaaccauagcaguggccaguggauuacuuuggguggcugagauucaaccucaguggauugccgcauccauaauuuuggaguucuuuuugaugguauuacuaauuccugaaccugaaaaacaacggacaccucaagauaaccaauuaauuuauguuauacuuacaauacucacaauaauaggucuuauagcugcuaaugaaaugggacuaaucgagaaaacuaaaacugacuuuggauucuaccaaguaaaaacagaaacuacaauauuagauguggaucuuagacccgcaagcgccuggacauuauacgcaguagcuacaaccauauugaccccaauguuaaggcauacuauagaaaauacuucugcgaaucuuucacuagccgcgauagcuaaccaagcagcaguuuugaugggucugggaaaaggauggccacuacaucguauggauuuaggcguaccccuauuagcaaugggauguuauagucaggugaaucccacaacacuaacagccagcuuagugaugcuacucguacacuacgcgauaauaggaccaggccuccaagcaaaagcaacacgagaagcccagaaaaggacagcagcgggcaucaugaaaaauccuacaguagauggcauuaccguaauagaccuagaaccaauaucauaugacccgaaguucgaaaaacaauugggacagguuaugcugcugguacucugugcuggccaguuacucuuaaugaggacuacaugggcauuuugugaaguccuuacauuagcgacggguccuauucugacccuaugggagggcaacccaggacgauuuuggaauacuacaauugcagugaguacagccaauauauucagggguucuuaccucgcaggcgcuggucuagcuuucagcuuaaucaaaaaugcacagacgccuagaagggguacuggaacagccggggaaacacuaggagaaaaauggaaacggcaauuaaacucacuagaccgaaaagaguuugaagaauacaaaaggucgggcauuuuagaaguagacagaaccgaagcuaaaucagcgcuuaaagacggaaguaaaauuaaacaugcaguuucgagagggagcucaaaaauaagauggauaguggagagggguauggugaaaccaaagggaaaaguaguugacuugggcugcggcagaggaggguggaguuacuacauggccacguuaaagaacguaacagaagugaaaggguacacuaaaggcgguccaggccaugaggaaccuauaccuauggcuacauauggauggaaucuaguaaaacugcacaguggaguggauguauucuacaaaccgacagagcaaguugauacacuauuaugcgacauaggcgaaucaaguagcaauccuaccauagaagaaggccguacuuuacguguccuuaagaugguugaaccuugguugaguuccaagccagaauuuugcauuaaaguauugaacccauacaugcccacagugauugaggagcuggaaaaacuacaaagaaaacauggcgguaaucuaguacguuguccauuauccagaaauucaacucaugaaauguacuggguaucaggagcaucagggaauauaguuucgaguguuaacacgacgucaaaaauguuauugaauagauuuacuacgcggcauagaaaaccgacguaugaaaaagacgucgaucuuggagcagguacgcgaagcguaaguacagaaauagaaaagccagauaugacaauaauuggacguagguuacaacgucuucaagaagaacauaaagaaacuuggcauuacgaucaagagaacccauaccggaccugggcguaccacggcucauacgaagcgccuucaacugggucggcaaguucgauggugaacggcguugugaaauuacuaacuaagccgugggaugugauuccgaugguaacgcaacuagcaaugaccgauacaacaccguuuggucaacaaagaguuuuuaaagagaaaguagacacgcguacuccucagccuaaaccagggacaagaaugguaaugacuaccacugcaaauuggcuuugggcccuucuuggaaagaagaaaaauccuagacuaugcacacgugaagaguucauaucuaaaguuaggaguaacgcugcaauuggagcaguguuccaagaagaacaaggauggacaagugcauccgaagcugugaaugauaguagguucugggaauuggucgauaaagagcgagcacuacaccaagaaggaaaaugcgaaucauguguguauaacaugaugggaaaaagggagaagaaacucggagaauuuggcagagcuaaagggucaagagcaauaugguacauguggcuaggcgcaagauuuuuggaauuugaagcacuaggcuuucuaaacgaagaucacugguuuggaagagaaaacucuuggagcggagucgaaggagaaggacugcacagguuggguuacaucuuagaagaaauugauaaaaaggauggugauuuaauguaugcggacgauacugcaggaugggacacacguauaacggaagaugauuuacaaaaugaagaguuaauaacagaacaaauggccccgcaccacaaaauacuagcaaaagcuauuuuuaaacuaacauaccagaauaaaguaguaaaaguuuuacgaccaacaccccgaggagcaguuauggacauaaucucgagaaaagaucaacgagguucuggccaaguagggaccuacggauuaaauacuuucacaaacauggaaguacaauugauacggcagauggaagcagaagguguuauaacucaagacgacaugcagaacccaaaaggucugaaagaacguguugaaaaguggcuuagggagugugguguagacagauuaaaaagaauggcaauaaguggcgacgauugcguugucaaaccguuggaugaacgauucgguaccucucucuuauuucuaaaugauaugggaaaaguaagaaaagauauaccucaaugggagccgagcaagggcuggaaaaacuggcaggaaguaccguuuuguucgcaucacuuccacaaaauauuuaugaaagacggacgguccuugguaguuccgugucgcaaccaggaugaauuaaucggccgugcucgaauuagucaaggugcggguuggagccuccgugaaaccgcuugucuagguaaggcuuacgcacagauguggucacuaauguauuuucauagaagagacuuaagacucgcuagcauggcgauaugcagcgcugucccuacugaaugguucccuacaagucguacaacuuggaguauccaugcgcaccaccaauggaugacgacugaagacaugcuaaaaguauggaauagaguguggauagaagauaacccaaauaugaucgauaagaccccagugcauucuugggaagauauaccuuaccuaggaaagagagaagacuuauggugugggucacuaauaggauugaguagucgggcuacgugggcuaaaaauauucacacugcaauuacgcaaguccggaaucugauaggaaaagaagaauauguugacuacaugucgguaaugaagcgauacucggcacccuccgagagcgaaggaguuuuauaa

SEQ ID NO: 23687 - RNA, 9867 nt, Artificial Sequence
  derived and/or modified CDS sequence (opt6) from DENV-4__KJ596671__SS-prME
ucaacgaucacauuacuuugucuaauuccaacuguuauggcauuucaucugagcacccgagacggagaaccauuaaugauaguagcgaaacacgaaagaggaagaccacuacuauuuaaaacaacugaagguauaaauaagugcacccuaauugcaauggauuuaggugaaaugugugaagauacagucacauacaaaugcccccuacucguaaauacggaacccgaagauauagauuguuggugcaaccuuaccuccacauggguuauguauggaacguguacccaaagcggcgaacgcagacgagagaaaaggaguguggcguuaacgccacauuccgguauggggcuagaaacaagagccgaaaccuggauguccagugaaggugcauggaaacaugcacaaagagucgaaucauggauacuacgaaaucccggcuucgcacuacuugcaggguuuauggcauauaugaucggacaaaccggaauacaacgaacugucuucuuuguacuaaugauguuggucgcgccaaguuauggaaugcgauguguaggaguagguaacagagauuucguggaaggagugucuggcggugcaugggucgauuuaguuuuagaacauggcggauguguuaccacaauggcacaagguaagccuacgcuugauuuugaauugacuaaaaccacagccaaagaagucgcucuacuaaggacauacuguauagaagcacuaauaaguaacaucacaaccgccacgcguuguccaacacagggugaaccuuaucugaaagaagaacaagaucaacaauauauuugucgucgagaugucguggaucgaggaugggggaacgguugcggacuguuugguaaagggggcguagucacaugcgcaaaguucucuuguagugguaaaauaacgggaaauuugguccaaauugagaauuuagaauauacuguuguaguuacaguccauaauggugacacucaugccguaggaaacgacacaagcaaucacggaguaacggcgacaauaacaccccgaucgccaaguguugaaguuaagcugccagauuacggugaacucacauuagauugcgaacccagaucaggaaucgauuuuaacgaaaugauacuaaugaaaaugaagaaaaagacuuggcuaguucauaaacaaugguuucucgacuuaccacucccguggacuacaggggcagacacgucagaaguccauuggaacuauaaagaacguauggugacauucaaaguaccacacgccaagcgucaagacguuacaguccuaggaucacaagaaggagcgaugcacuccgcacuagccggagcuacugaaguagacucaggugauggaaaccauauguucgcaggacauuuaaaauguaaaguccggauggaaaaacuuaggauuaaaggaaugagcuacacuauguguucugggaaauucucgauugacaaggaaauggcagaaacgcagcacggcacuacaguaguuaaggucaaauacgaaggagccggagcuccuugcaagguaccuaucgaaauacgagauguaaauaaagaaaaggucguagggcgggucauaagugcaacgccauuagcugaaaacacuaauaguguuacgaacauagaauuagaaccucccuuuggagacagcuacauaguaauuggaguugggaauagugcauuaacuuugcauugguucagaaaaggaucguccauuggaaagauguucgaaucaaccuacagaggugcuaaaaggauggcaauauuaggugaaacugcaugggauuuugguagugucggagguuuauucacaucuuuaggcaaggcuguacaucaggucuucgguagcguauacacgacgauguucggaggagucucuuggaugauacgaauauuaauaggauuuuuaguucucuggauaggaacaaacagucgaaauacgagcauggcaaugacuuguauugcaguugguggcauuacauuauuuuuaggcuuuaccguccaagccgacaugggaugcguuguuagcuggaguggacgugaauuaaaauguggaucuggaaucuucguuguagacaacguucauacauggacugaacaauauaaauuccagccagaaagcccagcgcgccuugcaagcgcaauacuaaaugcacauaaagaugguguauguggaauccgaaguacaacaagauuagaaaacguuauguggaaacagauuaccaaugaauugaauuacguacucugggaaggaggucaugaucuaacaguuguugcgggagacguaaaaggaguauugacgaaggguaagagggccuuaacaccaccggcaagcgacuuaaaauacaguuggaagacaugggggaaagcaaagauuuuuacuccugaagcgagaaacagcacuuuccugauugacggaccugauacuucagaaugcccaaaugaaaggagagcuuggaacucauucgaaguugaagacuauggguuuggaauguuuacaacaaauauuuggaugaaauuuagggaaggauccagcgaaguuugugaccaucgucuaaugagugcggccauuaaagaccagaaagcuguacaugcggauaugggauacuggauugaaagcucuaaaaaccagacauggcagauagaaagagcuagcuuaauugaaguaaaaacgugccuauggccaaagacucauacuuuauggucuaauggcguuuuagaaucgcaaauguuaauaccuaagucauacgcgggaccauucucccagcauaacuauaggcaagguuaugcaacacaaacuguaggaccguggcaccucggaaaacuugagaucgacuuuggugaaugccccggcacaacgguuacaauucaggaaaacugcgaccaucgcggaccuucacuucggaccacuacagcauccggcaaguuaguuacacaauggugcugcagaucaugcacuaugccuccucugagauuuuuaggagaagauggaugcugguacgggauggaaaucagaccauuaucugaaaaagaagaaaauauggucaaaagccaaguaacggcuggacaaggaaccucagagacguucucgaugggauugcucuguuuaaccuuauucguagaagaauguuuacgcagaagaguuacaagaaaacauaugauacuggcaguagucauaacccuuugugcuauaaucuuagggggauugaccuggauggaucugcuuagagcuuugauaauguuaggagauacuaugagugguaggaucgguggacagacucaucuggcaaucauagcuguauuuaaaaugaguccgggauauguucuagguguauuccuacgcaaauuaacgucuagagaaacagcucucauggugauaggaauggcuaugacgacaacacuuaguauaccacaugaccuuauggaguuaauagacggaauaagucugggucuuauacuacuuaagaucgugacacaguucgacaauacgcaggucgggacacuagcccuaucacucacauucauacgaucaacuaugucacuuguaauggcuuggagaaccauaauggcuguacuguuugucguuacucucauaccacuuugccgaacauccugcuuacaaaaacaaucacauuggguugaaauuacagcauuaauccugggugcccaagcauuaccaguguacuuaaugacccucaugaaaggugcaucaagacgaucuuggccacugaacgagggaaucauggcagucgggcuuguaagucuccuaggguccgcucuacucaaaaaugauguaccacuagcagguccaaugguagcaggcgggcugcuucuggcggccuauguaaugucaggauccucagcagaccugagcuuagaaaaagcagccaauguucaaugggaugaaauggccgauauaacggguucaucaccgauuauugaagucaaacaagaugaagauggcucauucucuauuagagacgucgaagaaacgaauaugauaacgcuauuagugaaauuagcauugauuacaguauccggauuauacccauuagcaauuccaauaacaaugacgcugugguacauguggcaagugaaaacucaaagaucaggagcucuuugggaugucccaaguccagcugcuacccaaaaagcagcacugagugaaggagucuacagaauuaugcaaagaggacuuuucggcaaaacucaaguggguguuggaauccacauggaaggugucuuucacacgauguggcacguuaccagaggaucgguaauuugucaugaaacaggaagguuagaaccaagcugggcagacgugagaaaugacaugaucuccuacgggggaggauggagacugggugacaaaugggacaaagaggaagacgugcaaguacuagcuauugaaccagguaaaaaucccaaacacguacaaaccaaaccuggccucuuuaaaacacucacuggggagauaggugccgugacgcuagauuuuaaaccaggaacaaguggaaguccuauuaucaaccgaaaaggaaaaguaauugggcuauauggcaauggaguagugacgaagaguggagauuauguuucugcuauuacacaagcugaacgaauaggagagcccgacuacgaggucgacgaagacauauuucguaagaaacggcucacaauaauggaucuacauccuggggcugguaaaacuaagaggauccuaccauccauugugagagaggcuuuaaaaagacggcuaaggacuuuaauacuagcucccacgcguguuguagcagcugaaauggaagaggcacuaagggguuuaccuauacguuaucagaccccagcaguuaaauccgaacacaccgguagggagauaguggaucucaugugucaugcaacuuucaccacacgccuauuaaguucaacccgaguaccaaauuauaauuuaauuguaauggaugaagcccacuuuacggacccuuccucaguagcggcacgaggauacauuagcacacgaguggaaaugggugaagccgccgcuauauucaugacggcaacgccuccaggcgcgacggacccguuuccacaauccaacucuccaauugaagacauagaacgagagauuccugaacggaguuggaauacaggguuugacuggauaacggacuaucaagggaaaacagugugguuugugcccucaaucaaagcugguaaugacauugcaaauugccuucgcaaaucggggaaaaaggugauccaauuaucucgaaaaacguuugauacugaguauccaaagacgaagcuaacugauugggacuuugucguuacaacugauauaucggaaaugggagcaaauuucagggcagguagaguaauagauccccgcagaugcuugaaacccgucauucuaaccgauggaccugaacgcgucauccuagccggaccuauuccagugacaccagcaagugccgcgcaaaggcguggacgaauaggacguaaucccgcucaggaagaugaucaguacguauuuaguggcgauccguuaaagaaugacgaagaucaugcacacuggacagaggcaaaaauguuacuagacaauauuuacacgccugaagguauaauaccaacacucuucggcccugagagagagaaaacgcaagccauugauggugaauuuagguugagaggggaacaacggaaaacguucguugaguugaugagaagaggcgaucugccaguaugguuaucuuauaaaguagccucagcugggauuaguuacaaagaccgugaguggugcuucacaggagaacgcaauaaucaaauucuagaagaaaacauggaaguagaaaucuggacaagagaaggagagaagaagaaauuaagaccaaaaugguuggaugcccgaguauacgcugacccaauggcguuaaaagacuuuaaagaguucgcaagcggaagaaagucaauaacauuggauauucuaacagaaauagcaucauuacccacauaccuaucaucacgcgcaaaacuagcacucgacaacauagugaugcuacauacaacggagagggguggaagggcauaccaacaugcguuaaacgaauugccggaaucauuagaaacacuaaugcuggucgcacuuuuaggagccaugacggcugguauauucuuauucuucaugcaaggaaaaggcauuggaaaacuaaguauggggcuaauuacuauagcaguagcuucuggguuacuaugggucgcugaaauucaaccgcaguggauagccgccaguaucauauuagaguucuucuuaaugguacuucuuauaccggaaccagagaaacaaaggacaccucaagauaaccaacuuauauacgucauauuaacuauacuuacaauaauaggauuaaucgcagcaaacgaaaugggacucauugagaagacaaaaacggacuucggauucuaucaaguuaaaacagagacuacuauauuagauguagaucugcguccugcaucagccuggacacuauacgccguugccacgaccauuuuaacuccaauguuaaggcauacaauugaaaauacuucggcuaauuuaagccuagcagccauagccaaucaagcagcagucuugauggggcugggaaaaggguggccucuacacaggauggaccuaggaguaccccuguuggcgaugggauguuauucgcagguaaaccccacgacacugacagcaucguuaguuaugcuccuuguccauuaugcgauaauagggccgggacuacaggcgaaagccacuagggaagcucagaaaagaacagcugcugguaucaugaagaacccgacgguagacggaauaacaguaauagaucucgaaccuauuucuuaugaccccaaauuugaaaaacaacugggacagguuauguuauugguacuuugcgcgggacaauuacuacucaugagaacuaccugggccuuuugugaagugcucacauuggccacuggcccgauauuaacacuaugggaagggaaccccggacgcuuuuggaauacuacuaucgccgucucuaccgcuaacauuuuccgaggauccuaucuugcuggagccgguuuagcguuuucauuaauuaaaaaugcacagacuccaagaagagguacaggcacagcgggagagacuuuaggggaaaaauggaaacgacaauuaaauucacuagaccguaaagaguucgaagaauauaagagaaguggaauauuagaaguggaccguacagaagcgaaaagcgcuuuaaaagaugggucaaaaauaaagcacgcugucucuaggggaucgagcaaaauacgauggauaguggaaagagggaugguuaaaccgaaagguaaagucguugaucuugguuguggccgggguggguggagcuauuauauggcgacucucaagaauguaacagagguaaagggauauacaaaaggugggccuggacaugaggaaccuauaccgauggcaacauauggcuggaaccuagugaagcuacauagcggaguggaugucuuuuauaaaccaacggaacaaguggacacacuucuaugugauauaggagaguccagcucaaauccaacuauugaagaaggacgaacauuaaggguguugaaaaugguagaaccguggcuaucaagcaagcccgaauuuuguauaaaaguauuaaacccauauaugccaaccguuaucgaagaauuagaaaaguuacaaagaaagcaugguggaaaccucguaagauguccucuaaguagaaauaguacacaugagauguauuggguaucuggugccucaggaaauauagucucuagugucaauacgacgucaaagaugcuucugaaucgguuuacgacucggcaccggaaaccaaccuaugagaaggauguagauuuaggugcugggaccagaucuguaaguacggaaauagaaaaacccgauaugacuauaaucgguaggcguuuacagcgauuacaggaagaacauaaagaaaccuggcacuaugaccaagaaaacccauaucgaacaugggccuaucaugguaguuacgaggcgccaucuacugguagcgcaucuucaaugguuaauggagugguaaaacuucucacaaaaccgugggauguuaucccaaugguaacacaauuagccaugacugacaccacuccauucgggcagcaaaggguauuuaaagaaaagguugacacgagaacuccucaaccaaaaccaggaaccaggauggucaugacaacgacugcgaauuggcuaugggcacuacuuggcaagaagaaaaacccacgacuuugcacgcgagaagaauuuaucucaaaaguacguucaaaugcagcaauaggagcuguauuucaagaagaacagggcuggaccagugcgucugaagcagugaaugauagcagauuuugggaacugguagauaaagaaagagcccuccaucaagaggggaaaugcgaaucgugcguuuauaacaugaugggaaaacgagagaagaaacuuggugaguucgggagagcaaagggaucaagagcaauuugguauauguggcucggagcuagguuucucgaguuugaggcuuuaggcuucuugaacgaggaucacugguucggcagggaaaauaguuggagcgguguagaaggugaaggccugcaucgccucggguauaucuuagaagaaauugacaagaaagauggggauuuaauguaugcagacgacacagcugggugggauacuaggauuaccgaagacgaucuacaaaacgaagaacuaauuacggaacaaauggcuccccaccauaaaauucuagcgaaagcuauauucaaacugacauaccaaaauaagguaguuaaagugcuucgcccaacaccccguggugcgguuauggauauaauaaguagaaaagaucaaagggguucagggcaagucggaaccuauggacuaaacacuuuuacaaauauggaaguacaacugauaaggcaaauggaagccgaagggguaaucacccaagacgacaugcaaaauccaaagggauuaaaagaaagaguugaaaaauggcuaagagaauguggugucgaccgcuuaaaaaggauggccauuagcggugaugauugugucguuaagccguuggacgagagauuugguacaucccuccuauuuuugaacgauaugggcaaaguucgaaaagauauaccacaaugggaacccaguaaagguuggaagaacuggcaggaaguaccuuuuugcucacaccauuuccauaagauauuuaugaaagauggacgcagccuaguaguucccugccguaaucaagacgaauuaaucggcagagcgagaauuucacaaggagcagguuggucguuacgcgaaacugcuugccugggaaaggcauacgcacaaauguggucguuaauguacuuccauagaagagaucuacgucuagcuaguauggcaauaugcagugccgucccgacagaaugguuccccacaucccgcacaacauggaguauccacgcccaucaccaauggaugacgacagaagauaugcuaaagguauggaaucgaguauggauagaagauaaccccaauaugauugauaagacacccguccauuccugggaggauauaccauauuuaggaaagagagaagauuuauggugcggaucuuuaauaggacuuaguagccgugcgacaugggccaaaaauauacauacugcgauaacucaagugcgaaaccucauuggaaaagaagaguauguagacuauaugucugucaugaagcgcuacucagcgccaucagaaagugaaggaguacucuga

SEQ ID NO: 23688 - RNA, 9867 nt, Artificial Sequence
  derived and/or modified CDS sequence (opt6) from DENV-4__KJ579241__SS-prME
ucgacaauuacuuuacuauguuugauacccacgguuauggcuuuucacuugagcacacgagacggugaaccucugaugauugucgcaaaacaugaaaggggucgaccacugcuauuuaaaacuacagaagggauaaacaaauguacauuaauagcaauggaucuuggggaaaugugugaagacacaguaacguauaaaugcccauuauuaguaaauacagaaccagaagacauagauugcugguguaacuugacuucaacauggguuauguacggaacauguacacaaucuggugaacguagaagagaaaaacguuccguagcgcugacaccccacucuggaaugggucuugaaaccagggcggaaacauggaugucaucagaaggcgcuuggaaacaugcgcaaagaguagagagcuggauauuacguaacccaggauucgcccuccuagcagguuucauggcguacaugauagggcaaacgggcauacaacggacagucuucuuuguccuuaugaugcuggucgcaccgucuuauggcaugagguguguuggaguggguaauagagacuucgucgagggcgugucaggaggagcauggguugacuuagugcuggaacauggagguuguguuacuacaauggcacaagguaagccuacauuggacuuugaacuaacgaaaaccacagcgaaagagguggcgcuucuucguacuuacugcauugaggcuuuaauuagcaauauaacaacugcaacaagaugcccuacucagggggagccauaccugaaggaggaacaagaucagcaauacauaugucgucgcgacguuguugauagagguugggggaauggauguggacuuuucggaaaagggggcguuguaacgugugcaaaauucucuugcagugggaaaauaacaggaaaucuaguacagauagagaacuuagaauauaccguugucguuacaguccauaauggagauacacacgcgguuggcaaugauaccucaaaucauggcguaacagcaacaauaacaccacggagcccuucgguggaaguaaagcucccagauuauggagaacugacauuggauugugaaccgcguuccggaauagauuuuaacgaaaugauauugaugaaaaugaagaagaaaaccuggcuuguucacaaacagugguuucuagaucugccacucccauggacuaccggggcggauacuucggaagugcauuggaacuauaaagaaagaauggugacuuuuaaaauuccacacgcuaaaaggcaagauguuacuguucuagggagucaggagggagcuaugcacucugcacuagcgggagccacugaaguggauucuggagaugggaaucacauguucgcaggacauuuaaaauguaaaguacgaauggaaaaacuuaggauuaaagguaugagcuauaccauguguucgggaaaguucucaauugauaaagaaauggcagaaacucagcacggaaccacaguaguaaaaguaaaguacgagggagccggcgcuccauguaaagugccuauagaaauuagagauguuaauaaagaaaaaguaguaggacguguuauaagcgccacgccccucgcagaaaacaccaauuccguuaccaacauagaauuagagccacccuucggugauaguuacauuguuauaggaguuggaaauuccgcgcuaacacuucauugguucagaaaagguucuaguauagguaaaauguucgaaucaacuuauaggggcgcaaagcgaauggccauccucggcgaaacugcaugggacuucggcuccguaggagguuuauucacuuccuuaggaaaagcgguacaucaaguguuuggcucuguguauacaacuauguucggagggguguccuggaugauacguauauuaaucggauuuuugguucuauggauaggcaccaauagucggaacacgucaauggcgaugacaugcauugcaguggguggaauaacacucuucuuagguuuuacgguccaggcagauaugggaugcgugguaaguugguccggacgagaauuaaaaugcgguaguggaauauuuguagucgauaacgugcacacguggacggaacaguauaaauuccaacccgagucucccgccagauuggcgucagcuauccuuaaugcacacaaggauggaguguguggaauaagauccacaacgcggcucgaaaacguaauguggaaacagauaacaaaugagcuuaacuacguauuaugggaagggggacacgaucuuacggucguggccggugaugugaaaggaguacuuaccaaggguaaaagagcuuuaacgccgccagcgagcgacuuaaaauacucauggaagacauggggaaaagcuaaaauuuuuacacccgaagcacgaaacagcaccuuccuaauagauggacccgacacaucagaauguccaaaugaacggcgagcguggaacucguuugaaguggaagauuacggauucggcauguucacgaccaauaucuggaugaaauuccgugaggggucgucugaaguaugugaucauagauuaauguccgccgcuauaaaagaucaaaaagcaguacaugccgacaugggcuacuggaucgagucaaguaaaaaccagacauggcaaauagaaagagcuagccuaauagaaguaaaaaccugucuuuggccgaaaacucacacuuuauggagcaacgguguccucgaaagccaaauguuaauaccaaaaucauaugcagguccauuuucucaacacaauuauagacaagguuacgcaacacaaacggucgguccauggcaccuuggcaaacucgaaauagacuuuggagaaugcccaggcacuacaguaacaauucaagaaaauugcgaucaccgagguccaucguugcguacaaccacagcaagugguaaauuaguaacccaauggugcugcagauccugcacuaugcccccauuaagguuuuugggugaagauggguguugguaugguauggaaauuagaccgcucucagaaaaagaagaaaauauggugaaaagucaggucacggccgggcaggguacaagcgaaacuuucucaaugggauuacuaugucuuacgcuuuucguagaggagugccuaagacguagggugaccagaaaacacaugauucuagcagucgucauaacgcucugugcaauaauacuuggcggguuaaccuggauggaucuguuaagggcucuaauaauacugggagauacuauguccgguagaauaggugggcagacacaccuagcuauaauggcagucuucaaaaugucacccggcuacgugcuaggcguguuuuuacguaaauugaccucacgagaaacagcccuuauggugauaggcauggcaaugacuacgacucuaaguaucccucaugacuuaauggaacuuauugauggcaucucacuugggcugauauuacuaaaaauugucacucaauuugauaauacccaagugggaacucuugcuuuaucucuaacuuucauacguaguacgaugagccugguaauggcauggcgcaccauuauggcagugcuguuuguagugacauugauuccuuugugucguacuuccugucuccaaaaacaaucgcauuggguggaaauuaccgcucuaauauuaggugcccaagcauuaccuguauauuuaaugacucucaugaagggagcaaguagacggaguuggccauuaaaugaaggaaucauggcaguaggauuaguuucucuauuggguuccgcccuacugaaaaacgacgucccauuagcaggaccaauggucgccggugguuuauuacuagccgcguacgucaugucuggaucaucugcagaucucagcuuagaaaaagcagcuaauguucaaugggaugaaauggcagauauaacaggaucuuccccaauuaucgagguuaaacaagaugaagaugguagcuucaguauacgagauguagaagaaacgaauaugauuacauuauuaguaaaacucgcacuuauaacagugucgggucuuuacccacuggcaaucccaauuacgaugaccuugugguauauguggcaagucaaaacacaacgauccggugcacuaugggaugucccuucaccagcagcuacacaaaaggcagcucuaagcgaagguguuuauaggauaaugcagaggggguuauucgguaaaacacaaguaggaguugguauacauauggaagguguguuucauacuauguggcauguaacucgcgggucgguaauaugccacgaaacuggucgacucgagccaagcugggcugauguaagaaaugacaugauuagcuauggaggaggcuggcgcuuaggcgacaagugggacaaagaagaagaugugcaaguauuagcgauagaaccuggcaaaaauccgaagcacguacaaaccaaacccggcuuauucaaaacauuaacuggggaaauaggagcaguuacucuugacuucaaaccuggcacuagcgggucuccaauaauuaauagaaaagggaagguaauuggauuguaugguaacggaguaguaacuaaaagcggggauuauguauccgcaauuacucaagcugaaagaauuggugaaccugauuacgagguagacgaagauauauuuagaaagaaacgacuaacaaucauggaucuucacccuggagcugguaaaacaaaacgaauacuuccaagcauugugcgggaggcuuuaaaacguagauuacgaacgcucauuuuagcaccuaccagaguuguagcagcugagauggaagaagcucuacguggacuaccaauaagauaccaaacaccggccguaaaaagcgagcacacgggacgggagauaguagaucuaaugugccacgcaacauucaccacuagacuauuaucaucuacuagagugccgaauuacaacuugauugucauggacgaagcucauuuuacagaucccaguaguguggcagcccgcggcuacauaucaacgagaguagaaaugggggaagcagcagcgaucuucaugacagcuacaccaccaggcgcaaccgaucccuuuccacaaagcaacucaccgaucgaggacauagaaagagagauaccugagcgcucauggaacacugguuuugacuggauaacugauuaucaaggaaaaacugugugguucguuccgagcauuaaggcugguaacgacaucgcaaauugucuucggaaaucuggcaagaaaguaauacaacuuaguagaaaaacguuugacacagaauauccaaaaacaaaacuuacugauugggauuuuguaguaacuacagauaucagugaaaugggcgccaacuucagggccgggagaguuaucgaccccaggcggugucuaaaaccaguaauacuaacugauggaccagaaagggucauacuagcagguccaauacccguaacacccgcaucagcagcucagcgcaggggcagaauagggagaaauccugcucaagaagacgaccaauacguuuucagcggagacccacuaaagaaugacgaagaccaugcgcacuggacagaggcaaaaauguuauuggacaacauauauacuccggaagggaucauaccaacacuuuucggaccugaaagggagaaaacgcaagcaauugauggcgaauuucgucuacguggggaacaaagaaaaaccuucguugaacuuaugagacgaggagauuuacccguuugguuaaguuauaaaguagcaucagcaggaauuucauauaaagaucgugagugguguuucaccggugaaagaaauaaucaaauacuggaagaaaauauggagguagaaauauggacaagagagggcgagaaaaagaaacugcgucccaaauggcuugaugcuagaguuuaugcggauccaauggcgcucaaagacuucaaagaauuugccagcggaagaaaaucuauaacauuggauauccugacagaaaucgcuagcuugccaacuuaucuaaguagcagagcgaaacucgcguuagacaacauagugauguuacauaccacagaacgaggugguagggccuaccagcacgcuuuaaaugaguugcccgaauccuuagaaacucucauguuaguggcguuacuuggagcaaugacagcagggauuuucuuguucuucaugcagggaaaaggaauaggaaaauuaagcaugggcuuaauuacgauagcuguagcgucaggauuauuauggguugcugaaauacaaccucaguggauagcggcaucgauaauacuagaguucuuucuuaugguucuguuaaucccugaaccagaaaagcagaggacaccucaagauaaccaauuaaucuauguuauauuaacaauucugacuauaauuggccugauagcagcaaaugaaaugggucuuauagagaaaacgaagacagauuucgguuucuaccaagucaaaacggaaacgaccauucuagacguggaccuaagaccggcaagugcguggacacuguaugccgucgcgacaacaauacucacaccaaugcuucgccauacgaucgaaaauacaucagccaauuugaguuuagcagcuauagccaaucaggcagcuguacuuaugggcuuaggcaaaggguggccucuucaccgaauggaucuuggcgucccccuauuggcgaugggauguuacagucaagugaauccaacuacauuaacggccucacuuguuaugcuacucguacauuacgcaauuauuggucccgguuuacaagcuaaagcuacucgggaagcacagaaaaggacugcugcugggauaaugaaaaaucccaccguagaugguauaacugucaucgaucuugaaccaauaucguaugauccgaaauucgaaaaacaacuuggucaagugaugcucuuaguccuaugugcuggucaauuacugcuuaugagaacuacgugggcuuuuugugaaguacuaacgcuggcaacgggaccgauauuaacgcuaugggaaggcaauccaggucgauucuggaauacgacaauugcaguuaguacagcaaauauauuccgagguucauaccuagcuggugcuggucuagcguuuucuuuaaucaaaaaugcccaaacaccgaggaggggaacagguacagcgggggaaacacuaggcgaaaaauggaaacgacaguuaaauucauuggaucgaaaggaguuugaagaguacaagagaucaggaauacuagaagucgauagaacagaagcgaagucagcuuuaaaagauggcucaaagauaaaacaugcagucucccgaggcaguucaaaaauccgauggauaguagaacgcgggaugguaaaaccaaaaggcaaaguuguugacuuaggcugcggccgcggaggauggucguauuauauggcaacgcuaaagaaugugacagaaguaaaagguuacacuaaaggaggaccaggacacgaagaaccaauuccaauggcgaccuauggauggaauuuagucaagcuacauucgggcguagacguauuuuacaaaccaacagaacagguagauacacuacucugugauauaggcgagaguucaucuaacccaaccauagaggaaggacgcacaaugaggguauugaaaaugguggaacccuggcuuucaucuaaaccagaguucuguauuaaaguauuaaacccauauaugccaaccguuauugaagaacuagaaaaauuacaacggaaacauggugggaaccuaguuagaugcccauugagcagaaauucaacacaugaaauguacugggucaguggagcuagugggaauaucguaaguaguguaaauaccacaucaaagaugcuacuaaacagguucacaacaaggcaucggaagcccaccuaugaaaaagauguugauuuaggggcaggaacccgaagcgucucaacagagacagagaaaccagauaugacaaucaucggucguagauugcaaagauuacaggaggaacacaaagagacuuggcauuacgaccaagagaauccguaccgaacuugggcguaccacggaucauacgaagcuccuaguacugguucagcuucuuccaugguuaacggcguuguuaaacugcugacaaaaccaugggacgucauucccaugguaacccaauuagcgaugaccgauacaacaccauucggacaacaaagaguauucaaagaaaaaguagauacacgcacaccacaaccaaagcccgguacucgaauggucaugacgacgacagcgaacugguuaugggcuuuacuagguaaaaagaaaaacccgcgcuuauguacuagagaagaauuuaucaguaaaguacgaaguaaugccgcgauaggugcagucuuccaagaagaacaaggguggacaucagccuccgaagcagucaaugauagcagauucugggagcuagucgauaaagagagggcacuucaucaagaaggaaaaugugaaaguugcguuuauaauaugaugggaaaacgagagaagaaacucggagaauuuggccgggcaaaaggauccagagcuauuugguauaugugguuaggggcaagguuucuggaauuugaagcacucggauuucuaaaugaggaucacugguuuggaagggagaacucauggagcggaguggagggagaggggcuacauagguuaggauauauacuagaagaaaucgauaagaaagauggagaucuuauguaugcugaugacacugccggaugggauacaagaaucacugaagacgauuuacaaaacgaagaacuaaucacugaacaaauggcaccacaucauaagauacuugcaaaagcaauuuuuaaguugacauaccagaauaaaguagugaagguccucagaccuacgccaagaggagcuguuauggauauaauaucacgaaaagaccagaggggcucgggacaggucggcacauacggccucaauacuuucacgaacauggaaguacaauuaauacgacaaauggaagcugaaggaguaauuacacaagacgauaugcaaaauccuaaagggcuuaaggaaagagucgagaaauggcuaagagagugcggaguagacagacucaaaagaauggcuauaagcggcgaugauugugucguuaaaccucuugaugaaagauucggaacaucucuauuguucuuaaacgauauggguaaagugcgaaaagacauaccccagugggaaccgucaaaagguuggaaaaacuggcaagaagugccuuuuuguucacaccauuuucauaaaauauucaugaaagaugggcgaagucugguggugccaugucgaaaccaagacgagcuaauaggccgugcccggauaagucaaggcgcaggcuggaguuuacgagagacugcuugcuugggaaaggcauacgcucaaauguggucauugauguauuuucaccgcagggaccugcgcuuagcaaguauggcaauauguucggcaguaccgacugagugguuuccaacaagccguacaacauggucaauucaugcacaucaucaauggaugacaacggaagauaugcuuaaaguauggaaccgagucuggaucgaagacaacccaaauaugaucgacaaaacucccguccacagcugggaagacauaccuuaccuagguaaaagagaagaucuauggugcggaagccuuauaggucugagcaguagggcuacaugggccaaaaauauucauaccgcaauaacucaaguaaggaauuuaauaggaaaagaagaauacguugacuacaugccaguaaugaaaagauauagugccccauccgaaagugaggggguccuauga

SEQ ID NO: 23689 - RNA, 9867 nt, Artificial Sequence
  derived and/or modified CDS sequence (opt6) from DENV-4__KJ596672__SS-prME
ucuacuauaacuuuacuuugucuuauuccgacaguaauggcguuucaccuaucaaccagagacggagaaccucuuaugauaguagccaaacaugaaagaggacgaccauuguuauuuaaaacgacagaaggaaucaauaaauguacucucauugcuauggauuuaggggaaaugugugaagacacuguaacuuacaaauguccguugcugguuaauacagaaccagaagauauugauugcugguguaaucucacuagcacuugggucauguauggaacuuguacacaaucuggagaaagaaggagagaaaaacguuccguggcccuaacgccgcacucaggaauggguuuggaaaccagggcagaaacuuggaugaguucugaaggagcuuggaaacacgcccagagaguagaaucuuggauucuacgaaauccuggauuugcgcuuuuagcuggauuuauggcuuauaugaucggacaaacuggaauccaaagaacaguauucuuuguacuuaugauguuaguugcuccauccuacggaaugcguuguguaggaguugggaauagagacuucguagaagggguaaguggaggagcauggguagauuuagucuuagaacacggugguugcguaaccacaauggcucaaggaaaaccaacauuagacuuugaauuaacgaaaacaacagcgaaagaaguagcauuacuucggacauacuguauagaagcccuaauuagcaauauaaccaccgcuacacgcugcccaacucaaggagaacccuauuuaaaagaagaacaagaucagcaguacauauguaggcgcgacguaguggacagaggcuggggaaacggguguggcuuauuugggaaagguggugugguaaccugugccaaauuuuccuguucaggaaaaauaacuggaaauuuaguucagauagagaaucucgaauauacaguagucguaaccguccacaacggggauacucaugcaguagguaaugacacauccaaccacggaguaacggcgacaaucaccccaagaucgccgucuguggaagugaaauugccagacuauggagaauuaacguuggauugcgaaccaaggucuggaauagacuuuaacgaaaugauauuaaugaaaaugaaaaagaaaacgugguugguucauaaacagugguuuuuagacuuaccuuuaccuuggacuacgggcgcagacacgucagagguccauuggaauuauaaagagcggauggucacuuucaaagugccccacgccaaacgacaagacgugacaguacuagggucucaagagggagcaaugcacucagcauuagcgggagcuacggaaguagauucaggcgauggcaaucauauguuugcagggcaucuaaaaugcaaaguaagaauggaaaaauugaggaucaaagguaugagcuauacgauguguaguggaaaauucagcaucgauaaagagauggcggagacccaacauggcacuacgguagucaaaguaaaauacgaaggagcaggggccccgugcaaaguaccuauagaaauucgggacguaaauaaagagaaagucguaggaaggguaauuagcgcaacaccucuagcugagaacacaaauucuguaacuaauauugaauuagagccuccuuuuggagauuccuauauugugauagggguaggaaauuccgcacugacauugcauugguuucgcaaagguucaucaauugggaaaauguucgaguccacuuauagaggugccaaaagaauggcaaucuuaggggaaacagcaugggacuuuggaaguguagguggacuauuuacuucgcuugguaaagcaguucaccaaguauucggcucaguauauacaacaauguucgguggaguuucguggaugauacgaaucuuaauaggauuuuuaguucuguggaucgggacaaauaguagaaacacuucaauggcaaugacauguauagcuguagggggaauaacuuuauuuuuagguuuuacagugcaagccgacaugggauguguaguaagcuggagcggucgcgaauuaaaaugcgggagcgguauauuuguaguagauaauguccacacuuggaccgagcaguauaaauuccagccagagucacccgcacgguuagcgagugcuauucuaaaugcacauaaagaugguguauguggaauccguucaacaacuagauuagaaaacgucauguggaaacaaauuacgaaugaauuaaauuauguccuuugggaagggggacacgaucuaacagugguggccggugacgucaaggguguuuuaacaaaaggcaaacgcgcacuaacacccccugccucugauuuaaaauacucuuggaaaacauggggaaaggccaaaaucuucacaccggaagcacgaaauagcacuuucuuaauagacggcccagacacuucagaaugcccgaaugaacggagagcauggaacucguucgaagucgaagacuauggcuuuggaauguuuacuacgaacaucuggaugaaauuccgggaggguagcucagaaguuugcgaucauagacuaaugucggccgccauaaaagaucaaaaagcugugcacgcagacaugggauauuggauugagucgucuaaaaaucaaaccuggcaaauagagagagcauccuuaaucgaaguaaagaccuguuuauggccaaagacucauaccuuauggaguaauggaguacuugaaagccaaauguugauuccuaaauccuacgcaggaccauucucccaacauaauuauaggcagggauaugcgacacaaaccguuggaccguggcauuuggguaaauuagaaaucgauuucggagaauguccagggacuacagucacaauacaagagaacugcgaucauagagggccaagccuacggacaacaacagcgucugguaaguuaguuacucagugguguugcagaaguuguacuaugccuccauuaagguuuuuaggagaagacggcugcugguacgggauggaaauaagacccuuaucugaaaaagaggaaaauaugguaaaaagccaagugacggcaggucaggguacaucagaaacauuuagcaugggcuugcuaugccugacacuguucguagaagagugucuaagacgacgaguuacucggaaacauaugauacuagcaguuguaauuacauuaugcgcuaucauuuugggaggacucacauggauggacuuacuaagggccuugaucaugcuuggggauacgaugucaggcagaauagguggucaaacucauuuagcaauaaucgccguauuuaaaaugucaccuggcuauguauuaggagucuuucuuagaaaacugacuagcagagaaaccgcgcucaugguaauuggaauggcuaugacuacuacacuaucaauaccucacgacuuaauggaauuaauugacggcaucucacuaggauuaauauuauuaaagauaguaacgcaauucgauaauacccaaguagguaccuuagcccugagccugacauucauaagaagcacgaugucucuaguaauggccuggcguacuauaauggcagucuuauuuguaguaacacuaaucccccuauguagaaccagcugcuuacaaaaacagagucacuggguagaaauuacugcuuugaucuuaggggcgcaggcucuacccgucuacuugaugacccuaaugaaaggcgcaucacgucguucauggccuuuaaaugaaggaauuauggcggucggccuaguaucgcuauugggauccgcccuucuuaagaaugacgugccucuagcuggaccaauggucgcaggcggucuauuauuagcugcauauguaaugucaggaucaucugcagauuugucacuugaaaaagccgcaaacgugcagugggaugaaauggccgauauaacggguaguuccccgauaauagagguaaaacaagaugaggaugguucuuuuaguauaagagauguagaagaaacuaauaugaucacauuauugguaaaacuggcauuaaucacagugucuggauuauauccucuagcaauuccaauuacuaugacauugugguauauguggcaaguuaagacacaaagaucuggagcgcucugggacguuccgucccccgcagcgacucaaaaggcagccuuaucagaagguguuuacagaauaaugcagagaggguuauuuggaaaaacgcaagugggaguagggauucauauggagggcgucuuccacaccauguggcacgugacaagaggcuccguaaucugccaugaaacuggcagacuugagccauccugggccgauguccggaacgauaugauaucguacggaggugguuggagauugggagauaaaugggacaaagaagaggauguccaaguuuuagcaauugaacccggcaaaaauccaaaacauguucaaacaaaaccaggacucuuuaagacucugacgggagaaauuggugccgugacuuuagauuuuaaaccaggcacgucagggagcccaauuaucaaucggaaggggaaagucaucgggcuauaugggaacggaguaguuacaaaaucuggugauuacgucagcgcaauaacacaagccgaaagaauaggugaaccagauuacgaagucgacgaggacaucuuuaggaagaaaaggcucaccauaauggaucuacaucccggcgcaggaaaaacuaagaggauauuaccuagcauuguccgggaggcacugaagagacgucuccggacucucauauuagcaccuacuagaguaguugcugcagaaauggaagaagcguuacgagggcuaccgauuagguaucaaacuccagcuguaaaguccgaacacacgggcagagagauuguagacuugaugugccaugcaacguucacgaccagacuacuuaguagcacaagaguuccgaauuacaauuuaauuguaauggaugaagcucauuucacggauccuaguucgauugcugcacgaggcuauaucucgacaaggguagaaaugggggaagcggcggcaaucuucaugacagccaccccaccaggggcuacagauccuuucccccaaucaaauaguccuaucgaagauauagaaagggaaaucccagaaagaagcuggaauacaggguuugauuggauuacagauuaucaggggaaaacaguaugguuugugccuucgauuaaggcagguaacgauauugcuaauugcuuacgcaaaucgggcaagaaaguaauacagcuuagccguaaaaccuuugauacagaguacccgaagacgaaauuaacugacugggauuuuguuguaacaacugauauaucggaaaugggcgccaacuuuagagcagggcggguaauagacccucggagaugccuaaagcccguaauauuaacagacggcccugaaaggguaauucuagcuggcccuauaccgguaacuccagcuucagcggcgcaaagacgggggcgcauaggcaggaacccagcacaggaagacgaccaauacguauucucaggugacccucucaaaaaugaugaggaucacgcacauuggacagaagcaaaaaugcucuuagauaauaucuauacaccggaagggauuauaccaacucuauucgguccugaaagagagaaaacgcaagcaauugacggagaauuucgacucagaggugagcaaagaaaaacguuuguagaacugaugcgaagaggugauuuaccaguaugguuaucuuauaaaguugcgagcgcagguaucucuuacaaagacagagaaugguguuuuacaggggagcgcaauaaccaaauucuugaggaaaacauggaaguggaaaucuggacuagggaaggagagaagaagaaacuuaggccuaaauggcuagaugcgaggguauacgccgacccuauggcacuaaaggauuuuaaagaauuugcaagcggacgaaaaaguauuacacuagauauuuugacugaaauagcgucguuaccaacuuaccucaguucucgcgcaaaauuagcguuggacaauauagucaugcuucauacgacggaaagagggggacgggcauaccaacaugcuuuaaacgaacuaccagaauccuuagaaacccuaaugcugguggcucuuuuaggugcaaugacagcagguauauuccuauucuuuaugcaaggaaaagguauuggcaaacuuaguaugggacugauaacaaucgccgucgcaucaggauuauuaugggucgcagaaauucagccacaauggauagcagcuaguauaauccuggaauuuuucuuaaugguccuauuaauuccagaaccggaaaaacaaagaaccccacaagacaaccaacuaauuuacguuauccucacaauuuuaacuauaauaggcuuaauagcagcaaacgaaaugggacugauagagaaaacaaagacagacuucgguuuuuaccaagugaaaacagaaacaacgauacuagauguugaucuucgaccagcgucagcauggacccuguaugccguugccacuaccauuuuaacaccuaugcuuagacauacaauugaaaauaccucugccaaccuauccuuagcugcaauagcaaaccaggcugcaguucuuaugggauuagguaaaggcuggccacugcaucgaauggaccucggaguuccucuuuuagcuaugggcuguuacucacaaguaaacccgacaacauuaacagcgucguuaguaaugcuacuuguucacuacgcaauaauaggcccaggcuuacaagcaaaagccacucgugaggcucaaaagagaacugcagcaggaauaaugaaaaacccgacaguugacggaauaacaguaaucgauuuggaaccaauaagcuacgaccccaaauucgaaaagcaacugggacaaguaaugcuauuagucuugugugcuggucaguuguuauuaaugcgaacgaccugggcuuuuugugagguacuaacacuagcaacaggaccuauacucacguuaugggagggaaacccagggagguuuuggaacacgacaaucgcuguaaguaccgccaauaucuucagaggaagcuaucuggcgggagcuggacuugcuuucagcuuaaucaaaaacgcucagaccccucgacgaggaacagggacagccggugaaacuuuaggagaaaaguggaaaaggcaacugaacagccuugaucgcaaggaguuugaagaguacaagcggucaggaauccucgaaguugauagaacagaagcgaaaagugcgcuuaaagauggaaguaaaaucaagcaugcgguaagucgaggaagcucaaaaauaagguggauagucgaaagggggaugguuaaaccuaaaggaaaaguuguugaccucggaugcggccgaggcggauggaguuauuauauggccacccuaaagaaugucacagaaguaaaaggguauaccaaaggaggaccuggacaugaagaaccaaucccuauggcgaccuacgguuggaauuuaguuaagcugcacucagguguagauguauuuuauaaaccuacagaacaaguagacacgcuuuugugcgauaucggugaaucaucaucaaauccuacaauagaggagggaagaacauuacguguacuaaaaaugguugaaccuugguuaagcucaaaaccagaguuuuguauaaaagucuuaaacccauauaugccgacgguuauagaagaguuagagaaguuacagaggaagcacggaggaaaccuaguccguugcccauuaucgagaaacucgacccaugaaauguauuggguaucaggggcuagcgguaauaucgugucaagcguaaauacuacaucaaaaaugcuacuaaauagauucacgacucgacauagaaagccaacuuaugaaaaggauguugaccuuggagccggaacuagauccguuucuacugagaucgaaaaaccugauaugacaauaaucggccguaggcuacaacgauugcaggaggaacacaaggaaacauggcauuacgaccaagaaaaccccuauagaacaugggcauaccaugguaguuacgaagcuccaaguacagguucagcaucguccauggugaacggaguagucaagcuacuuacgaagccaugggauguaauaccaauggugacucagcucgcuaugacggauacgacaccuuucggacaacaacgcguauuuaaggaaaaaguagacacaagaacaccgcagccgaaaccuggcacaagaaugguaaugacgacgaccgcaaauugguuaugggcguuauuaggaaagaagaaaaauccuagacuuugcacccgggaagaauuuauuucaaaaguacguucuaaugcggccauaggagcaguuuuccaagaagaacaaggauggacaucagccucggaagcaguaaaugauaguagauuuugggagcuaguagauaaagaacgugccuugcaccaagaagggaaaugcgaaucuuguguauacaacaugauggguaaaagggaaaagaaauugggugaguucggcagagcuaaagguucuagagcaauuugguauaugugguuaggcgcaagguuucuagaauuugaggcacuuggauuccuaaaugaagaccauugguucggaagggaaaacagcuggagcggagucgaaggggaaggacuacaucgcuugggauauauauuagaagaaauagauaagaaagauggagaucuaauguaugcagacgacaccgccgguugggacacaagaauuacagaggacgauuugcaaaaugaagaacucauaacagaacaaauggcgccacaccauaaaauucuugcaaaagcuaucuuuaaacugacauaucaaaauaagguagugaaaguauuacggccgacgcccaggggagcaguaauggauauuauaagucguaaagaucaacgaggaaguggacaaguagggaccuauggauuaaacacauucacaaacauggaaguucaacugauccgccaaauggaagcagaaggaguaauaacccaagacgacaugcaaaaccccaaggggcuuaaagaaaggguagagaaaugguuaagagaaugcggcguugauagauugaagaggauggccauauccggagaugauuguguggucaaaccucuugaugaacgcuuuggaacaucucuacuguucuuaaacgacauggguaaaguuagaaaggauauuccacagugggaaccaucuaaaggcuggaagaacuggcaagaaguacccuuuuguucccaucauuuccacaagauuuucaugaaggauggacggagcuuagucguucccugucguaaccaagaugagcuaauuggucgugcaagaauuagccaaggagcggguugguccuugcgagaaacagccugccuuggaaaagcauaugcucaaauguggucauuaauguauuuccauaggcgcgauuuacgauuagcaucuauggccauuuguagcgcaguccccacagagugguucccgacgaguagaacgacauggucaauacacgcacaccaucaauggaugacaacggaagacaugcuuaaaguguggaacagagucuggauugaagacaacccuaacaugauagauaaaacuccagugcauucaugggaagacauuccuuacuuggggaaacgagaagaucuuuggugcggaucccuuauugggcugagcucacgugcuacgugggccaaaaacauccauacugccauaacgcagguucguaaccucauagguaaagaagaauauguggacuauaugucagugaugaagcgauauucugcaccgagugaauccgaggguguauuauaa

SEQ ID NO: 23690 - RNA, 9867 nt, Artificial Sequence
  derived and/or modified CDS sequence (opt6) from DENV-4__KJ579242__SS-prME
ucaacaauaacauuacuauguuuaauuccaacuguuauggcauuucacuuaucaacacgagacggugaaccucugaugauaguggcaaaacaugaacgugggagaccacuuuuauucaagacgacagaaggaauaaacaaauguacucucauugcgauggaccugggagaaaugugcgaagacaccgugacauacaaauguccacuccuuguaaacacugaaccagaagauauagacugcuggugcaaccuuacaucaacgugggugauguaugguacaugcacgcaaagcggugaaaggcgacgugagaaaagaucaguagcacuuaccccucacuccggaauggguuuggaaacucgugcagaaacguggaugagcucagaaggugcauggaaacaugcgcagcguguagaaaguuggauacuuaggaauccaggcuuugcucuacucgccgguuuuauggcguacaugaucggacaaacaggcauacagagaaccgucuuuuucguucuaaugaugcuggucgccccuaguuauggaaugagauguguaggggucggaaaucgagauuuuguagaaggagugagcgggggagcgugggucgauuugguacuugaacacggagguugcgucacaacaauggcacaagguaaacccacacuagauuucgaauugacaaaaacaacugcgaaagaaguugcguuacuaaggaccuauugcaucgaagcauugaucagcaacauuacuaccgcuaccagaugcccaacacagggggagcccuaucugaaggaagaacaagaucaacaauacauaugccggagagauguaguugaccgaggcuggggaaauggcuguggucuauuuggaaagggcgguguagucacgugugcaaaguucaguugcaguggaaaaauaacagggaacuuaguacaaauagaaaaccuagaguauacuguaguaguaacaguacacaacggagacacucaugcaguaggaaaugacacaucgaaccauggaguaacagcuaccaucacuccaaggucgccgucuguagagguaaaacuaccggauuauggggaacuuacguuagacugcgagccaagaucuggaaucgacuuuaacgaaaugauauugaugaaaaugaaaaagaaaacuuggcuaguacacaaacagugguuuuuggaccucccguugccauggacgacgggugcagauacgucugaaguucauuggaauuauaaagaaagaaugguaacguuuaaaguaccccaugcuaagagacaagacgugaccguacugggaucccaagagggagcuaugcacucagcucuagcaggcgcaacagagguagacaguggugacgggaaucauauguuugcaggacaucugaagugcaaaguacgaauggaaaaauugagaauaaaagguaugaguuauacaauguguucagguaaauucaguauagauaaggaaauggcagaaacccaacacggcacaacagugguaaaaguuaaauacgaaggugcaggggcccccuguaaggugcccauagaaauacgcgauguaaauaaggaaaaaguuguaggucgaguaauaagugcuacuccgcuagccgaaaauacaaacaguguaaccaacaucgaacuagagccaccguuuggagauucguacauagucauagguguaggaaacagugcuuugacacuacauugguucagaaaaggaucuucaauagggaagauguucgagaguacauacaggggagccaaaagaauggcaauacuaggagaaacagcaugggacuuuggaucaguaggcggcuuauuuacaucacucgguaaagcaguacaucaaguauuugggucgguauauacaacaauguuugggggagucucuuggaugauacgcauacuuauuggauucuugguguuauggauaggcacuaauucucgaaauacuucuauggccaugacauguaucgcugucggcggaauaacauuauuccuugguuucacaguccaagcugacauggguuguguaguaucauggucaggccgagaacuaaagugugggagcgguauauuugugguugauaaugugcauacauggaccgagcaguauaaauuccaaccagaaagcccagcacgccuagccagugcuauucuaaaugcacauaaggauggaguaugcggaauccguaguacaacgcgauuggagaauguaauguggaagcaaauaacaaaugaauuaaauuacguguugugggaagggggccaugaucugacgguuguggcuggugauguuaaaggaguucuaacuaaggguaagcgugcgcuaacacccccggcgucagaucucaaauacucuuggaaaacuugggguaaggcaaaaauuuucacaccugaggcucggaacaguacguuuuuaaucgaugguccagauacaucagaauguccaaaugagcgacgggcauggaacucuuuugaaguugaagauuaugguuuuggaauguuuaccacaaacauauggaugaaauuuagggagggaucaucggaaguaugcgaccacagacuuaugagcgccgcgauaaaagaucaaaaagcgguacaugcagacaugggauacuggauagagucaucuaagaaccaaacuuggcaaauugaaagggcgucauuaaucgagguaaaaacuuguuuauggccaaaaacccauacacuauggagcaacgguguauuagagagccaaaugcuaauaccaaagagcuaugcagguccauuuucacaacauaauuacagacaaggauacgcgacccaaacuguagggcccuggcauuuagggaaguuggaaauugauuuuggagaauguccagggaccacaguaacuauacaagaaaacugcgaucaccggggaccgucguuacgaacaaccaccgcuagcgguaaauuaguuacacaaugguguugucguagcugcaccaugccuccacugcgauuucugggugaggauggauguugguaugggauggaaauacgaccuuuaucggaaaaggaggaaaacauggugaaaucucaagucaccgcaggccaagguaccagcgagacauuuaguaugggauuacugugccuaacauuauucguagaagagugucuuaggcgaagaguuacgaggaaacacaugauacucgcagugguaauaacucucugcgcuauaauacuuggaggacucacuuggauggaucuacuucgcgcccuaaucauuuuaggggauacaauguccgguagaauaggugggcaaacucaucuagcaauaauggcuguuuucaaaaugagucccggcuacguacucgguguauuucuucgaaagcucacgagcagggagaccgcccuuaugguaauaggaauggcuaugacuacuacuuuauccauaccacaugaccucauggaauugaucgacgguauaagucuugguuugauauugcuuaaaauaguaacgcaauucgauaauacacagguagguaccuuggcuuugucauuaacguucauuagaaguacgaugucccuagugauggccuggcguaccauuauggcgguuuuauuuguaguuacccuuauuccucuaugcaggacaagcugucugcaaaaacagucacacuggguugagauaacagcccuaauucuuggggcucaagcauuacccguguaucugaugacacugaugaaaggagccucucgaaggaguuggccacugaaugaagguauuauggcggucggucuuguaucauuauuaggcuccgcuuuacuaaagaaugacguuccucucgccggaccgaugguagcgggaggccucuuacuugcugccuauguaaugucaggaaguagcgcagacuuaucauuggaaaaagcagcuaacguccaaugggacgagauggcagauauaacagguaguucuccaauaauagaaguaaaacaagacgaggacggcagcuuuucaauucgcgacguggaagaaacuaacaugauaacgcuauuaguuaaauuggcuuuaauuacaguuucuggucuuuacccacuugcaaucccaauaacuaugacacuuugguacauguggcaaguaaaaacacaaagaucuggagcgcugugggauguccccucacccgccgcaacgcaaaaagcagccuuauccgagggaguauacagaauaaugcaacguggguuauucggaaaaacucaagucggcguuggaauacacauggaaggaguauuccauacuauguggcacguuacccguggauccguuaucugucaugaaacuggcagguuagaaccaucgugggcugacguccguaaugacaugauaagcuauggcggaggcuggcgauuaggagacaaaugggauaaggaagaagauguccaaguuuuagcgauagaaccuggcaaaaacccaaagcauguccaaacaaaaccaggacuguucaaaacacuuacgggagagaucggcgcuguuacucuugauuuuaaaccuggcacaaguggauccccaaucauaaauagaaaagggaagguaauaggccucuacggaaacggcguaguaaccaaaaguggggauuacgugucagcaauuacacaagcugaaaggaucggugaaccugacuaugaaguggaugaagauauuuucaggaagaaacgccuaacuauuauggauuuacaccccggagcugguaaaacaaaacgcauuuugccuucuauuguaagagaggcacuuaaacgaaggcuuaggacauugauauuagcaccaacgagagucguugcugcagagauggaagaagcauuacgaggcuugccaauacguuaccaaacgccugcuguaaagucagagcacaccgggagagaaauaguagaccuaaugugucacgcuaccuuuacaacccguuuacuuaguaguacuagaguaccgaacuacaauuuaaucguaauggacgaagcacauuucacggauccuucuagugucgcugcacgaggcuacauuucaacaagaguugaaaugggagaagccgcugcaaucuuuaugacagcaacaccuccgggagcaacagacccuuucccacagaguaauucaccuauugaagacauugaaagggaaaucccugaaagaucauggaauacuggguuugauuggauaacggauuaucaaggcaaaacagucugguuuguuccaucgauaaaagcuggaaacgauauugcuaauugucuaaggaaaagcggcaagaaggucauacaacugucuaggaaaaccuuugauacagaauacccaaaaacgaaacucacagauugggacuuuguuguaacaacugacauauccgagaugggagcuaauuuucgagcaggucgaguaaucgacccacgacggugucuuaaaccugugauccucacagacggcccugaacguguuauucuugcugggccaauaccagucacaccagcaucugcggcacaaagaagggguagaauugguagaaauccagcgcaagaagaugaccaguauguuuucucaggggauccucuuaaaaaugacgaagaccaugcacauuggacagaagcgaaaauguuauuagacaauauauacaccccugaaggcauuauaccgacucuauucggacccgaaagagagaagacacaggcaauagauggagaauuuagauuacgaggugaacaaagaaaaacauucguagaacuaaugagaaggggugauuugccaguaugguuaucuuacaaaguagcaagugcuggcaucuccuacaaagacagagaaugguguuucacaggagagcgcaauaaccaaauacuugaggaaaacauggaaguagaaauauggacccgagagggugagaagaagaaacugagaccuaaaugguuagaugcaagagucuaugcugauccaauggcacuaaaggauuucaaggaauuugcuucaggaagaaagagcaucacuuuagauauuuuaacugaaaucgcaucgcugccaaccuaccuuucgagucgagcaaaauuagcauuggacaauauuguaauguugcacacaaccgaacguggaggcagagcauaucaacacgcgcugaaugaacuaccugaaucauuggaaacuuuaauguugguugcccuuuuaggggcuaugacggccggaauauuccuauucuuuaugcagggaaaaggaauaggaaaauuaagcaugggguuaauuacaaucgcgguggccucuggccuauuauggguggcagaaauccaaccucaauggauugccgcguccauuauccuugaguucuucuuaaugguauuguuaaucccugaaccugaaaaacagagaacaccgcaagacaaccaauugauauacgugauacuaacgauucuaacaauuauaggauuaaucgcagcgaacgaaauggguuugauagagaagacaaaaacugauuucggcuuuuaccaaguuaagacagaaaccaccauacucgauguugacuugcguccugcauccgccuggacguuauacgccguugcaacgaccauacuaacuccaaugcuacggcacacaaucgaaaacacaagcgcaaaucugagccuggcagcgaucgcuaaccaagcugcugugcuuaugggacugggcaaaggauggccucuccaucguauggacuuaggcguuccauuacuggcaaugggguguuauucacaaguaaauccuacuacacuuacggcuucucuuguaaugcucuuaguacauuaugcuaucauaggaccuggauugcaagcaaaagcuacuagagaagcacaaaaacgaacugcugcagggaucaugaagaaccccacuguugauggaauaacgguaauugauuuggaaccgaucagcuacgauccuaaauucgaaaagcaacugggccaagugauguuauugguuuuaugcgcgggccaauuauuacucaugagaacgaccugggcauuuugcgaaguacucacacucgcuacaggcccaauccuuacucucugggaagggaauccagguagguuuuggaauacaaccaucgcggucaguacagcaaauauauuuagaggcaguuauuuagcaggagccggcuuagucuucucccugauuaaaaaugcacaaaccccacgaagggguacaggaacugcaggagagacguugggcgagaaauggaagcgccagcuuaauagccuugauagaaaggaguucgaggaguauaagcguaguggcaucuuagaaguggauaggacugaggcaaagucagcguuaaaagacgguucaaagauuaaacaugcaguuuccagaggcucuagcaagauacgguggauuguugaaagaggaaugguuaaaccaaaaggaaaagucgucgaucuaggauguggucgaggcgguuggagcuacuauauggcgacccuuaaaaauguuacugaaguuaaaggauacacaaaaggaggaccgggucaugaagaaccaauuccaauggcgacauauggauggaaucuaguaaaauugcacucuggaguggauguauuuuauaagccuacugaacaaguugacacguuauugugugauauuggagaaucuucaucgaauccaacaauagaagaaggucguacaaugaggguuuuaaaaauggucgagccaugguuaucgaguaaaccagaguucuguauuaaaguauuaaaucccuauaugccgacagucauagaagaauuagagaaauuacaacggaagcacggcggaaacuuaguucguuguccacucucuagaaacucaacucaugaaauguacuggguaaguggagccucuggaaauauuguaucgagugugaauacaacaaguaaaauguuauuaaauagauuuacuacaagacauagaaaacccacguacgaaaaggauguagaccuaggcgcagguacaagaagcgugagcacagaaaccgaaaaacccgauaugacaauaauaggcagaagauugcagcgccuccaagaagaacauaaggaaaccuggcacuacgaccaagaaaauccauaccgaacgugggccuaucauggcucauacgaagcuccauccacugguucagcaucaaguaugguaaacggugucguaaaacuucuaacgaaaccuugggacgugauuccaauggucacucagcuugccaugaccgauacaacuccuuuuggacagcagcgagucuuuaaagaaaagguagauacgagaacaccgcaaccaaagcccggaacuagaaugguaaugaccacgacggcuaauugguuaugggcacuucuuggaaagaagaaaaauccaaggcuauguacuagagaagaguuuauuucgaaaguaagaagcaaugcugcuauuggcgcuguauuucaggaagaacaaggauggaccucugcuucagaagccguaaaugauucaagauuuugggagcuaguagacaaagaacgagcauuacaucaagaagguaaaugugaaucauguguuuauaauaugauggguaaaagggagaagaaacuuggagaauuuggacgagcgaaagggaguagagcuaucugguauaugugguuaggugcacgauuucucgaauuugaagcucugggauuccucaaugaagaccacugguucggaagagaaaauagcugguccggaguggaaggcgagggucuucauagacuggguuacauauuagaggaaauugauaagaaagauggugaccuaauguacgcugaugacaccgcuggcugggacacaagaauuacugaggaugauuuacagaaugaggaauugauaacagaacagauggccccacaccacaaaauacuagccaaagcgauuuucaagcuaacuuaucaaaacaaaguaguuaaaguccuuaggccaacaccgagaggagccguaauggauauaauaucaaggaaagaccaaagaggcagcggucaagucggaacguacggcuugaacacguucacaaauauggaagugcaacuuauacgacaaauggaagcagaagguguuauaacucaagacgauaugcaaaacccuaaaggauuaaaagaaagaguggaaaaaugguugcgagagugcgguguagaucgauuaaagcggauggcuauuucaggggacgauugcgugguaaaaccgcuugacgaaagauucggaacaagccuauuguuucuaaaugauauggguaaaguaaggaaagauauaccgcaaugggaaccuaguaaagguuggaaaaauuggcaggaagucccauuuuguucgcaccacuuucauaaaaucuuuaugaaagacggaagaucauuaguugugcccugcagaaaucaagaugaguuaauuggccgggccagaauaucccaaggcgcugguuggagucuacgggagacagcaugcuugggaaaggcguaugcacaaauguggaguuuaauguacuuucaucgucgagauuugcgauuggcaucgauggcgauauguagcgcgguuccgacugagugguuuccaacuucacgaacgacauggucgauucacgcccaucaucaauggaugacaacagaagauaugcuaaaggucuggaauagggucuggauugaggacaacccaaacaugauugacaaaacuccagugcauaguugggaagauauucccuauuuaggaaaacgggaggaccuuuggugcggauccuuaaucggucugaguaguagagcuacaugggccaaaaauauacauaccgcgauaacucaaguaagaaaccugaucggaaaagaagaauacguggauuauaugccggucaugaagcguuauucggcaccaucagaaucugagggugugcuauag

SEQ ID NO: 23691 - RNA, 9867 nt, Artificial Sequence
  derived and/or modified CDS sequence (opt6) from DENV-4__GQ398256__SS-prME
ucaacaaugacgcuuuuaugccuuauccccacaguuauggcauuucauuuauccacaagagacggagaacccuuaaugauuguugcuaaacaugaaagaggaaggccauuauuguucaaaacuaccgaaggaaucaacaaauguacauuaaucgcuauggauuuaggagaaaugugcgaagacacugugacuuacaaaugcccacuguuaguaaauacagaaccagaggauauagauugcugguguaacuugacaagcacuuggguuauguauggaacuuguacucaaaacggugaaagacggcgugaaaagaggaguguugcacugacaccacauucaggaaugggacuugagacacgagcugaaacguggauguccucagaaggcgcauggaaacaugcacagcgugucgaaucauggauucuaagaaauccagguuuugcuuuauuggcuggcuuuauggcauacaugauuggucaaacagggauccaaagaacaguauuuuucguauuaaugaugcugguugccccaagcuaugguaugcgaugcguagguguaggcaauagagauuuuguugagggaguaagcgggggagcauggguugauuugguacuagaacauggggguuguguuaccacgauggcucagggaaaacccacacuugacuucgaacuaacaaaaacaaccgccaaagaaguugcacuauugaggaccuauugcauugaagcuagcauuuccaauauaacgacagcaacgagguguccuacucaaggagaaccauauuugaaagaagaacaggaccagcaauauauuugucguagagauguaguugauagaggaugggguaacgguuguggucuguucgguaaaggaggcguugucacgugugcaaaauuccuuugcucaggcaaaauaacuggaaacuuaguacagaucgaaaauuuagaauacacagucgcagugacgguacauaacggagacacacaugcaguuggaaaugauacaaguucacaugguguaacagcaaccaucacgccacgcaguccguccguagagguuaagcuaccugauuacggggaguuaacacucgauugcgaaccccguagugggauugauuucaaugaaaugauucucaugaaaaugaagaagaaaacauggcuugugcauaaacaaugguuccucgauuuaccuuugccauggacagccggagccgauacauccgagguccauuggaaucauaaggagagaaugguaacauuuaaaguuccccacgcaaaaagacaagacguaacaguccuagggucccaagaaggagcaaugcauucagcccuagcaggcgccacugaaguugauucaggagacgguaaccauauguuugcgggucacuuaaaauguaaagugagaauggaaaagcugcgaauaaaaggaaugaguuauacuauguguuccggcaaauucaguauagauaaggaaauggcugaaacucagcaugggacuacuguugugaaaguuaaauacgagggggcuggugcaccuuguaaggucccgaucgaaauuagggacguuaauaaggaaaaaguuguaggaagaaucauuucuucuacaccauucgcggaaaacacgaacucuguuacgaauauagaguuagaaccaccauuuggagacucauacauaguuaucggaguaggagaaucugcguugacguuacacugguucagaaaaggaucuucuauugguaagauguucgagagcacguauagaggugcaaaaagaauggcuauacuaggagagacugcuugggacuucggcagugugggaggacuguucacuucauuaggcaaagcuguacaucaaguauuuggcucaguuuacacuaccauguucggagggguaagcuggaugguacgaauacucaucggcuuucuaguucuguggauagguacaaauagucgaaauacgucgauggcaaugacauguauagcaguaggugggaucacguuauuuuuagguuuuacgguacaagcagauaugggaugcguagugaguuggaaugggaaggagcuaaaaugugguaguggaaucuuuguaguagauaacguccauaccuggaccgaacaauauaaauuccagccugaaucuccagcacgauuagcgagcgcaauucucaaugcucauaaagauggagucugugguauccgcucuacaacaagguuagaaaauguaauguggaaacaaauaacgaaugaauuaaacuacguuuuaugggaggguggacacgaucuuacgguuguagccggcgauguaaaaggcguccuuaccaaagguaaaagggcgcuaacgccuccgguuaacgaucuaaaauacaguuggaagaccugggguaaagccaaaauauuuacuccugaggcucguaacaguacguucuuaauagacggaccagauacaucagaauguccgaacgaacggagagcauggaacuucuuugaaguugaagauuauggcuuugguauguuuacaacaaauauauggaugaaauuucgugaaggaagcucagaaguuugcgaucauagauugaugagugcagcaauuaaagaucaaaaagcaguucaugccgacaugggauauuggauugagucaucuaaaaaccaaacuuggcaaauagagaaagcaucucuaauagaaguuaaaacaugccuauggcccaagacucacacacuguggucaaacggaguuuuggaaucacaaaugcuuauuccaagaucauaugcugguccauucagccaacauaauuacagacaaggauacgccacgcaaaccguugguccguggcauuuaggaaaauuggagauagacuuuggugaaugcccagguacaacagucgccauacgugaagauugugaccacagaggacccucguuacgaaccacaacagcaagugggaaauuagugacgcaguggugcugucgaagcugcacuaugccgccuuugagauucuuaggggaagaugguuguugguauggaauggaaaucagaccacuaagcgaaaaagaggagaauauggugaaaucucaaguuacagcugggcaaggaacuucugaaacauucucgaugggccuauuaugccuaacgcuauuuguagaagaaugucuacgucgucguguaacaagaaaacauaugauacugguugugguaauaacauuuugugcaauuauucucgguggguuaacauggauggaucuacugcgggcccuuauaaugcucggagauacuauguccggcaggauuggugggcaaauacacuuagccaucauggcgguauuuaagauguccccuggauacguuuugggaguauuuuuaagaaaacuuacaagucgagaaacagcuuuaaugguaauagggauggcaaugacaacaguauuuuccauuccacacgaccuaauggaacuuauagaugggauaagccuaggcuuaauacuucucaaaauaguuacucacuuugacaauacacaagucggaacauuagccuugucauuaacguuucuacguucuacaaucccauuaguaauggcauggcgaacaauuauggcaguauucuuuguuguaacccuaauaccauuaugcagaaccucaugucuacaaaaacaaucacacuggguugaaauaacagcauugauucugggugcccaggcguugccaguuuaucucaugacguuaaugaaaggugcaagccgacguaguuggccauuaaacgaaggaauaauggccguuggccuaguaagccuacuuggaagugcccuguugaaaaaugauguaccacuagcaggaccuaugguggccgguggauuauuacuagcagcuuauguaaugucuggaaguucugcagaucuuucuuuagaaaaggcagcuaacguccaaugggacgagauggccgauauuacagguucaucgccaauaauagaaguaaaacaagaugaagaugguaguuuuagcauaagagauguagaagaaaccaacaugauaacuuuacucguaaaacuagcgcucauaacaguaucuggauuguauccacuugcuauuccaguuacaauggcacuuugguacauuuggcagguaaaaacgcagagaucuggggcauuaugggaugucccgagcccagccgcgacacaaaaagcaacucugagugaaggaguuuacagaauaaugcaaagagggcuguuuggcaaaacgcaaguggggguaggcauucacauggaagguguauuccauacaauguggcacguaacaagagguaguguaauaugucacgagacaggaagauuggagcccagcugggcagacguccguaaugauaugauaaguuacggaggugguuggagauugggagacaagugggauaaagaagaagauguucaaguuuuagcaauugaaccagggaaaaaccccaaacauguucagacaaaaccaggucucuuuaagacguuaacaggcgaaauaggagccguuacgcuggauuucaagcccgguacgucggggaguccaauuaucaauaagaaaggaaaagugauuggacuauauggaaauggaguagugacgaagaguggagauuacgugucagcuauaacgcaagcggaaagaaucggagaacccgauuaugaggucgacgaagauaucuuucggaagaaaagacuuacuauaauggaucuccacccuggagccgguaaaacaaaacgcauauuaccaucuauaguucgugaggcccugaaacgaagacuucgaacucucauucuagcaccaacacgcguaguugcagcagaaauggaagaggcuuuacgaggauugccgaucagauaccaaacgccugcaguaaaaagugagcauacaggacgggagauuguagaccuuaugugccaugccacauucacaacaagacuuuugaguagcaccagagugccaaauuauaaucuuauaguaauggacgaggcacauuuuacagacccaugcucaguagcggcacguggauauauauccacgagaguggagaugggugaagcggcagcaauuuuuaugaccgcuacuccgccaggagcgacagauccguuuccacaaucaaacagcccgauugaagacaucgaacgagagauacccgaaaggagcuggaacacagguuuugauuggauuacugauuaucaagggaagaccguuugguuuguacccaguauaaaagcaggaaaugauauagcaaauuguuuaagaaagagugguaaaagagucauucaacugucacgaaaaacuuuugacacagaauacccaaaaaccaaacugacagacugggauuucguuguaaccacagacauaucagaaaugggagcgaacuuuagggcaggucgcguaauugacccuaggagaugucuuaaacccguaauauuaacugauggccccgaacgaguaauauuggcgggucccauuccugucacuccagcaagcgcagcacaacguagaggacggauuggacgaaacccugcucaagaggaugaccaauacguguuuucaggggacccacuaaagaacgacgaagaccacgcucacuggacggaagcaaagauguuauuagauaacaucuauacgccggaaggaauaaucccgacccuguucggaccggaaagagagaaaacacaagcaaucgacggcgaauuuagauuaagaggugaacaaaggaaaacguucguagaacucaugaaacgaggagacuuaccaguuuggcucucauauaaaguugccagugccggaaucucuuauaaagauagggagugguguuucaccggcgaacgaaacaaccagauacuugaagaaaacauggaaguagagauauggacgaaagaaggagagaagaagaaauuacggccuaaauggcucgacgcccguguuuaugcggaucccauggccuuaaaagauuucaaagaguucgcaaguggacggaaaucaauaacucuagauaucuuaacagagauagccucacuaccgacuuauuuaucuucaaaggcuaaacuagcuuuggauaacauagucauguuacacacaaccgaaaaaggcggcagagccuaucaacacgcucuuaacgaauuaccagaaaguuuggaaacauuaaugcugguggcgcuacucggggcgaugacugcaggaauauuuuuauucuuuaugcagggcaaaggcauugggaaauugucaaugggucucaucgcuauagcaguagcaucaggacugcucuggguggcagagauucaaccccaguggauugcagccagcauaauuuuagaguucuuucugaugguucuacuaauuccggaaccggaaaaacaaagaacaccucaagacaaccaacuaauuuacguuaucuuaacgauacucacaauaauaggauuaauagcugcaaaugaaaugggccuuauugagaaaacaaagacggacuuuggauuuuaccaagugaagacugaaacaaccauuuuggaugucgaucuaagaccggccucugcauggacuuuauacgccguugcaacuacuauauugacaccaauguuaagacacaccauagagaacaccagcgcaaaucugucuuuagcggcaauugcaaaucaggcggcgguuuugaugggauuaggaaaaggauggccauugcaucgaauggaccuaggcguaccauuguuggcgaucggcuguuacagucaaguaaacccgacaacauugacggcgucguuaguaaugcuucuuguacacuaugcaauuauuggacccgggcuucaagccaaagcaacaagagaagcccaaaaacgcacugcggcaggaauaaugaaaaauccuacaguagauggaaucacggugaucgacuuggaaccuaucagcuaugauccgaaauuugaaaaacagcuagggcagguuaugcuauugguuuugugcguuggucaauuauuauuaaugcgaacuacaugggcguugugugaaguguuaacgcuagcuaccgguccggcaaugaccuuaugggaaggaaauccugggagauuuuggaacacaacuauagcaguaucaacagcuaauauauuccgaggaagcuacuuggcaggagccggccucgcuuuuagucuaauuaagaaugcccaaacgccacgacgcggaacaggcacaacgggagagacgcuuggagaaaaauggaaaagacaacuaaauagucuagacagaaaagaguucgaagaauacaaaagaaguggcauccuagaaguagaucgaacggaagcaaagagcgcucuuaaagauggaagcaagauuaagcacgcaguuucgcgcggaagcagcaagauccgcuggauagucgaacguggaauggucaagcccaaaggaaagguaguagauuugggaugcggccguggagguuggucauauuauauggcuacgcugaagaauguaacugaagucaaagguuauacgaagggcggaccuggacaugaagaaccuauuccaauggcaacuuacggguggaaccuagugaaacuucacucugggguggauguguucuauaaaccaaccgaacaaguagacacguugcugugugauaucggcgaaagcucgaguaacccuacaauagaagagggaagaacauuaaggguucuaaaaaugguugaaccguggcuaucuucgaaaccagaguucuguaucaaaguauugaacccguauaugccuacagucaucgaagaguuagaaaaacugcaaaggagauacggggguucauuaguacguuguccgcuuagcagaaauucgacccacgaaauguacuggguaucaggugcaucaggcaacauaguaucaucaguuaauacgauauccaagauguuauuaaaccgcuuuacuacacgucacaggaaacccacauacgaaaaagauguugaucuuggggccggaacaagaucagucucaacagaaaccgaaaaacccgacaugacagugauaggucguagauuacagaggcugcaagaagaacauaaagaaacuuggcacuaugaccaagaaaaccccuaccgaacaugggcuuaccauggcucuuaugaagcaccaucuaccggcagcgcauccucaauggucaauggcauaguuaaguuacucacaaaaccgugggauguaaucccgaugguaacgcagcuagcaaugacggauacaacucccuucggucaacaacguguuuucaaagaaaaaguugauacacgaaccccgcaaccuaagccaggaacacgaaugauaaugacuacgacugcuaacugguugugggcauuauugggcaagaagaaaagcccucgucuuugcacacgcgaagaguucauauccaaagugagaucuaaugccgcaauaggagccguauuucaagaagaacaagguuggacaagugcaagugaagcaguaaaugauagcagauuuugggagcuuguuaacaaagaaagggcauuacaucaagaaggaaaaugcgagucauguguauauaacaugaugggaaaacgugagaagaaguuaggagaauuugguagagcaaaggguaguagagcuauaugguauaugugguuaggggcgcgauuuuuggaauuugaggcguuaggauuucuaaacgaagaucacugguuuucgcgcgaaaauucguggagcggcgucgagggagagggacuacauagacuaggauauauauuggaagacauagauaagcaagauggcgaccuuauuuacgccgacgauacagcuggaugggauaccagaauuaccgaagaugaccuauuaaacgaggaauuaauuacugaacaaauggcaccucaccacaaaacauuggccaaagcaauauucaagcuaacauaccaaaacaaagucgucaaaguucuacguccaacgccuaaaggugcagugauggauauuaucucaagaaaagaccaaagaggcagcggacaaguugguacuuauggacuaaacacuuuuacaaacauggaaguucaguuaauuaggcaaauggaagccgagggaguaauaacacaggacgauaugcaaaauccuaagggacucaaagaacguguugaaaaaugguuaacagagugcgguguagauagacucaaaaggauggccauuucaggugaugacuguguggucaagccguuggaugaacgguucuccgcaaguuuacuauucuuaaaugacaugggaaagguacguaaggacauaccacaaugggaaccuucaaagggcuggaaaaauuggcaagaaguaccauucugcagucaccacuuccacaaaauauuuaugaaagauggacgcagcuuagucgugcccugccgaaaccaagaugaguugauaggcagagcgagaauaucccaaggugcuggcuggucauugcgugaaacugccugucuuggaaaggcuuacgcgcaaauguggucuuugauguauuuucaccgaagggaccugagauuggccucaauggcuaucuguuccgcaguuccuacagaaugguuuccuaccucaaggacaacuuggaguauacaugcacaccaucaauggaugacuaccgaagauauguuaaaaguauggaaucgcguauggauagaggauaacccgaacaugacugacaaaacgccaguucauucgugggaagacauucccuauuuggggaaacgagaagacuugugguguggcagccuuauaggucuaucgucccgagcgacaugggccaaaaauauacauacggcaauaacccaagugagaaaccucaucggaaaagaggaguaugucgauuauaugccuguaaugaaacgguauagugcacccucagaaucugaaggaguacuauaa

SEQ ID NO: 23692 - RNA, 9867 nt, Artificial Sequence
  derived and/or modified CDS sequence (opt6) from DENV-4__KC333651__SS-prME
ucaaccaugacacucuuguguuuaaucccgacaguaauggcauuucaucuaucaacuagggauggggaacccuuaaugauaguugcuaaacacgaaagaggcaggccccuuuuauucaaaacgacagaaggaauaaauaaauguacacuaauagcaauggaucuaggagaaaugugugaagauacaguaacauauaaaugcccuuuauuagucaacacagagccugaagacauagacugcuggugcaaucuaacgucgacauggguaauguaugggacuuguacacagaauggagaacgucgaagggagaaaagaucgguggcucuaacaccccauucugguaugggauuagaaaccagagcagaaacuuggaugaguucggagggugcguggaaacaugcucaaagaguagagaguuggauauugaggaaucccggauuugcguuguuagcgggauuuauggccuacaugauaggacaaacagguauacaaaggauuguauucuuuguucuaaugaugcucguagcgccaucguaugguaugcgauguguaggagucgguaauagagacuuugucgaaggaguauccgggggagcauggguugaucuaguguuagaacacggaggcugcguaacuaccauggcacaagguaaaccuacucuagacuuugaauuaacaaaaacaacagcuaaagagguggcacuuuuacgaacguacugcauugaagcaagcaucuccaauauuacaacagccacccgaugccccacucaaggagaaccauacuugaaagaagaacaagaucaacaauauauaugcagacgagauguaguagauaggggauggggaaacggaugcggacuguucgggaaagguggagucguuacaugugcuaaauuccuauguucggggaagauuacuggcaaucugguucaaauagaaaaccuugaauauacaguaguaguaacaguacauaauggagacacacaugccguggguaacgauacuucaaaucauggagucacugcaacuauaacgcccagaaguccaucaguagaaguuaaacuaccagauuacggggaguuaacucuagacugugagccaagauccggaauagauuuuaacgaaaugauauuaaugaaaaugaaaaagaaaacuuggcuaguacacaagcaaugguuuuuagaucugccccuuccuuggacagcgggugcggauacaucagaaguacauuggaaucauaaggaacggauggugacguuuaaagucccucacgcuaaaagacaggauguaacaguccuaggcagucaagagggagccaugcauucagccuuagcaggcgcgacggagguagauaguggcgacgguaaccacauguuugccgggcaucuuaaguguaaaguaaggauggaaaaauugcguauaaaaggcaugucuuauacuaugugcucggggaaauuuucuauugauaaggaaauggcagaaacacaacaugguacaacaguagucaaagucaaauaugaaggagccggugcaccuuguaaaguuccgauagaaaucagagacguaaauaaagaaaagguuguagggagaauuauauccaguacaccauuugccgagaacaccaacuccguuacaaauauagagcuagaaccacccuuuggggauucuuauauuguuauagguguaggugagagcgcacuuaccuuacauugguuccguaaggguucgucaauugguaaaauguucgaaaguacuuauagaggagccaaaagaauggccauacugggagagacagcaugggacuuugguucaguaggcggccucuucacuucucuaggaaaagcuguacaucaaguauuuggcucuguuuauacaacaauguuuggcggggucucauggaugguacgaaucuugauaggauuucuuguacucuggaucgguacgaacucgcgaaacacaucaauggcgaugaccugcaucgcgguggguggcauuaccuuauuuuuaggcuucacaguccaggccgacauggguugugugguuagcuggaaugggaaagaacuaaaguguggaagcgguauuuucguagucgacaacgugcauaccuggacggaacaauauaaauuccaaccggaauccccagcacgucuugcuucagccauacuuaaugcccauaaagauggagucugugggaucagauccacaacuagacuugaaaauguaauguggaagcaaauaaccaaugaauuaaauuauguauuaugggaaggagggcaugaucuaacugugguugcuggggauguaaaaggaguuuuaacgaaaggcaagcgggcguuaacuccuccagugaaugaccuaaaauacucauggaagacauggggaaaagccaagauauucacccccgaggcaagaaauucgacauucuuaaucgacgguccagauacuucugaaugucccaacgagcgaagggcauggaauuucuucgaagucgaagacuacggauuugggauguucacuacaaacauauggaugaaguuuagagagggcaguucugaaguaugcgaucaucgacuuaugucagccgcuaucaaggaccagaaagcgguucacgccgauaugggcuauuggauagaaagcaguaagaaucaaacuuggcaaauagagaaggccucuuuaauagaaguuaaaaccugucuguggccaaaaacucacacacuauggagcaaugguguucuugagucgcaaaugcuaauaccaagaucauaugccggacccuuuucucaacauaacuaccgacaagguuacgcuacucaaacuguuggaccauggcaucuaggaaaacucgagauugacuuuggugaaugcccuggaacuaccguugcaauacgugaagacugugaccaucgggguccaucucuaagaacuacuacugcaucaggaaagcucguaacucaaugguguuguagaucauguacgaugccacccuugagguuccucggagaagacggguguugguacggaauggaaauacgaccauuaucagaaaaagaggagaacaugguaaagucacaagugacggcaggucagggcaccagugagacauuuucaaugggauuauuauguuugacacuguuuguagaggagugucuacgacggagagucacgagaaaacauaugauacucguggugguaauaaccuucugugcaaucauuuugggcggauuaacauggauggaccucuuacgcgcguuaauuaugcucggcgacacgaugucuggcagaauaggcggucaaauccaccuggcuauuauggcugucuuuaaaaugucaccaggcuacgugcuugguguuuuccuaagaaaauuaacuucgcgagaaacggcacuaaugguaauaggaauggcaaugacaacaguguucucuaucccgcaugacuuaauggaguuaauugauggaauaucguuagggcuuauuuugcuuaaaauaguuacucauuuugacaacacacaagucggcacucuugcuuuaagccuaacguuucuaagaucaacaauaccuuuagucauggcguggagaacgauuauggcaguauucuuuguuguuacauugauuccucuaugcagaacauccugccuacagaaacauagucauuggguggaaauaacugcacuaauccucggcgcucaagcacuuccgguuuauuuaaugacacuaaugaaaggcgcaaguaggcggaguuggccguuaaacgagggaauaauggcaguggguuuagugucacuacuuggaagugcuuuauuaaagaaugacgucccccuugccgguccgauggucgccgggggacuauuguuagccgcuuacguaaugagugggucgucagccgacuuacugcuggagaaggcggcuaacguacaaugggaugaaauggcugauaucacuggaucaucacccauaauagaggucaagcaggacgaggauggcaguuucucgauuagagacguggaggaaacaaauaugaugacucugcuuguuaaguuggcucuaaucacaguaucaggacucuacccuuuagccauuccuguaacgauggcucuuugguauauuuggcagguaaagacccaaaggucaggagcucuaugggacguaccgaguccggcagcgacacaaaaggcaaccuuaagcgaaggaguauaucgaauaaugcagcgcgggcucuuugguaaaacccaagucggcguaggaauacauauggaaggggucuuucauacaauguggcaugugacacgaggcagcgugauaugucacgaaaccggcagauuggaaccaaguugggcugacguacgaaaugacaugauaucauacggugggggauggcgacucggggauaaaugggacaaagaagaggauguucaaguucuagcuauagaaccagguaagaacccaaaacauguucaaacgaagccagggcuauuuaaaacgcuuacaggugaaauaggagccguaacauuagacuuuaaaccggguacgucaggaucuccgauuauaaauaagaaaggaaaagugauuggguuauaugggaacggugucguaacaaagaguggagauuacguaucggcgauaacccaggcagaaagaauuggugaaccugacuaugagguagacgaggauaucuucagaaagaaacgauugacuaucauggaucuccacccuggcgcggguaaaacuaagcgcauacuaccgucaauuguucgugaagcacuuaaaagacgucuuaggacauugauauuagcgccaacacgcgucguggcggcagaaauggaagaagcguuaagaggauuaccuauaagauaccaaacgccugccguaaaaagcgaacacacaggacgugagauuguagaucugaugugccacgcuacuuuuacuacacgacuauugucuagcacacgcguaccaaauuauaauuuaaucguuauggacgaagcacacuucacugaucccugcucaguugcagcccggggauacauaucgacacgagucgaaaugggagaagcugcagcaauauucaugacagcaacucccccuggagccaccgacccguuuccacaaucaaauucacccauagaagauauagaacgagaaaucccagaacgcucauggaauacaggauuugacuggauuacugauuaucaagggaaaacaguaugguuugucccgagcauuaaggcugggaaugauauugcaaacuguuugcguaagucgggcaaacguguuauccagcuaucgagaaaaacguuugacaccgaauaucccaaaacuaaacucacagauugggauuuuguagucacuacugacauuucggaaaugggugcaaauuuucgagccggacguguuauugauccacgaagaugcuuaaaaccaguuauauuaacggacggaccagaaagaguuauucuagcugggccgauuccgguaacucccgcuucugcugcacaaagaagaggacguaucgggcgaaacccugcucaagaagaugaccaauaugucuucucaggggacccucucaagaaugaugaagaucacgcacacuggaccgaagcuaaaauguuacuugacaauauauacacgccagaaggcauaauaccaacuuuauucggaccagagagagaaaagacucaagcaauagauggagaguucagauugagaggugaacaaaggaaaacauucguagagcugaugaaaaggggugaccuuccagucugguuaucauauaaaguugcaucagcuggaauaucguacaaagacagggaaugguguuuuacgggagaacgaaauaaccaaauacuagaggaaaauauggaaguggaaauauggacgaaagaaggagaaaagaagaaauuaagaccaaaauggcucgaugcacgaguguaugcagacccaauggcacuaaaagauuuuaaagaguuugcaagcgggcgaaaaaguaucaccuuagauaucuuaacagagaucgcaucccuuccaacauaccugaguagcaaagcgaaacuagcacuugacaauauagucaugcuucacacgacagaaaaaggcggucgcgcauaccaacaugcguuaaaugaacuacccgaaucauuagagacauuaaugcuaguagcacugcuuggagcuaugacggcaggaauauuuuuauuuuucaugcaagguaaaggaauugguaaacuauccaugggccucaucgcaauagcaguugcuuccgguuuguuauggguggcggagauccaaccucaguggauagcggcaucuaucauucucgaauuuuuccucaugguucuccucauccccgaaccagagaagcaacgcacaccacaagacaaccaacuuaucuacgucaucuuaacaauccugacuauuauugggcugauugcagcgaacgagaugggacuuaucgagaaaacaaaaacggacuucgguuuuuaucaaguuaaaacggaaacaaccauuuuagaugucgaucuucgaccugcaucugcauggacuuuguacgcuguagcaacaacaauacuaacgccuauguugaggcacacaauagaaaauacaagugccaauuuaaguuuagcagcuauagcgaaucaagccgcaguucuaaugggguuggggaaagguuggccccuccaucggauggacuuaggcguaccauuauuagcgauuggguguuauucacaaguaaacccaaccacacuaaccgcaucucuaguuaugcuauuggugcacuacgcuauuauaggcccaggucuacaggcuaaagcuaccagagaagcccaaaagagaacagccgcuggaauuaugaaaaauccuacaguagauggcauuaccgugauagauuuagaacccauaucauacgacccaaaauucgaaaagcagcuuggucagguaaugcuauugguauuaugcgcuggucaauuacuacuuaugagaacuacuugggcauugugugagguacuaacacuagcgaccggcccugcaaugacacugugggaggguaaccccggaagauucuggaacacgacuauugcugucucgacagcaaacauuuuccgaggaucuuaucuagcgggagcuggauuagcguucucucucauuaaaaaugcacagacuccucggcgcgggacgggaacaacaggggagacacugggugagaaauggaaaaggcagcuaaacucauuagaccgaaaagaauuugaagaguacaaaagaucuggaauuuuagaaguugaucguacagaagcaaaaagcgcuuugaaggauggaucgaaaauaaaacacgccgucucccgaggauccucaaaaauacgauggaucguugagcguggaauggugaagcccaaaggaaaagucguagaccuugggugugggcgaggaggguggagcuacuauauggcaacacuaaagaauguaaccgaagucaaagguuauacaaaaggcgguccagggcacgaagaaccaauaccgauggcaacauauggcuggaauuuagugaaacuccauuccggugucgacgucuuuuacaaaccuaccgaacagguugacacacuauuaugugacauaggggagucaucuaguaaucccacuauagaggaaggaaggaccuuacgcguauuaaaaaugguagaaccauggcugaguagcaaaccagaauuuugcauuaaaguacucaaucccuacaugccaacaguuauagaagaacuggagaaacuacaacgcagauacgggggaucgcuaguacguuguccacuaucucguaauucaacccaugaaauguauuggguauccggugcuaguggaaacauuguuucuagugugaauacaauaucaaaaaugcuucuaaauagguucaccacaaggcauaggaaaccaacauacgaaaaagauguagaccucggagcaggcacaaggagcguaucgacugaaacagagaaacccgacaugacagucaucgggaggcgauuacagcgauugcaggaagaacacaaagaaacuuggcauuacgaucaagaaaauccuuacagaacuugggccuaucaugggucauaugaggcaccaagcacggguucagcauccaguauggugaacggcguuguaaaacuauuaacuaaaccaugggauguuauaccgauggugacccagcuugcgaugacugacacaacuccuuucggacaacaaagaguuuucaaggaaaaaguugauacaagaacgccucagccgaagccggggacucguaugauuaugacuacaaccgcaaacuggcuaugggcauuacuagguaagaagaaaagcccucgcuuauguacccgggaagaauuuauuucuaaagucaggucaaaugcagcaauaggcgcgguguuucaggaggagcaaggauggaccagugcuucggaagcagugaacgacucuagauuuugggaguuaguggacaaagagcgugcacuacaucaagaagggaaaugugagucaugcguauacaauaugauggguaaaagggagaagaaauugggugaauuugguagggcuaaaggcaguagagcaauaugguauaugugguuaggagcgagauucuuagaauuugaagcucuagguuuucuaaaugaagaccauugguucagcagggagaacucaugguccggaguagaaggggagggguuacacagauuaggauauauuuuagaagacaucgacaaacaagaaggugaucucauuuaugcugaugauacagcagguugggauaccagaauaacugaagaugaucuucuaaacgaagaauugaucacugagcaaauggccccacaucacaaaacacucgcaaaggcaaucuuuaaacuuacuuaccaaaacaaagucguaaagguucugcguccuacgccaaaaggagcugugauggauauaauuuccaggaaagaccaaagggguaguggucaaguaggaacauacggacucaacacuuuuacgaacauggaaguucagcuuauacggcaaauggaagcagaggggguuaucacucaggaugauaugcaaaaucccaaaggacuaaaagaaaggguagaaaaaugguuaacagaaugcgguguugauagauuaaaaagaauggcaaucucgggagacgauuguguugugaagccuuuagaugaaagauucucuacuucauuacuauuuuuaaacgacauggguaaaguucgaaaggacauaccacaaugggagccuucuaaggguuggaaaaauuggcaagagguaccguuuuguucacaucauuuucauaaaaucuuuaugaaagacgguagaucguugguuguccccuguagaaaucaagaugaauuaauugguagagcaagaauuucacaaggugcuggcuggucucucagagaaacugcaugccucggcaaggcuuaugcccaaauguggucccucauguauuuccaccgacgggauuuaagacuagcaaguauggcaauuuguagugcagucccuacugaaugguuuccaaccagccgcacaacauggaguauccaugcccaccaccaauggaugacuacagaggauaugcuaaaaguauggaacagaguauggauagaagauaauccaaauaugaccgacaaaaccccuguacacagcugggaagacauuccuuaccuuggaaaacgugaagacuuguggugcggcuccuuaauaggcuugucaucucgugcaacuugggccaagaauauacacacggcgauuacacaaguacguaaccuuauaggaaaagaagauuauguugauuacaugcccguuaugaagcgauauucagcuccauccgaaucggaaggcguacuauga

SEQ ID NO: 23693 - RNA, 9867 nt, Artificial Sequence
  derived and/or modified CDS sequence (opt6) from DENV-4__JN559740__SS-prME
aguacaauuacccuucuuugcuuaaucccgacagucauggcauuucaucuguccacccgggauggagaaccauuaaugauaguagcgaaacaugaacgcggaagaccccuacuuuucaaaacuacagaaggaauaaacaaauguacacuuauugcaauggacuugggagaaaugugcgaagauacgguaacauauaaaugcccauuguuggugaauacagaacccgaagacauugauugcuggugcaaccuaacaucaacauggguaauguaugggacaugcacacaaucuggagaacguagacgagaaaaacgaagcguugcauuaaccccucauagcggaaugggacuugaaacacgggcagaaacguggauguccagugaaggggcauggaaacaugcacaacgugucgaaucguggauucugcggaaccccggauuugcacugcucgcaggauucauggccuacaugauuggacaaacagguauucagagaacgguuuucuuuguauugaugauguugguagcaccuaguuaugggaugcgcuguguaggugugggaaauagggauuuuguggaaggagucucaggaggagcauggguagaucucguuuuagaacauggggguugcguaaccacaauggcgcaagguaaaccuacauuagacuucgaacuaaccaaaacaaccgcaaaagaagucgcgcuacuaagaacuuacuguaucgaagcaucgauaagcaauauaacaacugcaacaagauguccaacacaaggggaaccguauuugaaagaagaacaagaucaacaauacauuuguaggagagacguuguagaucggggauggggaaacgggugcggauuguuuggaaaagguggcguaguuacaugugccaaauucaguugcucuggaaaaauaacggggaaucugguucaaauagaaaaucuagaauacacugucguagucacgguacauaauggggauacccgagcagucggaaacgauauaaguaaucaugguguuacugcaaugaucaccccuaggagccccucagucgaaguaaaauuaccugacuauggugaacucacacuggauugugaaccgagaucaggcauagauuucaacgaaaugauucuaaugaaaaugaaaaagaaaacgugguugguucacaaacaaugguuuuuagaucuaccauuaccguggacagccggagcagauacgagcgaaguccacuggaacuauaaagaaagaaugguaacauuuaaagugccgcacgcuaaaagacaggauguaacugugcuagguagucaagaaggugcuaugcauucagcucuagccggugcgacggaaguugauuccggugauggaaaccauauguuugcaggacauuuaaaaugcaaaguccgaauggagaaacugcggaucaaagggaugucuuacacgaugugcuccggaaaguuuucaauugacaaagaaauggcagaaacucagcacggcacaaccgucgucaaaguaaaauaugaaggagccggagcuccauguaaagugccuauugaaauaagggauguaaauaaagaaaaaguaguaggucgaauuaucagcagcacaccuuuagccgagaauacuaauagcgucacaaacauagagcuagaacccccguuuggugauagcuauauaguaauaggcguaggaaacagugcucuuaccuuacacugguuuagaaaaggaucaagcaucgggaaaauguuugaaucaacauauagaggcgccaaaagaauggcaauucuaggagaaacggcgugggacuuuggaagcgucgguggucuuuucacgucguuagguaaagcaguccaccaaguauuuggaagcguguacacgacaauguuuggaggggucucauggaugauaagaauauuaaucgguuucuuaguucuauggauuggaacuaacucacggaacacgucuauggccaugaccuguauugcagucggaggaauaacucuauucuuaggguuuacgguccaagcagacaugggguguguaguaucauggaguggaaaagaacuaaaauguggcucuggaauauuuguaguagacaauguacacacguggacugaacaauauaaauuccaaccagaaagcccggcaagguuagcaagugcgaucuuaaaugcucauaaagauggaguuuguggcauucgcucaacuacaagacuagaaaacguuauguggaaacaaauaacuaacgaguuaaauuaugucuugugggaaggaggacaugaucucacgguuguagccggugacguuaaaggagugcucacaaaaggaaaaagggcacucacuccaccagucucugacuuaaaauauucguggaagacauggggcaaagcgaagauauucacuccagaagcaagaaauuccacguuucuuauugacgguccugacacuucagaauguccuaaugaaaggagagcguggaacagcuuagaaguggaagacuacggguuugguauguuuacuacuaauauauggaugaaauuuagagaaggauccucugagguuugcgaccaccgucuaaugagugcugcaaucaaggaccaaaaggcaguucaugcagacauggguuacuggaucgagucaucgaaaaaucaaacauggcagauagaaaaagcaucucuuauugaagucaaaacaugucucuggccuaaaacccauaccuuauggagcaauggaguauuagagucacaaauguuaauaccgaaaaguuaugcaggacccuucucccagcacaauuaccgucaagguuaugcuacucaaacaguagggccuuggcacuuaggaaaauuggaaauagauuuuggugaguguccagguacuacuguuacuauucaagaagauugugaccauagaggcccaucguugagaacuacuacugcaucagguaaauuaguaacacaaugguguuguaggucaugcacuaugccaccucugcgguuuuuaggugaagauggcuguugguauggaauggaaauuagaccauuaagugagaaagaagagaacaugguuaagagucaagucacugcagggcaaggaacgagugaaacauucucgaugggguuguuaugucuaacucucuuugucgaggaaugucucagaagaagaguaacaagaaagcauaugauauuaguaguuguaauaacccugugcgcaauaauccucgguggcuugacauggauggaucuucuaagagcacucauaaugcuaggcgacacgaugucagggcgaauagggggccagauacaucucgcgauuauggcuguauuuaaaaugucaccagguuacguacuagggguuuuccuccgaaaacuaacaucaagagaaacggcauuaaugguaauaggaauggcuaugacgacagucuuaucaaucccacaugaucucauggaacuaauagauggaauaucacuagguuuaauauuacugaaaauuguaacucaguucgacaacacccaaguagguacauuggcgcuuucucuaacguucauuagaaguacaaugccccuaguaauggcuuggagaacgaucauggcuguccucuuugucguaacauugaucccgcuaugcagaacgucgugucugcaaaagcaaucacauuggguugaaauuacagcauuaauuuuaggagcgcaagcauuacccguguauuugaugacacugaugaaaggagccagucggagaaguuggccacugaacgaaggaauaauggcgguuggcuuaguaaguuuacucggaagcgcacuuuugaaaaacgacguaccgcuagcugguccaaugguagccgguggguuauugcucgcugcuuacguaaugucaggaucuuccgcagaccuauccuuagagaaagcggcuaacguacaaugggaugaaauggcugauauaacaggcucuagcccaauaauagaagucaaacaagaugaagaugguagcuuuagcauacgugauguagaggagaccaauaugauuacauuguuaguaaaacuagcacuaaucacaguuaguggacuuuauccacuagcaaucccgguaaccaugacacuaugguacauguggcaaguuaaaacacagcguucaggagcauuaugggaugucccuagcccggcagcuacacaaaaagcugcucuuagugaagguguuuauaggauaaugcagagaggauuguucgggaagacccaaguuggggucgggauucauauggagggaguuuuucacacaauguggcacguaacucgaggcagcgucauuugccaugaaacaggacgucuugaacccucuugggcugauguacgcaacgacaugauaucauacggcggggguuggagauuaggugacaaaugggauaaagaagaagacguacaagugcuagcaauagagcccggcaagaauccgaaacauguccaaaccaaaccuggucuauuuaaaacauuaacaggcgaaaucggagcagugaccuuggauuuuaaaccaggaacaagcgguaguccaauaauuaacagaaaaggaaaaguaauagggcuauacggaaaugguguugugacaaaaucaggagacuauguaucagccauaacacaagccgaacgaauaggagagcccgacuacgagguggacgaagacauauuuaggaaaaagcgcuuaacuauaauggacuugcacccuggagccgguaagacaaagaggauuuuacccuccauaguuagggaagcucuuaaacgacgacucaggacacuaauuuuggcuccaacaaggguaguggcggccgaaauggaagaagcucugcguggacucccuauuagauaccaaacgccugcugucaaaucggaacacacagguagagaaauuguagauuuaaugugccacgcaacauucacaacgcguuuacuaagcaguacucggguaccaaauuauaacuuaauagucauggacgaagcucacuucacggacccaucgaguguugcggcacguggauauauuucaacgcgaguugaaaugggagaagcugcagcaauauucaugaccgcgacuccacccggagcaacagacccauucccacaaaguaacucaccgauagaagauauagaaagagaaauaccagaacgcucauggaauacaggauuugacuggaucacugauuaccaaggaaaaacgguaugguuugugccuaguaucaaagccgguaaugacauugcgaacugucugagaaaaaguggcaagaaagugauucagcuaucacgaaaaacauucgauacagaauauccgaaaacgaagcucacggacugggauuuuguagucacgacggacauaucagaaaugggagcuaacuuuagagccgggagaguuaucgauccuaggagauguuuaaaacccguaauauuaaccgacgguccagagagaguuauucucgcaggaccaauaccaguaacacccgcgucagcagcccagagacguggucgaauaggucggaaucccgcacaagaagaugaccaauauguauuuaguggggacccacuuaaaaacgaugaagaucacgcacauuggacugaagcaaagaugcuauuggauaacauuuauacucccgaagguauaauaccaacgcuauuuggccccgaacgagagaaaacccaagcgauugacggggaauuucguuugcgcggagaacaacgcaaaaccuucguggaacugaugcgccgaggagacuuaccuguuuggcugagcuacaaaguagccagugcagguauaucuuauaaagaucgugaaugguguuuuacuggagagaggaauaaucagauauuagaggagaacauggaaguugaaauauggacaagagagggggagaagaagaaacuuagaccuagauggcuagaugcgcgagucuaugcagacccuauggcccuuaaagauuucaaagaauuugccucggggaggaaaucgauaacccuagauaucuuaaccgaaauagcaagccugccgacuuauuuauccagucgugccaaacuugcauuagauaauauuguaauguuacacacuacagagagagggggaagggcauaccaacacgccuugaaugaauuacccgaaucauuggaaacgcugauguuaguggcacuacuaggagcgaugacagcgggaauauuucuguucuuuaugcaagguaaaggcauaggaaaacuaucaaugggacuuauaaccauagcuguggcuaguggauuguuaugggucgcagaaauccaaccgcaauggaucgcagcaucgauaauacuagaguucuuucuaauggugcuacuuauucccgaaccagaaaaacaaagaacuccacaagacaaucaacucaucuauguuauauuaacaauucucacuauaauaggacuuaucgcggccaacgaaauggguuugauagagaaaacuaagacagacuuuggauuuuaccaagucaagacagaaacaacaauacuagacguagaucugaagccggcguccgccuggacuuuguaugcuguagcuaccacaauauuaacacccauguuacgacacacuauagaaaauacaucugccaaccuaucauuagcggcaauugcuaaucaagccgcaguacuaaugggcuuagguaaaggcuggccauuacauagaauggauuuagggguaccucucuuggcaaugggguguuauagccagguuaacccuauuacauuaaccgcaucacucguaauguugcuuguacauuaugcaauuauuggcccaggacuucaggcuaaagcuacacgagaggcgcaaaagagaacugcugccggcauaaugaaaaauccuacaguagauggaaucacgguaauugaucuugagccaaucagcuaugauccaaaauuugaaaaacaguugggacaaguaaugcuauugguauuaugugccggacaacuccugcugaugaggacaacgugggcguucugugaggucuuaacguuagcaaccggcccaauuuuaacuuugugggagggaaauccggggcguuuuuggaauacaacuauugcaguuucuacagccaacauauuuaggggaaguuauuuagcaggcgcaggacuggcauucucauuaauaaagaacguucaaacuccgagacgaggaacugguaccaccggugagacccuaggagagaaauggaagcgucaauuaaacucacuagaucgaaaagaauuugaagaauacaaacgaucgggaauuuuagaaguugaucgaacugaggcgaaauccgcacuuaaggaugguucaaaaaucaaacacgcuguuagccguggcagcaguaaaauuagauggauaguagaacgcggaaugguuaagccuaagggaaaaguaguugaucuaggaugcgggaggggcggaugguccuauuacauggccacauugaagaacguuacagagguuaaaggguacaccaaaggcgggcccggucacgaagaacccauaccuauggcuacauacggauggaauuuagugaaauuacauuccggaguagacguauucuauaagccaacugaacaaguggacacacuacucugugauaucggggagagcagcucaaauccgacuauagaagaaggaagaacucuaagaguucuaaagauggucgaaccuuggcuaagcaguaaacccgaguucuguauaaaaguccuaaauccauacaugccuacaguuauugaagaauuagaaaaacuacaaaggaaacacggaggaaaucucguucguuguccauuaagcagaaacucgacucacgagauguauuggguauccggagcaagugguaauauagucagcucaguaaacacgaccucgaaaaugcugcucaaccgauuuacaaccagacaucgcaagccaacuuacgaaaaagacguugauuugggggcgggcacuagguccguuaguacagaaacagaaaaaccggacaugaccauaauuggacgcagguuacaacgccuacaagaggagcacaaagaaacguggcacuaugaucaagagaacccauaucgaacuugggcauaucacgguucauaugaggcuccuaguaccgggucugcaucuucgauggucaacgggguugugaaauuacuuacaaaaccaugggaugucauuccgaugguaacacaacuugcaaugacagacacuacuccguuuggucagcagagaguuuuuaaagaaaaaguggacacacguacaccacagccaaaaccuggaacgcgaauggugaugacuacaacugccaauuggcugugggcauuacuaggcaagaagaaaaauccuagauuaugcacaagagaagaguuuauaagcaaaguaagaagcaacgccgcgauuggagcaguauuccaagaggaacaaggcuggacauccgcaucggaagcggucaaugauagcagguuuugggagcuuguugauaaagaaagagcguuacaucaagagggaaaaugugaaucguguguauauaacaugaugggaaagagagagaagaaauuaggugaguucggcagagcaaaagguaguagagcuauuugguauaugugguugggagcacgcuuucuggaguucgaggcuuugggauuuuuaaacgaagaucauugguuuggccgcgaaaauaguuggucugguguugaaggugaaggccugcaccgucuaggcuacauuuuggaggaaauagauaagaaagacggagaucuuauguaugcugacgacacagccgggugggacacaagaaucacagaagaugaucuacagaaugaagaauuaauaacggaacaaauggcaccccaccauaaaauucuggcaaaagcaauauucaaguuaacuuaucagaacaaaguugucaaggucuuacgaccaacaccucgaggagccgucauggacauaauaucaagaaaggaucaacguggcuccggacaaguggggacguaugguuuaaacacuuucacuaauauggaagugcaacuuauuaggcaaauggaggcggagggugucauuacccaggaugauaugcaaaaucccaaaggacuaaaagaaagaguggaaaaaugguugaaagaguguggaguagacaggcucaaacgaauggccauaagcggugaugauugcgucguaaagccauuggacgaaagguucggcacuucacuacuauuucuuaacgauauggggaagguccgaaaagauaucccacaaugggaaccaucgaaaggauggaagaacuggcaggaaguacccuuuugcucucaccacuuccauaaaauauucaugaaagauggcagaucauuaguaguuccuuguaggaaucaagaugaacuaauuggcagagcacguauuucucaaggcgcaggauggucauuaagagaaacugcuuguuuagguaaggcuuacgcacagauguggucuuuaauguacuuccaucgcagagaucuacgguuagcgaguauggcaauaugcucugccgucccgacagaaugguuccccacaagucgaaccacauggucaauccaugcucaucaucaauggaugacaacugaagauaugcuaaaaguauggaaccguguauggauugaagacaauccuaauaugaccgacaaaaccccaguccacuccugggaggacauucccuacuugggaaagagggaagaucuuuggugcgggagccucauaggccuaaguucaagagcaacgugggcaaagaacauucauacggccaucacacaaguacggaacuugauaggcaaagaggaauauguagacuacaugccagucaugaaacgauacucggcucccuccgaauccgaagguguacuauga

SEQ ID NO: 23694 - RNA, 9867 nt, Artificial Sequence
  derived and/or modified CDS sequence (opt6) from DENV-4__JN559741__SS-prME
ucuacuauaacuuuacucugucuuauaccgacugugauggcauuucaucuaucaacccgcgacggagaaccgcucaugaucguugcaaaacacgaacgugguagaccucuauuauucaaaacgacggaaggaauuaacaaauguacauugauagcaauggacuuaggggagaugugugaagauacgguaacuuacaaauguccccuacuuguuaacacggaacccgaagauauagauuguuggugcaaucuaacgucaaccuggguuauguacgguacuugcacgcaaucaggugagaggcggcgagagaaaagauccgucgcguuaacaccacauuccgguaugggauuggagacgagagccgaaacguggaugaguagcgagggugcauggaaacacgcgcaaaggguugaauccuggauauugaggaauccaggguuugcuuuacuugccggguuuauggcuuacaugauaggacagacaggcauucagagaacugucuucuuuguccugaugauguuaguagcacccucuuaugguaugagauguguagggguugguaaccgagauuuuguagagggaguuaguggcggagcuuggguugaccucguguuagaacacggaggcuguguaacaacaauggcccaagggaaaccaacacuagauuuugagcuaacaaaaacaacagcaaaagaaguggccuuacucagaaccuacuguaucgaagcauuaauaucuaauauuacaacugcaacacguugcccgacccaaggagaacccuaucuuaaagaagaacaggaucaacaauauauuugccgucgggauguaguagacagaggauggggaaacgguugcggguuauucggaaaaggcgguguaguaacuugugcuaaauuuucuugcucagggaaaauuacaggaaaccucguacaaauugaaaaucuagaauauacuguaguugugaccguucacaauggagacacucacgcagucggaaaugauacauccaaccauggaguuacggcaaccauuacaccgcggucaccaucaguggaggucaaacuaccggauuacggugaauuaacccuggauugcgaaccuaggucaggaauagacuuuaacgagaugauauuaaugaaaaugaaaaagaaaacuuggcuaguacauaaacagugguuucuagauuuaccucuuccuuggacuacaggugcugauacgucagaaguucauuggaauuacaaagagcgcaugguaacauuuaagguuccccacgcaaaacgccaagaugucacaguauuagguagucaagaaggugccaugcauucugcauuggcaggagcuacggaaguggauaguggagacggaaaccauauguuugccggacauuuaaaguguaaaguccggauggaaaaacuacguauuaagggaauguccuacacaauguguaguggcaaauuuucaauagacaaagagauggcagagacacagcauggaacaacuguugucaagguuaaauacgaaggagccggagcgcccuguaaaguacccauugaaauucgagauguuaacaaagaaaaaguugucggaaggguaauuucagcgacaccccuugcagagaauacgaacaguguaacaaacaucgagcuagaaccaccguucggagauucauauauuguaauaggggugggaaauucugccuuaacccuacacugguuuagaaaagguucaaguauaggcaaaauguucgaauccacguauagaggggcgaaacggauggcuauacuaggagaaacagcaugggacuucggcagcguagggggccuauuuaccucuuuaggaaaagccguccaccaaguauuuggaaguguuuauacaaccauguuugggggaguaaguuggaugauccgaauacuuauuggauuucucguauuauggauagguacaaacuccagaaacacaagcauggcuaugacuuguaucgcugucggagggauuacccucuuucugggguuuacuguacaagcagacaugggcugcguagucucauggucugguagagaauuaaagugcggcucaggaauuuuuguaguagauaacgugcauacauggacagaacaauacaaauuucaaccugagucaccagcacgccuugcuucugcuaucuuaaaugcucauaaggauggaguuugcgguauccggucgacaacacguuuagaaaaugucauguggaaacagauaacuaacgagcuaaacuacgucuuaugggaaggaggacacgauuuaacugucguagcuggggauguaaaagguguacuuacaaaaggaaagagagcucucaccccuccagcaucugaccuuaaguauucguggaagacuuggggcaaagcuaaaauauuuacuccugaagcgcgaaauagcacguuucuaauugaugggccugacacaagugaaugcccaaaugaaagacgagcauggaauagcuucgaagucgaagauuaugguuucggaauguuuaccacaaacauuuggaugaaguuuagggaaggaaguagcgaagugugcgaucacagguuaaugagcgccgcgaucaaagaucaaaaggccguucaugccgauaugggauacuggauagaaucgagcaagaaccaaacauggcaaauagaacgcgccaguuuaauagaaguuaagaccuguuuauggccuaaaacgcacacacucugguccaaugguguuuuagaaagccaaauguuaauuccuaaaaguuacgcuggcccauuuagucaacacaauuaccggcagggcuaugcgacucagacgguaggcccauggcauuuaggaaaacuggaaauagacuucggagaauguccugggacaacaguuacaauucaagaaaauugugaucaucgaggucccagcuuaagaacaacaacugcuuccgggaaguuggugacgcaaugguguugcagaagcuguacaaugccaccauugagguuuuuaggggaagauggcuguugguaugggauggaaauccguccucuaucagagaaagaagagaacauggugaaaucacaaguaacagcaggacaagggacgucugagacuuuuuccaugggucuauuaugucuuacgcuguuuguagaagaaugucuuagacgcagagucaccagaaaacacaugauucuagcggucgucauaacguugugugcaaucauccuaggaggauuaacauggauggauuuacuuagggcccucauuaugcugggagauacaaugaguggacgcauagggggacaaacacacuuggcuauaauggcugucuucaaaaugucuccaggauacguauugggcguauuuuuaagaaaguuaacgagccgagaaaccgcucuaauggucauuggaauggccaugacaacaacauugucuauaccucacgaucucauggagcugauagaugguauauccuugggacuuauacugcuuaagauaguaacacaauucgauaauacgcaaguaggcacacuggcccuuucauugacguuuauucgaucuaccaugucucugguaauggcguggcgaacuauaauggcuguguuauucguuguuacacuaauaccauuaugucguacaucgugucuucagaaacaaagucacuggguggaaauaaccgcauugauauuaggugcgcaagcccuaccaguguaucuuaugacacuaaugaaaggagcaucucgaagaucauggccauugaaugaaggaauaauggcuguaggauugguaagccuauuaggaagcgcacuauugaaaaaugauguaccccuagcaggcccgaugguagcaggaggacuucugcuugcagcauacguuaugagcggaucauccgcggauuugucccuugaaaaagcugcaaacguacaaugggaugaaauggcugacaucacggguaguagcccaauuaucgaagugaaacaagacgaggaugggagcuuuucuauacgugauguugaagaaacuaacaugauaacauugcucguuaaacuugcuuugauaacagucagugggcuauauccauuagcuauaccaauaacgaugacuuuaugguauauguggcaaguuaagacacaaaggucaggugcccuuugggauguuccuaguccggcugccacccagaaggcagcauuauccgaaggaguuuacaggauaaugcaaagaggccuguuugggaaaacccaaguagggguaggaauccacauggaaggcguuuuucauacgauguggcaugucacacgagguucuguaauuugucaugaaacagggcgccuagagccaaguugggcagauguacgaaaugacaugauuagcuacgguggcggauggcgucuaggcgauaaaugggauaaagaagaagauguccagguacuggcuauagagccggggaaaaacccaaaacacguacaaacaaagccaggauuguuuaagacccuaacuggagaaauaggagcaguaacgcucgacuucaaacccgggaccagcggaucaccaauuauuaaccgcaaagguaaagucauuggucuuuauggaaauggaguuguuacaaaaaguggagacuacgugucugcaauaacacaagcagagaggauaggagaaccugacuacgaaguagacgaggauauauucaggaagaaacgacuaacaauaauggacuugcauccuggugcagguaaaacgaagcguauucuaccuucaaucguccgagaagccuuaaagcgaaggcuucguacguugauucuggcgccgacuaggguuguagcggcagaaauggaagaggcuuuacgaggauugccgaucagguaccaaacgcccgcagugaagucagaacauaccggucgugaaauuguugauuuaaugugccacgcgacguucacuacgagguuacuuagcucuacucgagugccuaacuacaaucuuauugugauggacgaagcacacuuuacagacccuucaucaguagcugcaagaggcuauauaagcacgcgaguagaaaugggagaagcagcggcgauauuuaugacagccacaccgccgggugccacugauccauuuccacagaguaauucgccgauagaagacauagagcgcgaaauacccgaaaggaguuggaauacagguuuugacuggauuacagacuaccaagguaaaacaguaugguucguaccaagcauaaaagcaggaaacgauaucgcgaauugcuuaagaaaguccggcaagaaaguuauacaacuaaguagaaaaacguucgauacagaauauccuaaaaccaaacuaacugacugggauuucguaguaacuacagacauaucugaaaugggggcaaauuuucgagcugguagaguuauugauccgcgacgaugucuaaaaccugugauucugacugacggccccgaacgagugauuuuagcagguccgaucccaguaacaccagccucagcagcacaacgcagaggcaggaucggucguaacccagcacaagaagaugaccaauacgucuuuucgggcgauccguuaaagaaugaugaggaucaugcccacuggacugaagcuaaaauguugcuagauaacaucuacaccccagaaggaauaauaccuacguuguuuggacccgaaagggagaaaacgcaagcgauagauggcgaauuuagauuaagaggcgaacaacguaaaacguuuguagaacucaugaggcguggcgaccugccaguguggcucaguuacaaaguugcaucagcuggaaucagcuacaaagacagggaaugguguuuuacgggagaacguaacaaucaaauuuuagaggagaacauggagguagaaaucuggacgcgcgaaggugagaaaaagaaacuaagaccaaaauggcuugaugcgagaguguacgccgaucccauggcauuaaaagacuuuaaagaauuugcaagcgggagaaaaaguauuacauuagauauacucaccgaaauagcaucguuaccuaccuauuuaaguagucgugcgaaacucgcguuagauaauauaguaauguuacauacuacagagcgugguggucgugcuuaucaacaugcacuuaaugaacuuccagagucacuugaaacucugaugcugguugcuuuauuaggagcaaugacggcgggcauauuuuuauucuuuaugcagggaaaaggaauaggcaagcugucgaugggguuaauaaccauugcuguggcgaguggcuuauugugggucgccgagauucaaccucaauggauagcugccucaauuaucuuagaguucuuuuuaaugguacugcuuauaccagaaccggaaaaacaaagaacaccacaggauaaucagcuuauauauguaauacucacuauacucacuauaauugguuuaauugcugcuaacgaaauggguuuaauagagaaaacaaaaacagacuucggcuucuaucaaguaaaaaccgagacgaccauccuagacguagauuugcgaccggcaucugcauggacuuuauacgccguagccacaacaauauuaacaccgauguuaagacauaccaucgagaauacaucagccaaucucaguuuagcagcaauugcaaaccaagcggcugugcuaaugggauuagggaaaggcuggccucuucauaggauggauuuaggugugccauugcucgcaaugggcugcuauucacagguaaauccaaccacccuuacagcuucauuggucauguuauuaguacauuaugcaauuauagguccagguuuacaagcgaaagcaacgagagaagcacaaaaacgaacagcugccggaauaaugaaaaauccuacagucgacgguaucacaguuauagaccuagaaccaauuaguuacgacccuaaauuugaaaaacaguuaggacaaguuaugcuacucguccuaugugcuggccaguuauuauuaaugcgcacgacuugggcauucugugaaguacugacacucgcgacaggacccauccuaacauuaugggaaggcaauccaggaagauuuuggaauacaacuauagcaguaucgacagcaaauauauucagaggguccuacuuagcgggagcaggccuagcguuuagucuuaucaagaacgcccagaccccgcguaggggaacggguacagccggcgaaaccuuaggagaaaaauggaagagacaauuaaacucauuggacagaaaggaauuugaagaauauaaaagauccgggauauuagaaguagauagaacggaagcaaagagugcucuaaaggacgguucaaagauaaaacaugcgguuaguagggggucgagcaagauacgauggaucguagaaagggggaugguaaaaccuaaagguaaggucguagaccuagggugugggcgcggaggguggaguuauuauauggcgacucuaaagaauguuacugaaguuaaggguuacaccaaaggagggccaggacaugaggaaccaauuccaauggcgacguacggauggaaucuuguuaagcuccauaguggaguagauguuuucuauaaaccaaccgaacaggucgauacacuacucugcgauauaggggaaagcucaucaaauccgacaauagaagaaggcagaacacugaggguacucaagaugguugaaccaugguuaucuaguaagccagaauuuuguaucaaaguacuuaaccccuauaugccaaccgucauugaagaauuggagaaacuucaaagaaaacacggagggaauuuagugagguguccauugucacguaacaguacacacgagauguauuggguuucaggcgccucagggaacauuguuaguucaguaaauaccacaucaaagaugcuauuaaaucgcuucacuacccgacauagaaagccgacauaugaaaaagauguagaucugggggcaggaacccgaucggugagcacugagacugaaaagccagauaugaccauaauaggaagacgccuacaaagacuucaagaagaacauaaggaaacauggcauuaugaucaagaaaauccauaucguaccugggcauaucauggauccuaugaagcaccuaguacgggguccgcgagcucaauggugaaugguguagucaaauuacuaacaaagccgugggaugugauaccaaugguuacacaacuugccaugacggauacaacuccguucggacaacaacguguguucaaagaaaaggucgacacucgaacgccucagccuaagccugguacuaggauggugaugacaaccacggcaaacuggcuaugggcucuuuuagguaaaaagaaaaauccccgguuauguacgagagaggaauuuauaagcaaagugagaaguaaugcggcgauaggggcaguguuccaggaggaacaaggcuggacaagugcaucagaagcaguuaaugauucccgcuuuugggagcugguggauaaggaaagggcucuacaucaagaaggcaaaugugaaaguuguguauacaacaugaugggcaaaagagaaaagaaguugggagaauuugggcgagccaaggggaguagagcuauaugguacauguggcuuggugccagauuccuagaauuugaggcuuuaggauuccuaaacgaagaccacugguucggacgagaaaacucuuggucuggaguagaaggagagggcuuacauagauuaggcuauauacuagaggagauagauaagaaagacggggauuuaauguaugcagaugauacagcaggaugggauacaagaauuacagaagaugacuugcaaaaugaagaacuaaucacagaacaaauggcaccccaucacaaaauauuggcaaaagccaucuucaaauugaccuaucaaaauaagguagucaaaguuuuacgaccaacacccagaggggcaguuauggauauaaucucucgaaaagaucagagagguaguggucaaguuggcacguacggccuaaacacauuuaccaauauggaggugcaacugaucagacagauggaagcagaaggaguaauuacccaagaugauaugcagaauccaaaaggacucaaagaaagaguugagaaaugguuacgugaaugugggguugaucguuuaaagcgaauggccaucucuggagacgauuguguaguuaaaccauuggaugagcgguuuggaacgagucucuuauucuuaaaugauaugggcaaaguccgaaaagacaucccacaaugggaaccuucgaaagguuggaagaauuggcaagaagucccuuuuuguagucaccauuuccacaaaauauucaugaaggaugggagaagccuaguagucccuuguaggaaccaagaugagcuuauaggacgagcucguauuagccaaggagcaggcuggucgcuaagggaaacggcaugucuugguaaagcauaugcccaaauguggagcuuaauguauuuccauagaagggaucuaagauuagcaaguauggcaauaugcuccgcagucccaacugagugguuuccgacgagucgaacaacauggucaauccaugcgcaccaucaauggaugacgacagaagauauguuaaaaguauggaaucgagucuggauugaggauaaucccaauaugauagauaagacaccagugcauaguugggaggauauaccauaucuuggaaagagagaggaucuauggugcggaucacuaauagguuugaguucuagagcuacuugggccaaaaauauucauacagcgauaacccaaguuagaaauuuaauagggaaggaagaauacgucgacuauaugccagucaugaaacgguacucugccccaagcgaaucggaaggcguacuauaa

SEQ ID NO: 23695 - RNA, 9867 nt, Artificial Sequence
  derived and/or modified CDS sequence (opt6) from DENV-4__JQ513334__SS-prME
ucuacaauaacauuguugugucucauacccacgguaauggcuuuccauuuaaguacaagagacggagaaccuuuaaugauaguugcgaaacaugaaaggggacguccauuacuauuuaaaacuacugaggguauaaacaaauguaccuugauugcgauggaucuaggugagaugugcgaagauacuguaacuuacaaauguccucuauuagugaacacugaaccagaagauauagauugcugguguaauuuaacaagcacguggguaauguauggaaccuguacccaaaguggcgagcgccgaagagagaaaagaaguguggcucucacuccucacucugguaugggauuagaaacgcgagcagaaacauggaugucuagcgaaggugcauggaaacaugcacaaaggguagagaguuggauauuacgaaaucccggauucgcacuacuugcgggguuuauggcuuauaugaucgggcaaacagggauucaacguacuguuuucuucguauuaaugaugcuuguugcuccaagcuacgguaugagaugugucggcguagggaauagagacuuuguggaaggaguaagcgggggagcauggguagacuugguuuuggaacauggaggauguguaacuacaauggcucaaggaaaaccgacucucgauuucgaacucacaaaaacgacagccauggaaguugcacuuuuacgaacuuauuguauagaggcuagcauaagcaauauaacgacagcaaccaggugccccacccaaggugagccauauuugaaagaagaacaggaccaacaauacaucugcaggagagauguagucgaccgagggugggguaacggcugcggacuauuuggcaaagguggaguggucacuugcgcuaaauuuuccugcagcgagaaaauuaccgggaaccucguccaaauagaaaaucuagaauacaccgucgucguuaccguccauaacggagacacacacgcgguagguaacgacacaucaaaucauggcguaacggcaaccauuacuccgcguucaccuaguguagaaguagaauuaccggauuauggagagcuuacauuagacugcgagccaaggucgggaaucgauuuuaaugaaaugauucugaugaaaaugaaaaagaaaacuugguuagugcacaaacagugguuccuggacuuaccccuaccuugggcagcgggagcugauaccuccgaaguacauuggaacuauaaagagaggaugguaacauucaaggugccccacgcgaaacgucaagacgugacagucuugggaagucaagaaggcgcaaugcauucggcucucgccggugcaacagaaguggauagcggggacggaaaccauauguuugcaggacaccuaaaguguaaagucaggauggaaaaauuacggaucaagggaaugagcuacaccauguguaguggaaaguucucuaucgauaaagagauggcagaaacucaacauggcacaacaguuguuaaaguuaaauacgaaggagcgggugcuccuuguaaaguaccuauagaaauaagagacgugaauaaagaaaaaguaguuggacgagucauaucaucuauaccauuagcagaaaauacuaacucaguaacaaacauugaacuagaaccgccguucggagauuccuauauagugauagguguaggaaacagugcacucacgcuacauugguuucggaaagggucguccauagguaaaauguucgaaucgacauaucgaggggcaaaacgaguugccauacuaggcgaaaccgcaugggauuucgguagcguagggggacucuucacgucguugggcaaagcaguucaucaaguauuugguaguguguauacuacaauguucggcggcguaucauggauggugaggauuuuaaucggacugcucgucuuguggauuggaacaaauucacggaauacaaguauggccaugacuuguauugcgguugguggcaucacuuuauuucuaggauuuacuguacaagcugacaugggaugcguaguaucaugguccgguagggagcuuaaaugcggaucugggauauucgucguagauaauguacauacguggacggaacaauauaaguuucaaccggaaucccccgcaagacuagccucugcuauacuaaaugcucauaaagacggaguaugcggcauucgcaguacgacgagacucgaaaaugucauguggaaacagauaaccaaugaacuaaauuacgugcuuugggaaggcggccaugacuuaacaguaguggccggugaugugaagggaguuuuaacuaaagguaaacgagcuuugacgccacccguaucagaucuaaaauauaguuggaaaacaugggguaaggcaaaaauauucacaccagaagcuagaaauucuacuuucuuaauagacgguccagauacaagugaauguccaaacgaaagacgugcguggaacucuuuagaaguagaagacuacggauucggcauguucacaacgaauauauggaugaaguuucgagagggaucaucugaaguaugcgaccauagacuuaugucggcagcaauuaaagaucaaaaagccguucacgcagauaugggcuacuggauugaauccuccaaaaaccaaaccuggcaaauagaaaaagcaucauuaauagagguuaaaacauguuuauggccaaaaacccauacacuuuggucgaaugggguauuagaaucacagauguugauaccuaaaagcuacgccggaccuuucucacaacauaacuauagacaaggcuacgcgacacaaacgguaggaccauggcaucuugggaaauuagaaauagacuuuggugaauguccugggacaacugucacaauacaagaagauugugaucauagaggaccguccuuaagaacgacaacggcuucaggaaaguuggugacccagugguguugucgcucaugcacaaugcccccacuacgguuucuaggagaagaugguugcugguacggcauggaaauuagacccuugagcgaaaaagaagagaauaugguaaaaagucaggucgcugccggacaaggcacaucugagacauucucaaugggucucuuaugccuaaccuuauucguugaagagugccuaagacggcgaguaacgagaaaacauaugauccucgcuguggucaucacacuaugcgcaauuauacuaggcgguuuaacauggauggaccuccuaagagcauuaauaauguuaggugacacgaugucaggaagaauuggaggacagacgcacuuagcuauaauggcaguuuuuaaaaugucuccgggauacguauuagguguauuuuuacgcaaacucacaucgcgagaaacagcauuaaugguuauagguauggcaaugacaacgacccuaaguauuccucacgaccuuauggaauuaauagaugguauaucccuaggguuaauacuuuugaagauagucacgcaauuugacaauacccaaguaggcacucucgcauuaucacuuacauuuauuaggaguacaaugagcuuaguaauggcauggagaacgauaauggcuguauuguucguagucacgcucauuccgcucugcagaaccaguugucuacaaaagcagagucacuggguugaaauaaccgccuuaauucuuggagcacaagcucugccuguauacuuaaugacacuaaugaaaggcgcaaguagaagaucuuggccacuuaacgagggcauuauggcagucggucuugugaguuuacuuggaucagcucuacuaaagaaugacgugccccuugcaggaccaaugguagcgggaggucuuuugcuugcggcuuauguaaugagcggcagcuccgcggauuugagccuggaaaaagcugcgaauguucagugggaugagauggccgauauaacaggaucaagucccauaauagaaguaaaacaggaugaagauggaaguuucaguauucgagacgucgaagaaacaaacaugauaacuuuauuggucaaacucgcacucauuaccguuagugguuuguauccgcucgccaucccgguaaccaugacguuaugguauauguggcaggucaagacgcagcgaucaggcgcauuaugggauguaccuagcccggcugccacacagaaggccgcacugucugaaggcguauauaggauuaugcagaggggguuauuuggaaagacacagguaggcguaggcauacacauggaggguguauuucacacuauguggcaugucacuaggggaaguguaauuugucacgaaacuggaagacuagaaccuucaugggcagauguaagaaacgauaugauaucguaugggggcgguuggagacuuggugacaaaugggauaaagaagaagacguacaaguacuugcuauagagccugguaaaaauccaaaacauguacaaacaaagccugggcuuuuuaagacgcuuacgggugaaauaggagcagucacauuggacuucaaaccaggcacgucggguucgccaauuauuaacagaaaaggaaagguuauaggauuauacgggaauggcguaguuacaaaaucgggcgacuauguaucugcgauaacgcaggcugaaaggaucggggaaccugauuaugaagucgaugaggauauuuucaggaagaaaagauugacaauuauggaucugcacccuggagcuggcaaaacaaaaagaauauuaccuucaaucguccgugaagcauuaaaaaggagauuaaggacucugauucuagcuccaacacgaguaguagcugcugaaauggaggaagcacuccgugggcucccaauccgcuaucagacuccggcaguuaaaagugaacacacagggcgugagauuguagauuugaugugucaugccacauuuacuacucgauugcugaguaguacuagaguaccuaauuacaacuuaauaguaauggacgaggcacacuucacagauccuucaagcguagccgcgaggggguauauuucaacacgggucgaaaugggcgaggcagcagcaauauuuaugacugcgaccccucccggggcaacagacccauuuccacaaucaaauucaccgauagaagauaucgaaagggagauuccagaaagaaguuggaauacagguuuugauuggauaaccgacuaccaaggaaaaacaguaugguuugugccuucgaucaaagcgggaaaugauauugcuaauugucuacgaaaauccggcaagaaaguaauucagcuuucacgaaaaacauucgauacugaauauccuaagacaaaacuaaccgauugggauuuuguagucacgacugacauuagcgagaugggagcgaauuuuagagcggguagggugauagauccaagacggugccucaaaccaguaauacuaacagacgggcccgagagaguuauauuagcuggacccauaccaguaacuccugcauccgcagcccagagaagagguaggauaggaaggaauccagcucaagaagacgaucaauauguauuuagcggcgauccucuuaaaaaugaugaagaccacgcucacuggaccgaggcuaaaaugcuauuagauaauauauauacucccgaagggauaauaccaacccuuuucggacccgaacgcgagaaaacacaagcaauagauggagaauuucgauuaaggggagaacaacgcaaaacauuuguggaauuaaugaggcgcggugaucuaccaguuuggcucucauauaagguugccagcgcugggaucagcuauaaggaccgugagugguguuuuacgggugaaaggaauaaccaaauacuagaagaaaauauggaaguggagauauggacgagagaaggugagaaaaagaaauuacguccccgcuggcuugacgcccgaguguaugccgaccccauggcccuuaaagacuucaaagaguucgccucuggaaggaaaaguauaacacuagauauccuuacagaaauugccagccuaccgacauaucugucuaguagagcuaaauuagcgcuugauaacauagucaugcuacauacaacagaacgagguggccgagcauaucaacaugcucuuaaugaacuuccagaaagccuugagacgcuaauguuaguagcauuauugggggccaugacggcaggcauauucuuguucuucaugcaaggaaagggcauuggcaagcucaguaugggauugauaacaaucgcaguggcaaguggauuauuguggguagcggaaauacaaccucaguggaucgcagcgucgauaauccuggaauuuuuccuaaugguacuauuaaucccggaacccgaaaaacaacgaacuccacaagauaaccaauuaauauauguuaucuuagcuauuuuaaccaucaucggguuaauugcagcaaacgagaugggacugaucgagaaaacaaaaacugacuucgguuucuaucaagucaagacagaaacaacgauauuagacguugauuuacguccagcuucugcguggacgcucuaugccguagcaacgacaauucuuacaccuaugcuacggcauacaauagaaaacaccucggcaaauuuaucucucgcggcuaucgccaaccaagccgcuguacuaaugggacuagguaaaggauggccccuacauagaauggaccugggagugccauuacuggcaaugggguguuacucgcaaguaaacccaacuacauugaccgcaucgcucgugauguuauugguacacuaugcgaucauagguccaggacuccaagcuaaggcaacaagggaagcgcagaaaagaacagcagcugggauaaugaaaaauccuacaguagauggaauuacgguaaucgauuuggagccuauaucguaugacccaaaauuugaaaaacaauuaggccagguaaugcuauuaguuuuaugugcaggacaauuacuauuaaugcggacuaccugggccuuuugugaaguacuaacacuagcaacaggcccgauacuuacauugugggaaggcaacccaggacgcuucuggaacacuacaauagcaguauccacagcuaauauauuuaggggaaguuaccucgcgggggcuggauuagcauuuuccuuaauuaagaaugcucaaacuccacggcggggaacuggcacgaccggcgaaacacugggagagaaauggaaacgacaauuaaacaguuuagauaggaaagaguuugaagaguacaaaagaucagguauucuugagguagaucgaacagaggcgaagucugcacuaaaagauggaagcaaaauaaagcaugccgucucacgagggaguuccaaaauacgauggauuguugagcgaggcauggucaagccuaaagguaaaguaguagauuuaggaugcggaagagguggguggucuuauuauauggcuacucuuaaaaacgucacggaaguaaagggauauacuaaaggagggccuggucacgaagaaccuauucccauggcuacauauggauggaaccuaguaaaauuacauagcgguguugauguguuuuacaaaccaacugaacagguggauacacuucuaugcgauauuggugagucaucuucaaacccaaccauugaagagggucggacgcugagaguacuaaaaaugguggaacccuggcuaagcucuaaacccgaguucuguaucaaggugcugaauccuuacaugccuacuguaauagaagaacuugaaaaacuucaaagaaaacacggggguaaccucgucagauguccgcuaagucgcaauagcacgcaugagauguacuggguuaguggugccucugggaauaucguguccuccguuaacacaacgucgaaaaugcuucuuaauagauuuacaacaagacauaggaaacccacguacgaaaaagacgucgaucuaggugccggaacgcgaagcguaagcacagaaaccgaaaaaccagacaugacaauaauugggcggagacuacaacgucuucaagaggagcacaaagaaacguggcauuaugaucaagaaaacccauaccgaacgugggcguaccauggaucuuacgaggcaccuaguacagguagcgcuaguaguaugguaaacgggguagugaaacuacuaacuaaaccgugggauguuauuccuaugguuacacaguuagcuaugacagauacaacuccuuucggucagcaaagaguuuucaaggaaaaaguugacacacgaacuccccaaccaaagccuggcaccagaauggugaugacgacaaccgccaauuggcuaugggcucuacugggcaagaagaaaaauccuagacuuuguaccagggaagaguucaucucaaaaguacguucaaaugcagcaauaggagcagucuuucaagaggaacaaggcuggacguccgccuccgaagcaguaaaugauucgcgauuuugggagcuaguugauaaagaacgcgcacugcaucaagaaggaaaaugcgaaucaugcguuuauaauaugaugggaaagcgugaaaagaaauuaggugaauuuggucgcgcaaaagguucccgcgcaauaugguauaugugguugggugcgcguuuucucgaauuugaagcauugggcuuucucaacgaagaucacugguucggucgagaaaauucguggagugguguagaaggagagggcuuacauagacucggguacaucuuggaagagauagacaagaaagauggugaucuuauguaugcugaugauacggcaggaugggacacaaggauaacugaagaugauuuacaaaacgaagaacugauaacagagcaaauggcuccucaucacaagauucuagcaaaggcaauauuuaaacuaaccuaccaaaauaaaguugugaaaguacuaagaccgaccccaagaggagcaguuauggauaucauuucucguaaggaucagcguggaucgggacaaguagggacuuauggauuaaacacuuucacuaauauggaaguacaauuaauaagacagauggaagcagaaggaguaaucacucaagaugacaugcaaaacccaaaaggucucaaagagcggguggaaaaauggcuucgagaaugcgguguugauagauuaaaacgaauggcaauuaguggagaugauuguguaguaaaaccacuagaugagagauucggaacuucgcuacuauuuuuaaacgauauggguaaagucagaaaggauauaccacaaugggaaccuagcaaggguuggaaaaauuggcaggaagucccguuuugcagucaucauuuucauaagauauuuaugaaagaugggaggagucuagucgugccauguaggaaucaggaugaguuaauagggagagcucgaauaucucaaggcgcuggauggucacuuagggaaacugcaugccuagguaaagcauacgcacaaauguggucauugauguauuuucaccgaagagauuugagacuagcuucaauggccaucuguagcgcuguuccuacugaaugguuccccaccucaagaaccacuuggucgauacacgcacaucaccaauggaugacaaccgaagacaugcuuaaaguauggaacaggguauggauugaagacaauccuaauaugauugacaaaacacccguacacucaugggaagacauacccuaccuugguaaacgggaagaucuguggugcggaucuuugauaggccugaguucacgcgccacaugggcaaagaauauacauaccgcuauuacacagguccgcaaucuaauagguaaagaagaguacguagauuauaugccagucaugaaaagauacuccgcgccuucggaaagugaaggaguauuauaa

SEQ ID NO: 23696 - RNA, 9867 nt, Artificial Sequence
  derived and/or modified CDS sequence (opt6) from DENV-4__JQ513336__SS-prME
aguacuauaacuuuacuuugucuaauaccgacgguaauggcuuuucauuuaagcacuagagauggugaaccacuaaugauuguugcaaaacacgaaagagggaggccgcuguuguucaaaaccacagaagguauaaauaaauguacucuaauugcaauggaccuuggggaaaugugugaagauacagucacauacaaauguccauugcucguaaauacggaacccgaagauauugacuguuggugcaaccucaccucgacuuggguuauguaugggacuuguacacaaucaggagaacgacguagggaaaaacguagcgucgcucuuaccccacauucaggaaugggucucgaaacaagagcagaaacauggaugucauccgaaggagccuggaaacacgcucaaagggucgaaaguuggauacugagaaaucccggauucgcacuucucgcaggauuuauggcauauaugauaggacaaacagggauacagagaacuguauucuuuguacuaaugauguuagucgccccaucguacgguaugagauguguaggagugggaaauagagauuuuguagaaggaguuucaggcggagcuuggguagacuuaguacuugaacauggaggcuguguuacgacgauggcucaagguaaaccaacauuagauuuugaacugacuaaaacuacugcaaaagaagucgcguuacuacggacguacugcauugaggcuucuauaucuaauauaacaacugcgacucgaugucccacgcaaggcgagccguauuugaaagaggagcaagaucaacaguauauuuguagacgugauguuguugaccguggauggggaaauggaugcggguuauucggaaaaggcgggguuguuaccugugcuaaauucaguuguucagagaaaauaacggggaaucuaguacagaucgaaaaucuggaauacacuguuguaguaaccguacauaauggagauacacaugcaguugguaaugauacaucgaaucacggcgugacagcuacuauuacaccgagaucuccuaguguggaggucgaacuaccagauuauggagaauugacuuuggauugcgaaccccgaucaggaaucgacuuuaaugaaaugauuuugaugaaaaugaagaagaaaacguggcuuguucauaaacagugguuucucgauuuaccauuaccgugggcugcgggugccgacacguccgaaguacauuggaacuacaaagaaagaaugguaacguucaaagucccucaugcuaaacgucaagacgucacaguucucggaagucaagaaggggcuaugcacuccgcauuggcuggagcaacagaaguugacaguggagauggcaaccauauguuugcgggucauuuaaaauguaaaguuagaauggaaaaacuucgaauaaaagguaugucuuauacuaugugcuccgguaaauucagcauagauaaagaaauggcagaaacacaacaugggacuacuguggucaaaguuaaauacgaaggugcuggagccccauguaaagucccuauugaaauucgugauguuaauaaagagaaaguggucgguagaguaauuucauccauaccgcuggcagaaaauacaaacagugugacuaacauugaauuagaaccaccuuucggugacucguacauuguaauaggaguugguaauuccgccuuaacucuacacugguuucggaaaggaagcagcaucggaaaaauguucgaauccaccuaccguggcgcuaaaagaauggcaauuuuaggugaaacagcaugggauuuugggagcguagguggauuauuuacaagucuuggaaaagcuguacaucaaguauuugguagcguauacacgacuauguucgggggaguuaguuggaugguaaggauucuuauugggcuccuagucuuauggauugguacaaauagucgaaauaccuccauggccaugacuugcauugcgguaggaggaaucacucucuucuuaggauuuacugugcaggcggauaugggauguguugugucauggucaggaagagaacuaaaaugcgguagcggaauuuuugucguagauaauguccacaccuggacagaacaauacaaauuucagcccgaaucgccugcacgauuagcaucugcuauucuaaacgcgcacaaggauggagugugcggaauaagaagcacuacgagacuugaaaacguuauguggaaacaaauaacaaaugagcucaauuacguacuaugggaaggugggcaugaccuaacuguuguugcaggggauguaaaggggguauugacuaaagggaaacgggcacuuaccccaccaguuucggauuuaaaauauuccuggaaaacaugggguaaagcgaaaauuuuuacuccagaggcaagaaauucaacauuccuaauugacggaccagauacgucagaauguccgaacgaaagaagggcauggaacaguuuagaaguggaggacuacggauuugguauguucaccacuaauauauggaugaaguuccgugaagggagcagugaagucugugaucauagguuaauguccgccgcgauaaaggaucaaaaagcgguacacgcggauaugggauauuggaucgaaucgagcaaaaaccaaacuuggcagauagaaaaagcuagccuaaucgaagugaaaacguguuuguggccuaaaacacacacgcuauggucaaacggagugcucgagucacagauguugauuccgaaaaguuaugccgguccguuuucacaacacaacuauagacagggauaugccacccaaacagucggcccguggcacuuaggaaagcuagaaauagauuuuggggaauguccagggacaacaguuacaauacaggaggauugcgaccauagagguccuagucuucgcaccacaaccgcuaguggaaagcugguaacccagugguguugccgaaguuguacaaugccgccucugcgguuccuaggugaggauggcugcugguauggaauggaaauacgcccuuugucugagaaagaagaaaauaugguaaaaucacagguugccgccggacaaggcacuucugaaacuuucucaaugggacuacuaugucuuacgcuauuuguggaagaaugucuaagaaggcggguuacuagaaaacacaugauccuagcggugguaauaacuuuaugugcuauaauacucggcggauuaacauggauggauuuacuacgggcauuaauaaugcuaggagacacuaugagcgguagaauaggaggacagacgcaccucgcaauaauggcuguuuucaaaaugaguccaggguauguguuaggagucuuuuuaagaaaauuaacaagucgagaaacagcacuuaugguaaucggaauggcaaugacaacuaccuuaagcaucccacaugaucucauggaacuaaucgacggcauaucauuaggacuuauacuauuaaaaaucguaacacaauucgauaauacucaagucggaaccuuagcacucaguuuaacuuuuauacggucgacaaugucauuaguuauggcuuggcguacuauaauggcaguacuuuuuguuguaacauuaauuccacuguguagaacgagcugcuuacaaaaacagagccauugggucgaaauuacagcuuuaaucuugggcgcucaggccuuaccaguauaccugaugaccuuaaugaaaggcgccucuaggagauccuggccuuuaaacgaagggauaauggcaguaggucuugugucguuguuagggucggcccuccuuaaaaacgacgucccguuagcaggccccaugguugccggaggacuccuauuagcagcguacguuauguccgggucaucagccgaucugucccuugaaaaagcagccaauguacaaugggacgaaauggcugacauuacgggaaguagcccaauuauugagguuaaacaagacgaagacggcucuuucuccauacgugaugucgaagagaccaauaugauuacccuauugguuaaguuagcauuaaucacaguauccggccucuacccucucgcaauuccggucacaaugacguuaugguauauguggcaaguaaaaacacaacgaucaggggcucuaugggacguaccuuccccugcagcgacacagaaagcagcgcugucagagggaguguauagaauaaugcaaagggggcuuuucggaaagacgcaagugggugucggaauacauauggaaggaguauuucacacaauguggcaugugacgagaggauccguuauuugccaugaaacaggcagauuggagccaucuugggcggaugugaggaaugauaugauaaguuaugguggaggauggagacuaggagauaagugggauaaagaggaagacguacaggugcuugcuaucgaacccggcaaaaauccgaaacacguucaaacuaagcccggguuauucaaaacacuaacuggagaaauuggagccguaacccuagauuucaaaccgggaacaucugguucuccaaucauaaauaggaaagguaaaguaauaggucuguacggcaacggagucgucaccaagaguggcgauuacguaagugcuauaacucaagcugagagaauaggagaaccagacuaugaaguugaugaggauauauuucguaagaaacgcuugacuaucauggaucuacacccuggagcgggaaaaacaaaaaggaucuuaccaagcaucgugcgugaagcauugaaacgacgucuaagaacauuaauauuggcgcccacaaggguagucgccgcagaaauggaagaagcccuaagaggacuuccaauacgcuaccagacuccagccguuaaaagugaacacacggggcgugaaaucguugaccuuaugugucacgcgaccuucacuaccagauugcuaucaucgacacgagucccuaacuauaaccuuauuguaauggaugaagcacauuuuacugauccaucguccguugcagcacgaggauauauaucaacuagaguugaaaugggagaagcugcagcaauuuucaugacugccacgccgcccggagcgacagauccuuuuccacaaucaaauaguccaauugaggauauugaaagggaaauuccagagcggaguuggaacacaggcuuugacuggauaacugauuaucaaggaaaaacugugugguuuguucccucuauuaaagccgggaaugacauagcaaauugucuuaggaaaucugggaagaaaguuauccaacuuucucggaaaacauuugacacagaauauccaaaaaccaaacugacugacugggacuuuguaguuacuacagauauuucagaaaugggagccaauuuuagagcuggaaggguuauugauccacgaaggugccuaaaaccugucauauugaccgauggaccugaacguguaauauuggcugguccgauuccaguaacgccugcgagugcugcacaaagacguggccguaucggucguaauccugcucaagaggaugaucaauacguauuuucuggcgacccccucaagaacgacgaagaccaugcacacuggacggaagccaaaauguuauuggauaauauuuauacaccagagggaauaauaccaacgcuguuuggaccggaacgagagaaaacucaggcuauagacggugaauuucgauuaagaggagaacaacggaaaacauucguggaacuaaugcggaggggagaucuaccgguuuggcugucauacaaggucgccagugcuggaauaaguuauaaagaucgggagugguguuucacuggagaacggaauaaucagaucuuagaagaaaacauggaaguagagauauggaccagagaaggugagaagaaaaaguugagaccgcggugguuggacgcgcguguguaugcagauccaauggcuuuaaaggauuuuaaagaguucgcaaguggaaggaaaucaauuacucuagauauacuuacugagauagcaucgcuuccaacauaccuaagcucuagagccaaauuggcacuggacaacauaguaaugcugcacacgacagagaggggaggaagggcuuaucagcaugcgcugaaugaauugccagaaucuuuagaaacgcuaauguuaguugcacuucuaggggcaaugacagcagggauauuuuuauuuuucaugcaagguaaagguauagguaaacuguccauggguuuaauaacgaucgccguagcgucaggauuacuaugggucgccgaaauccaaccacaauggauugccgccagcauaauacuagaguucuucuuaaugguucuucucauaccagaaccagaaaaacaaagaacuccacaagacaaucaauugauuuacgucauccuugcaauauuaaccauuauaggacuuauugcagcuaaugaaaugggguugauugagaaaaccaaaacagacuuuggauuuuaucaaguaaaaacagagacuacuauauuggauguagacuuaagaccagccagugcguggacccuauacgccguugcaacaacaauacuaacuccuaugcuuagacacacaauagagaauacuucagcaaaccuaucauuagcagcaauagcgaaucaagcugcaguauuaaugggacuuggaaaagguuggccuuugcauagaauggacuugggaguuccauuauuagcuauggguuguuauucacaaguaaacccaacgacacuaacugcaucguugguaauguuauugguucauuaugccauaauaggacccggacuacaggcgaaagcuacacgcgaagcacaaaagagaacagcugcgggaauaaugaagaacccuacugucgaugguauaaccguaauagaucuggaacccauaaguuaugacccaaaguuugaaaaacagcuaggacagguuauguuauuaguucuaugugcgggucaacuccuauuaaugcgaacaacgugggcuuucugugaaguacuuacacuugcaacuggcccaauauuaaccuugugggaaggcaacccagggcgauuuuggaauacaacaauagcaguaaguacagcuaauauauucagagggaguuacuuggcuggcgccggauuggcauucagucuaaucaaaaaugcccagacuccgcguagaggcacugggacgacaggcgaaacuuuaggagaaaaauggaaaagacagcuuaacucacucgauagaaaagaauuugaagaguauaaacggaguggaauacuggaagucgauagaacugaagcaaaaucagcauuaaaagacggaaguaaaauuaaacaugccguaagccguggcucuagcaaaauaagguggauaguagaaagagguaugguaaaaccuaaagggaagguaguggauuuaggcugcgguagaggugguugguccuacuacauggcaacauuaaagaauguaacugaaguaaaaggauauacuaaaggagguccuggucaugaagaacccauaccaauggcuacauauggauggaaccuaguuaaauugcauucuggaguugacguauuuuauaaaccuacugaacagguugacacacuacugugugauauuggagagagcucaucgaauccaacuaucgaagaaggccgaacacuacgaguucuaaagaugguagagccgugguuaaguaguaaacccgaguucugcauaaaaguacuuaaccccuauaugccgacagugaucgaagaauuagaaaaacuccaacgaaaacauggcggaaacuuagugcgcuguccucuuagucguaacuccacacacgaaauguauuggguaaguggggcuuccggaaauaucguuucaucuguaaacaccacgaguaaaauguuguugaauagauuuacaacgagacaucgcaaacccacguaugaaaaagacguagaccuuggggcaggcacuaggucagucucaacagaaacugagaaaccagacaugacgauuauagggcggaggcuccagagauuacaagaagaacauaaagagacauggcacuaugaccaagaaaauccauaccggacuugggcauaucauggaaguuaugaagcgccaagcaccggcagugcgaguucaaugguaaacggugucgucaaauuguuaaccaaaccuugggaugucauaccaaugguaacacaguuagcuaugacagauacgacgccauucggccaacaaagaguauucaaggagaaaguagauacacggacgccacagccaaaaccuggcaccagaaugguuaugacgacaacagcuaacugguugugggcccuuuugggcaagaagaaaaauccaagguuauguacgagggaagaauuuauaaguaaaguucguucuaacgcugcgauaggagccguuuuccaggaagaacaaggcuggacauccgcaucggaggcaguaaacgacagccgauuuugggaauugguagacaaagaaagagcuuuacaucaagaagggaagugcgaaaguuguguauauaauaugaugggaaagagagagaagaaacuuggagaguucggacgugcgaaagguagucgagcaauaugguacauguggcuaggagcccgguuucucgaguucgaagccuuaggauuuuuaaacgaagaccauugguuuggccgggaaaauucuuggucaggaguugaaggugagggacuucacaggcuuggauauauauuagaagaaauagacaaaaaggauggggaucugauguaugcagacgauacugccggaugggacacacguauaaccgaagacgauuugcaaaaugaagaacuaauaaccgagcagauggcaccacaccauaaaauuuuggcaaaggcaaucuucaaauuaacuuaccaaaauaaaguaguaaaagucuuaaggccuacgccacgaggagccguaauggauauaauuagcagaaaggaucaaagggguaguggacaaguuggaacauacggauuaaauacauuuacgaauauggaaguacagcucauccgccaaauggaggcagaaggagugauaacucaagaugacaugcaaaauccuaagggccuaaaagaacgagucgagaagugguuaagggagugcgguguagacaggcucaagcguauggcaauuagcggagacgauuguguaguaaaaccacuggaugagcgguuuggcacuucccuucuuuuucugaaugauauggggaaaguacguaaagacauaccgcaaugggaaccaucaaagggauggaaaaauuggcaggaaguuccauucugcucucaucauuuccauaaaauauucaugaaagaugggaggagccuaguaguaccuugucggaaucaagacgaacuuauagggagggccagaauaagccaaggagcaggauggagccuuagagaaacagcuugucuaggaaaagcauaugcacaaauguggucauuaauguacuuccaccgcagagaccuacgacuggcaucaauggccauuugcagcgcgguaccaaccgaaugguuccccacaaguagaaccacuuggucgauucacgcacaucaccaguggaugacuaccgaggauaugcuaaaaguauggaaccgaguguggauagaagauaacccaaauaugauagauaaaacaccgguucauagcugggaagauauucccuaucucggaaaaagagaagaccuauggugcgggagucuaauuggauugucaagucgagccacaugggcuaaaaacauacauacggcaauaacucaaguacguaacuuaauuggcaaagaagaguacguagacuacaugccaguaaugaaacgcuacagugcaccgucugagucagagggcguacuauag

SEQ ID NO: 23697 - RNA, 9867 nt, Artificial Sequence
  derived and/or modified CDS sequence (opt6) from DENV-4__JQ513338__SS-prME
ucaacuauaacauugcuaugccuaauccccaccguaauggcuuuccauuuaucuacacgugauggagaaccccuaaugaucguagcaaaacacgaacgaggacguccucuuuuauuuaaaacaaccgaaggaauuaacaaauguacacuaauugcuauggaucucggagaaaugugugaagacacagugacauauaaauguccacuguugguuaacacagaacccgaggacauagauugcuggugcaaucuuaccucgaccugggugauguacggaacuuguacgcaaucaggcgaacgacgaagggagaaaagaucagucgcccugaccccucauucagguaugggucuugaaacaagagcugaaacguggaugucgucagaaggagcauggaaacacgcucagcggguggagucauggaucuuacguaaccccggauucgcccuccuagcggguuucauggcauacaugaucggucaaaccggaauacaaagaacuguauucuuuguacuaaugaugcuaguggcgccgucauaugguaugcguugugucggcguuggaaauagagauuuuguugaaggcguaucagguggcgcauggguagaccuaguauuagaacauggcggcuguguuaccacgauggcacaaggaaaaccuacauuagauuucgaauuaacgaaaaccacagccaaagaaguugcgcuacuaaggacauacuguaucgaggcgcuaauaucaaacauuacgaccgcaacaaggugucccacucaaggagaaccauacuuaaaagaagaacaagaacaacaguacaucugucggagagaugucguggacagaggauggggaaacggaugugguuuauuugguaaaggggguguaguuacuugugcaaaguuuucuugcucuggaaaaauaacagguaacuuaguacaaaucgaaaauuuggaauacaccguaguaguuacaguacauaaugggaacacuccugcaguaggcaaugauaccucuaaccauggcguaacagcaccaauaacuccgcguucaccuagugucgaaguaaaacucccggauuacggcgaauuaacacuggauugcgaaccaagaucaggaaucgauuuuaaugagaugauuuuaaugaagaugaagaagaaaacaugguuaguacacaaacaaugguucuuagaucuuccuuugccauggacuaccggagcagauaccuccgaaguacacuggaacuauaaagaacgaaugguuacuuucaaagugccacaugcaaaacgucaagauguuacaguacuaggcagucaagagggugcaaugcauucugcucuagcuggagcuaccgagguugacucuggcgacgaaaaccauauguuugcgggacacuuaaaaugcaaaguuaggaugggcaaauugagaauuaaaggcaugucauacacaauguguucaggcaaauucaguauagacaaagaaauggcagaaacacaacaugggacuacuguagugaaaguaaaauaugagggugcaggggcuccaugcaagguaccuauugagauaagagacgucaauaaagaaaaaguagugggaaggguuauaagugcaacuccacucgccgaaaauacaaauucagugacaaacauagaauuagaacccccuuuuggagaucgcuauaucguaaucggaguaggaaacucggcacuuacucuacauugguuccggaaaggcucaaguauugguaagauguuugaguccaccuauagaggugcgaagagaauggccauauugggagagacagcgugggacuuuggguccguaggaggacuauuuacuucccucggaaaagcgguccaucaagucuucggaucugucuauacuaccauguuuggaggagugucauggaugauaagaauauuaauuggauuccuaguacucuggauaggcacgaacagcaggaacacgucaauggcaaugacguguauagcagucggaggaauaacccuauucuuagguuuuacaguucaagcagauaugggcugugucguuaguuggagugggagggaauuaaaauguggaucagggauauuuguaguagauaacgugcacacuuggaccgagcaauauaaguuucaaccagaaagcccugcuagacuugccagcgccauucuuaacgcacauaaagacgguguuugcggcaucagaucaacuaccagguuggagaauguuauguggaaacaaauuacgaaugagcuuaacuacguacuaugggagggaggucacgaucuuacaguuguugcgggugauguuaagggaguucuaacaaaagggaagagagccuuaacacccccugccagugauuuaaaguacucguggaaaacuuggggaaaagcuaagauuuucacaccagaagcaagaaacucuacauuuuuaauagacggacccgauacuagcgaaugcccuaacgaaagacgagcguggaauagcuucgaaguggaggacuacggauucggcauguuuacuacaaauaucuggaugaaauuucgcgaagggaguagugaggugugcgaucauaggcuaaugucugcugcuaucaaagaccaaaaggcgguacacgcggauaugggcuauuggauagaaucaagcaagaaccaaacuuggcaaauagaaagggcgucucuuauagaagucaaaacuuguuuauggccgaaaacacauacacuauggucuaauggcguuuuagaaucgcagauguugauuccuaaaucauacgcaggcccauuuucgcaacauaauuaucgccagggguaugcaacucaaacaguugguccauggcaccuugggaaacucgaaaucgauuuuggcgaaugccccggcacaacuguuacaauucaagaaaauugcgaucacagaggcccauccuuacgcacgaccacugcaaguggaaaauuaguuacacaaugguguugucgcuccugcacuaugccgccauuaagauuucuaggagaagauggcuguugguacggcauggaaauaaggcccuuaucagaaaaagaagagaauaugguaaagagccaagucacugcaggacaggguacaagugagacuuuuaguaugggacuauuaugccuaacacuuuucguugaagaauguuuaaggagaagaguuaccaggaagcacaugauacuagcagucguuauaacauuaugugccauaauuuuaggaggcuuaacuuggauggauuuauugcgagcacugauaaugcuaggggauacaaugagugguagaauaggaggucaaacacaucucgcuauuauggcugucuuuaaaaugagcccgggauacguuuugggaguauuucuucguaaauugacaagucgugagacagcauugaugguaauaggcauggcgaugacuacgacacuguccaucccacacgaccucauggaacuaauagaugggaucagccuagguuugauucuauuaaaaauagugacucaauuugauaauacccaaguuggaacucuagcccuuucgcuaacauuuauacgaucaaccaugucacuuguuauggcauggagaacuauuauggccguccuauuuguagugacguuaauaccgcuauguaggacaucaugcuuacagaaacagucucauuggguugaaauaaccgcucuaauauugggugcucaagcacuacccguuuauuuaaugacguuaaugaagggugcgucacggaggucauggccacuuaaugaagguauuauggcagucggucuuguuagucuacuaggaucagcucuuuugaagaaugacguuccacuagcggggccaaugguugccggaggauuauuguuagcagcauacguuaugucagguuccucugcggaucuuaguuuagagaaagcagccaacgugcaaugggaugaaauggcagauauaacaggaagcaguccuaucauagagguaaagcaagaugaagacgggucauuuucuaucagagauguagaagagaccaauaugauaaccuuacuuguuaaauuagcccuuauuacuguuuccggucuguacccuuuggcgauaccuauaacuaugacacucugguauauguggcaaguuaagacucagcguagcggggcacugugggaugucccaagccccgcagcuacacaaaaggcggccuuaucagaggggguauauagaauaaugcaaagaggauuauucggaaaaacgcagguuggaguuggaauacacauggaaggaguauuccauacuauguggcauguuacacgagguucgguuauuugucaugaaacaggacgccuugaaccuuccugggcggauguucguaacgacaugauaucguauggaggcggcuggcguuuaggugauaagugggauaaggaagaagauguacagguucuagccauagaaccggguaaaaacccuaaacauguacaaacaaaaccaggauuguucaaaacuuugacgggugagauaggagccgugacauuagacuucaagccaggcacauccgguucucccaucauaaaccgaaaagguaaagugauaggacuuuauggcaaugguguaguaacgaagucuggcgauuauguaucugcuaucacacaagcagaacgaauaggagagcccgacuaugaaguagaugaggauauauuuaggaagaaaagauuaacaauaauggauuugcaucccggagcaggaaagaccaaacguauuuuaccaucuauagugcgagaggcgcuaaagagaagacuuagaacacuuauacucgccccuacacgcguaguagcagcugaaauggaggaagcacuccgugggcuaccaauaagguaccagacaccagccguuaagagugaacacacuggacgagaaauuguagaccugaugugucaugcuacuuuuacgacaaggcuccuaucaucuacuaggguuccuaauuacaaucuuauagucauggacgaagcucacuuuacagauccuucaucuguagcagcgcgugguuacauuagcacuagggucgaaaugggagaagcagcagcuauauucaugacagcaacaccacccggagccacagauccuuucccacaaaguaacucuccaauagaagauaucgaacgcgaaauccccgaacgaagcuggaauacaggauuugauuggaucacagauuaccaagguaagacagugugguuuguaccuucaaucaaggcugguaaugacaucgcuaauugucuaagaaaaucaggcaagaaaguaauacaacuuucaagaaaaacauucgacacugaguauccaaagacaaaguuaaccgauugggauuuugucguuacaacggauauuucugaaaugggagccaacuuuagagcaggacgagugaucgauccgcgacggugucuuaaacccguaauccuaacugacggaccugaaagaguuauacuugcuggcccaaucccggucacuccugcguccgcggcacaacgaagaggccguauaggucguaaucccgcccaggaagacgaucaguacguuuuuaguggcgauccacucaaaaaugaugaggaucacgcgcacuggacggaagcaaagauguuacuugauaacauauacacuccggaagggaucauucccacacuuuuugguccggaaagagaaaagacccaagcuaucgauggagaauuucgacuacgaggcgaacagaggaaaacauucguagaguuaaugagaagaggagacuuaccaguauggcuaagcuacaaaguagcaagcgcaggcauaucauacaaagauagagaguggugcuuuacuggagaaagaaauaaccaaauccuagaagaaaauauggaaguagaaauauggacucgcgaaggggagaagaagaaacuaagaccaaaauggcuagaugcaagaguauaugccgauccaauggcguuaaaagauuuuaaagaauuugcgucaggaagaaaaaguauaacuuuagauauacuaacugaaaucgcaucacucccaaccuaucuaagcucaagagcaaaauuggcucuagacaacauaguaaugcuacacacuacggaaaggggugguagagcauaccaacaugcuuuaaacgaacuacccgaaucgcuugaaaccuuaaugcuuguagccuuguuaggugcgaugaccgcaggaauauuuuuauucuucaugcaagggaaggguauugguaaauuaagcaugggccucauaacgauagcaguggcuucaggcuuauuaugggucgcugaaauccaaccucaauggauagcagcgaguauuauauuggaguucuuucuaaugguauuauugauaccggaacccgaaaagcaaagaacaccccaagacaaucaauuaauauacguaauccucaccaucuuaacaauaauaggauuaaucgcagccaaugaaaugggcuuaauagaaaagacaaaaacagacuuuggcuuuuaccaagucaaaacagaaacaacaauucuagauguggaccuuaggccagccagugcauggacgcuguaugcaguagcuacaacuauacuaacuccgaugcugagacauacaauagagaauacaagcgcaaauuugaguuuagcugccaucgcaaaucaggcugcuguguuaaugggccugggaaaagguuggccacuucauagaauggaccuuggaguuccccuucuagcaaugggaugcuacucucaaguaaauccaacaacguuaacagcaagccuaguaauguuauuaguucacuacgcuauuauaggaccugguuuacaagcuaaagcaacacgugaggcacaaaaacgaacagcugcaggaauaaugaagaauccgacuguagacggaauaacggucauagaccuagaaccaauuaguuaugauccaaaauucgaaaaacagcucggccagguaaugcuauuaguacucugugcaggacagcuacugcugaugcgcacaaccugggccuuuugcgaaguauuaacacuugcaacugguccgauacuaacacugugggaaggcaacccgggacgcuucuggaacacaaccauagcaguaucaacugccaacauauuucggggcucauaucucgcaggagcaggucuugcuuuuucacuaaucaaaaaugcccaaaccccgcggcgcggaacaggaacgaccggagaaacgcuuggugagaaauggaaaaggcaacucaacucgcucgaucggaaagaguucgaagaauauaaacgaucaggcauucuagagguggaucgaacugaggccaaaagcgcacucaaagaugggucgaaaauaaaacaugccguaucaagagguaguaguaagauuagauggauuguagaaagaggaaugguaaaaccuaaagguaaaguuaucgaucuaggcugcggacgagggggcugguccuauuauauggcgacccucaaaaauguaacagaaguuaaaggauauacaaaagggggaccaggucaugaagaaccgauaccgauggcuacauaugguuggaaucugguaaaacugcauuccggaguugacgucuuuuacaaaccaaccgaacaaguagacacguuauuaugugauauaggugaaucgucuagcaacccuaccauugaagaaggcaggacuuuaaggguauugaaaaugguugaaccaugguuaagcuccaaaccugaauuuugcaucaaaguacuaaauccauacaugccuacggugauagaagaacuugaaaaacugcaaagaaaacauggagguaaucugguacguugcccuuugucacgaaauucuacacaugagauguauuggguuaguggcgccucagggaacauuguuucaucaguuaacacuacaucaaagaugcuucuaaauagauucacuacacgucaucguaagccaacuuaugaaaaggacguggauuuaggagcugguacacguucagugaguacagaaacagagaagccagauaugacgauaauagggaggagguuacagagguuacaggaagaacacaaggaaacuuggcacuacgaccaggaaaacccauauagaacaugggcauaucacgguagcuaugaagcacccucgacaggaagugcgaguucaauggucaauggagucguaaagcuacucacuaagccaugggacgucauccccaugguaacacagcuagcaaugacagauacuacuccuuuuggccaacaacggguauuuaaagagaaaguggacacucgaacgccacagccuaaaccgggaacacguauggugaugacuacuacggccaauuggcuaugggcucuccuagggaagaagaaaaacccacgacuaugcacgcgagaagaauuuauaucaaaggucaggaguaacgcggcaauuggggcaguauuccaggaggagcaaggcuggacgucagcaagugaagcgguuaacgauaguagauuuugggaacucgucgacaaggagcgugcacuacaucaagaaggaaaaugcgaaagcugcguguauaauaugauggggaaacgagagaagaaacuaggggaguucggcagagccaaaggaucucgugcgauaugguauaugugguuaggcgcacgauuuuuagaguuugaagcacuaggauuccuaaacgaagaucauugguucggaagggaaaauaguuggucaggcguagaaggagaaggacugcacaggcugggauacauacucgaagaaauugauaagaaagauggugauuugauguaugcggaugacacagccggcugggauacacgcauuacugaggaugaucuucaaaacgaagaacuaauuacagaacaaauggcuccgcaccacaaaauccuagcuaaagcaaucuucaaacuuacguaccaaaauaaaguagucaaaguucugagaccaacuccucgaggggcuguuauggauauuauuaguaggaaggaucaacguggauccgggcaaguggggaccuauggguuaaacacauuuacuaacauggaaguacaauuaauaaggcaaauggaggcagaagguguaauaacacaagacgauaugcaaaauccaaaaggucuaaaagaacgaguagagaaaugguugagggaaugugggguugauaggcuaaagcgaauggcaauaucuggagacgauuguguugugaaaccucuugacgaaagauuuggaacuucauuacuuuuucuaaacgacaugggcaaaguuagaaaagauauaccgcaaugggaaccaaguaaaggcuggaaaaacuggcaagaaguaccuuuuuguagucaucauuuccauaaaauauucaugaaagacggcagaagccuagucguuccaugcagaaaucaggaugaauuaauugggagagcacguaucagucaaggugcgggaugguccuuacgagagacagcuugcuuaggaaaagcauacgcucaaauguggucacuuauguauuuccaccgacgugaccuuagauuagcaucuauggcgauuuguagugcaguucccacagagugguuuccaacgagcagaacaacauggucaauucaugcacaucaucaauggaugacgacagaagauaugcugaaggucuggaaucguguuuggauagaagauaauccuaauaugauugacaaaacuccaguucacucaugggaagauauaccauaccuaggaaaaagagaagauuuguggugcggaaguuuaauuggauuaucgagcagggcuaccugggcgaaaaacauacauacagcuauaacacaaguacgaaaucuuaucggcaaagaagaauacguugauuacaugccuguuaugaaaagauauagcgccccuagugaaucagaaggaguccuguga

SEQ ID NO: 23698 - RNA, 9867 nt, Artificial Sequence
  derived and/or modified CDS sequence (opt6) from DENV-4__JQ513339__SS-prME
ucaacuaucacucuucuguguuugauccccacuguaauggcauuccauuuaagcaccagggacggagaaccguuaaugaucguggcaaaacaugaaagaggacgcccacugcuuuuuaaaacgacagaaggaauaaauaaauguaccuugauugcuauggaucuaggagaaaugugugaagacacugugacguacaaaugcccccuauuagucaacacagaaccagaagauaucgauuguuggugcaaucucaccucuaccugggugauguauggaaccugcacacaaucuggagaaagaaggcgcgaaaaacgcucaguugcacugacuccccauucaggaaugggacuagaaacgagagcggaaacguggaugucgucugaaggugcuuggaaacacgcacaaaggguggaaaguuggauccuuagaaauccgggauuugcccuucuagcuggauuuauggccuauaugauuggacaaacgggcauucagcgcacgguauucuuuguauuaaugauguuaguugccccaaguuauggcaugcgcugcgucggcguaggaaaucgugauuuugucgaaggggucucugguggagcguggguggacuuaguccuagaacacggaggguguguuacuacgauggcucaaggaaaaccaacccuagacuuugaauugacgaaaacaacagccaaagaaguagccuuguugagaacauauugcauagaagcucuaauuaguaacauaacaacugcuacucgaugucccacacaaggagaaccauacuuaaaagaagaacaagaccaacaauacauuugcagacgggacguaguagacagaggauggggaaauggcugcggacuauuugguaaaggagggguaguaacgugugccaaauucucaugcaguggaaaaaucacagguaaucucguucaaauugaaaaucuagaauauaccgugguaguuacgguucacaauggugauacgcacgcaguuggaaacgauacaaguaaccauggaguaacagcaacuauaacacccaggagcccuuccguugaaguuaaacuaccugauuauggcgagcuaacuuuggauugugaaccaagaaguggcauagauuucaaugaaaugauuuuaaugaaaaugaaaaagaaaacuuggcugguacauaaacagugguuccuagauuugccacuacccuggacuaccggggcugacacaucugaaguccacuggaauuacaaagagagaauggcuacauuuaaagugccucaugcaaaacgacaggacgugacuuuguuggggucacaagaaggagcgaugcacuccgcauuggcuggagcuacagagguagauucaggagaugaaaaucacauguucgcuggucaccuaaaauguaagguuagaaugggaaaauugaggauaaaagguaugaguuauacgaugugcaguggaaaauuuucaauugauaaagagauggcagaaacgcaacauggcacaacgguagugaaaguaaaauaugaaggcgcgggagcaccauguaaaguuccaauagagauacgggauguaaacaaagaaaaaguuguaggccgcguucuuucagcgacaccauuagcggaaaauacaaauuccguaacaaauauagaacuagaaccgccauucggugacaguuauaucgucauaggaguggggaacuccgcacuaaccuuacacugguucacaaaagggucaucuaucgggaaaauguucgaaaguaccuauaggggagcuaaaaggauggcaauacuaggagaaacagcaugggacuuuggaucaguaggcggauuauuuacuagccuuggaaaagcaguacaucaagucuucgggucgguauacacuacuauguuuggcgggguaucuuggaugauaagaauacuaauuggguucuuaguauuauggauaggcacaaauucccgcaacaccucaauggcuaugacaugcauugccgugggcggaauuacauuauuuuugggguuuacgguacaagcagauaugggaugcguagugaguuggagcggucgugaacuaaaaugugguucagggauuuucguaguagauaacguacacacuuggacagagcaauauaaguuucaaccggaaucucccgcacgcuuagcgagcgcuauuuuaaaugcccauaaagacggaguaugugguauuaggucuacaacgagauuggaaaacguuauguggaagcaaauaacaaaugaauuaaacuauguguugugggagggaggacaugauuugacaguaguagcaggagacguaaaaggagugcuuacuaaggggaaaagagcauugacaccaccagcuucagaccuuaaauauagcuggaagacuuggggcaaagcgaaaauuuuuacaccagaagccagaaauucaacuuuccucauugaugggccugacacauccgaauguccuaacgagcgccgagcguggaacucauucgagguugaagacuacggcuucgguauguuuacaacgaauauauggaugaaguuuagagagggaucuagcgagguaugcgaccaccgauugaugucggcugcaauaaaagaucaaaaagcgguucacgcugauaugggauacuggauugaaucgucuaaaaaccaaacuuggcagauagagcgcgcaucguuaauagaggugaaaacuugccuguggccaaagacucauacacuauggucgaaugguguguuagaaagucaaaugcugauaccaaaaucauaugcagggccguucucgcagcauaacuaccggcaaggguaugcgacucaaacagucgguccuuggcaccucggcaaacuugaaauagacuuuggcgaauguccagguacaacuguaacaauucaagaaaauugcgaccauagagggcccagccuuagaaccacuacagcuucggguaaacucgugacucaaugguguuguaggucguguacaaugccuccucugagauuuuuaggugaagacggcuguugguacggcauggaaauucgaccauuaagcgaaaaagaagaaaacauggucaaaucacaggucacggcaggucaagguacaagugaaaccuucuccauggguuugcuaugucucacucuauucguggaagaaugucuuaggagacgcguuacgcgaaaacacaugauauuagcaguaguaauuacacuaugugccauaauacuaggcgggcuaacauggauggauuuacuuagggcauuaauuaugcucggcgacacaaugaguggacggauugggggacaaacucauuuagcuauaauggcuguauucaagaugagcccggguuauguucucggaguauuccuaagaaaacugacuucaagagaaaccgccuuaauggugauagggauggcaaugacaacuacacuaaguaucccacacgaucucauggaacuuauagaugguaucucccuaggccuaauacuguuaaaaauaguaacucaauucgauaauacgcaggucgguacucuugcauuaucacucacauuuauccggaguacaaugucuuugguaauggcuuggaggacaauaauggcgguuuuguucgugguuacuuuaaucccacugugccggacgucaugccuccagaaacaaagccauuggguugaaaucacagcccuaauauuaggugcucaagcauuaccagucuaccuaaugacguuaaugaagggagcaucccggcgaucguggccacuaaaugaaggaauuauggcuguaggauuaguuucacucuuggggagcgcauuauuaaagaaugauguuccacuagcagguccuaugguugccgguggacuauugcuggcugcauauguuaugucaggauccagugcagauuuaagucuagaaaaagcagcaaauguccaaugggacgagauggcagauauaacaggaaguucaccaauaaucgaaguaaaacaggacgaagacggaucguuuucgauacgugacgucgaagaaacgaacaugauaacacuauuagugaaauuagccuuaauaacaguaucaggucuauauccauuggcaauuccuaucaccaugacuuuaugguacauguggcaaguuaaaacacaacguucgggagcucucugggaugugccaucucccgcggcaacacaaaaagcagcucuuucagaggguguguauagaauaaugcaacgaggguuauucggaaaaacacaaguaggagucggcauucauauggaaggaguauuucauacgauguggcacgucacucgugggucaguaauaugucaugaaaccggccgcuuagagcccaguugggcugauguaagaaacgauaugauuucuuacggaggugguuggaggcuuggggauaagugggauaaagaagaagauguacagguucuugcuauagaaccugguaaaaaccccaaacauguacagaccaaaccaggcuuguuuaagacacucacaggggaaaucggagcuguuacuuuagauuuuaagccagguacaucugguucuccgauaauaaacagaaaaggaaagguaauaggccuuuauggaaacggaguaguaacaaagaguggugacuauguaucagcuauuacacaggcugaaagaauaggcgaaccggauuaugaaguagaugaggacauuuucagaaagaaacgacuaacuauuauggauuuacaucccggagcugguaaaaccaagcguauucugccaaguaucgucagagaggcauuaaaacgaaggcuaagaacuuuaauauuagcaccaacacgaguaguggcagcagaaauggaagaagcacuuagaggccucccaauccgcuaucaaacuccugcaguaaaaucagagcauacuggacgcgaaauaguggaccugaugugucaugccacguucacaacgagacuccuaaguucuacaagaguuccaaauuauaauuuaauaguuauggacgaagcacauuucacugauccaaguucaguugcugcaaggggauauauaucaacucguguagaaaugggugaagcagcggcuauauucaugacagcaacuccgccgggcgcuaccgauccguuuccgcagaguaacucuccuauagaggauauagaacgggaaauaccugagagaucguggaauacaggauucgacuggauuacagauuaucaagggaaaaccgucugguucguuccaucaauaaaagcagggaacgauauugcgaacuguuuacgaaaaucggguaagaaagugauucaguuaucccgaaaaacauuugauacggaauauccuaaaacaaaguugacagacugggacuucguugucaccacagauauuucagaaaugggcgcuaacuuccgagccgggcgaguuauugacccgagaagaugucuaaaaccuguaauccuaacagauggaccggagagaguuauucuugcaggcccaauaccggugacuccugccucagcagcacaaagacgcggucgaauaggaagaaauccagcgcaagaagaugaucaauauguuuucucuggagacccacugaaaaacgaugaggaucaugcgcauuggacggaggcaaaaaugcucuuagacaauauauacacgcccgaagggaucaucccuaccuuguuugguccagaacgggagaaaacccaagcuauugauggugaauuucggcuacguggcgagcaacgaaaaaccuuuguagaacucaugagaagaggugaucugccaguuugguuaaguuacaaaguagcuucagccggaaucucauauaaagacagagaauggugcuuuacuggagaaagaaauaaccaaauacuagaagagaacauggaagucgaaauuuggacgagagaaggugagaagaagaaauuaagaccaaaguggcuggacgcgcgugucuaugcggauccaauggcucuaaaagauuucaaagaguucgcuucaggcagaaaaucaauuacauuagauaucuuaacagaaauagcuucauuaccaacauaccucuccucacgagcaaaacuagcgcuggauaauauuguaaugcuacauacuacugaaagaggagggcgggcauaccaacaugcacuuaaugaacuacccgaaaguuuggaaacacucaugcuugucgcuuuguuaggcgcaaugaccgcggguauuuuccuguuuuucaugcaagguaaaggaauugggaaacuaaguaugggauuaauaacaauagcaguugcaucuggccuacuuugggucgcugaaauucagccgcaauggauagcugccaguauuauauuagaguucuucuuaaugguuuuauuaauaccagaaccagagaagcaaaggacaccucaagauaaucaacucauauacguaauauuaaccauccuaacaauaauaggccucaucgccgcaaaugaaaugggcuuaauugaaaagacgaaaaccgacuucggguucuaccaggucaagacugaaacuacaauucuagauguugauuugagaccagcgucggcguggacguuguaugcaguugcuacaacuauacuuacuccaaugcuuagacacaccaucgagaacacaucugccaaucucucucucgcagcuauagcuaaccaagcagcagucuuaaugggucuggguaaaggguggccuuugcaucguauggauuuaggaguuccacuacucgcaaugggcuguuauucucagguaaauccgacaacauuaacagccucgcucguuaugcuacucguacacuaugcgaucauaggaccaggucuacaagcuaaagcaacccgugaagcgcaaaaacguacggcagcaggaauaaugaaaaacccuacuguugacgguauaacaguaaucgaucuugagccgaucaguuacgacccgaaauucgaaaaacaauuaggacagguaaugcuguuaguacugugcgcaggccaauuauuguuaaugaggacaaccugggcauuuugcgagguccuaacucucgcuaccggcccaauccuuacacugugggaagguaauccgggccgauuuuggaacaccaccauugcuguaaguaccgcaaauauauuuagaggaaguuaucuagcuggugcuggauuagcauuuucgcuuauuaagaacgcacaaaccccaaggagagguacuggaacaacaggcgaaacauugggagaaaaauggaaacgacaacuaaauaguuuagaucguaaagaauuugaagaguacaaacguucuggaauacuagaaguugaccgcacagaagcaaaaagugcacuaaaagauggaucaaagauaaaacaugcgguaucuagaggaucgaguaaaauacguuggauaguagaacgagguauggucaaaccaaaaggaaaggucauagaccuuggauguggucguggaggguggaguuacuauauggccacucuuaagaauguuacagaagugaaaggauauacaaaagguggaccuggacaugaagaaccuauuccuauggcaacauacggauggaauuuggucaaacuacauucaggugucgaugucuucuauaagccuaccgaacaaguagacaccuuacuaugcgauauaggugaaucuuccaguaauccaacaauugaagaaggucguacccuaaggguacuuaaaaugguagaaccauggcugucauccaagccagaguucuguauaaaagugcuuaauccguauaugccuacagugauagaagaacuagaaaagcuccaacgaaaacacggagguaacuuagugagaugcccguuaagccguaacagcacacaugaaauguauuggguaucaggcgcaagcggaaacauagugucuucagucaacacaacaucuaagaugcuacuuaaccgcuuuacaacuagacacaggaagccgacauaugaaaaagauguugacuugggugcuggaacgagaagugugucaacggaaaccgaaaaaccagauaugacaauuauuggcagacgacuacaacgacuccaagaagaacauaaagaaacguggcacuaugaucaagagaacccuuaucgaacaugggcuuaucauggaaguuacgaagccccaucaacuggaagcgcaucaaguauggugaauggcgucguaaaacuacuaacuaagcccugggacguuauuccaaugguuacacaauuggcgaugacggacacaaccccauucggacaacaaagaguauuuaaagaaaaggucgauacgagaacaccucagccaaagccgggaacucggaugguaaugacuacaacugcaaauuggcuaugggcacuucuaggcaagaagaaaaacccaaggcuauguaccagagaagaguucauaucaaaagugagaaguaacgcggccauaggagcgguauuucaagaggaacaaggguggacaagugcauccgaggcuguuaaugauucuagauuuugggagcuaguagacaaagaacgugcacuucaccaagaagggaaaugcgagucgugcguauauaauaugaugggaaaacgggagaagaaauugggugaguucggccgagcaaaaggaucccgcgccaucugguauauguggcuuggggcgagguuuuuggaauuugaagcauuaggcuuuuuaaaugaagaucauugguuuggaagagaaaauagcuggucagguguggagggugaaggauuacaccguuuagguuacaucuuagaagagaucgacaagaaagauggcgacuuaauguacgcugacgauaccgcuggcugggacacaagaauaacagaagaugaucuucaaaaugaggaauuaaucacagaacaaauggcuccccaucacaaaauucucgcaaaagcaaucuuuaaauuaaccuaucaaaacaaaguuguaaaaguacuccgaccaacuccacguggggcuguaauggacauaauaagucggaaggaucaacgcggaaguggacaaguuggaacguacggacuaaacacuuuuaccaacauggaaguacaauuaauuagacaaauggaagccgagggagugaucacucaagaugauaugcagaauccgaaaggucugaaagaaaggguugaaaagugguuaagagaauguggagucgauagacuuaagagaauggcgauuucuggcgaugauuguguugucaaaccccuugacgaacgauucggcacaucauuguuauuccugaacgauauggguaaaguaagaaaggauauaccccaaugggaaccuucaaaaggguggaagaacuggcaagagguucccuuuuguagucaucacuuucauaaaauuuucaugaaagauggaagaucauuaguagugccuugucggaaucaggacgaauuaauaggaagggcuagaauaucucaaggggccggauggagcuuaagagagacugcaugccuugguaaagcguaugcacaaauguggucgcugauguacuuccaccgaagagaucuacgccuagcaaguauggcuaucugcuccgcagucccgaccgagugguuuccaacuucacgaaccacaugguccauucaugcacaucaucaguggaugacaaccgaggacaugcuaaaaguauggaaucgugucuggauagaagacaauccaaauaugauagauaaaacaccuguacacuccugggaagacauacccuaucuagguaaacgcgaggaccucuggugcgguucauuaauaggacuaucaagccgugcuacgugggccaaaaauauacauacugcgauuacacaagugagaaauuuaauagguaaagaagaauauguagauuauaugccaguaaugaaaagauacucagcaccgucugagucugaaggaguguuguga

SEQ ID NO: 23699 - RNA, 9867 nt, Artificial Sequence
  derived and/or modified CDS sequence (opt6) from DENV-4__JQ513343__SS-prME
aguacgauaaccuuacuuugcuuaauaccuacaguuauggcuuuccaucucaguacuagggauggugaaccucugaugauaguggccaaacaugaaagagguagaccacuuuuguucaaaacaacagaaggaaucaauaaaugcacauuaaucgcaauggauuugggggagaugugcgaagauacaguuacauauaaaugcccauuauuggucaauacugagcccgaagacauugacuguugguguaauuuaacgagcacauggguuauguauggaacuuguacucagucgggugaaagaagaagagagaaaagaucuguagcuuugacuccgcacuccgggaugggguuagaaacaagagcggaaacauggaugagcagugaaggagcguggaaacaugcacaacggguggaaucauggauuuuaaggaacccuggauuugcacuucuagcugguuuuauggcguauaugauaggucaaaccgguauacaacgaaccgucuucuuuguauuaaugaugcuuguagcucccucauaugguaugagauguguuggaguuggaaauagagauuuuguagagggaguauccggaggcgcuuggguugacuuaguacuggaacauggcgguugcguaacaacgauggcccaggguaaaccuacucuagauuucgaacugacgaaaacaacugcaaaagagguugcgcuguuaagaacauauuguauugaggcguuaaucagcaacauaacuacugcuacuaggugcccaacucaaggugaaccuuaccuaaaagaagaacaagaucaacaguauauuuguagacgugauguaguggauaggggguggggaaaugguugugguuuauuuggaaaaggagggguagugacaugugcgaaauucucauguucuggaaaaauaacaggcaaucuuguacaaauagaaaacuuagaauacacaguaguagucacugugcacaauggagauacccacgcuguuggcaacgauacaucuaaccaugggguuacagcuaccaucacaccuagaucuccaagcguugaaguuaaauuacccgauuacggagaauuaacacuagacugugagccacgaagcgggauagauuucaacgaaaugauacuuaugaaaaugaagaagaaaacuugguuaguacauaaacaaugguuucuugaccuaccuuuacccuggacgacaggugcugauacaagugagguacacuggaauuauaaagagcggauggaaacuuucaaaguaccacaugccaaacgccaggauguaacuuugcugggcagccaagaaggagccaugcacagugcacucgcgggagcuacggaaguagauuccggugacgaaaaccauauguucgcuggucauuuaaaauguaaaguccgaauggaaaaacuaagaauaaaaggaauguccuauacaauguguucaggcaaauucaguauagacaaagaaauggccgaaacucaacaugggacuacaguaguuaagguuaaauacgaaggugcuggagcuccaugcaaagugccuaucgagauuagagacgugaauaaagagaaaguggugggaagaguaauaagugcuacuccucucgcugaaaauacaaauucuguaacaaauauagaguuggagccacccuucggugauucuuauauaguaauaggaguuggaaauucugcucucacacuccacugguuuagaaaagggagcaguauaggcaaaauguucgaaucaacauauagaggcgccaaacgaauggcaauacuaggagaaacagcaugggacuucggcucuguaggaggacuguucacaucuuuagggaaagcaguucaccaaguuuuugguagcguauacacaacuauguuugguggaguuucauggaugauacgaauuuuaauuggauuuuugguguuauggauugguacgaauaguaggaauacaucaauggcuaugacuugcauugcaguaggcggcauuacucuauuucugggauuuacaguucaggcagauaugggauguguuguaaguuggaguggaagagaauuaaaaugugggucuggaauuuuuguagucgauaacguucacaccuggacggagcaguacaaauuccaaccagagucuccggcccgacuggcaucugcaauauuaaacgcacauaaagacggaguaugcgggauacggucaacaacacgacuggagaauguaauguggaagcagauaacaaaugagcucaauuauguacucugggaaggcggacacgacuugacgguuguugccggagauguuaaaggaguauugaccaaagguaagagagcuuuaacgccaccagcaagcgacuuaaaauauucguggaaaacuuggggaaaggcgaagauuuuuacucccgaggcgcgaaauaguacuuuucuaauugacggaccugacacuucggaaugccccaacgagagacgagcauggaacucauucgaggucgaagauuauggauuuggaauguucaccacaaacaucuggaugaaguucagagaaggaaguuccgaaguuugugaucauagacuaaugagugcggcgauuaaagaucagaaggcaguacacgcagauaugggcuauuggauugaaagcagcaaaaaucaaacauggcaaauagaaagggcaucuuugauugaaguaaagacgugcuuauggcccaagacacauacauuguggagcaacggagugcuugagucacagauguuaauuccuaaaaguuacgcggggccguucagccaacacaauuaccgccaaggauaugcuacacaaacagugggacccuggcaucuuggcaaauuggaaaucgauuucggugagugccccgguaccacggucacaauccaggaaaacugcgaucauagggguccuaguuuacguacaacuaccgcuagcggaaaacucguuacacaaugguguugcagaagcugcacaaugccucccuuaagauuucucggcgaagauggguguugguaugguauggaaaucagaccuuugucagaaaaggaagagaauauggugaaaucacagguaacagcuggacagggaacgagugaaacguucagcaugggauuguuaugccugacacuauuuguugaggaauguuuacguaggagggugacaagaaaacacaugauauuagcagucgucauaacuuuaugcgcaauuauauuggguggacuuacauggauggaucuauuaagagcauuaaucaugcuaggugacacgaugaguggcaggauuggaggacaaacacaccucgcgauuauggcaguauuuaaaaugagucccgguuauguacucgguguguuucucagaaagcugaccucgagagaaacagcucuuauggucauaggcauggcuaugacgaccacguugucaauuccacaugaucucauggaauuaauagauggaaucaguuuaggucuaauacuacuuaaaauuguaacacaauucgauaauacucaagugggaacacucgcauugagucuaacauuuaucaggucaacuaugaguuuagucauggcauggagaacgauaauggcagugcuauuuguggucacacugauaccucuuugccgcaccuccugcuuacaaaaacaaagucauuggguggaaauaacagcucuaauacuuggggcucaagcucucccaguuuauuuaaugacucuuaugaagggcgcuaguaggcgcucauggccucucaaugagggaauaauggcgguaggcuuagugucuuuacuugguuccgcuuuauuaaagaaugaugugccacuugcuggccccauggucgcgggcgguuuauuacuggccgcauauguuaugagcgggucuagcgccgauuuaucucucgaaaaagcggcaaacguccaaugggacgaaauggcugacauuacgggaaguucuccuauuaucgaggucaaacaggaugaagauggcucauuuuccauccgcgaugucgaggaaacuaauaugauaacucuacuuguuaaauuagcucuuauaaccguaucuggguuauauccacuugccauuccgauaaccaugacacucugguauauguggcaaguaaagacacaacggagcggcgcucuuugggacgucccaagccccgcugccacucaaaaagcugcucuuucugaaggaguauaccgcaucaugcaaagaggacuuuucgguaaaacacaaguaggugucgguauucauauggaaggaguauuccacacgauguggcauguaacaagagggagugucauaugucaugaaacgggcagguuagaaccaucaugggcagacgugagaaaugauaugauaucauauggcggcgguuggagauuaggagacaaaugggacaaagaagaagacguucaaguacuugcuauagagccggguaaaaauccuaaacacguacagacuaaaccgggucuauuuaaaacccucacaggagaaauaggagcaguaacccuagauuucaaaccuggaacuagcggcaguccuauuauaaauaggaaagguaaaguaaucggacuguaugguaacggugucguaacaaaaaguggggauuaugucucagccaucacacaggccgagcgcaucggagagccugacuaugaaguggaugaggacauuuucaggaagaaacgguugacgauaauggauuuacacccgggagcugggaaaacaaaaagaauauuaccaucuauaguccgagaagcacugaaacgccgccucagaacacuuauucuggcgccuacaagaguggucgcagcagaaauggaggaggcacuacguggacugccaaucagauaucaaacgcccgcuguaaaaucagagcacacaggucgagaaauugucgacuuaaugugucaugccaccuucacaacucgcuuacugaguucuacaagggugccuaauuauaauuuaauagugauggacgaagcgcauuuuaccgaucccucaaguguagcggcacgagguuacauaaguacacguguagagaugggcgaagcugcagccauauucaugacagcuacaccuccaggagcgacagacccauuuccccaaucaaacucuccuauagaagauauagagcgagaaaucccagagaggucauggaauacugguuuugacuggauaacagauuaucaaggaaaaacagucugguucguuccuucaauuaaagccgguaaugacauugcuaauugcuuacgaaagucaggcaagaaaguaauacagcuaucacgcaaaacauucgauaccgaauacccuaaaacuaaacuaacugacugggacuuugugguuacaaccgauauauccgagaugggugcgaauuuucgagcuggacgaguuauagauccacgaaggugucugaaaccggugauacuuaccgauggaccagagagagucauacuugcgggaccuauaccuguuacgccagcgagcgcggcucaaaggagagguaggauaggucgaaauccagcacaagaagacgaucaauaugucuucagcggugauccauugaagaaugaugaagaccaugcacauuggacagaagcaaagauguuacuagauaauauauauacgccugaagggauaauaccgacucuuuuugggccagaacgagagaaaacucaagcuauugauggagaauuucgacucagaggggaacaacgcaagacguucguagaacucaugagaagaggagaucuuccuguuugguugagcuauaagguugcuucagcaggaauuucauauaaagaucgggaaugguguuuuacaggagagagaaauaaucagauuuuagaagagaauauggaaguagaaauauggacacgcgagggggagaaaaagaaacugcgcccaaaauggcuagaugcgagaguauacgcugaccccauggcacuuaaagacuuuaaggaauuugcuuccggucgaaagaguauaacacuggauauauugacagaaaucgcgucauuaccuacauaccuuucuaguagagcuaaguuagcgcuagacaauauagugauguuacacacaacggaaagaggaggcagagccuaucaacacgcacuuaaugaauuaccagaaagccuagaaacuuuaaugcuaguugcgcuuuugggagcaaugacggcagggauauuuuuauucuuuaugcaggguaaaggaauaggaaaauuaagcaugggacuaauaaccauagcuguagcaagcgguuuacuauggguagcugaaauacaaccacaauggauugcagcaucuauuauacuagaauuuuuccucaugguguuguuaauuccugaaccggaaaaacagcgaacaccgcaagacaaccaauuaauauauguaauauuaacaaucuuaaccauaaucggcuugaucgcugcuaacgaaaugggccugauagaaaagacaaaaacagauuuugguuucuaccaggucaaaacagaaacgacaauacucgaugucgauuuaagacccgcuagcgccuggacgcuuuaugcuguugcaacaacaauccugacaccaauguuaagacauaccaucgagaacacaagcgcaaaucuuagccuagcagcgaucgcaaaucaggcagcgguacucauggggcuagggaaaggauggccccuccauagaauggaccuuggaguuccacugcuagcaaugggaugcuauucucagguaaauccaaccacucuuacagccucguugguuaugcucuuaguacauuacgccauaauagggccuggauuacaagcaaaagcuacgagagaagcacagaagcgcacagcagcagguaucaugaaaaacccgacagucgacgguauuacagucaucgaccuagaaccaauuucauaugauccgaaguuugaaaaacaauugggccaagugauguuacuuguucucugcgcuggacaguuauuacuuaugaggaccaccugggccuuuugugaggucuuaacccuugcaacaggaccaauacuaacacugugggaaggaaacccaggacgguucuggaacacgacgaucgcagugucgaccgcaaacauauuucgcgggagcuaucuggcaggagcuggucuggccuuuagucuuauuaaaaaugcgcaaacaccucgaagaggcacuggaaccacaggagagacacuaggagagaaauggaaaagacaauuaaacucgcuggauagaaaagaguucgaagaguauaagaggucaggaauauuagaaguagaucggacugaagcaaaaucagcacuuaaggacggaagcaaaauaaaacaugcgguuucacgggguucaucaaaaauucgcuggauaguggaacgaggcaugguaaaaccaaaagguaaaguaauagaucuaggaugugggagaggugguuggaguuauuauauggcgacacucaaaaauguuacggaaguaaaaggauacaccaaaggagguccuggacacgaggaaccaauuccaauggcgacauaugguuggaaccuaguaaaauuacacagcgguguagauguauuuuauaagccgacagaacagguagauacgcuucucugugacaucggggagagcaguucuaauccaacuauagaggaaggacgaaccuuacgaguacuuaagaugguagaaccuugguuaaguucaaaaccugaauuuuguaucaaaguccuuaacccguauaugccuacagugauugaggaguuagaaaaauuacagaggaaacauggcgggaaccuugugagaugcccacucucccguaauaguacacacgaaauguauuggguaagcggugcgagugggaauaucguuagcucaguuaacaccacaagcaaaauguuacucaacagauuuacaacaagacacaggaaacccacauaugaaaaggauguggauuuaggggcggggacuaggucagucuccacagaaaccgaaaaaccugacaugacuauuauaggaagacgauuacaaagacuucaggaagaacacaaagagacauggcauuaugaucaagaaaacccauacagaacuugggcauaucauggaaguuaugaagcuccgucaacgggaucagcgaguucgaugguuaauggaguugugaaacugcuaacuaaaccgugggacguuauuccuaugguuacgcaacuagcaaugacugauacaacgccuuuuggucaacaaagaguauucaaagaaaaagucgauacucgcacaccacagccaaagccaggcacacgaaugguaaugacaacuacggccaacuggcuuugggcgcuucuagguaagaagaaaaauccucgacuuuguacaagagaggaauuuaucagcaaaguacgcucaaaugcagccauaggcgccgucuuccaagaagaacaagguuggacaucagcuagugaagcagugaacgacucaagauuuugggaauugguagacaaggaaagagcacugcaucaagaaggaaagugcgaaaguuguguguauaacaugauggggaagagagagaagaaauuaggagaauuuggacgugcuaaaggaucgagggcaauuugguacauguggcuaggugcaagguuucuagaauuugaggcguugggguuccuuaacgaggaucauugguuugggagagaaaauaguuggaguggaguugaaggagaggguuuacauagauuaggguauauuuuggaagaaauagauaaaaaggauggagacuuaauguaugccgaugauacagcuggaugggauacaagaauuaccgaagacgauuuacaaaaugaagaauuaauuacggaacagauggcaccccaccauaaaauauuggcaaaagccaucuucaaauuaacauaccaaaacaaaguaguaaagguacuacgaccaaccccacgaggagcggucauggauauuauaaguaggaaggaccagcgggguucaggccaaguaggaacuuacggacugaacacauuuaccaacauggagguacaacuaauacgucagauggaggcggagggcguaauaacacaagaugauaugcaaaacccuaagggacuaaaggaaagagucgaaaaauggcuacgugaaugcggaguagauagguuaaaaagaauggcaauaaguggagacgacuguguaguuaaaccacuagaugaaagauuuggaacaucuuuauuguuucuaaaugacauggggaaaguccgcaaggacauaccacagugggaaccaucuaaaggcuggaagaacuggcaagaaguccccuuuugcagccaccauuuucauaagaucuucaugaaggacggcaggaguuuagugguaccgugcaggaaucaggaugaauugaucggccgagcaagaauaucacaaggcgcuggcuggucucugagagaaacugccugccucgguaaagccuaugcccagauguggagccuaauguacuuucacagacgugauuuaagacuggcuucuauggcaaucuguucagcuguaccaacagaaugguuuccaaccucccggacuaccuggucaauucaugcccaucaccaauggaugacaacagaggauaugcuaaaaguauggaauagaguuuggauagaagauaauccaaauaugauagauaaaacuccuguccacuccugggaggauauuccauaccuaggaaaaagagaggacuuauggugcgggagcuugauagguuuaucuuccagggcuacuugggccaaaaauauacacaccgccaucacccaagugcgcaacuuaauagggaaagaagaauacguagacuauaugccagugaugaaacgguacagcgcaccuucagaaucugaaggugugcucuaa

SEQ ID NO: 23700 - RNA, 9867 nt, Artificial Sequence
  derived and/or modified CDS sequence (opt6) from DENV-4__KT276273__SS-prME
ucgacuauaacuuuauuaugccuuauaccaaccgucauggcauuucacuugagcacuagagacggugaaccauuaaugauaguggcaaaacaugaaagagguagaccauuacuauuuaaaaccacagaagguauaaauaaaugcacccuaauagcuauggacuuaggagaaaugugugaagauaccgucacauacaaauguccacuucugguuaauacugagccagaagacauagauuguugguguaaucuaacaaguacguggguuauguauggaaccugcacacagucaggagagcgaaggcgcgagaaaagaaguguagcacucacgccucauuccggaaugggauuggaaacgagagcggaaacauggaugaguagugaaggagcuuggaaacacgcgcagagagucgagucauggauauuacgaaauccugguuucgcuuuacucgcagguuucauggcauacaugauaggacagacagguauacagcggacaguauucuuuguguuaaugaugcuuguugcuccuaguuacggaaugcguuguguuggagucgggaauagagauuuuguagaagguguuagugguggagccuggguugaucuaguuuuagaacauggaggaugcguaacuacaauggcccaaggaaggccuacccuagauuucgaguuaacuaaaacgacugccaaagagguugcuuuacuaagaacguacugcauagaagcaaguauaagcaauauaacgaccgccacccgaugucccacucaaggugaacccuauuuaaaagaagaacaagaucaacaauacauuuguagaagagacguaguugacagaggauggggaaacggauguggucuguucgguaaaggagguguaguuacaugugcaaaauuuucauguagugguaaaauaacuggaaacuuaguacaaauugaaaaucuagaauauacaguaguggucaccguacacaauggggacacccaugccguagguaacgauacauccaaucacggaguaacugcaaccauaacgccaagaagcccaaguguagagguugaacucccagauuauggagaauuaacacucgauugugaaccucgaucagguauagacuucaaugaaaugauauugaugaaaaugaauaagaaaacaugguuaguucacaagcagugguuucuugauuuaccgcuaccauggacagccggagcugauaccucagaaguacauuggaauaauaaagaacggaugguuacuuuuaagguaccccaugcuaaaagacaagauguuacgguguugggcucgcaagagggggcaaugcacagugcucuagcaggagcaacagaaguugacucuggagaugguaaucauauguucgcuggacaucuuaaauguaaagugagaauggagaaacuacggauaaaaggaaugucuuacacuaugugcucagguaaguucagcauagauaaagaaauggcagaaacacaacacgggacaaccgucguaaaaguuaaguacgaaggagcuggugcgcccugcaaaguaccgauugaaauuagggauguaaauaaagaaaaaguaauagggagaguuauaucgaguauaccucuagcugaaaauacuaacucaguuaccaacauagaacucgaaccgccuuucggagauucauauauaguaauuggagugggaaauagcgcacuuacacuacacugguuuagaaaaggaaguaguauaggaaagauguuugaaucaaccuaccgaggugcaaaacggauggcuauauugggugaaacagcuugggacuuugguucaguaggaggacuuuuuacaagucuaggaaaggcagugcaccagguauuuggaucaguauauacgacuauguuuggcggaguguccuggaugauaaggauucuaauaggcuuuuugguccuauggauaggcacuaauucacgaaacacaaguauggcuaugacaugcauugcgguaggcgggauuacacuguuccugggguuuacgguacaggccgacauggguugcguuguaaguugguccgguagggaauuaaaaugcggaucggggauuuuuguaauagacaauguacacacauggacugaacaauauaaauuccaaccugaaucgcccgcaagauuagcauccgcuauucuaaacgcacauaaagacggaguuugcgguauaagaucaacgacgagauuggaaaauguaauguggaaacaaaucacaaaugaauuaaauuauguucuuugggaagggggacacgaucuaacagugguagccggcgacguuaagggcguccucaccaaaggcaaaagagcauuaacaccuccagcaagugaucuuaaauauagcuggaaaacguggggaaaagccaaaauauucacaccagaagcacguaauucgacguuucuaauugacgguccagauacgucagagugucccaaugaacggcgugcauggaacucuuuggaaguugaagacuauggguucggcauguucacuaccaauauauggaugaaguuuagagaaggaucgucggagaugugcgaucacagguuaaugucugcagcuauaaaagaucagaaagccguacaugcggacaugggauacuggaucgaaucuaguaaaaaccaaacauggcaaauugaaaaagcaucccuaauugagguaaaaacaugucuguggccuaaaacacauacacuuuggagcaauggaguacuugaaucacaaaugcuaauaccaaaaucuuaugccgggcccuucagucaacacaacuaucgucagggguaugcaacacaaaucgcagguccauggcaucuuggaaaauuagaaaucgauuuuggagaauguccugguacaacgguuacuauccaggaggauugugaccaccguggaccaucacugagaacaacuacggcgagcggcaagcuaguaacccaaugguguuguagaucauguacgaugccaccauuaagguuuuuaggugaagacggguguugguaugggauggagaucaggccauuaagugaaaaggaagaaaacaugguuaagagucaaguugcugcaggacaaggaaccucagagacuuuuucaaugggauuacuuugccuaacauuguucguagaggaaugcuuacgucgucgaguaacucguaagcauaugauauuaguuguggucauaacauucugugcuaucauucugggaggacuaaccuggauggaucucuuaagagcucucaucaugcugggagauaccauguccggacguauaggaggacaaauacaucucgcaauaauggccguauuuaagaugucuccugguuauguucuuggaguauuuuuacggaaacuuacaagcagggaaaccgcacuuauggucauuggaauggcaaugaccaccguuuugaguauaccuuacgaucucauggaacucauugacgguaucagcuuaggucuaauauugcuuaagauagugacucaauuugacaacacucagguuggaacauuagcguuaucauugacuuuuauucgcuccacuaugccauugguaauggccuggcguacgauuauggccguacucuuuguaguaacccuaauaccauuguguagaacuucaugccugcaaaaacaaucucacuggguagaaauaacagcuuuaauccucggcgcucaggcuuugcccgucuaccuuaugacuuuaaugaaaggagccagcagacgaagcuggccuuuaaaugaaggaauuauggcgguaggacucguuucgcuucuuggaucagccuuauugaaaaacgacguaccgcuagcaggacccaugguugccgguggccuguuauuggcggcauacguuaugucuggauccucggcagauuugucguuagaaaaagcagcuaaugugcagugggaugagauggccgacauaacuggauccucgccaauuauagaaguaaaacaagaugaagacggcagcuuuucuauacgugacguagaagagacuaauaugaucacguugcuuguaaaacuagcgcucauaacaguuagcggucucuacccgcuagcaauuccgguuaccaugaccuuaugguauauguggcaaguuaaaacacagcgcaguggugcacuaugggacguaccgucgccagcagccacacaaaaagcagcacuaucugaagguguuuaucguauaaugcaaagggggcuauuuggaaaaacacaaguaggaguggggauacacauggaaggcguuuuccacaccauguggcacgucaccagagguucgguaaucugccaugaaacuggaagacucgaaccguccugggcggauguuaggaaugauaugauuucuuauggaggugguuggagguuaggagauaaaugggauaaagaagaagacgugcaagucuuagcuauagaacccggcaaaaacccuaaacauguacagacuaaaccaggacucuuuaaaacgcuaacaggugagauuggagcaguaacacucgauuucaaaccgggaacgagcggcucgccuauuauuaauagaaaagguaaagucauaggauuauacgggaacggaguaguaacgaaaucaggcgauuacguaagugcaauaacgcaagcggaaaggaucggagagccggauuacgagguggacgaagauauauuuagaaagaaacguuugacaauaauggacuugcauccuggagcagggaagacaaaaaggauucuacccucaauugugagagaagcgcuaaaaagacgguuacguacccucauuuuggcaccgacacgcguaguugcggcggaaauggaagaggcguuaagaggauuaccaauaagguaccagacuccagcaguaaaauccgaacauacuggaagagagaucguagaucucaugugccaugcaaccuuuaccacucgacuauugucuagcacaagagugccaaauuacaaccuaauuguaauggaugaggcccauuucacagauccuagcucuguagccgcuagaggauauaucaguacacgaguagaaaugggagaagcagcugcgaucuuuaugacggcuacucccccaggugcuaccgauccuuucccgcagucuaacucacccauagaagauauugagcgugagauaccugaacggagcuggaacacuggcuuugacuggaucacagacuaucaaggaaagacugugugguuugucccauccauuaaggcugggaaugauauugcaaauugucugagaaaaaguggcaagaaaguaauacaacuaagcaggaaaacauucgacacagaauacccaaaaacaaaacucacggacugggauuucgugguuacaacugacauaucggaaaugggagcaaauuuuagagcaggaagggucauugauccucggaggugcuuaaagccaguaauauugacagauggaccugagcgagucauucuggcgggacccaucccuguaacaccagcauccgccgcacaacgaagagggcgaaucggcagaaauccugcacaggaggaugaccaauauguauuuuccggagacccucucaaaaaugaugaagaucacgcccauuggacagaagcaaaaaugcuacuagauaauauauauacaccugaggguauaauuccuacacuguuuggaccggaaagagagaaaacccaagcgauugacggagaguuuagauugagaggggaacaaagaaaaaccuuuguagaauugaugagacgaggggaccugcccgucugguuaucauacaaaguagcaagcgcaggcauaucauauaaggaccgagaguggugcuucacaggggaaaggaacaaccaaauacuugaggagaauauggaaguagaaauuuggaccagagagggagagaaaaagaaauugagaccccgaugguuggacgcacgaguauaugcggacccaauggcccuuaaagacuuuaaagaauuugcuagugggcgaaaaucuauuacuuuagauauauugacagagauagccagcuuaccuacuuauuugagcucaagagcgaaacuugcccuggacaacauagugauguuacauacuacggaacgcggaggccgugcauaucaacaugcuuuaaacgaauuaccugaaucgcuugaaacauuaauguugguagcuuugcuuggggcuaugacagccggaauauuucuauucuuuaugcaaggaaaaggaauuggcaaacuaucuaugggacuuauaacuauugcgguagcaucaggacugcuauggguugcagaaauacagccccaauggaucgccgccagcauaauuuuggaauuuuuccuuaugguucuuuugauaccggagccagaaaaacaacgaacaccccaggauaaccagcuaaucuaugugauccucacaauccugacaauaaucggucuaauagcagcaaacgaaaugggguuaaucgaaaagacaaaaacagacuucggauucuaucaagucaaaacagaaacaacgauacuagacgucgacuuacgaccagcuucugcguggacucuauaugccguggccaccaccauauuaacgcccauguuaagacauacaauagaaaacacuucugcaaauuugagcuuagcugcaaucgccaaccaagcugcaguguugauggggcucggaaaggguuggccauuacacagaauggaccuaggaguucccuuacuugcgaugggcugcuacucacaagugaauccgacgacguugacugcauccuuaguaauguuacucguccauuacgcaaucauagguccgggacuucaagcaaaagcaacuagagaggcacaaaaacguacggcugcuggaauaaugaaaaauccuacuguggacgggauuacgguuaucgaccuggaaccaauaucauaugauccaaaauuugagaaacaauuaggucagguaaugcuacugguccuuugcgcuggacaacugcuauuaaugcgaacuacgugggcauucugugaaguuuuaacauuagccacaggaccuauacucacacuaugggaggguaacccgggaagauuuuggaauacaacaaucgccgugucaacugcaaacauuuuuagaggaaguuacuuagcaggggcaggucuggcguuuucacucaucaaaaaugcacaaacaccaagacgagggacaggcacaacaggggagacacuaggagaaaaauggaaaagacaacuaaacucuuuagacagaaaagaauuugaagaauauaaaagaucaggcauucucgaggucgacagaacagaagccaaguccgcauuaaaagacggaagcaagauaaaacaugcagucuccagggguaguucaaaaauucguuggaucgucgaaagaggaaugguuaaaccgaaaggcaaaguaguagaucuaggaugcggaagaggaggguggaguuauuauauggcgacuuugaaaaacguuacagaaguuaagggguacacuaaggguggcccaggccacgaagaaccgauucccauggcaacauacggcuggaaccucguaaaacuucacagcggaguugacguguuuuauaagccaacugaacaaguagacacacuccuaugcgacauaggcgaauccaguaguaacccaacuauugaagaaggacguacucuucgaguacuuaaaaugguagaaccuuggcuaucgucaaaaccagaauuuuguauuaagguacuaaacccuuacaugccaaccguaauugaagaauuagagaaguuacaacggaaacauggugguaauuuaguucgaugcccguuaucgagaaacucaacccacgaaauguauuggguaucuggagcuucaggaaauaucgucucaucuguaaacacuacaucaaaaauguugcugaacagauucacaacuagacauagaaaaccgaccuaugaaaaagacgucgauuuaggggcaggcacaagguccguaaguacggagaccgaaaagccagauaugaccauaaucggcagaagacuucagagauuacaagaggaacacaaggaaaccuggcauuaugaccaagaaaauccguaucgaaccugggcuuaccacgguagcuacgaagcaccaagcaccggaagcgccucguccaugguaaauggagucguuaaauuauuaaccaagccgugggauguaauaccgaugguuacccaauuggcaaugacggauacgacuccguucggacaacagagaguguucaaagaaaagguagauacucgaacuccgcaaccgaaaccuggaacacgaaugguaaugacaaccacagcaaacugguugugggcauuguuaggcaagaagaaaaacccccgauuaugcacaaaggaagaguuuauaucgaaagugcgagccaaugcagcgauuggagcagucuuucaagaagaacaaggguggaccagugcaucagaagcaguuaaugauucucgauucugggaacuuguagauaaggaacgagccuugcaucaagagggaaagugcgagucgugcguguauaauaugaugggaaagagagagaagaaauugggugaauuugguagagcaaagggguccagagcgaucugguauauguggcuaggugcaagauuuuuagaguuugaggcuuugggauuucugaaugaagaucacugguucggccgugaaaauucuuggucuggggucgaaggggaggggcugcacagacuuggauacauucuagaggagauugauaaaaaggauggagauuuaauguacgcagaugauacugcuggaugggauacuaggauaacagaagaugauuuacagaaugaggaacugauaacggaacaaauggcuccccaucauaagauccuggcaaaagcaauauuuaaacuaacauaucaaaauaaggucguaaagguacuccgucccacaccccgaggcgcgguuauggacauuauuucaagaaaggaucaaagaggcagcggccaagucggaaccuaugggcuuaauacuuuuacgaauauggaagugcaacucauuagacaaauggaagcagagggaguaauaacacaggacgacaugcagaaucccaaagguuuaaaagagcgaguagaaaaauggcugcgagaauguggugucgauagacuuaaacguauggcgauuaguggagaugauugcguaguuaaaccccuagacgaaagauuugccacgucauuauuauuuuuaaaugauauggguaaagucagaaaagauauaccucaaugggaacccucaaaaggauggaaaaacuggcaggaagucccuuuuuguucucaccauuuucacaaaaucuuuaugaaagauggacgaagccuagucgucccaugccguaaccaagaugaauuaauaggaagggcaagaauuagccaaggagcaggauggagccugaaagagacagcauguuuagcaaaagcauacgcucagauguggucccuuauguacuuucauaggcgcgaccuaagacucgcgucaauggcaauuugcagcgcugucccuacagaaugguuuccaaccagucgaacuacauggucuauacacgcacaccaucaauggaugacaacugaagauauguuaaaaguauggaaccgaguauggauagaggauaauccgaauaugauagauaaaacaccgguucacucaugggaagacaucccauauuuggguaaacgagaagaucuaugguguggcagcuugauuggccucuccuccagagcaacaugggccaaaaauauucauaccgcuauaacucaggugcgcaaucucauugggaaagaagaguacauggauuacaugcccguuaugaggagauauucagcaccaagugaaucugaagggguucuuuaa

SEQ ID NO: 23701 - RNA, 9867 nt, Artificial Sequence
  derived and/or modified CDS sequence (opt6) from DENV-4__KU523872__SS-prME
aguacgaugacuuuacuuugucuaauacccacugucauggcauuucauuuaucaacuagagacggagaaccuuuaaugauugucgcgaaacacgaacgaggcagaccacuacuauuuaaaaccacagaagguauaaacaaauguacauuaauagcgauggaucuuggcgaaaugugugaagauacaguaacuuauaaaugcccccuauuaguaaacacagaaccagaagauauagauugcuggugcaaccuuacaucaacauggguaauguauggcacuugcacucaaaguggagagagaagaagagaaaaacgauccguagcacuaaccccucauuccggaaugggacucgaaacgcgcgcugaaaccuggaugucuuccgaaggagcauggaagcaugcgcagagaguagagucguggauuuuaagaaacccaggauuugcacucuuagccgguuuuauggcucauaugaucggccaaacugggauucaacgaacggucuucuuuguccuuaugaugcugguugcaccaucauacgggaugagauguguaggugucgggaacagagauuuuguggaaggugugucaggaggagcuugggucgaccuaguacuugagcauggugggugcguuacuaccauggcacaagggaaaccuacguuagauuuugaauuaacgaaaacgacggccaaagaaguagcacuucuuagaacauacuguaucgaggcuucgauuaguaacauaacaaccgcaacccgcuguccuacacagggugagccuuacuuaaaagaagaacaggaucaacaauacauaugcagacgagaugucguugacaggggcugggguaacgguugcggucuauuugguaagggcggaguaguaacuugugcaaaauuuucauguucgggaaaaaucacugggaaccuuguucaaauagaaaaccuagaauauacagucguggucacggugcacaauggagauacgcaugccguaggaaaugauacaaguaaucacggagugacagcaacaauaacgccaagaagcccaucaguagaagugaaguuaccagacuacggagaacuuacuuuagauugcgaaccgaggaguggcauagauuuuaaugaaaugauauuaaugaaaaugaaaaagaaaacguggcucguacacaaacaaugguuccuugaucuaccucuaccauggacggcgggugcagauacaagugaaguacauuggaauuacaaggagagaauggugacauucaaagucccccacgcuaaaagacaagaugugacgguccugggcucacaagaaggugcaaugcacagcgcauuagcuggugcaacagaggucgacuccggagacgguaaccauauguucgcuggucacuugaaaugcaaaguaagaauggaaaaacuucgaauaaaaggaauguccuauacuauguguagcggcaaguuuaguaucgacaaagaaauggcugaaacucaacacgggacuacgguuguuaagguaaaguaugaaggagcuggcgccccuuguaaggugccgauugagauacgggauguaaauaaagagaaaguggucggaagaauuauaucaucuacuccuuuugccgagaacacaaauucaguaacgaauauagaauuagaaccgccauuuggagauucauauauagucauagggguuggagacucggcuuuaacacuucacugguuuagaaaaggaaguucuaucggaaaaauguuugagaguaccuaucgaggugcaaaacgaauggcuauucuuggggaaacagcaugggauuucgguucgguaggaggccucuuuacaaguuuaggaaaggcaguucaucaaguauucgguucggucuauacuaccauguuuggaggaguaucauggaugaucagaauauuaaucggauucuugguacucuggaucgggacaaauucgcgcaauacuucaauggcaaugacauguauagcaguaggaggaaucacccuauuccuugguuuuacugugcaagcugacaugggauguguuguuaguuggaauggaaaagagcugaaauguggaaacgguauauuuguuguugauaaugugcauacauggaccgaacaguauaaauuucaaccugagaguccagcacgauuagcaucugcuauuuuaaacgcacacaaggacgguguauguggcauaaggucuacgacuagacuagaaaacguuauguggaagcaaauaacaaaugaguugaacuauguccucugggaaggcggucaugacuuaacaguugucgcaggagacgucaaagguguguuaacaaaaggaaaaagagcauugacaccgccaguuaaugaccuaaaauauucuuggaaaacuugggguaaggccaaaauauuuaccccagaagcccgaaauucaacuuucuuaauugauggucccgauacauccgagugcccuaacgagagacgagcuuggaacuuuuucgagguggaagauuauggguuugguauguuuacuaccaauaucuggaugaaauuuagagaagguagcagcgaagucugcgaucauagguuaaugucugcagccaucaaagaucaaaaagcaguacacgccgauauggguuauuggauagaaucaagcaaaaaucaaacuuggcagauugaaaaggccucguugauagaaguuaaaacuugucuauggcccaaaacacauacauuauggaguaauggcguuuuagagucccaaauguuaaucccaagaagcuacgccggcccauuuucacaacauaauuacagacaaggcuacgcgacgcaaacugcgggaccauggcaucuuggaaaauuagaaauagauuuuggcgaauguccuggcacaacaguaacaauucaagaagauugcgaucacaggggcccaaguuuacgaacgaccacagcaucaggcaaacucguuacacaaugguguugcagaagcugcacgaugccacccuuaagauuuuuaggugaagauggaugcugguauggcauggaaauaagaccccuaagcgaaaaggaagaaaauaugguaaaaagucaaguaacagcaggccaaggcaccagugaaaccuuuaguaugggacuacugugccucacgcuauuuguagaggaaugccugagaagaaggguuacacggaaacauaugaucuuaguaguagugauuacguucugugcaauaauacucgggggucuuacauggguugaccuguuacgugcucuaaucaugcuaggagauacuaugagugggcgaauaggaggucagauccaccuagcaauaauggcuguauuuaaaaugucaccaggguacguguuaggaguauuuuuaaggaagcuaacgucacgggaaacggcauugauggugaucgguauggcuaugacaacagucuucucaauaccacaugauuuaauggaacugauugaugguaucucacuuggucucauacuucucaaaauagugacucauuuugauaacacucaagugggaacgcuggcccuaagccuaacauuuauaagaaguacgacgccucugguaauggccuggcggaccauaauggcaguauucuuuguggucacauuaaucccucuaugccgaacuucgugccuacagaaacaaucucacuggguugaaauaacugcuuuaauacucggagcccaggcacuuccuguauauuuaaugacacugaugaaaggagcaaguaggcgaaguuggccuuuaaaugaagggauaauggccguaggucugguuucuuuauuaggauccgcauugcuuaaaaacgauguaccgcuagcaggaccgaugguugccggugguuuauuacuugcggcuuaugucaugagcggaaguagcgcagaucucucauuagagaaagcggcaaacgugcagugggaugaaauggcugauauuacagguuccucaccgguaauagaaguaaaacaagaugaagaugguagcuucucaauacgcgacgucgaggaaacuaauaugaucacacuuuugguuaaguuggcgcuaauaaccguaagcggacuauacccucuggcuauaccgguaacaauggcaaucugguauauuuggcaagugaaaacacaaagaagcggagcucuaugggacguucccagccccgcagcuacacagaaagcaacacuaagugagggagucuacagaaucaugcaaagaggacucuuugggaaaacacaaguuggaguaggaauacacauggaagggguuuuccauaccauguggcaugucacccgaggauccguaaucugucaugaaaccgggcggcuagaaccuucgugggcagauguccguaaugauaugauaaguuacgggggaggauggaaacuaggagauaaaugggacaaggaagaagacguacagguacuggcaaucgagccuggcaagaauccgaaacacguccaaacgaaaccuggguuguuuaaaacuuuaacaggagaaauaggugccgucacacuagacuucaaaccuggaacauccgggucaccuaucauaaauaagaaaggaaaaguaauaggucuuuaugguaacggaguaguuacaaaaaguggggauuacgugagugcuauuacucaggcagagagaauaggugaacccgacuacgaaguagacgaagacauauuuaggaagaaacgacuaacaauuauggauuuacauccaggagcaggcaaaacuaaacgcauacuuccaaguaucguaagagaggcccugaagcguagauuaaggacauugauacuugcacccacgagagucgucgcugccgaaauggaagaagcacuucgcggacucccaauccguuaccaaacgccagcgguuaaaucggagcauacgggcagagagauagucgauuugaugugccaugccacuuuuacaacgcgauuauuaucuucuacccgcguucccaacuacaaccuaauagugauggaugaagcgcacuuuacugacccguguucaguugcagcucgaggauauauaucuaccagaguagagaugggagaggcagcagcuaucuuuaugacugccacgccuccagggucuauugauccauuuccucaaagcaauucgcccauagaggauauugagcgugagauccccgaaaggucauggaauacaggguuugauuggauaacagauuaccaaggaaaaacagucugguuuguaccgaguauuaaagcuggcaacgauauagcgaacugcuugagaaagucuggaaagagggucauccaauuaucacguaaaaccuuugauacggaauauccaaaaaccaaacuuacagacugggauuucguaguuacaaccgauauuucugaaaugggagcuaauuuuagagcaggacggguuauugacccuaggcgaugucugaaaccuguuauacugaccgauggacccgaaaggguaaucuuagcuggucccauaccuguuacucccgccagcgcagcucaacguaggggccgaauaggacggaauccagcucaagaagaugaucaauauguuuuuaguggcgauccucucagaaaugacgaggaucaugcgcauuggaccgaggcgaaaaugcugcuagauaauauauauaccccugaaggaauaauccccacacuauuuggccccgaacgggaaaagacccaagcaauagacggugaguuuaggcuuaggggcgagcagaggaaaaccuuugucgaguugaugagacgcggugacuuaccuguaugguuaucuuauaagguagccuccgcugguauaucuuacaaagacagagaaugguguuuuacgggcgagagaaacaaccaaauacuugaagaaaauauggagguugaaauauggacuagagaaggcgagaagaagaaauugcguccaaaaugguuagaugccagagucuaugccgacccaauggcauugaaagacuuuaaagaguucgcaucgggaagaaaaaguauaacucucgauauacuaaccgaaauagcaacacuucccacauaucugagcucaaaagccaaauuagcguuagauaauauagugaugcuccauacuaccgaaaaaggagggcgcgcauaucaacacgccuuaaacgaauugccagagagucuggaaacccuaauguugguugcccuacuuggagcgaugacagcaggaauauuuuuauucuuuaugcaaggcaagggaauagguaaacuuucaauggggcucauugcuauagcaguagccucuggauuguuauggguagcugaaauacaaccucaguggauagcagcaucaauuauauuggaguuuuuccuuaugguucuacugauaccugaaccugaaaaacagagaacaccacaagauaaucagcuuauauaugugauccugacuaucuugacaaucauaggauuaguagcagcgaaugaaaugggauugauagagaaaacgaagacggacuuuggguucuaucaggugaagacggaaaccacuauacucgacguagaucuaagaccugccagcgccuggacguuauaugcugucgcuacaacaauucuaaccccuauguuaagacacaccauagagaacacgagugcuaauuuaucgcucgcagcaaucgcgaaucaagcagcaguacuaaugggacuuggaaaaggcuggccacugcauaggauggaucuugguguaccucuacuugcuauaggaugcuauucgcaaguaaauccgaccacguuaacagccagcuuagucauguuauuaguucauuaugcaauaauagggcccggauuacaggccaaagcgacgcgagaagcacagaaaagaacagcugcagguauaaugaaaaauccgacgguugacggaauaacaguuauagacuuagaaccgauaaguuaugauccgaaauuugaaaaacaacuaggacagguaaugcuauugguuuuauguguggggcaauugcuccuaaugaggacaaccugggcauugugugaaguucuuacauuggcgacggggccaauuaugacucucugggaagguaacccaggaagauucuggaauacgacuauagcuguaucuacagcgaauauauuuagaggcucauaucuagccggugcaggauuagcauuuagucuaaucaaaaaugcacagaccccgcgcaggggaacaggaacgacaggugaaacauuaggagaaaaauggaagaggcaacuaaauucauuagauagaaaggaauuugaggaguauaaacgaagugggauccuagaaguggauagaacugaagccaaauccgccuuaagagauggaagcaagaccaaacaugcaguaucaagaggaucgucuaagauaagauggauaguugagagagguaugauuaaaccgaaggguaaaguaguggacuugggaugcggacgcggaggguggagcuacuauauggcuacgcucaaaaacguaacagagguaaaggguuauacuaaaggcggacccgggcaugaagaaccaaucccaauggcuacuuacggauggaaccuaguuaaauugcacucaggagucgacguauuuuacaaaccaaccgaacaaguagauacccuacuaugugacauuggagagaguucgucaaacccaacgauagaagaggggaaaacauuacgaguuuuaaaaaugguugagccuugguuaagcagcaagccggaauuuuguauaaagguguuaaacccauacaugcccacuguuauagaagaacuagaaaaauugcagcgucgacauggcggaaguuuaguucgaugcccuuugagucguaauucaacucaugagauguauuggguuucaggagcaucgggcaauaucguuuccaguguaaauaccauaucaaaaaugcuccuuaauagauucacuacacguuauaggaaacccacuuaugaaaaggauguagaccuaggugccggaacuagaucaguaaguacagaaacugaaaaaccggauaugacaauaauuggucgcagacuacagagguuacgagaagaacauaaagagacguggcauuacgaccaggaaaauccauaccguacaugggcauaccacgguucauaugaggccccaagcacaggaagcgcaucaaguaugguuaacggcguugucaaauuacuaacuaaacccugggaugucgucccaaugguaacacaauuagcgaugacagauacgacaccauuuggucagcagagaguuuucaaagaaaaagucgacacacggacaccacagcccaaaccuggaacaagaaaaauaaugacaacuacugcaaauuggcuaugggcauuacuuggaaagaagaaaaguccuagauuaugcacccgugaggaauuuauuaguaagguccggaguaacgcggcaauuggugcgguuuuucaagaggaacaaggauggacguccgcuagcgaagcugucaaugauucucguuucugggaguuaguagauaaagaaagagcuuuacaccaagaagggcguugcgaauccugcgucuauaacaugauggggaaaagagagaagaaauugggagaguucgguagggcaaaaggaagucgcgcuaucugguauauguggcucggagcgcgauuuuuagaauuugaagcauuggguuucuuaaacgaggaccauugguuuaguagggagaacucguggucuggaguagaaggagaaggacuccaccgauugggauauauacuagaagauaucgacaagaaagauggugaccuaauauacgccgaugacacugcggguugggauacucgaaucacugaggaugaucuucucaaugaagaacucauaacagaacagauggcgccacaccacaaaacgcuagcuaaagcaauuuuuaaacuuacguaucaaaauaaggucgugaaaguucuaaggccgacgcccaagggggcaguaauggacaucaucagccgaaaagaccaaagaggcuccggacagguaggaacauauggauuaaauacguucacaaauauggaagugcaauuaauuagacagauggaggcugaaggcgucauaacucaagacgacaugcaaaauccagaaggcuugaaagagagaguugagaagugguuaaaagaaugugguguggacagacuaaaaagaauggcgauaucgggugacgauugcguggugaaacccuuagacgaacgauucaguacuucacuguuauuucuaaacgauauggggaaaguacguaaggauauuccacaaugggaaccaaguaaaggauggaaaaacuggcaagaagucccuuucugcagucaccauuuucacaaaaucuucaugaaagacgggcgaucauuaguagugcccugucgaaaucaggacgaacuaauuggccgagcgcggauaagucaaggugcaggcuggucuuuaagagaaacugcuugccuggguaaagcauaugcgcaaauguggucccugauguacuuucaucgcagagaucucagacuugcuucuauggcgauauguucugcgguaccgacagaaugguuuccuacaagucgaacuacauggucaauacaugcucaucaccaauggaugacaacugaagauauguuaaaaguauggaaucgggucuggaucgaggacaacccaaauaugacagacaagacaccuguucacucaugggaggacauaccuuauuuaggaaaacgugaagauuuauggugugggaguuuaauuggacuuaguucccgagcaaccugggccaaaaauauacauacagcaauuacgcaaguuagaaaucuaauagguaaagaagaguauguagauuauaugcccgcuaugaagagguacucugcaccuuucgaauccgagggagucuuguga

SEQ ID NO: 23702 - RNA, 9867 nt, Artificial Sequence
  derived and/or modified CDS sequence (opt6) from DENV-4__KP140942__SS-prME
uccacaauuacauuguuaugucuuauuccaacagugauggcauuucaccuuucaaccagagauggggaaccucuaaugauuguugcuaaacaugaacgaggcagaccccuucuauucaaaacaacagaaggaauaaauaaauguacacuuauagcaauggauuugggcgaaaugugugaagauaccgugacguauaaaugcccccucuuagucaauacggaaccagaagauauagacugcugguguaaucuaacgaguacauggguaauguacgguacaugcacucaaucaggagaaagaagaagagaaaaacgaagcguagcacuuacaccucauucagggaugggguuggaaacaagagcugaaacuuggaugagcagugaaggagcguggaaacacgcgcaacgagucgaaucauggauacugcguaauccaggcuuugcacuucuugcgggcuuuauggcuuauaugaucggacaaacagguauccaaagaacugucuucuucguauuaaugauguuaguagccccuucguauggaaugaggugcguugguguuggaaacagagacuuuguagaaggaguuagcgguggggcaugggucgaucuuguccuugaacauggaggauguguuacaacaauggcccaaggacgacccaccuuagacuuugaacuaacaaaaacuacagcuaaagaaguugcacuuuugcgaacauauugcauugaagcaucuauuucuaacauaaccacggcuacuagauguccaacccaaggagaaccauacuuaaaagaagaacaagaucaacaauauauuuguagaagagauguuguagaccggggcugggggaaugguuguggacuuuucggaaaagguggagugguaacaugugcuaaauucucuuguucugguaaaauuacaggaaaucuaguacaaauagaaaauuuagaauacacaguaguagucacaguacacaacggugauacucacgcugucggaaaugauacgaguaaucacggcguaacagcaacaaucacaccaagaagcccuaguguugaagucgaauuacccgacuauggcgaauuaacucuggacugugaaccacgaaguggaauagauuuuaaugaaaugauauuaaugaaaaugaacaagaaaacauggcuaguucacaaacagugguucuuagaccuaccacuuccuuggacagccggagcagauacuucugaaguacauuggaauaacaaagaacgaauggugacauucaaaguuccccacgcuaaaaggcaggacgucacugugcucggaucccaagaaggggcuaugcacucagcccuggccggugcuaccgaagucgauucaggggauggaaaccauauguucgcaggucacuugaaaugcaaagucagaauggagaaguuacgaauaaaggguaugaguuacacgauguguucgggcaaauucucaaucgacaaggaaauggcagaaacccaacauggcacaacuguagucaaaguaaaguaugaaggggcuggagccccuugcaaaguaccuauagaaauaagagauguuaauaaggaaaaaguuauugggagaguaauuucaucaauuccgcuagcugaaaacacaaauucaguaacuaauaucgagcuagaaccaccguuuggcgauaguuauauaguuauaggcguagguaauagcgcccugacucuacauugguuccgcaaagggaguagcauaggaaaaauguucgaaucaacguaccgcggagcaaagcguauggcaauuuugggggaaacagcaugggacuuuggauccgugggaggucuauucaccucguuagguaaagcuguccaucaaguguuugguaguguauauacaacaauguucgggggagucucauggaugauacggauucuaaucggauucuuagucuuauggauuggaaccaauucgagaaacacauccauggcgaugacauguauugcaguugguggaauaacguuauuuuuagguuuuacagugcaagcggauauggguuguguaguuuccuggaguggcagagagcuaaaaugcggaucaggaauauuuguaauugauaacguacauacauggacagaacaauacaaguuucagccagaaagccccgcgagauuggcaagcgcuauacucaaugcucacaaggaugggguaugcgguauacgaucgacaacaagauuggaaaaugucauguggaaacagauaacaaaugaguuaaacuacgugcugugggaaggaggucacgauuuaacugucgucgccggagacguuaaaggugucuuaacaaaagggaagagagccuuaacacccccugcaucugauuuaaaauacaguuggaaaacgugggguaaagccaagauuuuuacacccgaagcaagaaacucuacuuucuuaauagacggaccugacacaucagaauguccuaaugagcgucgagccuggaacucguuagaaguugaggauuacggcuuugguauguucaccacaaauauauggaugaaguuuagagaggggagcagugaaaugugcgaucauagauuaaugagugcagcgauaaaagaucagaaggcgguacaugcggacaugggauauuggauugagaguucaaagaaucaaacuuggcaaauagaaaaggcuucuuugaucgagguaaaaacgugucucuggccgaaaacgcacacauuaugguccaauggggugcuagagagucagauguugauaccuaaaucuuaugcaggcccauucucgcaacauaacuauagacaagguuaugcaacacagauagcuggaccguggcaucuugggaaauuggagauagauuucggagaaugccccgguacaaccguaacuauccaagaggauugugaccauagaggucccucccuacgaacaacuacugccucuggaaaacucguaacacaaugguguuguagauccuguaccaugccucccuugcgcuuuuuaggagaagacggguguugguacggaauggaaauaaggccucuuuccgagaaagaagagaauaugguaaaaagucagguggcagccggucaaggcacaucagaaaccuucucgaugggcuuacuaugucucacucucuucguugaggaaugccuucgcaggcgugugacacgaaaacacaugauacuggccgugguuauaacgcucugugcaauuauucuagguggcuugacuuggauggauuuguuacgcgcgcuaauuaugcugggugauacaaugucagguagaaugggaggucagacucaucuagcuauaauggcgguuuucaaaaugaguccuggauauguucuagguguauuccuucgaaaacuuacuucccgagagacagcccucaugguaauaggcauggcaaugacaacuacauugaguauaccgcacgacuuaauggaauuaauugaugguaucagcuuagguuugauacuacuuaaaaucguuacccaguucgacaauacgcagguaggaacuuuagcauugagccuuacauucauuaggucuaccaugucuuuaguaauggcguggcgcacaauuauggccguuuuauucguagugaccuuaauuccccuauguagaacaucuuguuuacaaaaacaaucucauuggguugaaauaacagcacuaauacucggagcucaagcacuacccguauauuuaaugacccuaaugaagggugcuucaaaaagaaguuggccccucaacgaggggauaauggcugucggucucguuucgcugcuagggucagcacuacugaaaaacgacguccccuuagcggggccaaugguugcugguggauuauugcuagcugcuuaugugaugucggggucgucugccgaucuuagucuagagaaagcagcgaacguucaaugggaugaaauggcugauauaacugguucuagcccaauaauagaagugaaacaggaugaagaugggagcuuuucaauuagggauguagaagaaacaaauaugauuacacuauuaguuaaacuggcguuaauuacgguaagugggcuguauccguuagcuauaccagugacgaugacacuaugguauauguggcaaguaaagacacagcgcaguggugcacugugggauguacccucaccagcugcuacacaaaaggcagcccugagcgaaggaguauacaggauuaugcaaagaggauuauuuggaaaaacucaaguagggguaggaauacacauggaaggaguauuccacaccauguggcauguuacgcgcgguucuguuauaugucaugaaacaggaagguuggaaccaucaugggcugaugucagaaaugauaugauuaguuaugguggugguuggagacucggggauaagugggacaaagaagaagauguccagguucuggcuauagagccggguaaaaauccaaagcacguacagacaaagccagggcuauuuaaaacgcuaacgggagaaaucggagcaguaacccuugauuucaaaccuggcacuucuggaucgcccauuauuaaucggaaagguaaaguaauaggccucuauggaaacgguguaguaaccaaaaguggugacuauguaucagcaauaacccaagcugagcgaauaggcgaaccagacuaugaaguagacgaagacauuuuuaggaagaaacgucuuaccauaauggaucuucacccaggggcaggaaagacaaaacguauauugccgaguauaguaagggaagcccuuaaacgcagauuacgcacuuuaauucuugcuccuacacguguuguagcagcagagauggaagaggcuuuacgaggacuaccgauccgauaccaaacaccagccguaaaaagugaacauacgggacgagaaaucguugaucuaaugugucaugcuacauuuacgacaagauuauuaagcaguacucgggucccuaauuauaauuuaaucgugauggaugaagcacauuucaccgauccuaguaguguagcagcaagaggauauauaagcacacguguagaaaugggagaagcugcugcuaucuuuaugacagcaaccccgcccggcgcaacugauccauuuccccaaucaaauucucccaucgaggacauagaaagagaaauaccugaaaggucauggaacacgggauuugacuggauaacugauuaucaagguaaaaccguuugguuuguuccaucuauaaaggcugguaacgauauagcaaauugucuuagaaaguccggcaagaaagugauucaacuuucacgaaaaacuuucgauacagaauauccuaaaaccaaacuuaccgauugggauuucgucguuacaacugauaucuccgaaaugggagccaauuucagagcggggcgugucauagaucccaggaggugucugaaacccguuauacuaaccgacggacccgaaagagucauuuuagcaggaccgauuccagugacgcccgcuucagcagcccagcggagagggagaaucgggaggaaucccgcacaggaagaugaucaauacguauuuucaggagacccccuaaagaaugaugaggaucaugcccauuggacagaagcuaagaugcuauuggacaauauauauacaccagaaggaauaaucccaacuuuauucgggcccgaaagagaaaagacgcaagcaauagauggagaguucaggcuaagaggggaacaaagaaagacauuugucgaauuaaugagaagaggagacuuaccuguaugguuaagcuauaaagucgcaagugcuggaauuucguacaaagacagggaaugguguuuuacuggggaacgaaacaaucaaauuuuggaagagaacauggaagucgagauauggacaagagaaggggagaagaagaaacuaagaccacguuggcuagaugccaggguuuacgccgacccaauggcacuuaaggacuucaaagaguuugcuucaggacguaaaucucuuacccuagacauucugacugaaauugcaagucucccuaccuacuuauccucccgagcaaaauuagcguuagauaauauuguaauguuacacacuaccgaaagaggagggcgagcauaccagcaugcucuaaacgaauuaccggagucauuagagacacucauguugguggcauuacuaggagcaaugacggcugguauauuucuauuuuucaugcaaggaaaagguauaggaaaacuaucuauggguuugauaacaauagcuguggcuucagguuuauuauggguagccgaaauucaaccucaauggauagcugccucuauaauauuagaguucuuucuaaugguauuacugauccccgaaccugaaaaacaaagaacuccacaggauaaccagcuaauauacguuauucuaacaauauuaacuaucauaggacucauugcggcaaaugaaaugggcuugauagagaaaaccaaaacagauuuuggguucuaucaaguaaaaacugaaacaacaauucuggauguggacuugagacccgcuucugcuuggacccuauaugccguugccacuacgauuuuaacucccaugcuccggcacacaaucgagaauacgucugccaauuugucguuggcagccaucgcaaaccaagcugcugugcugaugggucuaggcaaagguuggccccuacaucgaauggaucuugggguuccgcuauuggcuauggguuguuauucacaagugaauccuaccacacuaacagccagucuaguuauguuauuaguacacuacgcaauuauugguccaggacuucaagcgaaagcaacuagggaagcucagaaaaggacggcagcugggaucaugaaaaauccgacuguagacggaauaacagugauugacuuagaaccuauuucauaugacccaaaguuugagaaacaacuaggacaaguaaugcuccuaguuuugugcgcaggccaacuacuacugaugagaacgacgugggcauuuugcgaaguuuuaacccuugcaacuggacccauucuuacauuaugggaaggaaauccagggcguuuuuggaauacaacuaucgcagucucuacagcgaauaucuuccgcggcucauauuuggcuggagcuggucuagcguucuccuuaauaaagaaugcccaaacaccacguagaggaacagggaccaccggagagacacuaggagaaaaauggaagagacaacugaacagcuuagacagaaaagaauuugaagaauacaagagguccggaauccuagagguagacagaacagaagcaaaauccgcauugaaagacggcucaaagauuaaacaugcuguuagcagagguuccucaaaaauaagguggauuguagaaagagguaugguuaagccgaaagguaaaguaguugaucuaggauguggucgaggcggcuggucauauuauauggccacucuuaaaaacgucacggaggugaaaggauauacaaaagguggaccaggacaugaagaaccgaucccuauggcgaccuauggauggaacuugguuaaacugcauucaggcguagauguguucuacaaacccacugaacaagucgauacucuacucugugacauaggagaaagcuccucuaauccgacaauagaagaaggaagaaccuuacgaguccuuaaaaugguagaaccuuggcucucuaguaaaccugaauuuuguauuaagguacuaaacccauauaugccaaccguaaucgaagaacuagagaaacuacaacgcaaacacgguggaaaccuagugagauguccacuaucuagaaauucaacgcacgaaauguauugggucucuggagcaagugguaacauaguaucaaguguuaauacaacaaguaaaaugcuacuaaauagauuuacuacucgacauaggaaaccgacauaugaaaaagacguggauuuaggagccgggacaagaucuguaagcacugaaacggagaaacccgauaugacuauuaucggacgaagguuacaaagauugcaggaggaacauaaagaaacauggcauuacgaccaagaaaauccauaccgcaccugggcuuaucacggaucauacgaggcgcccaguacuggcagugccuccaguaugguuaauggagucguuaaacuacuaacgaagccuugggauguuauuccuauggucacucaacucgcaaugacggacacgacaccauucggucaacagcgaguauuuaaagaaaaaguagauacucguacaccgcagccuaaacccggaacucggaugguaaugacuacaacugccaacuggcucugggcucuacuaggaaagaagaaaaauccacgauuauguacaaaggaagaauuuauuucaaaagucagggcaaaugcagccauaggagcgguauuucaggaagaacaaggauggacaucagcaagugaagccguuaaugauucaagauuuugggaacuugucgauaaagagagagcuuuacaccaagaaggaaaaugcgaaucuugcgucuacaacaugaugggaaaacgagagaagaaacugggcgaguuuggacgagccaagggaucaagagccauuugguacauguggcuaggagcacgauuucucgaguucgaggcccucggauucuugaacgaagaucacugguucggacgugaaaauucuuggucagguguagaaggugaagggcuucaccgacuaggauauauauuggaagaaauagauaagaaagauggcgacuuaauguacgcggaugacacagcugggugggauacacgaauuacagaagaugauuuacaaaaugaggaauugauuacggagcagauggccccucaccauaaaauauuagcuaaagcaaucuuuaagcuaaccuaccaaaauaaagucgugaaaguucuuaggccaacuccgaggggagccguaauggauauaauauccagaaaggaccaacggggaucuggucaggugggcacguaugguuuaaauacguuuaccaacauggaaguucaacuuauacgucaaauggaagccgaaggaguaauaacacaggacgauaugcaaaacccaaaaggccucaaagagcguguagaaaaauggcugcgggaaugcggcguugaccgacuuaaaaggauggcaauaagcggagaugauugcguaguuaaaccucuugaugaaagauuugcuacgucucuccuguucuuaaacgauaugggaaaaguccgaaaagauaucccucagugggaacccucuaaaggauggaagaauuggcaagagguaccauuuuguagucaccauuuucacaaaauauucaugaaagaugggagaagucucguuguuccgugucggaaucaggaugaguuaauagggcgugcgcgaauuagucagggugccggcuggucacuaaaagaaacagccuguuuagcaaaagcauacgcucaaauguggucacuaauguauuuccaccgucgcgaucuccgacuugcaucuauggcaaucugcucggcaguaccaacagaaugguuccccacaucucgcacgaccuggucgauccaugcacaccaucaguggaugaccacugaagacauguuaaaaguauggaacaggguauggaucgaagauaaccccaauaugauagauaaaaccccuguccacucgugggaagacauuccuuacuuagguaagagagaagaucuauggugugggagccuaauuggcuugaguucacgagccacaugggccaaaaauauucauaccgcuaucacacaaguacguaaccucaucgguaaagaagaguauauggauuacaugcccguaaugagaagguauuccgcaccuagcgaaagcgaggguguacuauga

SEQ ID NO: 23703 - RNA, 9867 nt, Artificial Sequence
  derived and/or modified CDS sequence (opt6) from DENV-4__KU523871__SS-prME
uccacaaugacacuacuaugucugauaccaacagucauggcauuccaucuuaguacgagagauggggaaccauugaugauuguagcaaaacaugaaagaggacgcccauuacuuuucaaaaccacugaaggcaucaauaaauguacacuaauugcaauggaucuaggggaaaugugcgaggauacaguaacauauaaaugcccacuauuaguuaauacagaaccagaagauauagacuguugguguaaccugaccucaacuugggucauguaugggacauguacgcaaaauggagaaagacggcgagagaaaagaaguguggcacuuacuccacauucgggcaugggucuagaaacacgggcggaaacauggaugucaagugagggagccuggaaacacgcacaacgcgucgaaaguuggauuuuaagaaacccuggauuugcacuuuuagcgggguucauggcuuauaugaucgggcaaacaggaauacaacgaauagucuuuuucguccuaaugauguuaguagcccccuccuacggcaugcguuguguaggugugggaaauagggauuuuguggaaggaguaagcgggggcgcauggguugauuuaguacuugaacacggaggaugcguaaccacaauggcacagggaaaacccacacucgacuuugaacuuacgaaaacuaccgcaaaagaaguugcucuuuuaagaacuuauuguauagaagcgaguauaaguaacauaaccaccgcaacaagauguccaacgcagggagaacccuaucuuaaagaagaacaagaccagcaauauauaugccgcagagauguaguagaucgagguugggguaauggaugcggauuauuuggaaaaggaggaguagucacaugcgcuaaauucuccuguagugggaaaauaacaggaaaccucguccagauagaaaauuuagaauacacgguagucguaacagugcauaacggagacacacacgcaguaggaaaugacaccucaaaccacgguguuacugcaacuauaacgccacgaucaccaucggucgaaguaaaacuacccgauuauggcgaguuaacacuugacugugagccacgcuccggaaucgacuucaacgagaugauacucaugaaaaugaagaagaaaacuuggcucguacauaaacagugguuucucgaucuaccguuaccuuggacagcuggugcugauacgagcgaaguacauuggaaucauaaagaaagaaugguaacauucaaagucccgcacgccaaaaggcaagaugucacuguccuuggcucucaggaaggagcuaugcauagugccuuagcuggagccacugagguggacaguggugacggcaaucauauguucgcagggcauuuaaaauguaaaguaagaauggaaaaacuacgaauaaaagguaugucauauaccaugugcucuggaaaauuuaguaucgauaaagaaauggcggaaacacaacaugguacuacugucgucaagguuaaguacgaaggcgccggugcaccuugcaaagugccuaucgaaauaagagauguuaauaaggaaaaaguuguggguagaaucauaucaagcacgccauuugcagaaaacacaaacucggucaccaacauagaguuagaaccaccuuucggugauucguauaucguaauaggaguuggggagucugcuuuaacguugcauugguuucgaaaaggaucaucaauaggcaaaauguuugagaguacauauagaggugccaaacgaauggcaaucuuaggagaaaccgcaugggacuuuggcucaguggguggauuauuuacaucccuaggaaaggcagugcaccaagucuucgguucagucuacacgacaauguucggaggggucagcuggaugguacgaauauuaauuggcuuucucguacuauggauaggcacuaauagucgcaauacgaguauggcuaugacaugcauugcagugggaggcaucacacucuuucuaggcuucaccgugcaagcugauaugggauguguaguaagcuggagugguaaagaacuaaaaugcggcucaggcaucuucguuguagauaauguucacacuuggacagaacaguauaaguuucaaccugaaucuccagcccgacucgcaagugcuauauugaacgcucauaaagauggggugugcggaauacggagcacaacucgacuugaaaauguuauguggaaacaaauaacgaaugaguugaauuauguacuaugggaagggggucaugacuuaacuguagucgccggugauguaaagggaguucuuacgcguggaaaaagagcucucacuccaccgguaaaugauuuaaaauacucuuggaaaacauggggaaaggcaaaaauauucacaccugaagcuagaaacucuacauuucuaauugaugguccagauacauccgaaugcccaaaugaacgaagggccuggaacuucuuugaagucgaagacuauggcuuugggauguucacuacgaauaucuggaugaaauuuagagaaggaaguagugaagugugcgaucaccgccuaaugucagccgcaauaaaagaucaaaaagcaguucaugccgacaugggguacuggauagaaucuaguaagaaucaaacauggcaaauugaaaaggcgucucuuauugaaguaaaaaccugccucuggccuaaaacccacacucuaugguccaacggcguccuagaaagccaaauguugauuccgcgaaguuacgcgggaccguuuucacaacauaauuaccgucaaggauaugcaacucaaacagugggaccguggcaucuaggcaaacucgagauagacuucggggaaugucccggcacuacuguugcaauaagagaagauugugaucauaggggaccuaguuuaagaacaacuacugcaucagggaagcugguuacccaaugguguugcagguccuguacaaugccaccuuuaagauucuugggugaagacgguuguugguacggcauggaaaucaggccccuaagugaaaaagaagaaaacaugguuaaaucacaagcaacggcgggacaaggaacgagugaaacauucaguaugggauuacuaugucuuacacuauuuguugaggagugccuuagaagacgaguuacaagaaagcacaugauauugguggucgugaucacuuuuugcgcaauaauauuagguggacuuacauggauggaucuucuuagggcuuugaucauguugggcgacacuauguccggucggauuggcgggcagauacaccuagcuauuauggcuguauucaaaaugucgccaggguauguacucggugucuuucugaggaaacuaacgucuagggagacagcauuaaugguuauaggaauggccaugacaacgguguuuucuaucccacaugaccuuauggaacucauagaugguauaagucuaggccuaauuuuacuaaaaauuguuacccacuuugauaauacacaaguuggcacuuuagcauuaucacuuaccuuucuuagaagcacgaccccacuggucauggcuuggcgaaccauaauggccgucuucuuugucgucacacugauuccuuugugccgaaccucaugccuacagaaacaaagccauuggguugaaauuacggcucugaucuuaggcgcacaggcuuuacccguguaccuaaugacuuuaaugaaaggugccucgagacguuccuggccauuaaaugaagggauuauggcaguuggucugguuagucugcuaggcagugcucuccugaagaacgaugugccccucgcuggaccuaugguggcaggaggguuauuacuagcagcuuauguaaugucagggaguucugcggaucuaucccuggaaaaagccgcuaauguucaaugggacgaaauggccgauauuaccggaucaucuccuaucauugaagugaaacaagaugaagacggcucauucucuaucagggacguagaagagacuaauaugaugacccuucuuguaaaacucgcauuaauuacaguuagcggucuauaucccuuagcaauaccaguaacaauggcauuaugguauauuuggcaaguaaaaacgcaacggucaggcgccuuaugggauguuccuucaccagccgcgacacaaaaagcuacacuuucagaagguguguauagaaucaugcagcggggguuauucgguaagacacaaguuggcgucggcauacacauggagggcguauuccauacuauguggcacgucacuagggguucuguuauuugucaugaaacgggucgcuuagaaccaucgugggcagauguaagaaaugacaugauuagcuacggaggggguuggagauuaggagacaagugggacaaagaagaggauguucaaguacuugcuauagaacccgguaaaaauccaaaacauguacagacaaagccaggcuuauuuaaaacauuaacgggagagauaggagcuguuacauuagauuuuaaaccuggaacuuccggaucacccauaaucaacaagaaaggaaaggucauaggacuguacgggaacggugugguaaccaaaagcggcgauuaugugagugcuauaacacaagcagaaagaauuggagagccggauuaugaagucgaugaggauauuuucaggaagaaacgauuaacgauaauggaucugcauccuggugcggguaaaaccaaaaggauacuuccgucaaucguccgagaggcgcuaaaaagaagacuuagaacacugauacuagcuccaacuagaguuguagccgcugaaauggaagaggcauugagaggacuaccuauuagauaucaaacgcccgcagucaaaagugaacacacuggacgggagaucguagauuuaaugugucaugccacauucacgacaagauuacuuucaucaacaagagugcccaauuacaacuugauuguaauggaugaagcacacuuuacggaucccuguaguguggcggcaagaggauauauaaguaccagaguugaaaugggagaagcugcagcaauauucaugacugccacuccgcccggagccacugaucccuuuccccagucaaacagucccauugaagauaucgagagagaaauaccugagcguucguggaacacuggauuugacuggaucacugauuaucaaggcaagacgguuugguucgucccaucgauaaaagcaggcaacgauaucgccaacuguuuaagaaaaucggguaaaagaguaauccagcuaucaagaaaaacguuugacacagaguauccuaaaaccaaauugacugacugggauuucguuguaacgacagacauuagugagaugggcgcaaauuuucgcgcuggucgaguuauagauccgagacgaugccuuaaaccagucauauugaccgauggcccagagagaguaauucuagccggcccuauacccguuacaccagccucagcggcgcagcgccgugguagaauuggacggaauccagcacaggaagaugaucaauacgucuuuucaggagacccccuuaaaaaugaugaagaucaugcacauuggaccgaagccaaaaugcuauuagauaacauuuauacgcccgaggguauaauaccaacucuauucggcccagaaagagagaaaacacaagcaauugacggugaauuuagacuacgaggagaacagcgaaaaacuuuuguagaacuaaugaagagaggggaccuccccguuuggcuaucauacaaagucgcuagugcuggaauaaguuauaaagaccgagaaugguguuucaccggugaaagaaauaaccaaauccuagaagaaaacauggaagucgagauauggacaaaagaaggugagaagaagaaacuccgaccuaagugguuggacgcuagaguguaugcugacccaauggccuuaaaagauuucaaagaauuugcauccgguagaaaaaguauaacauuagauauacuaacagagaucgcaucguugccaacauauuugucauccaaagcaaaacuugcgcuugauaacauaaucauguuacauacgaccgaaaaaggagggagagcuuaccaacacgcauuaaaugaacuaccagaauccuuagaaacacuaauguuaguugccuuacuaggcgcgaugacagcagggauuuuucuguucuuuaugcaagguaaaggaaucgguaaauuaucaaugggucuuauagcuauugcuguagcguccggauugcuauggguagccgaaauccaaccccaauggauugcagcgucuauaauucuugaguucuuuuuaaugguucuucucauuccugaaccugaaaaacaacgcacuccucaagacaaccaauugauauauguaauuuuaacuauucuaacaauaauaggcuugauugcugccaacgaaaugggacuuauugaaaagacuaagacugauuucgguuuuuaccaaguaaaaacagaaacgaccauauuagacguugaccuaagaccugcaucagcauggacucucuacgcaguggcuacgaccauauuaacaccgaugcuucgucauacaauugaaaauacaagugcaaacuugucauuggcagcaauugcgaaccaagcugcuguguugaugggacuaggaaaaggauggccauuacaccgcauggaucuaggugugccacuucucgcgaucgguugcuacucccaaguaaacccaacgacuuuaacggcgucgcuuguuaugcuguuaguccacuacgcuauaauagggcccggacuucaagcaaaagccacuagagaagcgcaaaaacgaacagcagcagguaucaugaaaaacccuacgguggauggaauaacaguaauagaucuagaaccaauaucauacgaccccaaauucgaaaaacaacucggucaaguaaugcucuuaguguuaugugcuggacagcugcuacugaugcgaacgacaugggcacucugugaagucuugacacucgcaacuggaccugccaugacauuaugggaagguaacccuggcagauuuuggaacacaacaaucgcugucucuacagcaaauauauuuagaggaucuuaucuugcaggcgcuggacuagcauuuuccuuaauuaaaaacgcccaaacuccuagaagaggaacgggaacuacaggugaaacguuaggcgaaaaauggaagagacagcuaaauucauuagauaggaaagaguucgaagaguauaaacgcaguggcauucucgaggucgauagaacggaagcuaagagugcucuuaaagacggcucaaagauaaaacacgcuguaucuaggggaucaucaaaaauccgguggaucguugagagaggcaugguaaagccaaaaggaaaagugguggauuuaggauguggaagagguggguggucuuauuacauggcuacacuaaagaaugucacugaagucaaaggguacacaaagggugggcccggucaugaagaaccuauaccaauggcuacuuacgguuggaaucuugugaaacuucauagcgggguagaugucuuuuauaaaccaacggaacaaguugauacucuuuuaugugauauuggagagaguagcucaaaccccacgaucgaagaaggacguacuuuacgaguguuaaaaaugguggaaccaugguuaagcucaaaaccugaauuuugcauaaaaguacugaacccauauaugccaacgguaauagaagaguuagaaaaauugcagcgucgacacggcggaucguuaguuagaugucccuuguccaggaacaguacucacgaaauguacuggguuaguggagccucagguaauaucguaucuucgguaaauacuauaaguaaaaugcuuuuaaacagauucacaacgagacauagaaaaccuacauaugaaaaagauguagauuuaggggcaggcacaagguccguaaguacagaaaccgaaaaacccgacaugacgauuauuggaagaagacuucagagacucagagaagaacauaaagagaccuggcauuaugaucaagaaaauccguaucgaaccugggcauaucacggaagcuaugaagccccuagcaccgggucagcuucguccaugguaaaugguguuguaaaacuacugaccaagccaugggacguaguaccuaugguaacacaguuagcaaugacagauacgacaccauuuggacaacaaagaguuuuuaaagaaaagguagauacaagaacaccacaaccuaaaccuggcacuagaaugauuaugacuacaacugccaacuggcucuggacuuuacucgggaagaagaaauccccuagauuaugcacuagagaagaguucaucagcaaaguaaggagcaaugcugcaauaggcgcaguauuucaagaagaacaaggguggaccucugcaucagaagccguuaacgauucccguuuuugggaauuaguagauaaagaacgugcauuacaucaggaaggcaaaugcgaaaguuguguauauaacaugaugggaaagagagagaagaaacuuggagaguuugguagagcaaaaggaagcagagcaaugugguacauguggcucggugccagauuuuuagaauuugaagcacuuggauuuuuaaaugaagaucacugguucucacgagaaaauucuugguccggagucgaaggagagggccuucaccgccugggguauauacuagaagauauugacaagaaagauggcgaucuaauauaugcugaugauacagccgggugggauacgcgaauaacggaagaugaccuauuaaaugaagaacuuauaacugagcaaauggcaccccaucauaaaacucucgccaaagccaucuucaagcugacauaccaaaauaaaguuguaaagguacucaggcccacgccuaaaggagcgguuauggauauuauaucacggaaagaucagcgaggcucaggucaagucggaacuuauggucuuaacacuuuuaccaauauggagguucaacuuauucgacaaauggaagcggaagggguaauaacucaagaugauaugcaaaauccgaagggacugaaagaacgcguugaaaagugguuaacggaaugcggaguugaucguuuaaaaagaauggccauauccggugacgauuguguaguuaaaccacuggaugaacgauucagcacaaguuuauuauuccuaaacgacaugggcaaagucagaaaggacauuccucagugggaaccaucaaaaggauggaaaaacuggcaagaagugccauuuugcucccaucauuuccauaaaauauucaugaaagauggaagguccuuagucguuccaugccguaaccaagacgagcuaauaggcagggcacgcaucagccaaggagcugguuggaguuuacgagagacggcguguuuggggaaggcuuacgcacaaaugugguccuuaauguacuuucauaggcgagaucuacgcuuagcgucgauggcuaucuguucugcaguaccgacagaaugguucccaacgucaagaacaacauggucuauacaugcacaucaucaauggaugacgacugaggauaugcugaagguuuggaaccgcgucuggauugaagauaaccccaauaugacagauaaaacaccaguauauucuugggaagacauaccauaucuaggaaaaagggaagaucuaugguguggcagucuuaucggauugaguuccagagcaaccugggcuaagaauauccauaccgcgaucacacaaguaagaaacuuaaucggaaaagaagauuacguagacuauaugccgauaaugaaaagauauucagccccuagugagucugaaggcguacuuuaa

SEQ ID NO: 23704 - RNA, 9867 nt, Artificial Sequence
  derived and/or modified CDS sequence (opt6) from DENV-4__HQ332175__SS-prME
ucaacgaucacacuuuugugucuuauacccacggucauggcauuccacuugagcacaagagacggugaaccauugaugauagucgcaaaacacgaacgcggacgacccuuguuauuuaaaacaacugaaggaaucaauaaaugcacgcucauagcaauggauuuaggugaaaugugcgaagauacugucacauauaaauguccgcuguuggugaauacagaaccugaagauaucgacuguuggugcaaucuuacaucgacuuggguaauguaugguacauguacccagucuggagaacgacgacgagagaaaaggucagucgcguugacaccucacucuggaaugggucuggaaacgagagcagaaacguggaugagcuccgaaggugcuuggaaacacgcacaacgcguggaauccuggauauuacguaaccccgguuuugcgcugcuugcuggguuuauggcuuauaugauuggacaaacagggauacaacggacuguauucuuuguucuaaugauguuaguagcaccuucuuacgguaugagaugugugggaguggguaacagagauuucguagaaggaguuucggguggagcauggguagacuuaguuuuagaacauggagguuguguuaccaccauggcccaaggaaaaccaaccuuagacuuugaacuuacaaaaacgacugcaaaagaaguugcccuacuuaggacguacuguauugaagcacuuaucaguaacauaacaaccgcuacuagguguccaacacagggagaaccguauuuaaaagaggaacaagaucaacaguauaucugucgaagggaugucguugaccgaggauggggaaauggauguggucucuucggaaaagguggaguaguaacgugugcuaaauuuagcugcagcgguaaaauuaccggaaaccugguccagaucgagaacuuggaguacacggucguaguaaccguucauaacggugauacccaugcaguaggcaacgauacaucuaaccacggagucacagcaacaauaacaccuagaaguccaagugucgaggugaaauugccagauuauggcgaacuuacauuggacugugagcccaggucuggcauagacuuuaacgaaaugaucuugaugaaaaugaagaagaaaacuuggcuaguucauaaacaaugguuuuuagaucuaccacuaccguggacuaccggagcagauacgagugaaguacauuggaauuauaaagaaagaauggucacauuuaaaguaccacaugcgaaaagacaagacgucaccgucuuaggaucacaggaaggugcaaugcauagcgcguuagcuggugcgacagagguggauaguggagauggaaaccauauguucgcggggcaucuaaaaugcaaaguaaggauggaaaaauuaagaauuaaaggcaugucauauacaaugugcucaggaaaauuuucaauagauaaagaaauggcagaaacacaacaugggaccacaguagugaaaguaaaauacgaaggugcuggcgccccaugcaaaguaccuauugagauccgcgacguaaauaaagaaaaaguaguggggcgugugauuagugcuacaccguuggcugaaaauacaaauuccguaacaaacauugaauuagagccuccguuuggagauucauauauaguaauaggagugggaaauucggcacuaacauugcacugguucagaaaaggaucuucaauaggaaaaauguuugaaucgacuuauagaggggcgaaacggauggccauacucggugagacugcaugggauuuuggaucaguaggggguuuauucacgucucuaggcaaagcuguucaucaaguuuuuggcagugucuauacuacgauguucggagggguaagcuggaugauaagaauauuaauuggauuucugguucuauggauuggcacgaacaguagaaauaccuccauggcaaugacauguauagccguugguggaaucacgcuuuucuuagguuucacagugcaagcugacauggguuguguaguaucguggaguggacgagaacuaaaaugcggcaguggcauauucgucguagacaacguucauacuuggacagaacaauauaaauuucaaccagagucacccgcuagacuagccuccgcaauacuaaacgcucauaaagaugguguuuguggaauaaggucaaccacccgauuagaaaauguaauguggaaacaaauaacaaaugaacucaauuauguguuaugggaagggggccacgaucuuacugugguagcaggagacgugaaggguguucucacuaaagggaaacgagcguugacacccccagcgucggauuuaaaauauucuuggaaaacauggggaaaagccaaaauuuucacuccggaagcgcgaaauaguacguuccuaauugacgggccugauacaagugaauguccuaaugaaagacgcgccuggaacucuuucgagguagaggauuaugguuucgggauguuuacaacaaacauuuggaugaaguuuagggagggaaguagugaaguaugcgaucaccgacuaaugucggcagccaucaaagaccaaaaagcaguacaugcugacaugggcuauuggaucgaaagcagcaaaaaucaaacguggcagauugaaagagcuagccuaaucgagguuaagacuuguuuauggccgaagacacauaccuuauggagcaaugguguacuugaaagucagaugcuaauuccaaaaucguacgccggaccauuuagucaacauaacuacagacaagguuaugcaacacaaacuguagggccauggcaucuagggaaacuugagauagacuuuggagaaugcccagguacaacaguuacuauacaggaaaauugcgaccauagggggccaaguuuacguacaaccacggcuuccggcaaauugguaacgcaauggugcugcagauccugcacaaugccuccacucagauuucugggagaagacggauguugguaugguauggaaauacggccucugagcgaaaaggaagaaaauauggucaaaucacaaguaacggcaggacaagguaccucugagacuuucucuaugggccugcuaugccucacauuauuuguugaagaauguuugcguagacguguuacuagaaaacacaugauucuugcagucguuauaacauugugcgcgauaauacucggaggucucacauggauggaucuuuuaagagcauugauuauguuaggagacacuaugucaggucguauaggagggcaaacacaucuugcgauaauggcuguauucaaaaugagcccaggauauguucuaggcgucuucuuaagaaaacucacuucgcgggaaacugcgcuaauggugauagguauggcgaugacaaccacguuaucgauuccgcaugacuugauggaacucaucgacgguauaucucugggguuaaucuuguugaaaaucguaacucaguucgauaauacucagguggguacacuagcgcucucacuuacuuuuauaaggucaacaaugucgcuaguuauggcauggcguacaaucauggcaguacuauuuguaguuacacuaauuccccuaugcaggacaaguugucuccaaaaacaaagccauuggguagaaaucacugcacuuauuuuaggagcacaggcuuuaccuguauacuuaaugaccuuaaugaaaggagcuagcagaaggagcuggccucuuaacgaaggaaucauggcgguagguuuggugucacuacuaggaucugcgcuucuuaaaaaugauguuccauuagccggacccaugguagccgggggucuuuugcuugcagccuauguaaugagugggaguaguguagaucuuagucuugaaaaggcugcuaacguccaaugggacgaaauggccgacauuaccggauccaguccgaucauagaaguaaaacaagaugaggacgguagcuuuucaaucagggaugucgaagagacaaauaugauaaccuuacuuguaaaguuagcccuuauuacaguaucaggcuuauauccauuagcaauacccauaaccaugacguuaugguacauguggcaaguaaaaacgcaacgcucaggugcgcugugggauguaccuucgccggcugcgacacagaaagcagcguugagugaagguguguacagaaucaugcagagagggcuuuucgguaaaacacaggugggcguagguauccauauggaaggaguauuucauacaauguggcauguuacacgagguucaguaaucugucaugaaacaggacgucuugaaccuagcugggcugauguccgaaacgauaugauaucuuaugguggaggauggaggcucggugacaaaugggauaaagaagaagacguucagguucuggcgauagaaccggguaaaaacccuaaacacguacagacuaaaccuggacuguucaaaacacuaacuggggagauaggagcuguuacacuagacuucaaaccggguaccagcgguuccccuauuauuaauagaaagggaaaaguuauuggguuguaugggaacgggguuguaacgaaauccggugauuauguuucugcaauaacucaagcugaaagaauaggugaacccgacuacgaaguagaugaagacauauuucggaagaaaagguuaacaauuauggauuugcacccgggagccggaaagacgaaaagaauacuucccucaauuguaagagaagcauugaaaagaaggcuacguacucuaauuuuagcccccacaaggguuguugccgccgagauggaggaagcacuucgugggcuuccaauccguuaucaaacuccggcagucaaaucugagcacacgggaagagaaauaguggauuuaaugugucacgccacauucacgacacgguuauugaguaguacaagaguuccaaacuacaauuugauugugauggacgaagcacauuucacggacccaagcucuguagcagcucguggcuacaucaguacgcguguugaaaugggugaagcugcagcuauauucaugacagcuacuccgcccggcgccacugauccauuuccccaaaguaacuccccuauagaagacauagaacgcgagauaccggagagaucauggaauacaggguucgauuggauaacggacuaucaggggaagacaguaugguuugucccaucgaucaaggcagguaaugauauagcuaacugucuaagaaaaucagguaagaaaguaauucaguuaucuagaaaaacguuugauaccgaauauccgaaaacaaaauuaacugacugggacuucguuguuacaacugauauaagugaaaugggggccaauuuucgggcuggccgagucauugauccacgucgcugccucaaaccagucauuuugaccgauggaccugaacguguuauccucgcuggaccuauaccuguaaccccggcaucagccgcucaaagaagagggagaauuggacguaauccagcacaggaggaugaucaauacguuuucuccggcgauccauugaaaaaugaugaagaccacgcucauuggacugaagcgaagaugcuacuagacaauauauauacaccugaaggaauaauaccaacacuauuuggaccagaaagggagaaaacucaagcgaucgauggcgaauuucgccuaagaggugaacaaagaaaaacuuucguagaauugaugagaagaggcgaccucccaguuugguuauccuauaaagucgccagcgcuggcauuuccuacaaggauagagaauggugcuuuacaggugaaaggaauaaccaaauucuagaggaaaauauggaaguggagauauggacgagggagggagagaagaagaaacugaggccaaaauggcucgaugcgagaguguacgcagacccaauggcucugaaggauuuuaaggaguucgcaucgggcagaaagaguauaaccuuagauauauugacggaaauagcuucauuaccaacuuaucuuucaucaagagcgaaauuagcacucgauaacauuguaauguugcauacaacugaaagaggcggcagagcauaccaacaugcgcuuaaugaguuaccugagucauuagagacguugauguugguagcccuacuaggggcaaugacggcaggcauauuucucuucuuuaugcaggguaagggaauuggaaaauuaucuauggguuuaauuacaauugccguggccucgggacuauuauggguggcagaaauacagccucaauggauagccgccaguauaauuuuagaguucuucuuaaugguacuuuuaauuccagaaccagaaaaacaaagaacaccacaagauaaccaauuaauauacguaauccuaacuauuuuaacgauaauuggguuaaucgcugcaaacgaaaugggauuaauugagaaaacuaaaacugauuucgguuuuuaucagguaaaaacagaaaccaccauacuggauguagaucugagacccgcguccgcauggacauuauaugcuguugccacaacaauauuaacaccuauguuaaggcauacuaucgagaacacgucugcaaaucugucacuugcugcaauagcaaaccaagcggccguccuaaugggccucgggaagggauggcccuugcacaggauggacuuaggugucccuuuauuagcaaugggauguuacucgcaagugaaucccacgacccuuacagcguccuuggucauguuauuaguucauuaugcaauaauaggcccggguuuacaagcgaaagcaacuagggaggcacagaaacgaacugcugccggaauaaugaagaauccgacuguugaugggauaacaguaauagaucuagaaccaauaucuuacgacccaaaguuugaaaaacaauugggccaagucaugcucuuaguucuaugcgccggacaauuacuauuaaugagaacaacaugggcauuuugugaaguauuaacucuugcgacaggucccauauuaacccugugggaaggaaaucccggaagguucuggaauacgacaauagcaguaucuacagccaacauauuuagaggguccuaucuagccggugcggguuuggcuuuuagucuaauuaagaaugcccaaacuccaagaaggggcacgggcacuacgggggaaacgcuaggugaaaaauggaagagacaacuaaauucgcucgauagaaaagaguucgaagaguauaaacguucugguauuuuagaaguagaccgaacugaagcuaaaagugcauuaaaagauggaucgaagauuaagcaugccguaucuagaggaucaaguaagauccgguggauaguagaacgagggaugguaaagccgaaaggaaaagugguggaccuuggcuguggacggggaggauggaguuacuauauggccacacuaaagaacguuacggaaguaaaaggauauacuaaaggaggaccgggucaugaagaaccuauacccauggccacauaugguuggaauuuaguaaaacuacacaguggaguugacguuuucuauaaaccgacagaacaaguagauacuuuauuaugugauauuggugaaucuagcaguaacccaacuauagaggaggguagaacuuugcgaguauuaaaaaugguagaacccugguuaagcucaaaaccugaauuuuguaucaaaguacuaaauccguacaugcccacaguaaucgaagaacuggaaaaacuucaacgaaaacaugguggcaauuuagucaggugcccguugucacgaaacaguacacacgaaauguauugggugucaggggcuaguggaaacauaguaagcaguguaaacacaaccucaaaaauguuguuaaaucgauuuacuacgagacauagaaaaccuacauaugaaaaggacguugaucucggagcagguacaagauccguaagcacggaaacagagaaacccgauaugacaauaauaggacgaaggcugcagaggcuucaagaagaacauaaagaaacauggcacuacgaucaagaaaacccauaucgaacuugggcguaucauggcaguuacgaagcgccaucaacaggaagugcaucuuccauggugaauggaguaguaaaacuacuuacuaaacccugggauguaauaccgaugguaacacaacuggcgaugacagacacgacaccauuuggacaacaacgcguguuuaaagaaaaaguggacacacgaacaccgcaacccaaaccagggacaagaaugguuaugacaaccacagcaaauuggcuuugggcauuacuagguaagaagaaaaauccgaggcuauguacacgagaagaguuuaucagcaaaguccgaucuaaugccgcaauaggugcaguuuuccaagaagaacaaggauggaccagugcgagugaggcugugaaugacuccagauuuugggaguuaguugauaaagaaagagcacugcaccaggaaggaaaaugcgagaguuguguuuacaacaugauggguaaacgcgaaaagaagcucggagaguuugggagagcuaaaggaaguagggcaaucugguauauguggcugggagcucgauuucuugaguucgaggcuuuaggcuuucuaaaugaggaucacugguuugguagagaaaauucaugguccgguguagagggggaaggauuacauagacuuggauauauuuuggaagagaucgauaagaaagauggagaucugauguaugcggaugauacagcaggaugggacacuaggauuacugaagacgaucuacaaaaugaagaacuaauaaccgaacaaauggcuccccaccacaagauauuagcgaaagccaucuuuaaauuaacauaccaaaauaaagucguuaaagucuuaagaccuacaccacguggggcagucauggacauuauaagucguaaagaucaaagaggaucaggucaaguugggacauacggccuaaauacuuuuacuaauauggaaguccaguugauaagacaaauggaagccgaaggaguuauuacgcaggaugauaugcaaaauccaaaggguuugaaagaaagaguagagaaauggcucagagaaugcggcguugaucgguuaaaacgcauggcuauaucaggggacgacuguguaguaaagcccuuggacgaaagauuugggacuucauugcuauuuuugaaugauauggggaagguccgcaaagauauuccccagugggaaccaagcaaaggguggaaaaacuggcaagagguaccuuucuguagucaccauuuucauaaaauauucaugaaagacgggcguucuuuaguaguucccugcagaaaucaagaugaauuaauaggcagagcaagaauuagccagggggcaggguggagucuucgagaaaccgcaugucuaggcaaagcauaugcacaaauguggucguuaauguauuuccacagacgggaucugagguuggccucuauggccauuuguagugcaguuccgacagagugguucccuacaucgcggacuacauggaguauacaugcacaucaucaauggaugaccacagaggauaugcuaaaaguauggaauagaguguggaucgaggacaauccaaauaugaucgauaaaacaccgguccacucgugggaagacauaccauauuuagggaaaagagaagaucuguggugugguucuuuaaucgguuuauccagccgggcaacuugggcgaagaacauucauacagcaauugcccaaguacgaaaucuaauagguaaagaggaauacgucgacuauaugccaguuaugaaaagguacuccgcaccauccgagagcgagggaguauuauaa

SEQ ID NO: 23705 - RNA, 9867 nt, Artificial Sequence
  derived and/or modified CDS sequence (opt6) from DENV-4__HQ332172__SS-prME
ucaacuaucacguuacuuuguuuaauccccacugugauggcuuuucauuuaucuacgcgugauggggagccauuaaugaucguugcuaagcaugaaagggggcggccauuguuauucaagacgacugaaggcauaaauaaauguacuuugauagcgauggaucugggggaaaugugugaggauaccgugacuuauaaaugccccuugcuaguuaauacggaaccugaagauauugauugcuggugcaauuuaacgucugcauggguuauguacggaacuuguacacaaagcggggagagaagaagagaaaagcguagcguggcauugacgccgcauagugggaugggucuagagacaagagcagaaacguggauguccagcgaaggcgcuuggaaacaugcacaaagaguugagucauggauccucaggaauccggguuuugcauuacucgcaggauuuauggcauacaugauagggcagacaggcauccaacgaaccguauuuuucguacuaaugaugcuagucgcuccuucauauggaaugcgaugcguagggguuggaaaucgggauuucguagaagggguaucagguggagcauggguagaucucguauuagaacauggagguuguguaacuacgauggcacaaggcaaaccuaccuuagacuuugaacucacuaagacaaccgcuaaagagguagcacugcuucgcacuuauuguauagaagcauuaauuuccaacauuacaacagcuacaaggugcccaacgcaaggcgaacccuaucuuaaagaggagcaagaucagcaauacauuuguagaagagacgucguugaucgaggcuggggaaauggauguggucuauuugggaaaggagggguugucacgugugcaaaguuuagcugcaguggaaagauaacagggaacuuaguacaaauagaaaacuuagaauacacgguggucguuacuguacacaauggcgacacacacgccguugguaaugauacaaguaaucauggaguaacagcaaccaucaccccucguagucccucaguugaagucaagcucccagauuacggagaauuaacauuagauugugaaccacgcucaggcauagacuuuaaugagaugauccugaugaaaaugaaaaagaaaacuuggcuaguucauaaacaaugguuuuuagaucucccuuuaccauggacaacaggagccgacaccucugaaguucauuggaauuauaaagaaagaauggucacauucaaaguaccacaugcuaagagacaagauguaacaguauuaggaucacaggaaggagcuaugcauagugcccucgccggugcuacagaaguagauucaggcgauggcaaccacauguuugcuggccaccuaaagugcaaagugagaauggaaaaguuaagaauuaaaggcauguccuauacaauguguagugggaaauucagcauagauaaagagauggcggaaacucaacaugguacaacagucgugaaaguuaaauacgaaggcgcaggagccccaugcaaagugcccauugagauucgagaugugaacaaagagaaagucguaggacgugugauaagcgcuacaccccuagcagagaacaccaauagugugacgaauauugaacuagaaccaccuuucggggauucauauaucgugaucggaguugguaacucagcguuaacccugcacugguucagaaaaggaucgagcauagggaaaauguucgaaucuacauauagaggggcaaagagaauggcuauccugggggaaacagcuugggauuuuggaaguguugggggacuauucacaagucuaggaaaagcaguacaucaaguauucggaaguguuuauaccacaauguuugggggaguuucuuggaugauaagaauccuaauuggauuucuaguauuauggauaggaacaaauucuagaaauacgagcauggcgaugaccuguaucgcaguaggagggaucacauuauuuuuaggauuuacaguccaagcagauaugggauguguaguauccuggucaggaagagaauugaaauguggcucggguaucuuuguaguugacaauguacauaccuggacagagcaauauaaauuucagcccgaaucuccagcccgucucgcgucggcaauacuuaacgcucacaaagauggagugugcggcauucggagcacaacacgucuugaaaacguuauguggaaacaaauuacgaacgaauuaaauuauguacucugggaggguggucaugauuugacuguugucgccggugacgucaagggcguacuuacaaaagggaagagagcucugacaccaccagcuuccgaucucaaguauagcuggaagacauggggaaaagcaaagaucuucacgccggaagcacgcaauaguacauuuuuaauugacggaccagauacaucagaaugcccgaaugagcgacgagcuuggaauagcuucgaaguggaagauuauggguuuggaauguuuacgacuaauauauggaugaaauucagagagggaaguucugaggugugcgaccacagauuaaugucagcagccauaaaggaucagaaagcgguacaugccgauaugggcuauuggaucgaauccagcaaaaaccaaacauggcaaauugaaagagccucuuuaaucgaaguaaagacgugccuguggcccaagacccauacacuguggucuaauggaguacuggagucccagaugcuaaucccaaaauccuaugcuggacccuucagucaacauaauuauagacaggguuacgcgacacaaaccguggggccuuggcauuuggguaaacucgaaaucgauuucggggaauguccuggaacuacagugacaauacaagaaaauugcgaucauagaggaccaucauuacguacuacaacagccucaggcaagcucguuacucaaugguguugucggaguuguacuaugccacccuuaagauuccucggugaagauggauguugguacgguauggaaauuaggccuuuaucagaaaaagaagaaaacauggucaaaucccaaguaacagcaggacaagggaccuccgagacauucagcaugggcuuacuaugcuugacucuauucgucgaagaaugccugcgaagacgagucaccagaaagcacaugauuuuggcaguaguaauaacuuuaugugcuauaauauuaggaggcuuaaccuggauggauuuacucagggcucuaaucaugcugggagacacgaugagcggucgaauaggagggcagacacauuuggcuauuauggcgguuuuuaaaaugucgccaggcuauguacucggagucuuuuuacgcaaacuaacaagccgagaaaccgcacuaaugguuauaggaauggcaaugacuaccacccuuuccaucccccacgaucuaauggaguuaauagauggcauauccuugggccuuauucuuuuaaaaauugucacacaauucgauaacacucaaguaggaacccuagcguuaucucuaacauuuauccgcucgacaaugagucuaguaauggcuuggaggacuauaauggcuguuuuauuuguagugacauuaauaccauuaugucguacaagcuguuuacaaaaacagucccauugggucgaaauaacagcacuaauacuaggugcgcaagcgcucccaguauaucugaugacauugaugaaaggugccucaagaagaaguuggccucugaacgagggaauaauggcagugggucuaguuucacugcugggaucagcucuuuuaaagaaugacguuccgcuugcuggcccuaugguagcggguggacuuuuacuagcagcauaugugauguccggaucuucugcagauuuaagucuugaaaaagcagcaaauguccaaugggacgaaauggcagauauaacaggauccucaccgauuaucgaaguuaaacaagaugaggaugggaguuuuaguauuagagaugucgaggagacaaacaugauaacguuguuaguuaaacucgcacugauaacuguuucaggauuguacccccuugcaauuccaauaacaaugacacuaugguauauguggcaaguaaaaacacaacgaagcggagcacuaugggauguuccuagcccaacagcuacucaaaaagccgcucucagugaagggguauaucgcauuaugcagagaggauuauuugguaaaacgcaaguggguguagggauacauauggaggguguauuccauacgauguggcauguaaccagagggagcgucauaugucaugaaaccggccgauuggaaccgaguugggcugauguaagaaaugauaugaucagcuauggggguggcuggcgacuaggugauaaaugggauaaagaagaggacguacaaguccuagcgaucgagccugggaagaauccaaaacacguacaaaccaagccaggccuauuuaagacgcucacgggugagauuggugcuguaacgcuagauuucaaaccuggaacuagcggaucaccaauuauaaacagaaaaggaaaggugauuggauuauacggaaacgguguuguaacaaagaguggugauuauguaagugcuauaacgcaggcugaacguauaggcgaaccagacuacgaagucgaugaagacauauuuagaaagaaacgacuaacgauaauggaucugcacccuggagcaggcaaaacgaaaagaauuuuaccuucaauagucagggaagcucuaaaacgcagauuacgcacgcucauucuugcgccuacuaggguuguugcggcagaaauggaagaagccuuacguggacuaccgauccgauaccaaacccccgccgugaaaucugagcauacaggacgagaaauagucgauuuaaugugccaugcuacguucacgacgagacuuuuaaguaguacaagggucccaaacuacaaccugaucgucauggaugaagcccauuucacugaccccagcucggucgcugcacguggauacaucucaacacgagucgaaaugggcgaggcagcagcuaucuuuaugacugcuaccccgcccggggcaacagauccauucccccaaucaaauucuccgauugaagauauagagcgggagauacccgagaggucguggaauacgggauucgauuggauaacagacuaucagggaaaaacaguuugguuuguucccuccauaaaagcuggcaacgacauagcuaauugucugaggaaaucuggaaagaaaguuauccaacuaaguagaaaaaccuuugauaccgaauacccgaaaacuaaauugacagauugggauuuuguugugacaacagacaucagugaaaugggagcuaauuuucgugcaggacguguaauugauccucgcagaugucucaaaccaguaauccuaacugacgguccggagagaguaauacuagccggcccgauaccgguaacaccagcaucagcagcgcaaaggagagggcggauaggucggaacccagcacaggaagaugaucaauaugucuuuaguggugacccacuuaaaaacgaugaagaucacgcacauuggacagaagcuaagaugcuacuagacaauauauacacaccugaggguauaauaccaacccuuuuugggcccgaacgcgaaaagacacaagcaauugauggagaauuucgauuacgaggagaacaaagaaaaacuuuuguugaauuaaugagaagaggagaccuccccguauggcugaguuauaaagucgcgagugcggguaucucauauaaagauagagaauggugcuucacgggggaacguaacaaccaaauacuagaggaaaauauggaaguagaaauauggacaagggaaggagagaaaaagaaauuaagacccaaauggcuagaugcacgcguauacgcagacccgauggcauuaaaggauuucaaagaauuugcgucgggcaggaaaucaauaacauuagauauauuaacugaaauagcaucccuacccaccuacuuguccucgagagcaaaguuggcacuagacaacauaguaaugcuucauacgacagaaagaggugggcgggcguaccaacacgcgcuaaacgagcugccggagucuuuggaaaccuugaugcuuguugcucucuugggugcaaugacagcuggcaucuuucuguucuuuaugcaagggaaaggcauaggcaaauugucgaugggacuaauaacuauagcaguugcaucaggacuguuauggguugcagagauacaaccacaauggauugcagcgucuaucauccuagaauuuuuccucaugguauuauuaauaccggaaccagaaaagcaacgaacgccucaagauaaucagcuaaucuacgucauacuaacgaucuuaacaauaauaggauugauagcagcaaaugaaaugggauuaaucgagaaaaccaagacagacuucggauucuaucaaguuaaaacagaaacuacuauucuggauguugauuuaagaccggcuuccgcguggacacucuacgcaguagcgacaacaauacuuacaccuauguugagacauacaauagaaaacacuucagcuaaucucagccuagcugcgauugccaaccaagcagcaauacuuaugggacuagguaaggguuggccccuacauaggauggaucuaggagucccacuuuuagccaugggaugcuacucacaaguaaauccaacaacacuaacugcgucucuuguaaugcuucuggugcacuacgcaauaauaggaccgggucugcaagccaaagcgacacgagaagcucaaaaacgaacagcagcgggaauuaugaaaaacccaacaguggacgguaucacaguaauagaccuagaaccgauuucguaugauccgaaauuugaaaagcaacuuggccagguaauguuacuagcauugugcgcgggacaacugcuccugaugcgaacgacaugggcguuuugugagguucuuacccuagcaacuggcccaauacuuacacuaugggaaggaaacccaggaagguuuuggaacacuacaauugcgguuaguaccgcuaacaucuuucgagguucauauuuagcgggagcuggauuagcauuuagccugauuaagaacgcucagacacccagaaggggcacuggaacuaccggcgaaacguuaggugagaaauggaaacgacaacuuaauucuuuagaccgcaaggaguuugaagaauacaagcgcagugguauuuuggaaguugauagaaccgaagcaaaaucggcucuaaaggauggcucuaaaauuaaacacgcgguuucucguggcucaaguaagauaagauggauaguugaacgagguauggugaagccuaaggguaaagucguggaccugggaugcgguagagguggauggucauauuacauggcuacuuugaagaacgugacagaaguaaaaggauauacgaaaggagguccuggacacgaggaaccuauuccaauggcuacuuaugguuggaauuugguaaagcuacauucaggcguagacguauuuuauaagccuacugaacaaguggauacccuacuaugugacauuggggagaguucuucaaacccaacuauugaagaagguagaacuuuacgagucuugaaaaugguggaaccauggcuaucaagcaaaccagaauuuuguauuaaaguccugaauccguauaugcccacaguaauugaagaguuagaaaagcuacaaagaaaacaugggggcaauuuaguacguuguccuuugucuagaaauagcacucacgaaauguauuggguuuccggagcaucaggaaauauugugaguucaguaaauacaacaucgaaaaugcuccuuaauagauuuaccaccagacacaggaaaccuacguaugaaaaagauguugacuuaggugcuggaacuagaucuguaucgacggaaacagagaagccagacaugaccaucauugguagacgacuacagcgucugcaagaagaacauaaagaaaccuggcacuaugaccaagaaaauccuuacaggacaugggcguaucaugguagcuaugaggcaccgucuacgggcagcgcaucgucuauggugaacggaguggucaaacuucucacuaaaccaugggauguaauuccaaugguuacacaacuagcuaugacagauacuaccccauucgggcagcaacggguauuuaaagaaaagguagauacuaggacaccacaaccuaaaccaggcacuagaauggugaugacaacuacggcaaacugguuaugggcccucuuaggcaagaaaaagaauccuagauuaugcacaagagaagaguucauaaguaaaguaagaagcaacgcugcaauuggugccguguuccaagaagaacaaggauggacaagugcuucggaagcaguaaacgauagcagauuuugggagcucguggacaaggaacgagcgcugcaccaagaagguaaaugugaaagcugugucuauaauaugaugggaaagagggagaagaaacuaggagaguucgggcgcgcaaaagguucaagggcuauuugguauauguggcuaggagcaagauuucuagaauuugaggcgcuuggguuccuuaaugaagaucauugguucgggagagaaaauucuuggagcggcguugaaggagaaggucuucauagacuaggguauauacuugaagagauagauaagaaagauggagauuuaauguaugcggacgacacagcugguugggacacuaggauaacagaagacgaccuacaaaacgaggaauugauaacggaacaaauggcuccgcaucauaaaauauuagcaaaagcgaucuuuaaauugacuuaucagaauaaaguaguuaagguuuuaagaccaacaccccgcggcgcaguaauggacauaaucucaaggaaggaucaaagaggaaguggucaaguugguacuuauggauugaacacauuuacgaauauggagguucagcugauuaggcaaauggaagccgagggcguaaucacucaggaugacaugcaaaauccuaaaggacucaaagagcgagucgaaaaauggcuuagggaauguggcguagaccgacugaaaagaauggcaauaagcggagaugauugcguuguaaaacccuuagaugaaagauuuggaaccucucuacuuuuucuaaaugacauggguaaaguccgaaaagauauaccucaaugggaaccaaguaaaggcuggaaaaauuggcaggaaguuccauuuuguucucaucacuuucauaaaauauuuaugaaagaugggagaaguuuagucguuccuugccguaaccaggacgaacugauagguagagcacgaauaagucaaggagccgguuggucauuaagagaaacugcuugccuggguaaagcauaugcacaaauguggaguuuaauguauuuucauagacgggacuuaaggcuagcgaguauggcaauauguucagcaguuccaacagaaugguucccaacaucgagaacaacuuggucuauacacgcacaucaucaauggaugaccaccgaagauaugcuaaaagucuggaauagaguuuggauagaagauaacccaaauaugauagauaaaacaccuguacauucaugggaggauauucccuacuuagguaaaagagaggaccuguggugcggaaguuuaaucggguugagcucgagagcaacaugggcgaaaaauauacauacggcaauaacacaggugagaaaucuaauaggaaaagaggaauacguagauuauaugccaguaaugaaacguuauucugcuccaagugaaagcgaagguguauuauaa

SEQ ID NO: 23706 - RNA, 9867 nt, Artificial Sequence
  derived and/or modified CDS sequence (opt6) from DENV-4__HQ332176__SS-prME
ucuacaauaacauuauuaugcuuaauccccacaguuauggcauuucacuuaaguacucgugauggggaaccccuaaugauugucgcaagacacgaacgagguaggccccuacuuuucaaaacaaccgaggguauuaauaaauguacauuaauagcaauggaucuuggugagaugugugaagauacuguuacauacaaauguccguuacucguuaauacagaaccugaagacauagauugcuggugcaaucuuacaucaacauggguaauguaugggacuuguacgcaaaguggagagcguaggagagaaaaacgcagcguggcacuaacaccacauucaggaaugggacuggagacuagagcugaaacuuggaugaguucugaaggagcguggaaacaugcacagagagucgaaaguuggauacuuaggaauccuggguucgcauuauuagcaggauucauggcuuauaugauaggacagacggggauucaacgaaccguauuuuucgucuuaaugaugcuaguggcuccauccuauggaaugcgcuguguuggagucggaaauagagauuuuguagagggaguaaguggaggagcauggguggaccuggugcuagagcauggcggcugcguuacaacgauggcacaaggcaaaccgacucuagacuuugaacuaaccaaaaccacugcaaaagaaguggcuuuacuaagaacauauugcauagaggcauugauuaguaauauaacaacagcaacacguuguccaacccaaggcgaaccuuauuuaaaagaggaacaagaccaacaguacauuuguagacgagauguugucgauagggguuggggaaacggauguggucuuuucggaaaagggggaguugucacaugcgcaaaauuuucuuguucugguaaaauaacuggaaauuuagugcagauugagaaccuggaauauaccgugguuguaacaguacacaacggugauacacaugcggugggaaaugauacaucaaaucacgguguuacagcaacgauuaccccuagaucaccuagcguggaaguuaaacuaccagacuauggcgaguuaaccuuagacugugaaccccgaucagggauagacuucaacgaaaugauacuaaugaaaaugaagaagaaaacauggcucguucacaaacaaugguuccuugaucuaccauugccuuggacaacaggcgcggacacuuccgagguucauuggaauuauaaagagcggaugguaaccuuuaaaguuccucaugcaaagagacaagauguaacaguccuaggaucucaagaaggugccaugcauucugcgcucgcgggggcaaccgagguggacagcggggaugguaaccauauguucgcgggccauuugaagugcaaagucagaauggaaaagcuaagaauaaaagguaugucauauacaauguguucuggcaaguucucaauagacaaagaaauggcagaaacccaacacggaaccacuguuguaaaagucaaauaugagggcgcuggcgcgccauguaaaguaccgauugaaauuagggauguaaacaaagaaaaaguagugggacgaguuauaucugcaacucccuuggcagaaaauacaaauucaguaacaaacauagagcuugaaccgcccuucggggauucauauauuguaauaggaguagguaauucugcuuuaacgcugcacugguuucgaaaaggcagcucaauugguaaaauguuugaaaguacauaucgaggagcuaagcggauggcaauauugggagaaacugcaugggauuuuggaagcgucggaggucuauuuaccucguuaggcaaggcgguucaucaaguuuuuggaucaguuuauacgacgauguuugggggcguauccuggaugauaagaauccuuauugguuuccuuguauuauggauaggaacaaauucgcguaauaccagcauggcuaugacguguauugccguuggagggauuacauuguuucuugguuuuaccguucaagccgauaugggaugcgucguuucuuggagcggaagagaacuaaaguguggaucagguauauuuguaguagauaacguucauacauggacagagcaguacaaauuucagccagaaagucccgcuaggcuggcgagcgcaauacuaaaugcacacaaagaugguguaugugggauuagaucgacaaccaggcuugagaacgucauguggaagcaaauuaccaaugaacuuaauuauguacuaugggaagguggacaugauuuaacgguaguugcaggggauguaaagggagugcucacuaaaggcaagagggcccuaacgccacccgcauccgaucuuaaauauaguuggaaaacauggggcaaagcuaaaauuuucacgccagaagcgcgaaacuccaccuuucucauagacgggcccgacacaucagaaugccccaacgaacgcagggcuuggaauaguuuugaaguagaagacuacggauuuggaauguuuacaaccaauauuuggaugaaauuccgagaaggcuccucagaagugugugaucacagacugaugagcgcagcuauuaaggaucaaaaagcggugcaugccgauauggguuauuggaucgaaagcaguaaaaaucaaacauggcagauagagcgcgcuucauuaauagaaguuaaaacuugucuuuggccaaaaacacauaccuuauggucuaacggaguauuagagucacagaugcuuauaccaaaaucauaugcggguccuuuuucacaacauaacuaccgucagggauaugcuacacaaacuguaggcccauggcacuuaggcaaauuagagauagauuuuggagaaugucccgguacgacgguaaccauucaagaaaacugcgaccaucgugguccaagucugagaaccacuacggcaucagggaaauugguuacccaaugguguugcagauccuguacuaugccuccucucagguuccuuggugaagauggguguugguacggaauggaaauccgcccucugucagaaaaagaagagaacaugguaaaaucacaagucaccgcaggucaggggaccagugagacauuuucaaugggccuuuuguguuugacuuuauucguugaggaauguuuaagaaggagagucacgcgaaaacauaugauacuagccguuguaauuacuuugugugccauaauacuagguggacuuacguggauggaccuauuacgcgcgcuuaucaugcuaggggauacuaugucaggacgcauaggaggacaaacccaccuagccauaauggcgguuuuuaagaugucuccaggcuauguacucgguguauuccuacgaaagcuaacaaguagggagacugcccuaaugguuauuggaauggcaaugacuacaacacuaagcauuccacacgauuugauggaauuaaucgacggaauuucguuaggauugauauuguuaaaaauagucacacaauucgacaauacacaaguaggaacccuugcguuaucucuuacauucauacgaucaacaaugucacucguaauggcguggaggaccauaauggcagugcuguucguuguuacauuaauaccauuaugucgaaccucgugccuacaaaaacagucgcauugggucgagauaacugcacuaauauuaggagcgcaagcgcuuccuguuuaucugaugacccuuaugaagggagcuagcagaagaagcuggccucucaaugaaggcauuauggcaguaggcuuaguaucucuccuugggagugcucuauugaaaaaugacguaccgcuagcaggcccaaugguagcuggaggacuacuacuagcagcuuacguaauguccggaaguucggcugacuuaaguuuagaaaaagcagccaacgugcaaugggaugaaauggcugauauaacuggcagcucuccaauaauugaagugaagcaggaugaagacggaucauuuaguauacgugacguagaagaaacuaacaugauuacacuccuaguuaaguuggcauuaauaacaguaucaggccuauauccucucgcaauaccgaucaccaugaccuugugguauauguggcaaguaaagacacagaggucgggagccuuaugggauguaccuaguccagcugcuacucaaaaagcagcgcuaucagagggaguguaccggauaaugcaaaggggguuauuuggaaaaacucagguugguguuggcauacauauggaggguguguuucauacaauguggcauguuacucguggcucaguaauaugucaugaaacaggccggcuagaacccaguugggcagauguaagaaacgacaugauuagcuauggugguggauggagacuuggugauaagugggacaaggaagaggauguacaggugcuugcuauagaaccgggcaaaaauccgaaacaugugcaaacgaaaccaggucuauucaaaacucucacuggggagauuggagcaguaacgcuugacuuuaagccagggacuucagguucgccgauaauuaacagaaaaggaaagguuauuggcuuguacgguaaugguguggugaccaaauccggugacuauguuuccgcuaucacucaagcugaaagaaucggcgaaccagacuacgaaguugaugaggauaucuucaggaagaaacgauuaaccauaauggaucuacaucccggggcgggaaaaacuaagagaauuuuaccaucaauaguaagggaagcacuuaaaaggcggcugagaacacuaauacuugcaccaacacguguaguggcagccgaaauggaagaagcacuuagaggcuuaccuauaagauaccaaaccccagcuguaaaaucagagcauacaggacgagagauuguagaucuaaugugucaugcaacuuuuaccacccgauugcugucaagcacacguguaccaaauuauaauuuaauuguaauggaugaagcgcacuuuacggauccaaguucuguagcugcgcgaggauauauaucuacaaggguagaaaugggagaagcagccgcaauuuuuaugacggcaacgccuccaggggcaacagacccauucccucaaaguaacucccccauugaggacaucgaaagggagauacccgaacgcucauggaauacggguuuugauuggauaacagauuaucaagguaaaacagugugguucgugcccucuauaaaggcuggaaacgauauugcaaauugucuccguaaaucaggcaagaaaguaauacaacuaagucgaaaaacuuuugauacugaauacccuaaaacaaaauuaacagauugggauuucguaguaaccacagacauaagugaaaugggagcuaacuucagagcuggacggguuauagacccuagacgaugccuuaaaccuguaauacugacugauggaccugagagaguaauacuugcaggcccuauacccguuacuccggcuagugccgcucaaagacguggccgaaucggccgaaacccggcucaagaggacgaccaauauguauucaguggagauccguugaaaaacgaugaggaucacgcgcauuggacugaggcaaagaugcuacucgauaauauuuauaccccugaagguauaauucccacacuauuugguccggagagagagaaaacacaagccauagauggcgaguuccggcugagaggggaacaacgaaaaacauuugucgaauuaaugagaagaggggaucuaccugucuggcucucguacaagguagcuagcgccggcauaucauacaaagaucgggaauggugcuuuacaggggaaagaaacaaucaaauauuagaagagaacauggaaguagaaauauggacaagggaaggagagaagaagaaacuucgaccgaaguggcuggaugcgagaguauacgcugauccaauggcuuuaaaagauuucaaagaguuugccucugguagaaagagcauaacucuggacauucugacagaaauagcaaguuuaccuacguauuuaucaucgagagcaaaguuggcacuggacaauaucgucaugcuccauacaacagagagaggcgggagggcauaucaacaugcucuaaaugaacuaccugagucauuagagacauuaauguuaguggcauugcucggcgcaaugacagccggcauauuuuuauuuuucaugcagggaaaaggcauugggaaacuaaguauggguuuaauaacuauagcgguagcauccggcuuauuauggguagcagaaauucaaccucaauggauagccgcgucgauaauacuugaauuuuucuuaaugguccuguuaauuccggagccggaaaaacaaagaacgccccaggacaaccaacucauauauguuauauugacuauauuaaccaucaucggcuugauagcugcaaaugagaugggguugauagagaaaacaaagaccgauuuuggauuuuaucaaguuaaaacagaaacuaccauacuagauguggaccugaggccagcuucagcuuggacucuguacgcggucgcgacaacuauacuaacuccuauguuacgacauacgaucgagaauacaucagcaaacuuaucacuagcugcaauagcgaaucaagcugcaguacuuaugggacuagggaaaggguggccuuuacacagaauggacuuagggguuccguuauuagcaaugggguguuacucucaaguuaacccaacuacgcucacugccagucuuguuauguugcuuguccauuaugcaauuauagggccagguuuacaagcaaaagcuacgagagaggcacagaaaagaacugcagcaggcauaaugaaaaauccuacagucgacggcauuaccguaauagaucuggaaccaaucagcuacgaccccaaauuugaaaagcaacuaggacagguuaugcuucuaguuuuaugugcaggacaauuacuauuaaugaggacaacaugggccuuuugugaaguacuaacucuagcaacugguccgauacuuacuuuaugggaaggaaacccggguagauucuggaacacuaccauagcaguuaguacagcuaacauauuucguggaaguuaucuugccggugcuggacuagcauucucauuaauuaaaaacgcacaaacaccaaggagaggcacaggcacaacuggugaaacguuaggagaaaaguggaagcgacaacugaacagccuggaucgaaaagaguucgaagaauauaaacgcucagguauauuagaaguagacagaacagaagcgaaaagcgcacuuaaagacgguagcaaaauaaaacaugcgguaagucgagguucuucaaaaauaagauggauuguugaacgagggaugguaaagccgaaaggaaaaguaguugaccugggguguggaagaggaggguggucauacuacauggccaccuuaaagaacgucacagaaguuaagggauacacgaagggaggaccgggccaugaagaaccgaucccaauggcaacauauggauggaaucuugugaagcugcauaguggaguagauguuuucuacaagccgacagagcagguagacacacuacuaugcgauaucggggaaucgaguucgaaucccacaauagaagaggguaggacauugaggguucuaaaaaugguagaaccgugguuaucuagcaaaccugaguucuguauaaaaguacucaacccuuauaugccuaccguaauugaagaauuagaaaaacuccaacgaaaacacggugguaaucuaguuagauguccucucucacggaacucuacacaugagauguauugggugucuggggcuucggggaauaucgugaguucaguuaauaccacgucgaaaauguugcuaaauagauuuacaacaagacaucgaaaaccgaguuaugaaaaagauguagacuuaggggcuggaacacgaagugugaguaccgaaacagaaaaaccagauaugacaauaauaggccgacgauuacaacguuuacaagaagaacacaaagaaacuuggcauuacgaccaagaaaacccauauagaacgugggcuuaucauggaucuuaugaagcuccuucaacgggcuccgcuuccucaaugguaaauggggucguuaaacuccugacuaaaccuugggacguaauuccuaugguaacgcaauuagcaaugacugacacuacccccuucggucagcagagagucuucaaagaaaaaguggacacccgcacgccacaaccaaagccugguacgaggaugguuaugacgaccacagcaaauuggcuaugggcacuucuaggcaagaagaaaaauccaagauuauguacacgagaagaauuuauauccaaagugagauccaacgcggcaaucggagcgguuuuucaagaagaacagggguggacaagcgcgucggaagcaguaaaugauuccagauuuugggaacuuguugacaaagagcgcgcauuacaucaagaaggaaagugugaaucaugcgucuacaauaugaugggaaaacgagagaagaaacucggagaauuugguagagccaaggguuccagagcaauaugguauaugugguuaggugcacgauuucucgaauuugaagcguuagguuuccuaaaugaggaucacugguuugguagagaaaauucuuggaguggagucgagggcgagggcuuacauagauugggauauauccuggaagagauugacaagaaggacggagauuuaauguacgccgaugauacagccggaugggauacacgcauaacugaagacgaucuucaaaaugaagaacuaauaacagaacaaauggcaccucaccauaaaaucuuagcaaaagcgauuuuuaaguuaacauaccagaacaaaguagugaaaguacuuagaccuacgccaagaggagcuguuauggacaucauaagccgaaaggaccaacgugguaguggacagguagguacuuauggacuuaauacuuuuaccaauauggaaguccagcuuauacgacagauggaagccgaagguguuauuacacaagaugacaugcaaaauccuaaaggucuaaaagaacguguggaaaagugguugagagaaugcgguguugacagguuaaaaagaauggccauaaguggagaugacuguguuguuaaaccacuagacgaacguuucggaacuuccuuacucuuccuaaacgacauggggaaaguacggaaagacaucccacaaugggaaccaaguaaaggauggaaaaacuggcaagaggucccuuuuugcucacaucacuuucauaaaauuuucaugaaagauggucgcucucuaguagucccauguaggaaucaggaugaguuaauugguagggcucggauaucacaaggagcaggauggucucuaagagaaacugccugucuaggaaaagccuaugcccaaauguggucauuaauguacuuucauaggagggacuuacgauuagcaaguauggcuaucuguucagcaguaccuacggaaugguuuccuacuagcaggacaacauggaguauccaugcucaucaucaauggaugacaacagaagauauguuaaaaguguggaauagaguauggauagaagauaauccaaauaugaucgacaaaaccccaguacauuccugggaggacauaccauaucucggcaagagagaagacuuauggugcggaucguugauuggacucaguucacgagcuacaugggccaaaaauauacauaccgccauaacacaagugagaaauuuaaucgguaaagaagaauacguagauuauaugccuguaaugaagagauauucggcgccaucagagucggaagguguccuuuga

SEQ ID NO: 23707 - RNA, 9867 nt, Artificial Sequence
  derived and/or modified CDS sequence (opt6) from DENV-4__HQ332174__SS-prME
aguacgauaacuuuacuuuguuugauaccgaccgcuauggcguuucauuuauccacgagagacggggaaccacuuaugauaguggcaaagcacgaaagaggaagaccuuuacucuuuaaaacuacagaagguauaaacaaguguacccucaucgcuauggaccuaggagaaaugugcgaggauacuguaacauauaaaugccccuuguuagucaauacggaaccugaggacaucgauuguuggugcaacuugacaaguacaugggugauguaugggaccugcacucaaaguggagaacggaggcgagaaaagagaucaguagcacuaacaccacauucaggaaugggacucgaaacacgugcagaaacguggaugucgagugaaggcgcauggaagcaugcacaaaggguggaaucauggauuuuaaggaaccccgguuucgcuuuauuagcagguuuuauggcauacaugauuggacaaacgggcauucagagaacgguguuuuucguauuaaugaugcucgucgccccgucguaugguaugagaugcguuggaguaggaaacagagauuuuguggaaggugucucagggggagcuuggguagaucucguucuagagcauggcgggugcgugacaacaauggcccaagguaagccuacgcuugauuuugaacuaaccaaaaccacagcuaaagaaguugccuuauuacgaacuuauuguaucgaagccuuaaucaguaauauaacuacggcgacacgaugcccaacacaaggggaaccauaucuuaaagaagaacaagaccaacaauacauauguaggcgcgaugugguggauagaggaugggggaacggguguggcuuauuuggaaagggcgguguugugaccugcgcaaaauuuucuuguagugggaagaucacaggaaaccuaguccaaauagaaaaccuagaauauacaguugucguaacgguccauaauggcgauacucaugcaguagggaaugauacauccaaucacggaguaacagcgaccauuacaccgaggucuccaucaguagaaguaaaguugccagauuacggagaguuaacucuggauugugagccacguucaggcauagacuuuaaugaaaugauauuaaugaaaaugaaaaagaaaacuuggcucguccauaaacaaugguuuuuggauuugccacuacccuggacuacaggagcugacaccuccgagguucacuggaauuauaaggaacgaaugguuaccuucaagguaccacaugcuaaacgacaagacgucacgguauuagggagucaagagggcgcaaugcacucggcgcucgccggugccacggagguagauagcggugaugggaaccauauguucgcaggucaucugaaauguaaaguccgaauggagaaacuaagaauuaaggguaugaguuauaccaugugcucagguaaauucaguaucgauaaagaaauggcagagacacaacauggaacaacagucguuaaggugaaauacgagggagcuggggcaccaugcaaaguaccaauagaaauuagagauguuaacaaggagaaaguggugggccgaguaauaagcgcuacaccuuuagcagagaauacuaacagcguuacaaauaucgaacuagaaccaccuuuuggugacucauauaucgugauaggaguaggaaauucugccuugacacuucauugguucagaaaaggaucuucuauugggaaaauguucgaaaguaccuacagaggugccaaaagaauggcaauacuuggggaaacagcuugggacuuuggaucaguagggggauuguucacuuccuuagguaaagcuguacaucaaguuuuugggucagucuauacaacaauguucggaggugugaguuggaugauuaggauucuaauuggauuuuuaguauuauggauagguacaaacagucguaauacgagcauggcaaugacauguauagccgugggagggauuacuuuauuucuagguuuuacgguccaggcugacaugggaugcguagucaguuggagcggcagggaacuaaaauguggauccggaauuuuuguuguggauaacguacauacauggacagagcaauacaaauuccaaccagaaucgccagcaagauuagcuucugcuauccuuaacgcacacaaagacggaguuuguggaauuaggucaacaacgcgacuagaaaacgugauguggaaacaaaucacaaaugaauuaaacuacguacuuugggaagguggccaugaucuuacaguuguagcuggggaugugaagggcguguuaacgaaggguaagcgugcguuaacaccaccagcauccgaccucaaauacucauggaaaaccuggggcaaagcgaagauuuuuacucccgaggcgcggaauaguaccuuuuuaauagauggaccugacacaucagaauguccaaaugaacgacgugcuuggaacagcuuugaaguagaagacuacggauucgguauguucacuaccaauauauggaugaaguuccgagaaggaaguagcgaagugugcgaccauagacuaaugagugcugcaauaaaagaccaaaaggcuguacaugcugauauggguuacuggauagaaaguucaaagaaucaaaccuggcaaauagaacgagcgaguuuaauagagguuaaaacaugccuuuggccuaagacccauacucuauggucgaacggaguacuagaaucacaaaugcuuauaccaaaaucauaugcgggaccuuuuagucagcauaauuacagacaaggauaugccacacaaacgaugggaccauggcaucuaggcaagcucgaaauagauuucggggaaugcccaggcacuacuguuacaauacaagagaacugcgaucauagaggcccuaguuuaagaacaacgacagccuccgguaagcuagucacucaauggugcugucguuccugcacaaugccaccguuaagauuucuaggagaagaugguugcugguauggaauggaaauccgaccauuaagugagaaagaagaaaauauggucaaaucgcaaguaacggccggacaaggagcuucagaaacuuuuaguaugggauuacuaugccugacauuauuuguagaagaaugucuaaggagacgaguuacgcggaagcauaugauucuagcaguagugauaaccuugugugccauaauucucggcggccuuaccuggauggauuuauuaagggcguuaauaauguugggagauacuaugucaggaagaauaggaggccagacucaucuggcgauuauggcgguauuuaagaugucgccagguuauguacuaggcguauuuuuaaggaaauuaacaucaagagaaacugcacuuaugguaauugggauggcuaugacaaccacuuuaagcauaccgcaugaucucauggaauuaauugauggaauauccuugggcuugauacuccuuaaaauuguaacgcaauucgauaauacacaaguagguacuuuagcauuaucauugacauuuauuagaaguacuaugagucuaguuauggcguggcgcacgauaauggcuguccucuucguuguaacuuuaaucccacugugccgcacaaguugucuccaaaaacaaucgcacuggguugaaaucacagcuuuaauucuuggagcacaggcacucccaguauacuuaaugacacuaaugaagggagcgagcagacguaguuggccuuugaaugaagguaucauggccguuggcuuaguguccuugcuugguagugcuuuacuuaaaaaugacguuccuuuagccgggccaauggucgcgggcggcuuacuauuggcagcuuacguaaugucaggauccucagccgauuuaucgcuagaaaaggcggcgaauguacaaugggaugaaauggcugacauaacgggauccagccccauuauagagguuaaacaggaugaagacgguucuuucucuauaagagaugucgaagaaacgaauaugaucacuuuauuagucaaacuggcauuaauaacaguuucuggauuguauccacuugccauucccauaacaaugacacuaugguauauguggcagguaaaaacgcagagaucuggagcccuaugggaugucccaagcccugcagcuacccaaaaagcugcacuaucagaaggaguauauagaauaaugcaaagaggauuguuuggaaaaacgcaaguagguguuggaauacacauggaagggguuuuucauacgauguggcaugugaccagaggcucgguuauuugccaugaaacugguagguuagagccaagcugggccgauguacguaaugacaugauaaguuauggagguggcuggcgguuaggugacaaaugggacaaggaagaagauguccaaguuuuagcaauugaaccuggcaaaaauccuaaacauguacaaacgaaaccaggacucuuuaaaacucuaacuggugaaauuggcgccgucacacuagauuuuaaaccagguaccagcggcaguccaauuauaaaucgcaaaggaaaaguuauuggcuuauauggaaaugguguaguuacuaaaucaggggacuauguuagugcaauuacucaagcggaacggauaggugaaccagauuaugaaguggaugaagauauauuccguaaaaagcgguuaacuaucauggaucuccaucccggcgcagguaaaacuaaaagaauacuaccuaguauuguuagagaagcucuuaaacgacggcuuagaacuuuaauccuagcuccaacaagagucgucgccgcggaaauggaagaggcuuuacggggucuuccgauaagauaucaaacgcccgcaguuaaaagugaacacacaggacgagagauaguugaccuaaugugccaugcuacguuuacuacccguuuguuauccaguacuagaguaccaaacuauaaccuuauuguuauggaugaggcgcauuuuacugacccgucaagcguagcggcgagagguuauauaaguacgcgaguggaaaugggugaagcugcggccauauucaugacagcuacgcccccaggagcaaccgacccauuuccccaauccaauaguccaauagaagauauagaacgggaaaucccagaacgcuccuggaacacaggcuuugauuggauaaccgauuaccagggaaaaacugugugguucguaccuagcaucaaagcggguaaugauauugcaaauugcuuaagaaaaaguggcaaaaaggugauccaauuaagcaggaaaaccuucgauacggaguauccgaagacaaaguugacagauugggacuuugugguaacuacugacauauccgagaugggagcaaauuuuagagcggguagagugauugauccgaggagaugucucaaaccuguaaucuugacagacgguccggaaagggucauacuagccggaccaauaccuguaacucccgcaucagcagcacaaagacgaggucguauuggcaggaaucccgcacaagaagaugaucaauauguguuuagcggagauccacugaaaaacgaugaggaccacgcccauuggacagaagcaaaaaugcuacuagauaauauauauacacccgaggguauuauaccuacacucuucggcccagaaagggagaaaacgcaagcaauugauggggaauuucgccuucggggagaacaaagaaaaacguuuguagaauuaaugcguagaggcgauuuaccuguaugguuaaguuacaaggucgcaucugccgggauaucuuauaaggauagagaaugguguuucacuggcgagagaaacaaccaaauacucgaggagaauauggaaguagaaauuuggacuagagagggagaaaagaaaaaguuaagacccaaguggcuugacgcgagaguauaugcggacccuauggcuuuaaaagacuucaaagaguuugcaagcggcagaaaaucaauaacacuagacauucuaacagagauagcaucccuacccacguaucucucaucacgcgcgaaauuagcauuggacaauauaguuauguuacauacgacagagcgcggugguagggcuuaucagcaugcccuuaacgagcucccagaaucacuagaaacucuuaugcuugucgcacugcugggagcaaugacagcgggaaucuuucuauucuuuaugcaaggcaaggggaucgguaagcugaguauggggcugaucacgauugccguagcaucaggauugcucuggguagcggaaauucagccacaauggauagcagcaucgauaauacucgaauuuuuccuuaugguccuacuaauuccggaaccagagaaacaaagaaccccacaagauaaucagcuaaucuacgugaucuugacgauucucacgaucauaggauuaauagcagcgaacgaaaugggacuaaucgagaaaaccaagacagacuucgguuucuaccaagcaaaaacagaaacuaccauauuagacguagauuuacgaccagcaucggcauggacacuauaugcuguagcgacuaccauacuaacaccaaugcucaggcauacaauagaaaauacuuccgcgaaccucagcuuggcugcaaucgcgaaccaagcggcuguuuugauggggcuaggaaaaggauggccacuacaucgcauggaccuuggaguuccgcuauuggcgaugggaugcuauucgcaagugaacccgacgacauuaacagcaagccuagugaugcucuuggugcauuaugcgauaauugguccaggccugcaagcaaaagcaacuagagaggcacaaaagcguacagcugcgggaauaaugaagaacccgaccguggaugggauaacgguuauagaucucgagcccauuagcuacgacccaaaauucgaaaaacaauugggacaagucauguuauuagucuuaugcgcuggacaauuauuauugaugcggacaaccugggcuuucugcgaaguacuaacacucgcuacuggcccaauuuugacacuuugggagggaaacccaggccguuuuuggaauacuaccauagcuguaucgacugccaacauauuuagagggagcuaucuagcaggagcagggcuggcauucucacugauuaagaaugcacagaccccuagacgaggcacagguaccacaggggaaacccucggagaaaaauggaagagacagcuaaauucucuggacagaaaggaauuugaggaauauaaacgcucaggaauuuuggaaguugauagaacagaagcaaaaagugcgcuaaaagauggaagcaaaauaaaacacgcuguuagccgaggaucuucgaagauaagauggauaguagagcgcggaaugguuaaaccgaaaggcaaaguuguugauuuggggugcggcagaggcggauggagcuauuacauggcaacucugaaaaacguaacggaagucaaaggguacacaaagggaggaccuggucaugaagaaccgauucccauggcaacuuacggcuggaaucugguaaaauuacauaguggaguggacguauucuacaaaccgacagagcaaguugauacacuguuaugugauauaggagaaagcucauccaacccaacaauugaagaaggcagaaccuuaagaguuuuaaagaugguugagccuuggcuaagcucaaaaccugaguucugcauaaaaguucugaauccuuauaugccgacugugauugaagaauuagagaaauuacagcgaaaacacggugggaacuuaguaaggugcccgcuuucacgaaacucaacacacgaaauguauugggucuccggugcaagcggaaauauaguaucuucagucaauaccacuucaaaaaugcuuuugaaccgguuuacaacaaggcauaggaaaccgacguaugaaaaagauguugaucugggagcagguacacggucgguauccacagaaacggaaaaaccagacaugacaauuauuggacgaagacuucaaagacuacaggaagaacauaaagagacuuggcauuacgaucaggaaaauccguaccguacaugggcguaucacgguuccuaugaagccccuaguacgggaagcgcaaguucaauggugaauggagugguuaaauuauuaacaaaaccuugggauguuaucccaaugguuacucagcuagccaugacugacacaaccccauuuggacaacaacgaguauucaaagaaaaaguagauacucgaacaccucagccaaagccaggaacacgaacaguaaugacaacgacugccaauugguuaugggcacucuuaggcaaaaagaaaaauccuagacuguguacucgggaagaguuuauuucgaaaguaagaucgaaugcugcaauaggcgcggucuuccaagaggagcaaggauggacauccgcauccgaagcaguaaaugauaguagguuuugggaguuaguggauaaggaacgagcuuuacaucaagaagguaaaugugaguccugcguauacaauaugaugggcaaaagagagaaaaagcuaggugaguuugggcgagcaaagggaaguagagccauaugguauauguggcucggggccagauuucuagaauuugaggcguuaggguuucuaaacgaagaucauugguucgguagagaaaacucauggucaggaguggaaggagaaggauugcaucgauuaggauacauauuagaagaaauagacaagaaagacggagaccucauguaugcggacgacacggcagguugggauacgagaauaacagaagacgacuuacagaaugaagaacuaauuacugaacagauggcuccacaucacaaaauauuagcaaaagccauauuuaaacucaccuaccaaaacaaagucguaaaggucuuacgacccacuccccguggagcgguuauggauauuauuagucgaaaggaccaacggggaucgggucaggugggcaccuauggauugaauacauuuaccaacauggaagugcaauuaauacggcaaauggaggcagaaggaguaauaacacaagacgacaugcaaaaccccaaggggcuaaaggaaagaguagagaaaugguuacgugaaugugggguagaucgacuuaagagaauggcgauuuccggagacgauuguguaguaaaaccuuuagaugaacgauucggaacaaguuuauuauucuugaaugacaugggaaagguacgcaaagacauaccacaaugggaaccuucuaaaggauggaagaauuggcaagaaguuccuuuuuguucacaucacuuccauaaaauauuuaugaaagacggucgaagucugguaguaccgugcagaaaucaagacgaacucauugguagggcgagaaucucacaaggagcuggcuggucauugagggagacggcgugucuuggcaaagcauacgcccaaauguggucauuaauguauuuccacagaagagaccuaaggcuggccuccauggcaaucugcagcgcugugcccacugaaugguucccaacuucucgcacuacuugguccauacacgcucaccaucaauggaugacuacagaggauaugcuuaaaguguggaaucgcguauggauagaagauaauccuaacaugauagacaaaacaccgguccauucuugggaagauauacccuacuuaggaaaaagagaagaucuuuggugugguucuuugauuggcuuauccucgcgugccacaugggccaaaaauauacauacggccaucacacaaguacguaauuuaaucggaaaagaagaauauguugauuacaugccaguaaugaaacgcuacucugccccuucggaaucagaaggaguacuauaa

SEQ ID NO: 23708 - RNA, 9867 nt, Artificial Sequence
  derived and/or modified CDS sequence (opt6) from DENV-4__KT026308__SS-prME
aguacuauaacauugcuuuguuuaauaccaacgguuauggcguuccauuuaucaacgagagacggagaaccacuaaugauuguggcaaaacacgaacgaggacguccuuuauuauuuaaaacuacugaagguauaaauaaaugcacgcuaauugcgauggaccuaggagaaaugugcgaagauacagucacauacaaauguccccuguuagucaauacugaaccugaagacauugauugcugguguaaucugacuuccacuuggguaauguauggcacauguacgcaaucuggggaaagacgccgugaaaaacgcucaguagcguuaacaccacauagcggcaugggacuagaaacaagagcagagaccuggaugaguagugaaggggcguggaaacacgcgcaacguguagaaucguggauauugcgaaaucccgguuucgcuuuacuugcagguuuuauggcauacaugauaggccagacaggcauucagagaaccguauucuucauacugaugauguuggucgcuccuucuuaugguaugagauguguaggcguagguaacagagacuuuguagaaggaguuaguggaggagcauggguggaccuaguacucgagcacggaggaugcguaacuacuauggcucaaggcaaaccuacguuagauuuugaauuaauaaaaacaacggcaaaagaaguagcccuucuccguacuuacugcauagaagccagcauuucaaacaucacuacagcuacaagaugucccacacaaggcgagccauacuuaaaagaagaacaggaucaacaauacauaugccgaagagauauggucgaucgggggugggguaacggcuguggacuauuugggaaaggagguguaguaacgugugcuaaauuuucaugucucgggaaaauaacagguaauuuaguacaaaucgaaaaucuugaauauacugucgucguaacuguucacaacggugacacucacgcaguuggaaaugauacaucuaaucauggagugacagccaccauaacaccgagaucaccaucgguagaaguucagcuaccagauuauggugaacuaaccuuagacugugaaccccguaguggaauagauuucaacgaaaugauauugaugaaaaugaaaacaaaaacuuggcuaguacacaaacagugguucuuagaccuaccacuuccuuggacaaccggagcagauacccuagaggugcauuggaaccauaaagaaagaauggucacauucaagguaccccacgcaaaaagacaggauguaacgguauuaggaucccaagaaggugcgaugcacucagcauuagcgggcgcuaccgaaguagauucaggugacgguaaucauauguuugcaggacauuuaaaguguaaaguacguauggagaaacuaagaauuaaggguaugaguuauacaaugugcucuggcaaauuuucaaucgacaaggagauggcagaaacacaacaugguacuacaguugucaaagucaaguaugaggguacaggagcaccauguaaaguaccuauagaaauucgcgauguuaacaaggagaagguaguuggcaggauuauuuccaguacaccuuuugcugagaacacaaacucggugacgaauauugaacuagaaccaccauucggagauucauacauuguaauuggagucggugacucagcccuaaccuuacacugguuccgaaaaggcagcuccauaggaaagauguucgagucaacauacagaggugccaaacgaauggcaauacugggagagacagcaugggauuucgguuccguagggggucuuuuaacaagccucggaaaggcaguacaucaaguauucggaagcguauacacgacgauguucggagggguuucuuggaugguaagaauuuuaaucggauuauugguuuuauggauuggcacaaacucuaggaauacuucaauggcgaugucuuguaucgccguaggcggcauuacuuuauuucugggguucacaguacaugcagauaugggaugugucguuagcugguccggcaaagagcuuaaaugcgggucugggaucuuuguaauagacaauguucauacuuggacagaacaauacaaauuucaaccagaaucuccagcacgauuagcaucagcaauacuaaaugcacacaaagagggaguauguggaauacgaucgacuacacggcucgaaaacgugauguggaagcagaucacgaacgaauuaaauuauguacucugggaagggggacaugauuugacaguaguagccggugacgucaaaggcguguuaagcaaagguaagagggcacuggcacccccuguuaacgauuuaaaguauaguuggaaaacauggggaaaggcaaaaaucuucacacccgagaccagaaauagcaccuucuugguagaugguccagauacuucagaaugccccaacgagaggagagcauggaauuucuuagaaguagaagauuauggauucggaauguuuacaacgaauaucuggaugaaguucagagaagguuccucugaagucugcgaucaucgauugaugagugccgcaauuaaagaccagaaggcgguacaugcagacaugggcuauuggauagaaucaucgaaaaaccagacauggcaaauagagaaagccaguuuaauagaaguuaaaacuugccuauggccgaaaacgcauacgcuuuggucaaacggaguacuagaaucacaaaugcuaauuccgaaagcauacgcaggaccaauuucgcagcauaauuaccgacaggguuacgcaacgcaaacugcagguccuuggcaucuggguaaacuagagaucgauuuuggagagugcccagguacaacaguuacaguacaggaagauugcgaucacagaggacccagccuacgcaccacuacagcaagugggaaauuaguaacacaguggugcuguagauccuguacuaugccucccuugcgguuucuaggugaagacggaugcugguauggaauggaaauucgccccuugaaugagaaagaagaaaauaugguuaagucucaagucucagcgggucacggcacaagugagacauuuuccaugggucugcucugcuugaccuuguucguagaggaauguuugagaagaagaguuacaagaaagcauaugauauuaguuguugugacuacccuaugcgcgauaaucuuaggaggcuuaacauggauggauuuacuuagggcacuaauaaugcuuggagauacaaugaguggacgaaugggaggucaaauacauuuagcuauuauggcaguuuuuaaaaugaguccuggauauguguuaggaauauuccuaagaaaacuuacaucacgggaaacagcacuuauggucauaggaauggcaaugaccacagugcucagcauuccucaugaucuaauggaauuuauagaugguauaagucuuggucuuauacuucuaaaaauggucacacauuuugacaacacacagguuggaacgcuagcacuagcacugaccuuuauuaaaucgacaaugccauuaguuauggcuuggagaacuaucauggcugugcuauuugugguaaccuugauuccgcuaugucggacguccugccuacaaaagcagucacacuggguugagauaacugcauugauauuaggagcucaagcgcuaccaguauauuuaaugacacucaugaaaggagcuucuaaaagaaguuggcccuuaaaugaagguauuauggccguaggccuuguaucacuauuaggaucugcccuuuugaagaacgauguuccgcuagcaggacccaugguggcaggaggguuacuuuuagcugcuuacguaaugaguggaucuucagcagaucugaguuuagagaaagcugcaaaugugcaaugggacgaaauggccgauauaacaggaucuucaccgauaauagaagucaagcaagacgaagacgguagcuuuagcauaagagauguagaggagaccaacaugauaacacuccucgucaagcuagcguuaauaacagucagcggacuauacccacuagcuauuccaguaaccaugacccucugguacauguggcaagugaaaacacaaaggucaggagcauugugggauguuccaucacccgcagcggcucagaaagcaacacuuacagagggugucuauagaauaaugcaaagaggauuguucggcaaaacucaagucgguguaggaauacauacagaaggaguauuucacacuauguggcauguaacgcgagguuccguaauuugccacgaaucagggcgauuggaaccaaguugggccgauguaaggaacgacaugaucucauauggugguggguggagguuaggugacaagugggacaaagaagaagauguacaaguccuagcaauagaaccagguaaaaaccccaaacauguccaaaccaaaccagggcuuuuuaaaacccuaacuggugaaauuggugcugucaccuuagauuucaaaccaggcacaucgggaucaccgauaauaaauaggaaaggcaaaguuaucggauuguacgguaauggcgugguuacaaaaucaggugacuaugucucagcgauaacucaggcugaaagaauaggcgaaccagauuacgaaguagacgaagauauauucaggaagaaacggcuuacgaucauggaucuccaccccggcgcagguaaaacaaaaagaauauugccauccauaguaagagaagcucuuaagcgacgauugagaacgcuuauauuagcaccgacuagaguaguagcagccgaaauggaagaggcguuaagagggcuuccaauaagguaucagacuccugcagugaaaagugaacacacaggcagagaaauaguggaccuuaugugucacgcuacauuuacuaccagauuauuauccagcacuagagugccgaauuauaaccuuaucgugauggaugaagcucauuucacagacccgucaucagucgccgcacguggauauaucucuacccgcguagaaaugggugaggcagccgcuguauuuaugacagcaacacccccaggaacuacagauccguuuccccaauccaauucgccgauagaagacaucgaaagggagauaccagagagaucuuggaauaccgguuucgauuggauuacugauuaucaaggcaagacgguuugguucguaccauccauaaaagcgggaaacgauauugccaauugcuugagaaaaucuggcaagaaagugauucaauuaucaagaaaaacguuugacacagaguacccuaaaacuaagcuaacagauugggacuucguuauuacuacagacauaucagagaugggugcaaacuuucgcgcagguaggguaauagaccccagaagaugucugaagccggugauacuaacagaugguccagaacgcguaauccuggcuggaccaauaccuguaaccccugcaucagcagcacagaggagaggucgcauugggagaaauccggcacaagaagacgaucaauaugucuuuucuggggauccacuuagaaacgacgaagaccaugcgcauuggaccgaggccaaaauguuacuagacaauauauauacucccgaagguauaauaccaacauuguuugguccagaacgugagaaaacccaagcaauagauggagaguuucguuuacgaggagaacaacggaaaacauucguagagcuaaugcguagaggcgaccuuccaguaugguuaucucacaaaguugcuagugcagguaucucauacaaagaucgcgaguggugcuuuacaggagaaaggaauaaccagauucuagaagaaaauauggaaguagaaauauggacuagagaaggcgagaagaagaaacuacgacccaaaugguuagaugcgcgcguauaugccgauccaauggcauuaaaagacuuuaaagaauuugcauccggccguaaaucuauuacacuggacauauuaacugaaauagccucacuuccaacauauuuauccuccagagcuaaacuggcguuagauaacauagucaugcuccacacuacagaaagaggugggaaagcauaucagcaugccuuaaaugaacugccagagagcuuagaaacauuaauguuaguugcguuacuaggagcuaugaccgcuggaauauuucuauucuuuaugcaaggaaaggguauggguaaauuauccaugggccuaaucgcuauagcuguagcuagugggcucuuauggguugcggaaauacaaccucaauggauagcagcauccauaauacuagaguuuuuccuuaugguacuguuagugccugagccggaaaagcaaagaacaccccaggauaaucaacucauuuauguaauauugacaauacuaacgauaauagcacucguagcagcaaaugaaaugggacugauagagaaaacuaaaacugauuucggauuuuaccaaguaaaagcagaaacaacuauacuggacguugaucuaagaccagcaagcgccuggacuuuauaugcuguagcaacuacaauauuaacgccuauguuacgccacacgauugagaauacgagugcaaauuuaaguuuagcugcuauagcaaaccaagcugcuguucugaugggucuugggaaagguuggccccugcacagaauggacuuaggcgugccacuucuagcgaugggauguuauucccaaguuaauccaacaacauuaacagccucuuuagucauguugcugguccauuaugcuauaauugguccuggacuacaagcuaaagccacuagagaggcucagaagagaacugcggcaggcaucaugaaaaacccgaccguagauggaauaacugugaucgaccuagaaccuaucuccuacgauccuaaauuugaaaaacaguuagggcagguaauguugcucguacuaugugucgggcaacuguuauuaaugagaacuacgugggcauucugugagguucuaacucucgcaaccgggccaauccuuacauuaugggaaggcaauccaggucgguuuuggaauacuacaauugcgguaagcacagcuaacauauuuagaggcaguuaccuugcuggugcaggauuagcuuuuucauugaucaaaaacgcacaaacaccacgacgagguaccggaacaaugggagagacucugggagagaaauggaaacgacaacucaauucacuugaccgcaaggaguuugaagaguacaaacgcagcgggauauuggaagucgaucgaacagaagcucgaucugcauuaaaagacgggucgaaaauuaaauaugcgguaucuagaggcacaagcaaaauuagguggauuguugagcgagggaugguuaaacccaaaggaaagguaguagacuuaggcugcggacgaggaggaugguccuauuacauggccacccucaaaaauguuacugaagugaaaggcuauacaaagggaggaccgggucaugaagaaccuauaccuauggcgacauacggauggaaucuaguuaaacuccauucugggguugacguguuuuauaaacccacugaacaaguggauacacucuuaugugacaucggugagucuaguaguaaccccacgauagaggagggacguacauuaagaguucuaaaaaugguggagccuugguuaucaucgaaaccugaauuuugcauuaaaguguugaauccguacaugccuacugucaucgaggaauuagaaaaauuacaacguagacacggagggagcuuaguacgauguccuuuaagcagaaacuccacucacgaaauguauugggugaguggggugucuggaaacauaguaagcaguguuaacacaacaaguaagaugcuacuaaauagauucaccacgaggcaucguaagccgacuuacgaaaaagaugcugacuuaggggcugguacgaggagugucagcaccgagacggaaaaaccagauaugacaauuauaggccgccguuuacagagacuacaagaggaacacaaagaaacauggcauuacgaccaugaaaacccauaucgaacuugggcauaccacggaaguuaugaggccccaaguacugguucagcguccagcauggugaacgggguaguaaaacuucuaacuaaaccaugggauguuguuccgauggugacgcagcuggcaaugaccgacaccacaccauucggucaacaacguguguucaaggagaagguugauacuagaacaccccaacccaaaccaggaacacaagucguaaugaccacgacggcuaacuggcuauggacucuacuugggcguaagaaaaacccaaggcuauguacucgugaagaauuuauuucuaaagugagaagcaaugccgcaauaggagcgguauuccaggaagaacaaggcuggacaucagcgucagaagcgguuaaugacucacgauuuugggagcuaguugacaaagagagagcuuuacaucaagaaggaaagugcgagagcuguguguacaacaugauggggaaacgagagaagaaacucggugaguuuggucgcgcaaaaggauccagagccauuugguacaugugguugggagcucgcuuucuagaguucgaagcacuaggcuuuuuaaacgaagaucacugguuuggaagggaaaauuccugguccggcguugaaggugaaggacuacauagacuugguuauaucuuagaagacaucgauaaaaaggacggcgacuugauauacgcugacgauaccgcugggugggauacccguauaacugaagacgauuugcuaaaugaggaguugauuaccgaacagaugacaccgcaucacaagauacucgcuaaagcuauauucaaacuaacauaccaaaauaaagucguaaaagugcuacggccaacaccaaagggagcaguaauggauaucauaucuagaaaagaucaaagaggaagugggcaaguaggaacauauggauuaaauacauucacaaacauggaaguacaauuaauaagacaaauggaagccgagggggugauaacgcgagaugacaugcacaauccgaaaggacuuaaagaaagggucgaaaaauggcugaaagagugcggagucgauagacuaaaaagaauggcaaucucuggggaugauugcgucguuaaaccacuagacgaaagauucagcacaucguuacucuuucuaaaugauauggguaaagugcgaaaagauauuccacaaugggaaccuagcaaaggguggaaaaauuggcaggaaguuccauucuguucucaucauuuccauaaaauuuuuaugaaagauggcagauccuuagucgugccuugucgaaaccaggacgaacuuauaggacgggcuaggauaucgcaaggugcuggauggucauugagagaaacagcaugccuaggaaaggcuuaugcacagauguggagucuuauguauuuucaccggagagaucuucgcuuagcgucuauggcaaucuguucagccguaccuacagaaugguuccccacguccagaacgacauggucuauucaugcacaccaccaguggaugacaacagaagacaugcuuaaagucuggaaccgggucuggauagaagacaauccuaauaugauugacaagacaccaguucauagcugggaagauauaccguaucuaggaaaacgcgaagaucuguggugugguucauugauaggacucagcaguagagcuaccugggccaaaaacauacauaccgcaauuacccagguacguaaucuaauagguaaggaagaauauguugacuacaugccggcuaugagacgcuacucugcacauuuugagucagaggggguacucuag

SEQ ID NO: 23709 - RNA, 9867 nt, Artificial Sequence
  derived and/or modified CDS sequence (opt6) from DENV-4__KT026309__SS-prME
aguacuauuacacugcucugccuuauaccuacggucauggcauuccacuuaagcacucgcgauggagaaccguuaaugauuguugcaaaacacgaaaggggaagaccucuuuuguucaaaacaacugagggaauaaacaaauguacacuaauugcaauggaucuaggagaaaugugugaagauacgguuacuuacaaauguccucuacucguuaacacugaaccugaagacauagauugcugguguaaucuaacgucuacaugggugauguacgguacuuguacucaaucuggugaaaggagacgggagaaacggagcgucgcuuugacuccgcauagugggaugggguuagaaacacgugcggaaacguggaugucaucagaaggagcguggaagcacgcucaacgcguagaaaguuggauauuaagaaacccgggauucgcacuauuagcaggauucauggccuauaugauaggacagaccggaauccaaaggacuguauucuuuauccuaaugauguuaguggcucccucguacggaaugagaugugucggaguaggaaauagagauuuuguugagggagucucugggggagccuggguugacuuagucuuggagcauggcgguuguguaacgacaauggcgcaagggaagccaacacuggauuuugaacuaaucaaaaccacagcuaaagaggucgcguuacuaaggacauacuguaucgaagcguccaucagcaauauaacaacggcaacuaggugcccuacccaaggugaaccguacuugaaagaggaacaagaccaacaauacauaugcagaagggauaugguggaccgaggauggggaaacgggugcggcuuguucgguaaggguggcguagugacaugugcuaaauucucaugcuuagguaaaaucacaggaaaucuaguccagauagaaaauuuggaauacacaguugugguuacuguccacaauggagauacucacgcaguagguaaugauacgucgaaccacggcguuacagcaacuauaacgccuaggaguccuuccguagaaguacagcucccagauuauggcgaauugacauuagauugugaaccaagaucagguauagacuucaacgaaaugauacucaugaaaaugaaaaccaaaacauggcuuguacauaagcaaugguuuuuggaccuaccuuuacccuggacaacaggagcagauacucucgagguccacuggaaucauaaagaacguaugguaacauucaaaguaccucacgccaaaaggcaagauguuacaguacuagggucucaagagggggcaaugcacuccgcgcuugcuggugcaacagaggucgauucaggugauggaaaucauauguuugcaggccaucuuaaauguaaagugcgcauggaaaaacuaaggaucaaggggaugucauauacaauguguucugguaaguuuucuauugacaaagaaauggcagagacgcagcacgguacgacgguugugaagguaaaguaugagggaacuggagcacccugcaaaguaccuauugagauuagagauguaaacaaggagaagguggucggucgaauuaucucaucuacaccuuucgcugagaauacuaauuccguaacgaauauagaguuagagccacccuucggcgacagcuacauagugauaggugucggggacucagcauuaacucuacauugguucagaaaaggaagcucuauaggaaaaauguucgagaguacuuauaggggcgcaaaacgaauggcuaucuuaggugaaacagcaugggauuucggaucaguagguggccuguuaacgaguuugggaaaagcaguucaccaaguauuuggcucuguauauaccacaauguucggagguguuucauggaugguaaggauccugauaggucuucuaguguuauggauagguacaaacucgcggaacacgagcauggcuaugucuuguauugcaguuggaggaauuacacuauuccuaggauuuacaguacacgcugacauggguugugucguuaguuggagugguaaagaauuaaaaugcggaucagguauauucgugauagauaacguccauacauggacugaacaguauaaauuccaaccagagaguccugcucgacuagcaagugcaaucuuaaacgcacacaaagagggaguaugcggaaucagaaguacaacuagauuggagaacguaauguggaaacaaauuaccaacgaauuaaauuacguccuuugggagggaggucacgaccuuacuguaguagcuggagauguuaagggcguucuuuccaaagguaaaagggcacuagcaccuccugugaacgaucucaaauauucuuggaagacauggggcaaagccaaaauuuucaccccagaaacccgaaacucuacauuuuuaguagacggcccagauaccucagaauguccaaaugagcggcgagccuggaacuucuuagaaguagaagauuaugguuuugguauguuuacgacgaacauuuggaugaaauucagggaaggaucuucugaaguaugugaucauagguuaaugagcgcagcaaucaaagaucaaaaggcaguccaugcugauauggguuauuggauagaaaguagcaaaaaccaaacauggcaaauugaaaaagcaucauuaauugagguaaaaacguguuuguggcccaaaacacauacguuguggagcaauggaguacuagaaagccagauguuaauaccaaaagcauacgccggaccaauaucucaacauaauuacagacaagguuacgcgacccagacagcaggccccuggcaucuuggaaaauuagaaauugauuucggagaaugccccggaaccacuguaacuguacaagaggauugugaccauagagguccaagucugagaacaacaacugccucugguaaacuugucacacaaugguguugccguucaugcaccaugccuccacuaagauuccugggugaagacgggugcugguaugguauggaaauucgaccguuaaaugaaaaagaagagaauauggugaagucgcaagucagugccggacacgguaccagcgaaacauuuaguaugggauuauuguguuuaacguuguucguagaggaaugccugagaagaaggguuacgaggaaacauaugauccuaguaguagucacuacauuaugugcgaucauuuuaggaggacuaacuuggauggacuuacugcgugcacugauuauguuaggugacaccaugucagguagaaugggaggacaaauacauuuggcgauuauggcgguuuucaaaaugagcccuggauacgucuuaggaauauuccuccgaaaacuaacaucuagagaaacagcacugauggugaucgguauggccaugacuacuguuuuaagcauaccacaugaucucauggaauuuauagacggaauaaguuuaggauugauacuacucaagauggucacgcauuucgauaauacacaaguggggacauuagcacuugcgcucaccuucaucaaguccaccaugccacugguaauggcuuggcgaacgauuauggcgguuuuauucguggucacgcuaauuccuuuaugucguaccucuugcuuacaaaagcaaucgcacuggguugaaauuacagcauugauacucggcgcgcaagcauuaccagucuaccuuaugacacugaugaaaggagcuucuaaaagaagcuggccauuaaaugaaggcauaauggccguuggccuaguuucacuacuugguucagcauuacuaaagaaugacgucccuuuagcggggcccaugguugccgggggucuccuccuagcugcauacguuaugucagggaguagugcagaucucucucuagagaaagcggcaaacguacaaugggaugaaauggcagacauuacugggucgucucccauuaucgaagucaaacaagacgaagauggaucauuuagcaucagagacguagaggaaacaaacaugauaacucuauuaguaaaauuggcacuuauaacagugucaggauuauacccccuagccaucccaguaacuaugacgcuaugguacauguggcagguuaagacccagcgcucuggggcgcucugggauguacccucgccagcugcggcacagaaagcgacucuaacagaaggaguauaucguaucaugcaaagggguuuguucggaaaaacacaaguagguguagguauccauacggaggguguuuuccacacuauguggcauguaacaagaggaucagucaucugccaugaaagcgggagacucgaaccaagcugggccgauguaagaaaugauaugauaagcuacggcggaggauggcgguuaggugacaagugggauaaagaggaagauguucaaguuuuagccauagaaccgggcaaaaauccaaaacacguacaaaccaaaccgggacucuuuaagacacuaaccggagaaauuggugcuguaaccuuagacuucaaaccgggaacaagugguucaccuauaauaaaucgcaaaggaaaagucauuggucuuuacggaaacggaguugucacaaaaaguggagauuacgugucugccauaacacaagcagaacgaaucggggagccagacuaugaagucgacgaggauaucuuuagaaagaaaagguuaaccauuauggaucuacauccaggugcggguaaaacaaaacguauccuaccuucaauaguucgggaagcguuaaaacguaggcuuagaacacuuauucuugcacccacgcgaguaguggccgcagagauggaagaggcauuaagagguuuaccuauacgauaucaaacacccgcgguuaaaagcgagcauacaggcagggagauaguugaccugaugugccaugcuaccuuuaccacucgacuucuaucaucaacaaggguuccuaauuacaaccuaauaguaauggaugaagcucauuuuaccgauccauccagcguagcggcaagaggcuauauaaguacucgagucgaaaugggugaagcugcagccguauucaugacugcaacaccaccuggaaccaccgaucccuucccacaaaguaauucaccuauagaggauaucgaaagagaaaucccugagagaagcuggaauaccggguucgauuggaucaccgauuaucaggguaaaacaguaugguuugucccaucaaucaaagcugguaaugauauugcaaacuguuugaggaaaagcggcaagaaaguuauacaacuuucccguaagacauuugacacggaauaucccaaaaccaaacuaacagacugggacuuuguaauaacaacugauauuucagaaaugggcgcgaauuuucgugcgggacgagugauagauccucgcagaugccuaaaaccaguuauauuaacagacgggccagaaagaguaauauuagcuggcccaaucccaguuacuccugccagcgcugcucaaagaagagguagaauugggcggaauccagcacaagaagaugaucaauacguauuuucaggugacccauuaagaaacgaugaagaccaugcucauuggaccgaagcaaagauguuauuggacaacauuuauaccccugaaggcaucaucccuacucuuuuugggccggaaagagagaaaacucaggcgauagauggagaguuccgacuccguggugaacaacgaaaaacuuuuguggaacuuaugcgccguggugaccugccuguguggcuaucucacaaaguagcaagcgccggaauuaguuacaaagacagggaauggugcuuuacuggagaacgaaauaaccaaauacuugaagaaaauauugaagucgagaucuggacucgagaaggagagaaaaagaaacucagaccaaaaugguuagacgcgcguguguaugcugacccgauggccuuaaaagacuucaaagaguucgcgagcggccguaaaucaauaacgcuagauauacuaaccgaaauugcauccuuaccaacguaccuuucaagucgcgccaaacuagcguuagacaauauagucaugcuucauacaacagaaagaggcggaaaagcauaucaacacgcauuaaaugaguuaccagaaucccucgagacacugaugcuuguggcuuuauuaggcgcgaugaccgccggaauauuucuauucuuuaugcaaggcaaggguauggguaaauuaucuaugggucuuauagcaaucgcuguugccaguggccuguuauggguagcagaaauacagccgcaauggauagcugcaucaauaauacuagaguucuuuuuaaugguuuuauugguuccggagccugagaaacagagaacaccucaagauaaucaacuaaucuauguaauccuaacgauuuuaaccauuauagcuuuaguagcagcaaacgaaaugggauugaucgaaaagacaaaaaccgacuuuggcuuuuaccaaguuaaagcagagacuaccauuuuagauguggauuuaagaccagcauccgccuggacacuguacgcaguugccacaacgauuuuaacaccuaugcuaagacauacuaucgagaacacaucagcgaacuuaucacuagccgcaaucgcaaaccaagcugcaguacuaaugggauuaggaaaaggcuggcccuugcaucgaauggaucuaggaguuccccuuuuagcuaugggauguuauagccagguuaauccaaccacgcucacagcauccuuggucaugcugcucgugcacuacgcuauaauaggcccuggucuacaagcuaaagccacccgcgaagcccaaaagcgcacggcggcaggaaucaugaaaaauccuacgguagacgguauuaccguaauagaccuagaacccauaucauaugacccuaaauucgaaaaacaacuugggcagguuaugcuacugguucucugcguuggacaacuacuucuuaugagaacaacaugggcuuuuugcgaagugcuaacuuuagcgacaggaccgauuuuaacccuaugggagggaaauccgggacgauuuuggaauacaaccauagccgucucaacggcgaacauauuucgugguucuuaucuggcaggagcaggacuggccuuuaguuuaaucaagaacgcgcagaccccucgaaggggcacagguacgaugggagagacauuaggagaaaaguggaaacgucagcuaaauucccuugauagaaaggaauuugaagaauacaaacggaguggcauuuuagaaguagaccgaacugaggcgagauccgcgcuaaaagacgguucaaaaauaaaauaugcaguuucaagggguacaucaaaaauucgcuggauaguagaacgaggaaugguaaaaccuaaaggaaaaguaguagauuuaggauguggucguggaggcuggagcuauuauauggcgacucugaaaaacguaacagagguuaaaggcuauacuaagggcggaccaggucaugaggaacccauuccuauggcaacuuauggauggaauuuaguaaaauugcacagcggggucgacguauucuauaaaccaaccgaacagguagacacucugcuaugcgacaucggugaaucuucauccaacccuacaauugaagaagguagaacacucagaguuuuaaaaaugguugagccgugguuaaguagcaagccugaguucuguaucaaaguauuaaauccauauaugccuacggugauagaagaauuagaaaaacuucaaagacgucacggaggcucucuuguacguuguccauuaucaagaaacuccacccacgagauguauuggguauccggcgucagugguaacauaguauccaguguaaauacaaccucaaaaaugcuguugaauagauuuaccacgcgccauaggaagccuacauaugagaaggaugcagaccuaggagcagggacacgaucugucuccacagagacagagaagccagauaugacuauaauugggcgaagacuacaaagauugcaggaagaacauaaagaaacauggcacuaugaccaugaaaacccauaucguacaugggcauaucacggaagcuaugaagcucccucgacaggaucggcaucaaguauggucaacggugugguaaaguuauuaacuaaaccuugggauguaguaccgaugguaacacagcuagcuaugacagacacuacccccuuuggacaacaaagaguauucaaagaaaaaguagacacucgaaccccacagccaaagccaggaacccagguaguaaugacuacuacggccaacugguuauggacucuauugggacgcaagaaaaaucccagacuaugcacgcgugaggaauuuauuaguaagguaagauccaaugcagcaauuggugcaguauuccaagaagaacaaggauggacuucggcuucggaagcuguuaaugauagucgauuuugggaauugguugauaaagaacgggcacuacaccaggaagggaaaugugaaucuuguguauauaauaugauggggaaaagggaaaagaaacucggugaauuuggacgagcuaaaggcucacgagcgauuugguauauguggcuaggugcgcgauuuuuggaguucgaagcauuaggcuuuuuaaacgaagaccacugguuugggagggaaaacucuuggaguggaguggaaggcgaagggcuccaucgcuuggguuauaucuuagaagacaucgacaagaaagacggugaucuaauauacgccgaugacacagcuggaugggacacucggauaacagaagacgaucuacucaaugaagaauuaauuaccgaacaaaugacuccgcaccauaaaauauuagcgaaagccauauuuaaacuaacuuaccaaaacaagguaguuaaaguacuacguccaacaccaaaaggggcaguuauggauauuauaaguaggaaggaccaacgaggauccggacaaguuggcacuuauggccugaauacauuuacuaauauggagguucaacuuauuagacaaauggaagcagaagggguaauaacuagagaugauaugcauaauccuaaaggccugaaggaacgcguugaaaagugguuaaaagaaugcggagucgacagauuaaaaagaauggcaauaucuggagacgauuguguugugaagccguuagaugagcguuucucuaccucccuacucuuucugaaugauaugggcaaaguccgcaaggacauaccucaaugggagccaucuaaaggcuggaaaaauuggcaagaaguuccuuucugcucucaccacuuucauaaaauauuuaugaaagauggucgaagucugguuguaccuuguagaaaccaagaugaauuaauaggaagggcgcguauaucacaaggggcgggauggucguuaagagaaacagccuguuuaggcaaggcauaugcacaaauguggagucucauguauuuccauagaagagaccuucggcuagccucuauggcgauaugcuccgcgguaccgacugaaugguuuccuacaucacgaaccacuuggaguauacaugcccaucaucaguggaugaccacggaagauaugcuaaaaguuuggaaccgaguauggauagaagauaacccaaacaugaucgauaagacgccagugcacucaugggaagacauuccuuaccuaggaaagagagaagaccuuugguguggaucacuaauaggguugucuucaagagcaacuugggcuaaaaacauucacacggcaauuacgcagguaagaaauuugauagguaaagaagaauauguugauuacaugccugcaaugagacguuacagugcacauuucgagucagagggaguauuguaa

SEQ ID NO: 23710 - RNA, 9867 nt, Artificial Sequence
  derived and/or modified CDS sequence (opt6) from DENV-4__KF907503__SS-prME
agcaccaucacauuguuaugccugauaccaacgguaauggcguuccaccuaucgacccgugacggagaaccauugaugauugucgcuaaacaugaaagagggcguccacuauuauucaaaacaacagaaggcaucaauaaauguacacuuauugcgauggaucuuggggaaaugugcgaagacaccgugacuuauaaauguccauuauuaguaaacacugaaccugaagauaucgauugcuggugcaaucuaacgucuacuuggguaauguacgguacgugcacucagaguggagaaagacggcgugagaaaagaucaguugcauuaacaccacacucagggaugggucuggaaacuagagcagaaacuuggaugucgucggaaggggcauggaaacaugcgcagcguguggaaaguuggauuuugcgaaacccugguuuugcacuauuagcuggauucauggcuuacaugauaggucaaacugguauccaaagaaccgucuucuuuguacuaaugauguuaguagcucccucuuauggaaugcguugcgucggagucgguaacagagacuucguugaaggagugaguggaggagcgugggucgaucuaguauuagaacaugguggcugcgucacuacaauggcacaaggcaaaccaacccuagauuucgaauuaacaaaaacaacugcgaaagaaguggcuuuauuaagaacguauugcaucgaggcaagcauaagcaacauaacuacagcgacccgaugcccgacucagggagaaccuuaucuaaaagaagaacaagaucaacaauacauaugccgcagagacgugguugaccguggauggggaaauggauguggucuauucgguaaaggagggguaguaaccugcgcaaaauuuuccuguagugguaaaauaacugggaaccuaguucaaauugaaaaccuugaguacaccguagugguuacuguacacaauggagacacgcaugcgguagggaacgauacaucaaaucacggcguaacagcaaugauaaccccgcgcuccccaaguguagaaguuaaauuaccggauuacggagaauuaacacuugauugugaacccagaaguggaauugacuuuaacgaaaugauuuugaugaaaaugaagaagaaaacgugguuagugcauaaacagugguuuuuagauuuaccucuccccuggacagcaggggcugacaccucugaaguacauuggaacuauaaagagcgaaugguaaccuucaaaguaccacacgccaaaagacaagaugucaccguacuugguucacaggaaggcgccaugcacucagcauuagcaggagcaacagaaguugauucgggcgacgguaaucacauguuugcagggcaccuaaaauguaaaguuagaauggaaaaauuaagaaucaaagggaugucauauacaauguguaguggcaaauucucaauugauaaagaaauggcggaaacgcaacauggaacaacagucguaaaggugaaauacgaaggugcaggagcuccuuguaaaguaccaauagagauaagagacguuaauaaagaaaaaguuguaggacgaauuaucucuuccacaccauuggcugagaauaccaauucaguaacaaauauugagcucgaaccaccauucggggauagcuauauaguaaucggaguagggaacagcgcauuaacguugcauugguuuagaaaaggaaguagcauaggaaaaauguuugagaguacuuacagaggagcaaaacgaauggcgauauugggagaaacggcuugggacuuuggaucugugggaggacuauucacaagccuggggaaagccguacaccagguauucggcucaguguauacaacgauguucgggggcguaagcuggaugaucaggauacuaauuggauuuuuaguacucuggauagggacuaacucaaggaauacuucuauggcuaugacuuguauagcaguaggagggauuacccucuucuuagguuucacaguacaagcagauaugggaugcguaguuucauggucaggaaaagagcuaaaaugcgguucagggaucuucguaguagacaacguacacacuuggacagagcaguauaaauuccaacccgaaaguccagcgagauuggcaucugcgauucugaaugcacacaaagacggcguuugcgggauaagaaguacaacucgacuugaaaaugugauguggaagcagaucacgaacgagcugaauuauguccugugggaagguggacacgaucuuacgguuguugcaggcgauguuaaaggagucuugacuaaaggaaaacgugcuuuaaccccaccagugucagaucuuaaauacucauggaaaacaugggguaaagcaaagauauucacgccagaagcaagaaauaguacguuuuuaauagacggaccagauacaucggagugcccuaaugaaaggagagcauggaacucccuggaaguugaagacuacggcuuugguauguuuaccacaaauaucuggaugaaauuccgugaaggcaguuccgaaguuugcgaucauagacuaaugagugcggcuauaaaagaucaaaaggcaguacacgcagauaugggauauuggaucgagucaaguaagaaccaaacauggcaaauagagaaagcaucucuuauugagguaaagaccuguuuguggccaaagacgcauacucuauggucuaacggaguucuagaaucgcaaaugcuaauaccaaaaucauaugcgggcccuuuuagucaacacaauuauagacagggcuaugcaacucaaacggucggaccguggcacuugggaaaacucgaaaucgauuuuggugaaugcccuggcacgacugugacuauccaagaagacugugaucaucguggacccucgcuuagaacauccacagccagcggcaaauuaguaacacaauggugcugccguucauguacaaugccaccacuuagguuuuuaggugaagaugguugcugguacggcauggaaauacgcccacuauccgaaaaagaagaaaauauggucaaaucucagguaacugccgggcaagguacaagugaaacauuuuccaugggacuguuaugccuaacacuauuuguugaagaaugcuugcgucggcgcguaacccguaaacauaugauucucgucguugucauaacacuuugcgcaauaauauuagggggucuuacauggauggacuuacuaagggcacuaauuaugcuuggcgacacaauguccggaagaaucggaggucagauccaccuugcaauuauggcugucuucaaaaugucacccgguuauguauuaggaguguuuuuaaggaagcugacaucacgagaaaccgcuuugauggugauaggcauggcaaugaccacgguauuaucgauaccacacgaucugauggaacuaauagaugggaucaguuugggauuaauacuucuaaaaaucgugacacaauucgauaacacacagguaggaacauuggcacucucguuaacguuuauacgaucaacaaugccccuuauuauggccuggcgaaccauuauggccguauuauuuguaguuacauuaaucccacuuugcagaacuucuugcuuacagaaacaaagucacuggguggaaauaacugcacucauacuaggagcacaagcccugccaguuuacuuaaugacguuaaugaaaggagcaucacggcgaaguuggccuuuaaacgaggggauaauggccgugggcuugguaucgcucuuggguucagcauuacuuaagaaugacguuccacuggcagggccaauggucgcgggagguuuguuguuagcggcguaugucaugucaggcagcucugcggaccugucucuagaaaaagccgcuaacguucagugggaugaaauggcagauauuacggguaguucaccaauaaucgaaguaaaacaggaugaagauggguccuuuaguauuagagacguggaagaaacgaauaugauaacccuccuagucaaacuugcacucaucacugucaguggccuguaccccuuagcaauccccguuacuaugacacuaugguauauguggcaggucaaaacucaaagaagcggcgcucuuugggaugugcccucaccggccgcuacucaaaaggcagcauugucagaaggagucuaucgaaucaugcaacggggucuauucggcaagacucaagucggaguugguauccauauggagggugucuuucauacaauguggcacguaaccagagggucugucaucugucacgaaacagggcgacuugaaccaucaugggcagaugugagaaaugacaugauuucauacggaggaggcuggagacucggagauaaaugggauaaagaggaagacgugcaaguuuuagcgaucgaacccggcaaaaauccaaagcacguacaaacaaaaccgggguuauuuaaaaccuugacaggagaaauaggagcaguaaccuuagacuuuaagcccggaaccucuggaagccccauuauaaacagaaaagggaaaguaaucggucuuuacggcaauggaguugucacaaaaucuggagacuauguaagugccauaacgcaagcagaacggauuggagaaccugacuacgaaguagaugaagauauuuucaggaagaaaagauugacuauaauggaccugcauccaggagcugggaaaacuaaaagaauuuuacccucaauuguaagagaagccuugaaaagaaggcuucguacgcucauauuagcaccaacucgaguagucgcagcagaaauggaggaagccuugcgaggcuuaccaauacgauaccaaacaccagccguaaagagugaacauaccggaagagaaauaguagaucuuaugugccacgcaacgaguacaacacgucuucuuucaagcacuagaguaccuaacuauaacuugauagucauggaugaagcucauuuuacagauccaucaaguguagcagcuagaggauacauaucuaccagaguagagaugggagaggcugcagccaucuucaugacggccacaccaccaggagcuacagauccuuuuccacaauccaacuccccuauagaggauaucgaacgagaaauaccagaaagaagcuggaacacaggauucgauuggauuaccgauuaucaaggaaaaaccgucugguuuguaccuucaauuaaagcgggaaacgacaucgcgaacuguuuaagaaaaucuggcaagaaaguuauucagcuauccagaaagacauuugacacagaauaucccaagacaaaauugacagacugggauuuugucguaacuacagauauaagugagaugggagcuaacuuuagggcagggaggguuauagauccucgacgguguuuaaaaccugucauuuuaacggacgggccagagcgcgucaucuuagcgggaccgauaccagugacuccggcaucagcugcacaacgccgggguagaauugggaggaacccagcccaagaagacgaucaauacguauuuucaggagaucccuugaagaaugaugaagaccacgcccauuggacggaagcaaaaaugcuacucgauaauauauacacacccgagggcauaauuccuacuuuauucggcccugagagagaaaagacucaggcaauugauggugaauuucgacuaagaggagaacaaagaaaaacauuuguagagcuaaugagaagaggggacuugccuguauggcugaguuacaaagucgcuucugcuggaauaucguauaaagauagagaauggugcuuuacaggggaacgcaauaaccaaauucuugaagaaaauauggaaguggagauuuggacaagggaaggggagaagaagaaauuacgucccagauggcuugacgcacgagucuaugcagauccaauggcuuuaaaagacuuuaaagaguucgcauccgggaggaaaucaauaaccuuagauauauugacagaaauagcaucucuaccgaccuauuuaucaagcagagcuaagcucgcucucgauaauauagucaugcuacacaccacagaacgaggagguagggcauaucaacaugcccucaaugaacuaccugaaucacuggaaacauuaaugcuuguggcgcuccuaggagccaugacggcugggaucuuuuuguuuuucaugcagggaaaggggauaggcaaacuaagcaugggucugauuauuauugcaguugcaucuggacuacuauggguggccgaaauacagccacaauggauugcagcaaguauuauucuagaguucuuuuuaaugguauuguugaucccagaaccugaaaagcaacggacaccacaggauaaucaacucauauacgucauauuaacaauuuugaccaucauaggcuuaaucgccgccaacgagaugggauuaauugagaaaacuaaaacagauuuuggguuuuaucaagugaaaacggaaaccacuauacuugacguugaccuaagaccagcgucggcauggacauuauacgcuguugccaccaccauacuaacuccaaugcuucggcacacaauugaaaauaccagugccaauuuaucguuagcagcgaucgcaaaucaggcggccguacucauggggcuaggcaaaggauggccauugcacagaauggaccuugguguuccauuguuggcuaugggcuguuauucacaaguaaacccgacaacacuaaccgcuaguuuagucauguugucuguccauuaugcaaucauuggaccgggguuacaagcaaaagcgacaagggaagcucaaaaacguacagcugcuggcaucaugaaaaacccgacaguggacggaaucacuguaauagaucuagaaccaauaucauaugacccaaaguuugaaaaacaacuuggucaggucauguuacuugucuuaugcgcuggucagcuacuauuaaugcgaaccacuugggcuuuuugugaaguacuuacuuuagcuacuggaccaauuuuaacucuaugggaaggcaauccaggaagauucuggaauacaacaauagcuguuucgaccgcaaauaucuucagagggucauaccuggccggugcuggacuagcauuuuccuuaaucaaaaaugcacagacaccgcggaggggcaccgggacaacgggagaaacacuaggcgagaaguggaaaagacaauuaaacagccucgacagaaaagaauuugaagaauauaaacgcucagguauuuuggaggucgacagaacugaagcaaaaucggcguuaaaagauggcaguaaaauaaagcacgcuguaagucgcggaaguucaaagauacguuggauuguagagcgcggcauggugaagccaaaaggaaaagucguagaucugggguguggaagagggggcuggucauauuauauggcaaccuugaaaaacguaacagaagucaaaggcuauacuaaaggagguccgggacaugaggaacccauuccaauggcuacauacggauggaauuuaguuaaacuacauucagguguagacguauuuuauaagccuacagaacagguagacacgcuacucugcgauauuggagaaucaagcucaaauccgaccauagaggaagguaggaccuuaaggguacuaaaaaugguagaacccugguuaagcaguaagccagaauuuugcauaaaaguacuuaacccauauaugccaacugucauagaagaacuugaaaaacuccagcgaaaacaugggggaaacuuagucagauguccuuugucaagaaauaguacacaugaaauguauuggguuagcggcgcgucaggaaauauagugaguagcguaaacacuacaucaaaaauguuacuaaacagguuuacuacacgccauagaaaaccaacauacgaaaaagauguagaucuaggagcagggacacgaagcgucucgacugagacagaaaagccagacaugacgauuauagggcgaagguuacagcgucuucaggaagaacacaaggagacauggcauuaugaucaagagaauccauaccguacuugggcauaccauggaucauacgaagcaccaagcacaggaucagcaaguucuauggucaauggaguuguaaaacucuuaaccaagccaugggauguaauaccaauggucacacagcuugccaugaccgacacuaccccuuuuggucagcagagaguguucaaagaaaaaguggacacuagaacaccacaaccaaaacccggaacacgaaugguaaugacgaccacagcaaauuggcuaugggcccuucuagguaagaaaaagaacccaagauuaugcacaagagaagaguucauaaguaagguuagaucaaacgcagcaaucggcgcugucuuucaggaggaacagggguggaccagugccucugaggccgugaaugauagucgauuuugggagcuaguugacaaagagagagcuuuacaucaagaaggaaagugugaaaguugugucuacaauaugauggguaagcgggagaagaaacuuggugaauuuggucgagcaaaaggcaguagggcaaucugguacaugugguuaggugcaagauuuuuagaguucgaagcguuggguuucuugaacgaagaucauugguuuggcagagagaacaguuggucaggaguagagggagaaggauuacauagacucggcuacauuuuagaagaaauagauaagaaagacggagaccugauguaugcagaugauacggcaggcugggauacaagaauaacggaagaugacuuacaaaaugaagaacuaauaacagagcaaauggcaccucaucacaaaauacuagccaaagcuauauuuaaacuaacauaccaaaauaaaguaguuaaagugcuucggccaacgcccagaggagcggugauggauauaauaucccggaaagaccaacgcgguucaggacaagucggcacuuacggauuaaacaccuucacaaauauggagguacagcuaauaagacagauggaagcagagggaguaauaacucaagaugauaugcaaaaucccaaaggacugaaggagcgcguagaaaaauggcuuaaggaaugcgguguagacaggcuaaagaggauggcgaucaguggggacgauuguguuguuaaacccuuggacgagagguucgggacuuccuuauuauuucuuaaugacaugggaaaaguacguaaggauauaccacaaugggagccuucuaagggauggaaaaacuggcaagaagucccuuucugcucucaucauuuucauaagauuuuuaugaaagauggucggagccuagucguuccuuguagaaaucaagaugaacugauaggcagagcacguaucucucaaggagcuggauggucucuaagagaaacugcaugucuaggaaaagcauaugcgcaaauguggucucugauguauuuccaucgcagagacuuaagauuggcgucgauggccauaugcagcgcggugccuacugaaugguuuccuacaaguagaacuacauggucaauccacgcucaccaccaauggaugacaacagaagauauguuaaaaguguggaaucggguauggauugaagauaaucccaacaugacagacaaaacaccaguacacagcugggaggacauucccuaucugggaaagagagaagauuuaugguguggaucguuaauuggucucucaucaagagcaacuugggccaaaaacauacacacagcaauaacacagguacguaauuuaauagguaaggaagaauacgucgacuacaugccuguaaugaaacgcuauagugcaccaagugaaagcgagggaguuuuauga

SEQ ID NO: 23711 - RNA, 9867 nt, Artificial Sequence
  derived and/or modified CDS sequence (opt6) from DENV-4__AY947539__SS-prME
ucaaccaugacgcuccuaugccugaucccgacugcaauggcguuucaucuaucaacaagagauggagaaccacuaaugauugucgcacggcaugaaaggggacgacccuuacuuuuuaaaacgacggaaggaauaaauaaaugcacccucauagcaauggaucuuggagaaaugugugaagacacaguaacauacgaauguccuuuauugguaaacacugaaccggaagacauugacuguuggugcaacuugacgagcgcauggguuauguaugguacuuguacgcagagcggugaacguaggcgugagaaacgaucuguggcauugacuccgcacucuggaaugggccuugaaacuagagcugaaacauggaugagcagcgaaggagcguggaaacaugcacaacgaguagaaucauggauccugaggaaccccgguuucgcgcuucuugccggcuuuauggcguauaugaucgggcaaacgggcauacaaagaacaguguucuuuguuuugaugauguugguagcaccaucuuaugggaugagaugcgugggagugggaaauagagacuuuguugaaggaguaaguggaggugcauggguggacuuaguuuuggaacaugguggauguguuacgacuauggcccaagguaaaccuacacuggauuuugaacuaaucaaaacaacugccaaagaaguugcacuucuucgcacauauuguauagaggcuucaaucaguaacaucacaacugcaacgagauguccaacucaaggagaaccuuauuuaaaagaagaacaagaucaacaauauauaugcagaagagauguuguugacagaggcugggggaaugguugugggcuauucgguaaaggaggagugguuacuugcgccaaauuuaguuguuccggaaaaaucacaggcaaccuaguacagauugagaacuuggaauacacaguaguuguaacaguacauaauggcgacacgcaugccguugguaacgauaucccaaaucacggugugacagcaacgauaaccccgaggucuccaucaguugaagugaaacuuccugauuacggugaauuaacacuagauugugaaccuagaucaggaauugauuuuaaugaaaugauauugaugaaaaugaagaagaaaaccugguugguacauaaacaaugguuucuagauuuaccgcuaccaugggccgccggagcagacaccuccgaaguucacuggaacuauaaagaacgaaugguaacauucaaagucccccaugcaaaacgacaagacgugacaguacugggaucucaggagggcgcaaugcacagcgcucuaacaggggccacagaaguagacucuggggaugguaaccauauguucgcuggucaucuuaaauguaaaguacgaauggaaaaauugcggauuaaaggaaugucauacacuaugugcagcggaaaauuuucgauagauaaagaaauggcagaaacucaacauggaacaaccgucguaaaaguuaaauaugaaggcgcaggcgcaccauguaaaguuccaaucgagauaagagaugugaacaaagagaaaguaguuggucgaauaaucuccuccacaccauucgcagaguacacgaauaguguaacaaauauagaacuagagcccccuuucggagacucauauaucguuauaggaguaggagauagugcuuuaacacuacacugguuuagaaaaggaaguucaauuggaaaaauguuagaaagcacauaccgaggagcaaaacguauggccauacuaggugagacggccugggacuucggaucaguggguggacuauugacuucguuagguaaagccguccaucaaguauuuggaucuguauauaccacgauguuugguggaguaaguuggaugguccgaauccuaauuggauuccucguauuauggauugggacuaauagccguaauacuucgauggcuaugacauguaucgcaguagguggcauuacgcuauuccugggauuuaccguacaugcugauacuggaugugcaguaucuuggucaggcaaagaacuaaaaugcggcaguggaauauuuguaauugauaacguacauacauggacagaacaauauaaauuucaaccagagagucccgccagacuggccucugcaauucucaaugcacacgaagauggcguuugugguauacgcagcacgacucgacuugaaaauauuauguggaaacaaaucacgaacgaacuaaauuacguccugugggaagguggacacgaccuaacaguagucgcgggggauguaaaaggugugcuauccaaagguaagagggcacuagccccuccaguaaaugauuuaaaauauaguuggaagacaugggggaaagcaaaaauauucacaccggaggcaaagaacucaacauuccugauugacggucccgauacuuccgaguguccaaaugagagacgcgcauggaacuuuuuggaagucgaggacuacggauucgguauguucaccacuaauauauggaugaaguucagggagggaucgagcgaaguuugugaucauagacuaaugagugcagccauuaaagaucaaaaagcagugcaugcugacaugggauauuggaucgagucaagcaaaaaucagacauggcaaauagaaaaggcaagucuuauagaaguuaaaacaugccuauggccuaaaacccacacucuguggaguaacgguguauuagaaagucagaugcuuauuccaaaagcguaugcuggaccauuuucacaacacaauuaucgacaggguuaugcaacgcagacuguuggacccuggcaccuaggaaagcucgaaaucgacuuuggugaauguccaggcacaacaguuacuauacaggaggauugugaccacagggggccuucauuacggacaacaacugcaucugggaaguuaguuacucaaugguguugcaggucuugcacaaugccuccguuacgauuucuuggugaagacggauguugguacgguauggagauuaggccuuuaagcgagaaggaagaaaauaugguaaagucccagguaucagcgggacaagguacaagugaaaccuucucaaugggacuauuaugucuaacguuauuuguugaggaauguuuaagacgacgcguaacaaggaaacacaugaucuugguuguaguuacaacucuaugugcuauuauauuaggcggauuaacauggauggaucuucuuagggcauugaucaugcugggagacacgaugagcggacgcauggguggacaaauucaucuggcaauuauggccguuuucaaaaugagccccgguuacguauuaggaauuuuccuccgcaaguugacaucucgagaaacugcacucauggugauagguauggcaaugacgacgguacuaucaauaccucaugaucuaauggaguucauagaugguauaucacuagggcucauucuuuugaaaauggucacgcauuuugauaauacgcaaguaggaacacucgcacuaaguuuaacauucauacgaucuacaaugccacuuguuauggccuggcguacgauaauggcaguacuguuuguagugacacuuaucccauuaugcagaacgucaugucuccaaaaacaaagucacuggguagaaaucacagcauugauucuaggagcacaagcacuaccaguauacuuaaugacucuaaugaaaggcgcuucuaaaagaaguuggccccugaacgaagguauaauggcaguuggccuaguuucgcuauuaggaagcgcguuauugaaaaaugacgucccacuagcgggaccgaugguugcaggcggacuacuacuggcagcauauguuaugucaggcaguagugcagauuuaagucuggaaaaagcugcuaaugugcaaugggaugaaauggcagacaucacugggagcucuccgaucauagaaguaaagcaggaugaagauggcaguuuuucaaucagagacauagaagaaaccaacaugauuacacuucuaguaaaacuagcgcuaaucacgguaucaggucuuuacccacuagcuauuccagugacaaugacacuuugguauauguggcaaguaaaaacgcaacgaaguggagcauuaugggauguccccucgccagcugccgcacagaaggcaacacucaccgaaggcgucuauagaaucaugcagagaggacuuuucgguaaaacucaaguugguguagggauacacauggaaggcguauuucauacuauguggcacguaacccgcgguaguguaauaugucacgaaacugggagacuagaacccagcugggcagauguaagaaacgauaugauuuccuaugguggugguuggagguuaggugauaaaugggauaaggaggaagacguacagguauuggcaauagaaccggguaagaaccccaaacauguccaaacaaaacccggauuauuuaaaacauugaccggagaaaucggugcuguuacauuagacuuuaaaccagggaccagcggaucaccaauaauuaaucggaaaggaaagguaauuggacuauaugguaaugggguugucacaaaaaguggggauuaugucucagcuaucacccaagcagagcggacaggagaaccagauuaugaaguagaugaagauauauucagaaagaaacgguuaacaaucauggacuuacacccaggcgcugguaaaacaaaaagaaucuuaccaucgaucgugcgggaagcauuaaagaggagauugaggacacuuauacuugcuccgacgcgaguaguagcagcggagauggaagaagcauugagagggcuaccaauuagauaucagaccccugcggugaaaagugaacauacaggccgagaaauaguagacuuaaugugucaugcuaccuucaccacaaggcuucucucaucuacccgaguuccuaauuauaauuuaauaguuauggacgaagcccacuuuacagacccuuccuccguugccgcgcgcggcuauaucucaacccgaguagaaaugggcgaagcagcugcgauuuucaugaccgcaacaccuccaggcgcuacagauccuuucccucaaaguaacucuccgaucgaagacauagaacgggaaauucccgaacgauccuggaacacaggauucgacuggauuacagacuaucaaggaaaaacagugugguucgugccaucaauuaaagcgggcaaugauauagcaaacugcuuaaggaaaucugguaagaaagugauacaacuaagucgcaaaacuuucgauacagaauaucccaaaacaaaacuuacggauugggauuuuguuguaacaacagauauaagcgaaaugggagcaaauuuuagggcaggucggguaauagacccacggcgcuguuuaaaacccguaauuucaacagauggucccgaacgaguuauacuagcuggcccuauuccaguaacgccggcaagugcagcacagcguaggggcagaauugggagaaauccugcucaagaagacgaucaauaugucuuuagcggugaccccuugaaaaacgaugaggaucacgcucacuggacagaagcuaagaugcuacuagauaacaucuacacaccagagggaauaauuccaacacuguucggccccgaacgugagaaaaaccaagcaaucgacggggaauuucgacuaagaggagaacagcgaaagacauuuguagaacuuaugaggagaggugaucuuccaguaugguuaucuuacaaaguagcuagugcuggcaucagcuauaaggauagggagugguguuuuacuggugaaagaaauaaucagauuuuagaagagaauauggagguagaaauuuggacgcgugaaggugagaagaagaaauugagaccuaaguggcuagaugccaggguauacgccgaccccauggcccuaaaggauuucaaagaguucgcaucagguagaaaaucgaucacgcuugacauucuaacagaaauagcgucccugccuacuuaccugaguagcagagccaaauuggcccuugacaacauuguuauguuacacacaaccgagcgagguggaaaagcauaucaacacgcacugaaugaacucccagaaagccuggagacuuugauguuaguugcacuauuaggugcuaugacugccggaauauuuuuauucuucaugcaaggcaaaggaaucggaaaguugucaauggguuuaauagccaucgcagucgcgucuggccuucuuuggguggccgaaauacaaccacaauggauugccgccaguauaauauuagaauuuuuccuaaugguguugcuuauaccggaaccagaaaaacaaagaacaccgcaagauaaucaguuaauauauguuauacucacaauacuaacaauaauaggcuuaauagcggcaaaugaaauggggcuuauagagaaaacgaagacagauuucgguuucuaccaaguaaaaacugaaacaaccauauuggauguugaucuacgcccugcaucagcauggacacuuuaugccgucgccacaacaauuuuaaccccgaugcuacgccauacaauagagaauacaucagccaacuuaaguuuggcagcaauagcaaaucaagcagccgugcugaugggauuaggcaaagguuggccccuucauaggauggauuugggaguuccacuauuagcaauggguuguuauagccaaguuaauccgacaacauugauagcaagccuuguuauguuauuaguacauuacgcuaucauaggaccaggauuacaagccaaagcaaccagagaagcucaaaaacguacagcagcuggcauuaugaaaaaucccaccguagacggaauuacagucaucgaccucgaaccuauuucauaugauccaaaauuugaaaaacaauuaggacaaguaaugcuauuaguuuuaugcgcuggacaacuauuacuuaugagaacuacaugggcauucugcgaagugcugacucuggcaacagguccgguacucacacuaugggagggaaacccagggagauucuggaacacaacuauagcuguaucuaccgcgaauauuuucaggggaucauaccuagcuggggcaggacuggcguuuucccugauaaagaaugcucaaacaccacgacggggcacagggaccacgggugagacuuuaggggaaaaauggaaaagacaguuaaacucgcuugaucgaaaggaauuugaagaguauaaaagaucgggaauauuagaaguugacaggacggaagcaaaaagcgcuuuaaaagauggaaguaagauaaaacacgcagucucuagaggcucaagcaaaauacgauggauaguggaacgagguaugguaaagccgaaaggaaaagucguagaucuugguugcggacguggaggauggaguuacuauauggcaacgcugaaaaauguuacggaagugaaggguuauaccaaagggggaccaggccacgaggaaccaaucccgauggcaacauauggcuggaaucuagugaaauuacacaguggagucgaugucuuuuauaaaccaacagagcaaguugacacguuacuuugcgacauuggugaaucaagcaguaacccaacaaucgaagaggguaggacacuaaggguucugaaaaugguugaaccuugguuaaguuccaaaccugaguucuguauaaagguacuaaauccuuauaugccaacagucauugaagaauuagaaaagcuccaaaggaaacacggaggcucuuuaguaagauguccacugaguagaaacaguacccaugaaauguauuggguaucaggaguaaguggcaacauuguaucaucaguaaacacgaccaguaaaaugcuucuuaauagauucacuaccaggcacaggaaacccacauaugagaaggauguggauuuaggagcagguacuagaagcguuucaacugaaacagaaaaaccagacaugacuauaauugggcguagacuucaaagacuacaggaagaacacaaagagacguggcacuacgaucaagagaauccauacaggacaugggcauaucauggaagcuaugaggcaccuucaaccgggagcgcaucaucaauggugaauggaguugugaaacucuuaacuaaaccuugggacguaauuccuauggucacacaauuagccaugacugauacaacaccguuuggucagcagcgaguguucaaggagaaaguagacacucggacaccacaaccuaaaccugggaccaggaugguaaugacaacaaccgcuaauuggcugugggcuuugcucggcaagaagaaaaauccaagacuauguacucgagaggaauuuauaucuaaaguaagaucaaaugcagccauaggagcaguauuucaagaagaacaagguuggacuucagccuccgaagcugugaaugacuccagauucugggagcuuguagacaaagaaagagccuuacaccaagaaggaaaaugugagaguuguguuuauaacaugaugggaaagagggagaagaaauuaggagaguucgggagggcaaaagggucucgugcuaucugguacauguggcucggugccagguucuuagaauuugaggcuuuaggauuuuuaaacgaagaucauugguucggucgggaaaauucauggucaggugucgaaggugaaggcuuacaccgccuaggauacauauuagaagauauagacaagaaggacggagacuugauauacgcagacgauacugcuggcugggauacccggauaacagaagaugacuugcuuaacgaagaauuaauuaccgagcaaauggcaccacaucacaaaauacuggcaaaggcaauauucaaauuaacauaccagaacaaaguaguaaaaguacuuagaccuacgccaaaaggggcuguaauggauauaaucuccagaaaagaccaaagaggcaguggacaaguuggaacauauggcuugaacacuuuuacgaacauggaaguacaacucauaaggcaaauggaggccgaaggcguaauaacccaagaugacaugcauaacccgaaaggcuugaaagagagaguugaaaaauggcucaaagaaugugguguggaccgauuaaaaagaauggccauaaguggggaugauugcgucguaaagcccuuagacgaaagauuuucuacuucguuacuauuuuuaaacgacauggggaaaguacguaaagauauaccacagugggaaccaucaaaaggguggaaaaacuggcaggaaguaccauuuugcucgcaucauuuucacaaaauauucaugaaagauggucgaagucucguagucccguguagaaaucaagaugagcuuauaggccgggcgcguaucucgcagggcgcgggguggucucuaagggaaacagcgugcuugggaaaggcuuaugcgcaaauguggucacuuauguacuuccaucggcgugauuuaagacucgcgaguauggcaauuugcucugcaguuccuacugaaugguucccaacauccagaaccacuuggucaauacacgcccaucaccaguggaugacaacggaggacaugcucaaaguauggaaccgcguuuggauagaagauaacccaaauaugaccgauaaaacgccugugcauagcugggaagauaucccuuaccucggcaaacgcgaagaucuuugguguggaucacuaaucgguuuaaguucgcgcgcaacuugggcgaaaaauauacauacagcaaucacacaagugagaaaucuuauagggaaagaagaguaugucgacuauaugccaguuaugaaaagauauucagcaccuuuugaaucugaagggguccucuaa

SEQ ID NO: 23712 - RNA, 9879 nt, Artificial Sequence
  derived and/or modified CDS sequence (opt11) from DENV-1__AB608789__SS-prME
ucagucaccauguugcuaauguuaaugcccacagcauuggcguuucaccugaccacacgcggaggggaaccacacaugauaguaacgaaacaggaaaggggaaaaagccuccuauucaagacaucagcaggggucaauaugugcacccuaauagcgauggaucuuggggagcuaugcgaggacacuaugaccuauaaaugcccgaggauuaccgaagcggagcccgacgacaucgacuguuggugcaacgcaacagacaccugggucacuuacgguaccugcucucagacgggggagcaccggcgagacaaaaggucgguagcacuagccccgcacgugggacucggcuuagagacccguacagagacauggaugagcuccgaaggggcauggaaacaaauucagaggguggaaaccugggcgcuacgccauccaggauucacagugauugcauuauuccuggcacacgcaauugggacaaguaucacccaaaaggggauuauauucauacuacugaugcucguaacgcccuccauggcgaugcgaugcgugggaauugguagcagggacuucguggaaggucuuucaggagcaacauggguagacguuguacucgaacacggaaguugcgucaccacaauggccaaagacaagcccacacuagacaucgagcuucuaaagacagaggucacaaauccagcgguacuacgaaaacuguguaucgaggcaaaaauauccaacacgacgacagacucgagaugcccaacacagggggaggcgacgcucgucgaagaacaagacgcgaacuuuguaugucgacgaacguucguugaccgcggcugggggaacgggugcggacuauucggaaaagguucacucauaacgugcgcuaaauucaaaugcgugacuaaacuggaagggaaaauaguccaguacgaaaaucuaaaguauagcgucaucgucacaguacacacaggcgaccaacaccaagucggcaacgagaguaccgagcacggaaccacagccacgaucacaccccaggcccccaccagcgaaauacagcucacagacuacggagcacuaacccuggacugcucgccccgcacuggcuuggacuuuaaugagaugguccugcugacaaugaaagaaaaaucguggcuagugcacaaacagugguuccuagaccugccacucccauggacauccggagcaagcacgucccaggagacauggaaccggcaagaccucuuagugaccuuuaagaccgcccacgccaagaaacaggagguagugguccuagguagucaagagggagcaaugcacacggcccugaccggggcgacggaaauacagacaaguggcaccacaacaaucuucgccggucaccucaagugcagacucaagauggacaaacuaacauugaagggaaugagcuacgugauguguacugggucauucaagcuggagaaggagguggccgaaacccagcacgggaccgugcucguccagaucaaauacgaagggacugaugcacccugcaaaauaccguucaguacucaagaugaaaaaggagucacacaaaacggacgucuuauaacagccaaucccauagugacggacaaggaaaaacccgucaacauugaagcagagcccccguucggcgaguccuauauuguaauaggugcuggggagaaggcauugaaacucagcugguuuaaaagaggauccagcaucggaaagauguucgaagcaacagccagaggggcacgccggauggcaauccuaggcgauaccgccugggacuucggguccaucgggggcguauucaccagcgucgguaaacuuguccaucaaaucuucggcacggcauacggcguacuauucucagggguaaguuggacaaugaagaucggcaucggcguccuccuaaccugguugggacugaacucacgcucgaccagccuuuccaugacuugcauagcugucggacuugucacucuauaucucggcgugauggugcaagccgacuccgggugcgucaucaacuggaaaggccgugaacuaaaaugcggaagugggauuuucguaaccaacgaaguccacaccuggacagaacaauauaaauuccaggcagacuccccaaaacggcucagugccgcaauaggcaaggcuugggaggagggggucugcggaaucaggucggccacgagacuggaaaacaucauguggaaacaaauauccaacgaguuaaaccacauucugcuagagaaugacaugaaguucacagucguggugggggacgucguagggauucucgcccaaggcaagaaaaugauacguccccaaccuauggaauauaaauacucauggaaaagcuggggcaaggcuaaaauaaucggcgccgacgugcagaacacaaccuucauaauagauggaccaaacacgcccgaguguccagacgaccaaagagcauggaacauaugggaagucgaagacuauggcuucgggauuuucacgacaaacauauggcuaaaacuuagagauagcuacacgcaagugugcgaucacagacuaaugagcgcugcgauaaaggacuccaaagcuguacacgcggauaugggguacuggauugaaagcgagaaaaacgaaacauggaaacuugcgagggcuucauucauagaaguaaaaacguguaucuggccuaagagccacacacuauggucaaacgggguucucgaaucagaaaugauaauaccuaagauuuacggcgggccuauaagccagcacaacuacagaccaggauauuuuacacagacagccgggccauggcaccucggcaagcuagaauuagauuucgaucugugugagggaacaacgguagucguggaugaacacugugguaaucgcgguccuagccuccggacaaccaccguaacaggcaagaucauccacgaauggugcugccgaaguugcacccugcccccgcuacguuuuaaaggggaagacggaugcugguauggcauggaaauucgcccaguuaaagagaaagaggaaaaccuugucaaaucuauggugagcgccggguccggcgaagucgacucauuuagccugggacuccucugcaugagcaucaugauagaggaagugaugcgcucucgcuggucccgaaaaaugcuaaugaccggaacccuggcgguguuucugcuacuuaucauggggcaacuaacauggaacgaccuaauacgccuuugcauaaugguuggcgccaaugcaucggacaggaugggaaugggcacaacuuaccuggcccuaauggccacauuuaaaaugcggcccauguucgccguagggcugcuauuucgacgacucacgagccgagaggugcuucuccucacgauagggcuaagccuagucgcaagcguggaguugcccaauucacuugaagaacuaggagacggacucgccauggggaucaugauacuaaaauuacucacagacuuucaaucucaccaacuaugggcgacccuccugucccucaccuuuauuaagaccacugugaguuugcacuacgccuggaaaacgauggccaugguacucagcaucgucagccucuucccacuauguuuguccacaaccagccaaaagaccacaugguugccugugcuauuggggucucucggaugcaagccccugaccauguuccuaauagccgaaaauaaaaucuggggcaggaaaagcuggcccuuaaaugaagggauaauggccgucggaauugucucaauuuuauuaucuagccuccuaaagaaugacgucccgcuggcaggaccacucauugcgggaggaaugcuuaucgccugcuauguaauuucaggaagcagugcagaccuaucccucgaaaaagcggcugaaguuucuugggaagaggaagcagagcacaguggugccagccacaacauccuaguagaagugcaagaugacgggaccaugaagaucaaggacgaagaaagagaugauacacucacgauccuauuaaaggcaacccucuuagcaguauccggaguguacccacuaaguaucccggcaacccuauucgugugguacuuuuggcagaagaaaaagcaaaggagcggcguccugugggacaccccaucuccucccgaaguugaaagggcgguguuagacgaaggaaucuauaggaucaugcaacgcggacuacucggaagaucgcaagugggggucggcgucuuccaagaaaacgucuuucacacuauguggcacgugacccgaggagcgguacugauguaccagggcaagcgucuggaaccaagcugggcauccguuaaaaaggaucugaucucauaugggggcggauggcggcuccaaggaaguuggaacacaggcgaggaaguccaaguuaucgcaguagagcccggcaaaaauccgaagaauguacaaacagcacccggcacguuuaagacaccagaaggugaaguaggggccaucgcguuagauuuuaaaccaggaacgucgggaucaccuauagugaacagagaaggcaaaaucguuggcuuauacggcaacggggucgucaccaccucgggcaccuauguaucugcuauagcgcaggcgaaagcaucgcaggaaggcccacuucccgagaucgaagaugaaguauuccguaagcguaaccucaccaucauggaccugcaucccgggucagggaaaacacgccgcuaccuacccgcaaucguccgcgaagcgaucaagcgaaaacuacgaacccugauccuggcgccgacaagaguugucgcauccgaaauggccgaagcucuuaaagguaugccaaucagauaccagacaacggcagugaaaucugagcauacaggcaaagagauuguagaucucaugugucaugcuacguucaccaugcggcuccuuagcccugucagaguacccaacuacaacaugaucauuauggacgaggcacauuucacugacccgagcagcauugcagcgcgcggauacauaagcacacgggucggaaugggcgaagcggcggcuaucuucaugacagcgaccccgccgggaagugucgaagcauuuccccaaucaaacgccguaauccaagacgaggaacgugacauccccgagcgauccuggaacuccggauaugaauggauuacagacuucccggggaaaacggugugguucgucccaaguaucaaguccgguaaugacaucgcaaacugucugaggaagaacggaaaacgugucauacaacugagcagaaagacguuugacacggaguaccagaaaacuaagaacaaugacugggacuauguugucaccacagacauaucagagaugggcgccaauuucagagcggacagaguuauagacccccgacguugcuugaaaccgguaauccugaaggacggaccugagcgagugaucuuggccggaccgaugccagucaccguugcauccgcagcacaaagacgaggaagaauaggccgaaaccacaacaaagaaggcgaccaauacauauauaugggccagccgcuuaacaaugacgaagaccacgcccacuggaccgaagccaaaaugcuucuugauaacaucaauaccccagaagggauaaucccugcgcuauuugagccagagcgggagaaaucggcggcaaucgacggggaguacagacuaagaggggaagcccggaaaacuuuuguagaacucaugagacgaggagaccugccgguguggcucucguauaaagucgcauccgagggguuccaguauucggaccggcgaugguguuucgacggagaacggaacaaucaggugcuagaggagaacauggacgucgaaauauggacaaaagaaggggaacggaagaaacuucggccgcgauggcuagacgcacgcacauauagcgacccgcucgccuugcgugaguucaaagaguucgcagccggacgacgaucagugagcggugaucuaauacucgagaucgggaagcuaccacaacaucuaacccagagggcucagaaugcguuggauaaucuagucaugcuccacaauuccgagcaaggcgggcgcgccuaccggcaugccauggaggaacuccccgacacuaucgagacgcugaugcuuuuggcgcuuaucgccguucugacggguggaguuacacuauucuuccucuccggucgaggcuugggcaagaccuccauagggcuacugugugucauggccuccucaguauuacuguggauggccucgguagagccgcacuggauagcugcgucaauaauacucgaauuuuucuugaugguacuccugauaccggaacccgauagacagcgaacaccccaggacaaucagcucgcauaugucgucaucggccuccuguucaugauccucacgguugcugcaaacgagaugggcuuacucgagacgacaaagaaagaccugggaaucggucacguagcggucgaaaaucaccaccacgcaaccaugcuugacguugaucuacacccagccagcgcguggacauuguacgcagucgcgacgaccauaauaaccccgaugaugcgccacaccaucgagaauacgaccgcaaauauauccuuaaccgccauagccaaucaagcagcuauuuuaauggggcuggacaagggauggccaaucagcaagauggacaucggggucccacuauuggcccuggggugcuacucccaaguaaauccauugacacucacagcggcgguccuaaugcuuguagcgcacuacgccaucauaggcccuggguugcaagcaaaagccacucgcgaagcacagaaaaggacggcggcugguaucaugaagaacccgacaguagacggaauagucgcgaucgaccucgaccccgucguuuacgaugccaaauucgaaaagcaacuggggcagaucaugcuacuaaucuuaugcacgagccagauauuacugaugcgcaccacaugggcucugugcgaaagcaucacccuagcuaccggaccauuaacgaccuuaugggaaggaagcccagggaaauucuggaacacgaccaucgcggucucaauggcaaauaucuuccgggggagcuaccuagcaggagcaggauuagcguucucgcucaugaaaucacuagggggaggucggagagggacaggagcacaaggggaaacccugggcgaaaaguggaaaaggcagcuaaaccaauuaucaaagucugaauuuaauacuuauaagaggagcggaauaauggagguggacaggagcgaagccaaggagggagugaagcggggcgaaacgacaaagcacgcaguaucacgagggaccgccaaacuccggugguucguggagaggaacuuggugaaaccggaagggaaagugauagaccuaggaugcggaagagggggcuggucguacuacugugcaggccuuaagaaagugaccgaggugaaaggguacacgaaaggcggcccgggacacgaagaaccuauaccaauggcaacauacggauggaaccuagugaaacugcacagcggcaaagacguauucuucacgcccccagaaaaaugcgacacccugcucugugauauaggagagagcagccccaacccgacgaucgaggaaggcagaacgcuacgggugcuuaaaaugguagagcccuggcuucgcggaaaccaguucuguauaaagauccuaaaccccuacaugcccuccguaguagagacacuugagcaaaugcaacguaagcacggcggaauguuagucaggaacccccucucccgcaacucgacacacgaaauguauugggucaguugcggaacaggaaacauaguuucagccgugaacaugaccaguaggaugcuacugaacagauuuaccauggcccaucgcaaaccgacauaugagcgcgacguugaccuuggcgcagggacacggcacgucgcggucgaaccggaaguagcaaaccuagacaucaucggccagcgaauagaaaacauuaaacacgaacacaaaucgacauggcauuacgacgaagauaaccccuacaagaccugggccuaccacggaagcuacgaagucaaacccucaggguccgcaagcagcaugguaaacgggguagucaaacuccuuacuaaaccaugggauguuaucccgauggugacacagauugcaaugacagacacaacacccuucgggcagcaacggguauucaaggaaaaaguagacacacgcacacccaaagcaaaaagagguacggcacagaucauggaagugacagccagaugguuauggggcuuccuaagucgcaacaagaagccacggauauguacacgggaagaauuuaccagaaaggugcgcucaaaugccgccaucggagcgguauucgucgacgagaaccaauggaacagcgcaaaagaggcggucgaggacgaaagauucugggaucugguccaccgcgagcgugagcuucacaagcaaggaaaaugugccacaugcgucuacaacaugauggggaaaagagagaagaaguugggagaguucgguaaagccccggagucccgagccaucugguacaugugguuaggcgccagauucuuagaguucgaagcauugggcuucaugaacgaagaccacugguuuucccgagaaaauucccugucgggcguggagggagaaggacuccacaaacuuggauauauccugagagacaucagcaagauucccggagguaacauguacgccgacgacacggcgggcugggacacaaggaucaccgaggacgaccugcaaaacgaagcgaaaauaacugauauaauggaaccggaacacgcguuauuagccacgagcaucuuuaaacuaacguaccagaauaagguaguccguguccaacguccagccaaaaacgggacgguaauggacguaaucagcagacgcgaucagagaggaucaggacaagucggcaccuauggccuuaacacauucacuaauauggaggcccaacuaauccggcaaauggaaucagaaggcaucuucuccagcuccgaacucgagaccccaaacuuagccgaacgggugcuagacuggcugggaaaauacggaguggaacgacuuaagagaauggcaaucucaggcgaugacuguguugugaagcccaucgacgacagguuugcuaccgcgcuuaccgcccugaaugacguugggaaaguacggaaagacaucccccaaugggaaccuucuaagggcuggaacgauuggcagcagguaccauucuguagccaccacuuucaccaacuuauaaugaaagauggcagggaaaucguggucccgugccguaaccaggaugaauugguuggacgugcaaggguaagucagggcgccggauggagucugagggagacggcaugccucggaaagagcuacgcacaaauguggcaacuuauguacuuccaccgcagagaccuaagacucgcggccaacgcgaucugcuccgcugucccgguggacuggguucccaccagccggacuacguggucgauccacgcacaucaccaguggaugaccacggaggacaugcucaguguguggaacagaguauggaucgaagaaaacccguggauggaggauaaaacacauguaucaaguuggggcgacguacccuaccucggaaaacgggaagaccaauggugcggcagcuuaauaggacuaacggccagagcgacgugggcaacaaauauccaaguggccauuaaccagguccgacgccucaucgggaaugagaacuaccucgacuauaugacgucaaugaaacgcuucaagaacgaaagcgacccagaaggagccuuaugguaa

SEQ ID NO: 23713 - RNA, 9879 nt, Artificial Sequence
  derived and/or modified CDS sequence (opt11) from DENV-1__AB608788__SS-prME
agcguaacaaugcuucuaaugcugcuccccaccguacuagcauuccaucuaaccacgcgcggaggagaaccucauaugauuguaaccaaacaagaaaggggcaaaucacuucuauucaaaacuagcgcgggugugaacaugugcacacucaucgccauggacuuaggcgaauuaugcgaagacacaaugaccuacaaaugcccccgaauaaccgaagccgagccggacgacguagacugcugguguaacgcaacagacacuugggucacguacggaacgugcagccaaacaggagaacauagacgcgacaaacguaguguugcacuggcgccccacgugggccuaggacuagagacacgcacagagacguggaugucaagugaaggagccuggaaacaaauucagaggguugagacuugggcacuacgccaucccgguuucacgguuauagcacucuuuuuggcgcaugcaaucggaacaagcaucacccaaaaaggaaucauuuucauucuguugaugcuugucacgcccuccauggcaaugcggugcgucggcaucggcaaccgcgauuucguagaaggccucagcggcgccacuuggguugauguuguacuagagcaugggagcuguguaacaaccauggcaaaggauaaaccgaccuuggacaucgaacugcuaaaaacagaggugaccaacccggcugugcugaggaagcuguguauagaggcgaaaauaagcaacacgaccaccgacagucgaugucccacucaaggagaggcaacgcuaguagaagaacaggacgcgaauuucgugugucgccgcacauucgucgaccgagguuggggcaaugguugcggccucuuuggcaagggcucccuaauuacaugcgcuaaguuuaaaugcguaacaaagcuggaaggaaaaauuguacaguacgagaaccucaaguacagcgucauugugacgguccauacgggggaucagcaccaggucggcaacgagucaacugaacacgggacaacggcaacaauaacgccacaagcaccgacuucggaaauacagcuaacagacuacggcgcccucacacuggacugcucgccacgaacaggauuggauuuuaacgaaaugguccuccucacaaugaaggagaaaagcuggcucguacauaaacaaugguuccuggaccuaccacugcccuggacaaguggagcuacgacaagccaagaaacauggaaccggcaagaccuauuagucacuuucaaaaccgcccacgccaagaagcaagagguuguagugcuuggcagucaagaaggggcaaugcauacugcgcucacaggagcgacggaaauucaaacgagcggaacaacgacaaucuuugcaggccacuugaaaugccgauugaaaauggacaaacucaccuugaaaggcaugagcuacgucaugugcacgggcagcuucaaacuagaaaaggaaguagcagaaacgcagcacggaacagucuuaguacaagucaaguacgaaggcaccgaugcgccgugcaagauccccuucucuacgcaagacgagaaaggcguaacgcaaaacggacgcgugauaaccgccaaccccaucgucacggauaaggagaaaccagugaacauagaggcagaaccaccauucggagaauccuacauugugguuggagcgggcgaaaaagcgcucaaacugucgugguucaaaaaggggucaacaauuggcaaaauguucgaggcuaccgcaagaggggcccgucgaauggccauacugggggauaccgccugggauuucgguucgaucggcggcgucuuuacaucggugggcaagcucguccaccagauauucggcacggcguacggcguacuuuucuccggagugucguggacaaugaagauaggcauuggagugcuacucacauggcuuggccuaaacucucgcucaaccagccuaucuaugacgugcaucgcagucggacucguaacauuauaccuaggagugaugguacaagcggauuccggguauguaauaaacuggaaagggagagagcuaaaguguggaagcggaauauuuguuaccaacgaaguccacacauggacugaacaauacaaauuccaagcggauagcccgaagagacuuuccgcagcaauaggaaaagccugggaagaaggaguuugcggaauccgaagugccacucggcuggagaauaucauguggaagcaaaucagcaacgagcugaaccacauauuacuggaaaacgauaugaaguuuacaguagucgugggagacguguccggcauacuagcacagggaaagaaaaugaucagaccccaaccgauggagcacaaauacagcuggaaaagcugggguaaagccaaaaucauaggggccgacgugcagaacuccacguucauaaucgauggacccaacacaccggaaugccccgacgaccagcgagcauggaauauuugggaagucgaggacuauggauucgggauauucacaaccaauaucuggcucaagcuacgagacucguacacgcaagugugcgaccaccggcucauguccgcagccauaaaagacucgaaggcugugcacgccgacaugggguauuggauagaaagcgagaagaacgagacguggaagcuagcgcgggcgaguuucaucgagguuaagacaugcgucuggccuaaaagucacacacuaugguccaauggaguacuagaaagcgaaaugauuauaccuaaaauuuacgggggaccaauaucgcaacacaacuacaggccaggcuacuucacacaaacuagcgguccguggcacuuaggcaaacuugagcuagacuucgaccugugugaagggacgacagucgucguggacgagcauugcgggaaccggggaccaagucugcgcacaaccaccguaacgggaaagauaauacacgagugguguugccgcagcugcacucuaccacccuuacgauucaagggggaagacggguguugguacgguauggaaauccgccccgugaaggaaaaagaggaaaacuuagucaaaagcaugguuucggccggcucgggagaagucgauuccuucucguugggacuccuaugcauuaguauuaugaucgaagagguaaugcgcucgaggugguccagaaaaaugcuaaugacaggcacacuagccguguuccuccucuuaaucauggggcaacucacauggaaugaccugauaagacuauguauuaugguaggagcgaacgccagugauagaaugggcauggggaccacguaccuggcgcucauggccacguucaagaugcgcccaauguucgccguggggcuccucuuccgcagacucaccagccgcgagguccuuuuguuaacgauaggacugaguuuagucgcaagcguagagcuaccgaacucccuggaggaacucggagacggacuugcuauggggauaaugauauuaaaacuccucacagauuuccagagccaucagcuaugggcggcacucuuaagccuaacguuuaucaaaacaacguucagucuucacuacgcguggaaaacgauggccaugguucuaucaaucgucagccucuucccgcuaugccuaucaacgacaagucagaaaacgacauggcucccggugcucuugggaagucucgguugcaagccgcuaaccauguuucuaauagccgaaaacaaaaucugggggcgcaagucauggccauugaacgaagggaucauggcaguagggaucgucagcaucuugcugagcagucuccucaagaaugauguuccauuagcaggaccucugaucgcaggcgggauguugauagcgugcuacgucauaagugggucaagcgcagaccucucacuugagaaggccgcugaagugagcugggaggaagaagcagagcacagcggcgcgucgcauaacaucuugguagaaguccaagacgacggaacaaugaaaaucaaagacgaagaaagggacgauacucugacgauccuacuuaaggcuacauuacuagcagucagcgggguuuacccacuaagcaucccggcuacgcuauucguaugguacuucuggcagaagaagaaacagagaaguggaguucuaugggacaccccaucaccacccgaagucgaacgcgcaguccucgacgacgggaucuaucgaaucaugcagagaggucuacucggucggagucaggucggggucggggucuuccaagagaacguguuccacaccauguggcacguaacacgaggcgccguacucauguaccaaggaaagcgguuggaaccgucaugggccagugucaagaaagaccuaauaaguuacggcggcggcuggcgucuacagggguccuggaacacgggagaagaaguacagguaauagcgguggagcccgggaaaaaccccaaaaauguacaaaccgccccuggaacguucaagacaccagagggcgagguaggagcaauagcgcuagacuuuaaacccgggacaucagggucacccauaguaaaucgugagggaaaaaucguggggcuauacggcaacggcguaguaaccaccucgggaacguacguaucugcgaucgcacaagcgaaagccagucaagaggggccgcuaccagaaauagaagacgaggucuucagaaagcggaaccuuaccauuauggaccuccacccaggaucaggaaaaacacggcgauaucuaccagcgauaguuagagaagcaauaaagcgcaaacugcguacauugauucuugccccaacacgcguuguagccagcgagauggcagaagcacugaaggggaugcccauaagauaccaaacaacugcgguaaaaagugaacacaccgggaaggaaaucguggaucuuaugugucaugccaccuucacaaugagguugcucagcccuguccgggugccgaauuauaacaugauaauaauggacgaagcccauuucacagaccccuccuccauagcggcaagaggauacaucucaacccgcguuggaaugggagaggcugcagcaaucuucaugaccgcaacaccgccagguagugucgaggcguucccacaaucgaacgcggucauacaggacgaggagcgagauauccccgaaagaagcuggaacagcggcuacgacuggauaacggacuuccccgggaaaacggugugguucguacccagcauuaagucuggcaacgacauagcgaauugccuacgcaaaaacgggaaacgagucauacaacuaaguagaaaaaccuucgacaccgaguaccaaaagacuaaaaauaaugauugggacuacgucgugacuacagauauauccgaaaugggcgcaaacuucagggcagaccgagugaucgauccaaggcgaugcuuaaagcccgugauuuuaaaggacggcccagaacguguaauccuggccggaccaaugccaguaacuguggccucggcugcacaacggcgaggccggaucggacgaaaucaaaacaaagaaggcgaucaguauaucuacaugggucaaccgcuaaacaacgaugaggaccacgcgcacuggaccgaagcgaaaaugcugcuagacaauauuaacaccccagaggggauaauaccagcgcuauuugaaccagaaagagaaaagagcgccgcgauagacggagaguaccggcugcgaggugaggcgagaaagacguuuguggagcugaugaggcggggcgaccucccgguuuggcuaagcuacaaaguagcuagugaagguuuccaauacagcgaccggaggugguguuucgacggcgagcguaacaaccagguccuugaagagaacauggacgucgaaauuuggacgaaggaaggggaaaggaagaagcuccggccucgguggcucgacgccaggacauauagugacccacucgcgcuaagagaauuuaaagaauuugccgcaggcagaagguccgucagcggugacuugauacuagaaauagggaaacucccacaacauuuaacgcaacgagcucagaacgcccucgacaaucuggucauguuacacaacagcgagcaaggaggcagagccuaccgccacgcaauggaggagcugcccgauacaauagagacucuaaugcuacucgcucugauagccgugcuaacgggaggcgugacucucuucuuccugucuggacgcggauuagguaagaccucgauaggauugcucuguguaauggccaguuccguccuccuguggauggccaguguugagccacacuggauagcagccagcauaauacuugaauuuuuccugauggugcuacucaucccugagcccgaccgccaaaggacuccgcaagacaaccagcuugcuuacguagucauagguuuauuauucaugaucuuaacggucgccgcaaacgaaaugggucucuuggagaccaccaagaaagaccuaggaauuggacacguugccguagagaaccaccaccacgccaccaugcucgauguagaccuccauccggcguccgcauggacguuauacgcagucgccacgacgauaauuacacccaugaugcgacacaccauagagaacacuaccgcaaacauaagccuaacggcaauagcuaaccaggcggcaauccugauggggcuagacaagggguggccgauauccaaaauggacaucggugugccguuguuggccuugggaugcuacucucaagucaacccacuaaccuugacagcggccguuuugaugcuaguagcccacuacgcaaucaucgggccuggacuccaagcgaaagccacaagagaggcccagaagcgaacagcagccggcauaaugaaaaacccgaccgucgacggaauuguagcgauagaccuagacccuguagucuacgacgccaaauucgaaaagcaacuugggcagauaaugcuguugaucuuguguacgagucagauccuccugaugcgaacaaccugggcacugugcgaauccauaacccuggcaacaggaccauuaaccacucuuugggaagggagccccgggaaguucuggaacacaacaauagccguaagcauggcgaacauauucagagggagcuaccuggccggcgcaggccucgcauuuucgcuaaugaaaucccuagguggaggacgacggggaacgggggcacaaggcgagacacugggagaaaaauggaaaagacagcugaaccagcucagcaaaagcgaauuuaacacauauaaacgcagcggaaucauugaaguagauaggagcgaagcaaaagaaggcuugaagagaggcgagaccacgaagcacgcagugucgagggguacggccaagcugagaugguucguugaaagaaaccuggugaaaccggaaggaaaggugaucgaccuuggaugcggaagaggaggguggagcuacuacugugccggacugaagaaaguaacggaggucaaagguuauacaaaaggaggagcgggucaugaagaaccaaucccaauggcaacguacggauggaaucucgucaaacuuuacuccggcaaggacgucuucuuuacuccacccgaaaagugcgacacacuccucugcgacauaggagaaaguucaccgaacccaaccaucgaggaaggacggacgcucagaguauuaaaaauggucgaaccauggcugaggggaaaccaguuuugcaucaagauacuaaacccauacaugccuagcguaguagagacacucgaacaaaugcaaagaaagcauggcggcauguuggucaggaacccccuaucccggaacucuacucacgaaauguacugggugaguuguggaacggguaacaucguaagugcggucaacaugacaagcagaaugcuccugaacagauuuacaauggcgcaucgaaaaccaacauacgaaagagauguagaucuuggggcggggacacggcaugucgccguagagcccgaagucgcgaaccucgacaucauagggcaaaggauagaaaauauaaaacacgagcauaaaagcaccuggcacuacgacgaagauaacccauauaaaacaugggcuuaucauggaagcuacgaagucaaaccgucagggucggcuucauccauggugaacggcgucguccgacuccuaaccaagccuugggacgugauaccgaugguaacacagaucgcaaugacggacacgacacccuucgggcaacagagaguguucaaggaaaaagucgauaccagaacgccaaaagcaaaacagggcacugcacaagugauggaagucaccgcaagauggcuauggggauuccuuagcagaaauaagaaaccacgaaucuguacucgagaggaguucacucgaaaaguaagaagcaacgcagcaauaggcgcugucuucguggaugagaaccaauggaacuccgccaaggaagcugucgaggaugaacgcuucugggaccuaguccaccgagagagggagcuacacaaacagggcaaaugcgcaacguguguguauaacaugaugggcaagagagagaagaaacuaggagaguucgggaaggccaaggggucgagggccauuugguacauguggcuuggggcacgauuccuagaguuugaggcuuugggauuuaugaacgaggaccacugguucucucgggagaacagcuugucaggagucgaaggagagggauuacacagacucggguacaucuugcgagacauaucgaaaauaccaggcgggaacauguacgccgacgacacagcaggaugggacacaagaaucaccgaagacgaccugcagaacgaggccaagaucaccgacauaauggaaccggaacacgcccuucuagccaccucaauauucaaacuuaccuaucaaaacaagguuguccguguacagaggccagccaaaaacgguacagucauggacgugaucagucgaagagaccaacgagggucaggacagguagguacauacggcuugaacacauucacuaauauggaggcacagcuuauaagacagauggaaucggaaggaauuuucucacccucagaacuggaaacaccaaaucucgcagagcggguccuggacuggcuugaaaaguacggcguagaaagauuaaaacgcauggccauaucaggcgacgauugcguaguaaaaccaauagacgaccgcuucgcuacagcccucacggcccugaacgauaugggaaagguaagaaaggacauaccacagugggaacccaguaagggauggaacgacuggcaacaaguacccuucuguucgcaccacuuccaccagcugauaaugaaggacgggcgggagaucgucguuccauguaggaaucaggacgaauuaguggggagagccagaguaucacaaggugcuggguggucccuacgagagacagcaugccugggaaagucguacgcgcaaauguggcaacucauguacuuccaucgaagagaccuccggcuugcagcaaacgcgauuugcagcgccgugccaguggacugggugccaacgucaagaacaaccuggaguauucacgcacaccaucaguggaugaccaccgaaaacaugcugucagucuggaaccgggucuggaucgaggaaaacccauggauggaagacaagacccacguaagcagcugggaggacguacccuaccuggggaagcgggaggaucaguggugcggcagcuuaauaggccuuaccgcucgcgcaacuugggcgacuaacauacaagucgcgauaaaucaaguucgcagauugaucggcaacgaaaacuauuuagacuacaugacgucuaugaagagauuuaaaaacgauagcgacccagaaggggcgcuuugguag

SEQ ID NO: 23714 - RNA, 9879 nt, Artificial Sequence
  derived and/or modified CDS sequence (opt11) from DENV-1__AB608786__SS-prME
agugugacuaugcugcucaugcugaugcccaccgcccuggccuuccaccucaccacucggggcggcgagccgcauaugaucguguccaagcaggagcggggcaagagccuguuguucaagacaagcgccggggugaacaugugcacccucauagccauggaucugggcgagcugugcgaggauaccaugaccuacaagugcccccgcauaacagagaccgagcccgacgacguugacugcuggugcaacgccacugauaccugggugaccuaugggacguguucgcaaacgggcgaacaccgcagggacaaacgguccguggcccucgcaccacacguuggccuuggguuagagacccgaaccgagacguggaugucguccgaaggcgccuggaagcagauccagcggguugagacgugggcccuccgccaccccggguucacaguaaucgcccuguuccucgcccaugugaucgggaccagcaucacccagaaagggauuaucuucauccuccugaugcugguaacgccuucccuugccaugcggugcgugggcaucggcucccgggacuucguggaggggcuguccggcgcgaccugggucgacguggugcucgaacacgggucaugugucacuacgauggccaaagacaaacccacguuggacaucgagcugcugaagaccgagguuaccaaccccgcugugcuccggaagcuguguaucgaagccaagaucuccaacaccacuaccgacagccguuguccuacccagggcgaggcgacccugguagaggagcaggacgccaacuucgugugccgccgcaccuucguggauagagguuggggcaacggcugugggcuguucgggaaagggucccugauuacgugugccaaguucaagugcguaaccaagcuggagggcaagauugugcaauacgagaaucucaaguacuccgugauagucaccgugcacacgggggaccaacaucaggucggcaacgagucuaccgagcacggcaccacagccaccaucacuccccaagcccccaccaccgagauccagcugaccgacuauggggcgcugacgcucgacugcagcccccgaacaggccuagacuucaaugagaugguccugcuuaccaugaaggagaaguccuggcugguucacaagcagugguuccuggaucuccccuugcccuggacuaguggggcuagcacgucccaagagacguggaaccggcaggaccugcucgucaccuuuaagaccgcccacgcaaagaagcaggagguggugguccugggaucacaggagggcgcgaugcacacggcguuaacgggggccaccgaaauccaaaccuccggcacgacgaccauauucgccgggcaccuaaagugccgccugaagauggacaagcuaacccucaaggggaugagcuacgugaugugcacgggaucuuucaagcuugagaaggaaguggccgagacccagcacggcacgguccucgugcagaucaaauacgagggcaccgacgcccccugcaaaauacccuucagcacgcaagacgagaagggagugacgcagaauggcaggcugauaacagcgaacccgaucgucaccgacaaggaaaagcccgucaacauugaggccgagccccccuuuggggaguccuacauuauuaucggcgcuggcgagaaggcucucaaauugagcugguucaagaagggguccucuauaggcaagauguucgaggcgacggcccgcggggcccgacgcauggccauccugggcgacacagccugggacuucgggagcauuggcggcguguuuacgucggucgggaaauuggugcaccaaaucuucggaacggcguaugggguccuguucuccggcgucucuuggacgaugaagaucggaaucggcgugcugcucaccuggcugggacugaacucccgcagcaccagucuuagcaugaccugcaucgccguagggcuggucacguuauaccucggcgugauggugcaggccgacucggggugcgucaucaacuggaagggcagggaacugaaaugcgggagcggcaucuucgugaccaacgaaguucauaccuggaccgagcaauacaaguuccaggcugacagcccgaagcgccuguccgcggcaaucggcaaagccugggaagagggggucugcggcauucggagcgcuacccgccuugagaacaucauguggaagcagaucagcaacgaacuaaaccacauacuacuggagaacgacaugaaguucacggugguggucggcgauguggccggcauccuggcccagggaaaaaagaugauccggccccagcccauggaguacaaguacagcuggaaguccugggguaaggcgaagaucaucggcgccgaugugcagaacaccaccuucaucaucgacgggcccaacaccccagagugccccgaugaccagcgggccuggaacaucugggagguugaggauuacggauuugggaucuucacgacuaacaucuggcugaaacuccgcgauagcuacacccaggugugugaccaccgccugaugagcgccgcgaucaaggacuccaaggcugugcacgccgauaugggcuacuggaucgaguccgaaaaaaacgagaccuggaaguuagcgcgggccagcuuuaucgaggucaagacaugcaucuggccaaaaagucacacucuauggagcaauggagugcuggaguccgagaugaucauccccaagauuuacgggggcccaaucucacagcacaacuacaggccuggguacuucacccaaacggcuggccccuggcaccugggaaagcucgagcuggacuucgaccuaugcgagggcacuacgguaguuguagacgagcacugcggaaaccgggggccaucccucagaaccacgaccgugaccgggaagaucauccacgaauggugcugucggagcugcacccugccgccccugcgcuuccgaggcgaagacggcugcugguacgggauggagauccgccccguuaaagagaaagaggagaaucuggugaaguccaugguguccgccggaagcggcgaagucgacuccuucucgcuggggcugcucugcauauccauaaugaucgaggagguaaugcggagccgcuggucccggaagaugcugaugaccgggacgcuggcuguuuucuuccuccugaucauggggcaacugaccuggaacgaccucauccgucuguguaucauggucggcgccaacgccagcgaccguauggggaugggcaccaccuaccuggcgcugauggccacguucaagaugcgacccauguucgcugugggccuguuauuccgcaggcucaccucccgagaggugcugcuacucacaaucgggcucucucucgucgccuccgucgaacuccccaacucacuggaggagcugggcgacgggcucgccaugggcaucaugauacucaaguuguuaaccgacuuccagagccaccagcugugggcgacucuacuuagcuuaacuuucauuaagaccaccuucagucugcacuacgccuggaagacgauggccauggucuuaagcaucguauccuuauucccccugugccuaagcacaaccucccagaagaccacguggcugccuguccuccucgggagccuggggugcaagccgcugacaauguuccucaucgccgagaauaaaauauggggucguaaguccuggccauuaaacgaggggaucauggcggucggcauagugucaauccugcugucgucccugcugaagaacgaugugccacucgccgggccgcuuauugccggcggaaugcugauugccugcuacguaaucagcggguccagcgccgaccucucccuggagaaggcggccgaggugagcugggaagaggaagccgaacacuccggcgcuucacauaacauucugguggaaguucaagacgacgggacaaugaagaucaaggaugaggagcgcgacgacacccucaccauccugcugaaagccacguugcucgcggugucuggaguuuacccgcuaagcaucccagccacccuguucgucugguauuuuuggcagaagaaaaagcaaagguccgguguacugugggacacccccaguccacccgagguggagcgcgccguccuggacgacggcaucuaucgaaucaugcaacguggccuacucgggcggucccaggugggcgugggggucuuccaggagaauguguuccacaccauguggcauguuacacgcggcgcuguccuuauguaccaggggaagcggcuggaaccgucgugggcguccgucaagaaggacuuaaucagcuacggcggcggguggcgccugcaggguuccuggaacacgggugaggaggugcaggucaucgcaguggagcccggaaaaaaucccaaaaacgugcagacugcgcccgggaccuucaaaacgcccgagggggaggucggcgcuaucgcccuggacuucaagcccgggacgucgggauccccuauaguuaaccgggaggggaagauagugggccuguacggcaacggagucgugaccacuaguggcacguacgucagcgccaucgcgcaagccaaggcaucccaggaaggcccccugcccgagaucgaggacgaggucuuucgcaaacggaaccugaccauuauggaccuccaccccggcuccgggaaaacccgccgcuaccugccagccauagugcgcgaggcgaucaagcggaaacugcgcacccuaauccuggcacccacacguguggucgccagugagauggccgaggcccugaagggcaugcccauccgguaccagaccaccgcggucaagagcgagcacaccggcaaggagaucguggaccucaugugccacgccacguuuaccaugcgccuucugaguccgguccgggucccgaacuacaacaugaucaucauggacgaggcccacuucacugaccccuccuccaucgcugcccgcggguacaucagcacccgggugggcaugggggaggcugccgccaucuucaugacggccacgccgccuggcuccgucgaggccuucccgcagagcaacgcggugauccaggacgaggagcgcgauauccccgagcgguccuggaauagcggguacgaguggaucaccgauuucccgggcaagacggucugguucguccccuccaucaagagcggcaaugauaucgccaacugccuccgcaagaacgggaagcgggugauccagcugucgcgcaagacguucgacaccgaguaccagaagaccaagaacaacgacugggacuacguggucaccacggacaucagugagaugggcgccaacuuccgggcagauagagugauagauccucgacgcugccugaagccagugauacucaaggacggaccagagaggguaauucuggcggggccuaugccgguaaccgucgccuccgccgcucagcgccgggggcgcaucggccggaaccacaacaaagaaggcgaccaguauauauacauggggcaaccccugaacaacgaugaagaucacgcccacuggaccgaggcuaagaugcucuuagauaacauaaacacaccagaaggcaucauccccgcccuguucgagccggagcgcgagaagucugccgccaucgacggagaauaccgccuccggggagaggcccgcaagacguucguggagcucaugcggaggggggaccugccuguuuggcucuccuacaaaguggcgagcgagggcuuccaguacagcgaccgacgcuggugcuucgacggagaacggaacaaccagguguuggaggagaacauggacguggagaucuggaccaaggagggggagcgcaaaaagcugcgaccgcgcuggcucgaugcccggacguacuccgauccccuggcucuucgcgaguucaaagaguuugccgccggcaggcgcagcgucuccggggaucucauccuggaaaucggcaagcuaccgcagcaccugacccagcgggcucagaacgcccuugacaaccuggugauguugcauaacagcgagcagggcgggcgcgccuaccggcaugccauggaagagcugccagacacgaucgaaaccuugaugcucuuggcgcugauugcggucuuaacgggcggggucacccuguuuuuccuguccggccgagggcucgguaagacgagcaucggccugcugugcgucauggccuccagcguguuacuguggauggccagugucgagccccauuggaucgccgcgagcaucauccuggaguucuuccucauggugcuucugaucccagagccggaucgccagcgcacgccgcaggauaaccagcucgcuuacgugguuaucggacugcuguucaugauccucacgguggccgcaaacgagaugggccugcuggaaaccacgaagaaggaccucggcaucggacauguggcagucgagaaccaccaccacgcagccaugcuggacgucgacuuacacccugcauccgccuggacguuguacgccguggcgacaaccauuaucacacccaugaugcggcauacuaucgaaaauaccaccgccaauaucagccugaccgccaucgccaaccaagccgcgauccugauggggcucgacaagggcuggcccaucucaaagauggauaucggcgucccccugcuagcccucggcugcuacagccaggugaacccccugacgcugaccgccgccgugcucaugcugguagcgcacuacgccaucauaggcccggggcugcaggccaaggcgacccgcgaggcccagaagcguaccgcggccggcauaaugaaaaaccccacgguggacgggaucguugcgauagaucuggacccggucguguacgaugcaaaguucgagaagcagcucggccagaucaugcugcucauacugugcacgucccaaauccugcucaugcggacaacgugggcccuaugcgagucgaucacccuggcgaccggaccuuugacgacccugugggaggguuccccaggcaaguucuggaacacgaccaucgccgucagcauggccaacaucuucaggggguccuaccuagccggugcuggccucgccuuuagccugaugaagucccucgguggcggacggcgcggcacaggagcccagggugaaacccucggcgagaaguggaagcggcagcugaaccaacugagcaagagcgaguucaacacguacaagggguccggcaucauggaggucgacaggucggaggccaaggaagggcucaagcggggcgagaccaccaaacacgccgucucccgcgggacagcgaagcugcggugguucguggaacgcaacuuggucaagccggagggcaaaguaaucgaccugggcugcgggcggggcggcuggaguuacuacugcgccggucucaagaaagugaccgaggucaagggguacaccaagggcggccccgggcacgaggagccgauccccauggccaccuacggcuggaaccuggugaagcugcacuccgggaaggacguuuucuucaucccccccgagaagugcgacacccuccugugcgacaucggcgagagcagucccaacccuacgaucgaggaggggcgcaccuuacggguccucaagaugguggagccauggcugcguggcaaccaguuuugcauaaagauacugaacccuuacaugccuagcgucgucgagacccucgaacagaugcaacggaaacacggcgggaugcuggugcgcaacccgcugagucggaacagcacccacgagauguacugggugucgugcggcacugggaauaucguuucggccgugaacaugacgucccgcaugcuccuaaaccgguucaccauggcccaccgcaagcccaccuacgagcgcgacguagaccugggcgcgggcacccggcacgucgcggucgaacccgagguggccaaccuagacauuaucgggcagcgcaucgagaacaucaaacacgagcacaagagcacguggcacuacgaugaggacaaucccuacaagaccugggccuaccacgguucauacgaggucaagccuagcggguccgccucuagcaugguaaacggcgucgugaaacugcugaccaagcccugggacgugauccccauggucacccagauagcaaugaccgacaccacgccguucgggcagcagcggguauuuaaggaaaagguggauacucgcacgccgaaggccaagaggggcacagcccaaaucauggaggucaccgccaaguggcucuggggauuccugucccguaacaagaagcccagaaucugcacccgggaagaauucacgcggaaggugcgcucuaacgccgccaucggggccguguucguugacgagaaccaguggaacuccgcgaaggaggccguggaggacgagcgguucugggaccuggugcaccgcgagcgggaguuacacaagcaagguaaaugcgcgaccugugucuacaacaugauggggaagcgcgaaaagaaacugggggaguucgggaaggccaagggcaguagagccaucugguacauguggcugggcgcccgcuuccucgaguuugaggcccugggguuuaugaacgaagaccacugguucucccgcgagaacagccugucgggcgucgagggggaaggccuccauaagcugggguacauacugcgcgacaucagcaagauccccggugggaacauguacgcggacgacaccgcgggcugggacaccagaaucacggaagacgaucuccagaacgaggccaaaaucacggauauaauggagccggagcacgcauuacuugccaaguccauuuucaagcucacguaccagaacaaaguggugcgggugcagcggccagcgaagaacggcaccgugauggacgucaucagccgccgcgaccagcgggggucuggccaggugggcacguacgggcugaacaccuucaccaacauggaggcccagcugauccgccagauggaaagcgaggguaucuucagccccucugaguuggagacgcccaacuuagccgagcgggugcuagacuggcucgagaaguacggagucgagcgccuuaaacggauggccauaucaggcgacgacuguguggugaagccgaucgaugaucgguuugcgacggcgcucaccgcgcucaacgacauggggaagguccggaaggacaucccgcagugggaacccucaaaaggcuggaaugauuggcagcagguucccuucugcucucaccacuuucaccagcugaucaugaaggacggcagggagaucguggucccgugccggaaccaagacgagcugguggggcgcgcgcggguaagucagggcgccgguuggucccucagagagaccgcaugccucggcaaauccuacgcgcagauguggcaacugauguacuuccacagacgcgaccuccggcuggccgcaaacgccaucuguagcgcgguccccguggacugggugccaaccagucggacgaccuggagcauccacgcgcaucaccaguggaugaccacggaggacaugcugucgguauggaaccggguguggaucgaggagaacccuuggauggaggauaagacgcauauaagcuccuggggugacgugccguaucucggcaagcgcgaggaccaguggugcggaagccugaucgggcuaaccgcccgggcaaccugggccaccaacauccaggucgcgaucaaucaggugcgccgccucaucggcaacgagaacuacuuagacuacaugacuuccaugaagcgguucaagaacgagagcgacccugaaggagcccugugguga

SEQ ID NO: 23715 - RNA, 9879 nt, Artificial Sequence
  derived and/or modified CDS sequence (opt11) from DENV-1__AB608787__SS-prME
uccgucaccaugcuguugaugcugaugccgaccgcccuagcguuccaccuaaccacgcgagggggugaaccucauaugauuguaucgaaacaagaacgcggaaaaagucuacuauuuaaaaccucagcugguguuaacaugugcacccuaauugcaauggaucuaggcgaacucugugaagauacuaugacguacaaaugcccaaggaucacagaggcagagccagacgacguugacuguuggugcaaugcgacagauaccugggucacauaugggacgugcucccaaacaggugaacaucgucgagacaaaagguccguagcccucgcuccccaugugggguuagggcucgaaaccaggacagaaacguggauguccuccgagggggcguggaaacaaauccagagaguagagaccugggcccugcgucacccgggcuucacgguaauagcccuauuccuagcccacgcaauaggcaccagcauuacacaaaaaggcaucauauucauucuucuaaugcucguaacaccgagcauggccaugcguugugucgguaucgggucgcgcgacuucguugaaggguuaagcggggccaccuggguagacguaguacuagaacacggcucgugugugaccacuauggccaaagauaaaccgacgcucgacauagaauuacugaagaccgaagugaccaauccggcuguacugcgcaaacucuguaucgaagcaaaaaucuccaacaccacgaccgacagccgcugucccacacaaggggaggcuacacugguugaagaacaagacgcaaacuucgugugccggcgaacauucguagaucguggauggggaaauggaugcggccuuuucgguaagggaucgcuacuaaccugcgcaaaguucaagugugucacaaaguuagaaggcaaaauaguccaguacgaaaauuugaaauacagugugaucgucacaguacacacaggagaccaacaccaaguaggcaacgaauccacggaacacgggaccacagcuacgauaaccccgcaagcucccacaacagaaauccaacucacugauuacggagcacuaacucuugauuguagcccgagaaccgggcuugacuucaacgagauggucuuacuaaccaugaaggaaaagagcuggcuggugcacaaacagugguuccuggaccuaccacucccguggacuucgggagcaucaacaagccaagagacauggaacaggcaagaccuccuuguuacauucaaaacagcacacgccaagaagcaggaaguagucguauuagguucgcaggaaggcgcuaugcauaccgcccucacaggagcaaccgaaauccagaccagcggaaccaccaccauauucgcaggacaccugaaaugcaggcucaaaauggacaaacugacguugaaaggaaugucauaugucauguguacugguaguuucaaacucgaaaaagagguggccgaaacucaacacgggacaguccuaguacagaucaaauacgaaggcacugacgcaccaugcaaaauacccuucagcacccaagacgagaaaggggucacgcagaauggccgacugauuaccgcaaacccgauuguuaccgacaaggaaaaaccagugaacaucgaagccgagccgcccuucggagagucauacaucguaauaggagcuggugagaaggcccugaagcucucgugguucaagaaagguagcagcaucggaaaaauguucgaagcaacagcccgcggugccaggaggauggccauccuaggggacacagcuugggauuuuggaagcauaggaggcguuuucacguccguggggaagcuaguccaccagauauucggcaccgccuacgggguguuauucagcgggguuagcuggaccaugaaaauaggaaucggagugcuccucaccugguuaggacuaaauucacgaagcaccagccuaucaaugacuugcaucgcaguaggacucguuaccuuguaccuagggguaaugguccaagcggacucaggaugugucauuaacuggaagggccgagaacugaagugcggcuccggaaucuuugugaccaacgaagugcauaccuggacggagcaauacaaguuccaagcagacuccccuaagcgucugagcgcugcaauagguaaagcgugggaagagggggucugcgggauccgcuccgcaacccgccuagaaaauaucauguggaagcaaauuuccaacgaacugaaccauauacugcuggaaaacgacaugaaauuuacuguaguagugggagacgucgccgggauacucgcacaaggcaagaaaaugauaagaccccagccgauggaacacaaguacagcuggaaguccugggguaaggcaaagauaauaggagcagauguacaaaauucaacguucaucaucgacgggccgaacaccccagaguguccggaugaccaaagagccuggaauauaugggagguagaggacuauggauuuggaauuuuuacgacaaacauauggcuaaagcuccgagacaguuacacacagguuugcgaccaccgguuaaugagugccgcgaucaaggacucaaaggccgugcacgcagauaugggauacuggaucgaauccgagaaaaacgaaacuuggaagcuagcccgugccucguucauagagguuaaaacauguaucuggccaaaaucucacacgcuauggucuaacggaguccucgagagcgagaugaucauaccgaaaaucuacgggggaccgaucucccaacacaauuaccgccccggauacuuuacacagacagcagggccguggcaccucgggaagcuagaacucgacuucgaccuaugcgaaggaaccacggucguaguagacgagcauugcggaaacagaggacccucgcuccgcacuacaacagucacggggaagaucguccaugaguggugcugcagaagcugcacauugccaccccuacgguucagaggggaagacggcugcugguacgguauggaaauccggccagugaaagagaaggaggaaaaccuagucaagaguauggucagcgcagggagcggcgagguggacuccuucagccucgggcuacucuguaucuccaucaucauagaagaagugaugcgcuccagguggauccggaaaauguuaaugacuggaacccugggugucuucuuccugcucaucaugggucagcuaacauggaacgaccuuauccgucucugcauaauggucggcgccaacgcaagcgaccgaaugggaaugggcacaacguaucuagcacugauggcuaccuucaagaugcgacccauguucgcaguugggcuucucuuucgccgccuaacuagcagggagguacuccuccucacgauaggccuaagccuaguugccucaguagagcuacccaacagucuagaggagcuuggcgacggccucgcgauggggaucaugauacuuaaauuacucacggauuuccaaucgcaccagcuaugggccacccuacuaucgcuaaccuuuauaaagacaaccuuuagccugcacuacgcguggaagaccauggcaaugguccuuuccauugugucauuguuccccuuaugccuaagcacgacuucgcagaaaacuacguggcuucccguuuugcugggcucucucggcugcaaaccucuaacgauguuucucauagccgaaaacaagauauggggucgcaaaucguggccccuaaacgaaggcaucauggcagucggaauagugucgauccuguugucgagccuacugaaaaacgauguaccauuagcgggcccccucauagcgggaggcaugcucauugccugcuauguuauaagcggaaguuccgcagaccugucacuagagaaggccgcagaagugaguugggaggaagaggcggaacacucaggggccucgcacaacauccuaguagagguucaagacgauggaaccaugaagaucaaagacgaagaacgagacgauacacuaaccauauuauugaaggcgacgcuguuggcaguauccggcgucuacccgcuaaguauaccggcaacacucuucgugugguacuuuuggcagaagaagaaacaacggagcggugucuugugggauacaccaagcccacccgagguggagcgagcagugcuugacgacggaauauauagaauaaugcagcgggggcuccugggacgaagccaagugggcgucggaguauuccaagagaacguauuccacaccauguggcacgugacccggggugcgguccucauguaccagggcaagcggcuagaaccguccugggcguccgucaaaaaggauuuaauuagcuacggcggaggguggcgguuacagggaagcuggaauacaggcgaagaagugcaggucauagcaguagagccaggcaagaaucccaaaaacguccaaaccgcacccgggacguucaaaacgccagaaggcgaggucggggcgaucgcccuagacuucaaacccgggacgucgggcagcccgaucguaaaccgagaaggaaaaaucguggggcuguacggaaacggaguagugacgaccaguggaaccuacguaucggcaauagcccaggccaaggccucccaagaggggccucucccggaaaucgaagacgaagucuucaggaaacggaaucuaacaauuauggaucuacaucccggcucaggaaaaacgagacgauaccuccccgcaaucgucagagaggccauaaaacgcaaacugcggacgcuuaucuuagcaccgaccagaguugucgcaucagagauggcagaggccuuaaaaggaaugccaauuagguaccaaacgacagcagugaaaucugaacacacaggaaaggagauaguagaucugaugugucacgccacuuucacgaugcgacugcuaagcccaguccgcguaccuaacuacaacaugauuauuauggaugaagcgcacuuuacggacccguccagcauagcagccagaggguauauaagcaccagagugggcaugggcgaagccgcggcuauauuuaugaccgccacgccacccggcagcguagaagccuuuccccaaucaaaugcgguaauucaggacgaagaacgcgacauaccagaacgaucauggaacucugguuaugaauggaucacagauuucccgggcaagacuguaugguucguccccagcauaaaggcgggaaacgauauagccaacugccuacgcaaaaaugguaaaaggguaauacaauuaucccggaagacguucgauacggaauaucagaaaacgaaaaacaacgauugggacuacgugguaacgacggacaucagcgaaaugggcgcaaacuuccgagcggaccgcguaauagacccaaggcguugccuaaaacccgugauccugaaagacggacccgaacgugugauacuagccgggccaaugccggugacaguugcuucggcagcacaaagacgaggaagaaucggacgaaaucacaacaaagaaggugaucaauacaucuacaugggacaaccccuuaacaacgacgaggaccacgcacacuggaccgaggcaaaaaugcuguuggacaacaucaauacccccgaggggaucaucccggcuuuauuugaacccgaaagagagaagucggcggccauagacggggaauacagauugcguggggaagcacgcaaaaccuucguggaacugaugcgccgaggcgacuuaccagucuggcucucauauaaaguugcaucagagggauuccaauacucagaccgucgaugguguuuugacggcgaacgaaacaaccaaguacuagaggagaacauggacgucgaaauuuggacaaaagagggggagcggaaaaagcuccgcccccgaugguuagaugcccgaacauacagcgauccucuagcauugagggaguucaaagaauuugccgccgguaggagaagugugaguggagacuugauauuagaaaucggcaaacuaccacagcaccuuacacagcgcgcucagaacgcacuggauaacuugguuaugcuacacaacagcgaacagggaggcagggcuuauagacacgccauggaagaacucccugacaccaucgaaacgcucaugcuucucgcccucauagccgugcugaccggaggcgugacgcuguucuuccucucaggcaaaggccuagggaaaaccuccauaggacuacuauguguuauggcaucaucuguccugcucuggauggccucugucgaaccccacuggauagcagccagcaucauacuagaguucuuucucaugguccuguuaauaccagaaccagauaggcaaaggacaccacaggacaaccagcuggcauacguggugauaggccugcuguucaugaucuugacuguggcagccaacgaaaugggacugcuggaaacuaccaagaaagacuuaggaauaggacacguugccgucgaaaaccaccaucacgcagcgaugcucgacguggaccuucacccagccucagcauggacccuuuacgcggucgccacaacaauaauaacuccgaugaugcgacauacgaucgagaauaccacagcgaacauaagccuaacagcaauugcgaaucaggccgcaauacugaugggucuggacaaaggguggcccaucagcaagauggacauaggagucccacuccuggcguuaggaugcuacucgcaagugaacccacuaacauuaacagcggccguacucaugcuuguggcccauuacgcgauaaucggcccaggccuccaagcgaaggcgaccagagaggcccaaaagaggacugccgccggaauuaugaaaaacccuacagucgacggcauuguagccauagaccucgacccugugguauacgacgcaaaguucgagaaacaacucggccagauaaugcuucuaauauuaugcacaucucagauauuguuaaugcggacaacgugggcacucugcgaguccauaacccuagccacggguccgcucacaacccuuugggagggaucgccaggaaaguucuggaauaccacaauagcaguuucgauggcuaacauauucaggggaucauacuuagcgggcgccggucuggccuuuagccugaugaaaucacucggcggcggccgaagaggcacaggagcgcagggugaaacacucggagaaaaguggaaacgucaauuaaaccaguuaucgaaaagugaguuuaacacauacaaagggucuggcauaauggaaguagaccgaagcgaagcaaaagagggcuuaaaacgaggagaaacaacgaagcacgcugucagccgagggacagcaaaacuuaggugguuuguggagagaaauuuaguaaagccggaggggaaagucaucgacuuaggaugcggacguggaggcuggucauacuacugcgccggacucaagaaagugaccgaagucaagggcuacacaaaaggcggcccuggccaugaggaacccauaccgauggcaacuuacggguggaacuuggucaaacugcacucugguaaggacguauucuuuaucccacccgagaaaugcgauacccugcuaugcgacauaggagagaguagccccaauccuacaaucgaagaagggaggacauuacguguacugaaaaugguggaaccauggcucaaagggaaccaguucuguauaaagauauugaacccauauaugccaagcgucguagaaacgcucgaacagaugcagcgcaagcauggaggcaugcuaguaagaaauccguugucucggaacuccacccacgaaauguauugggucucaugcggaaccgggaacauagucagugcugucaacaugacaagccgaaugcuacugaaucgauucacgauggcucaccgcaagcccacauacgaacgcgacguagaccugggggccgggacccgccaugucgcagucgagccagaaguagcuaacuuagacaucauagggcagcgaauagaaaauauaaaacacgaacacaaaaguacuuggcacuacgacgaagacaaccccuacaaaacaugggcauaccauggaaguuacgaaguuaaacccucgggcagcgcaaguagcauggucaauggcgucguaaaacugcugacgaaaccgugggacgugauccccauggucacgcagauagcuaugaccgacacaacacccuuugggcaacagcgaguuuuuaaggagaaagucgauacgcgcacaccaaaagcgaaaaggggcaccgcgcaaaucauggaagucaccgcccgcuggcuauggagcuuucuguccagaaauaaaaagccacggauuuguacacgagaagaauuuacccgcaaaguaaggucuaacgccgcaauaggcgccguauucguagaugagaaucaauggaacucggccaaggaggcugucgaagacgagcgauucugggaccugguccaccgcgaacgggagcuucacaagcaaggaaaaugugccacaugcgucuacaacaugaugggcaaacgggagaagaaacucggagaguucggaaaggccaaggguagucgagcaaucugguauauguggcugggggcaagauuuuuggaguucgaggcucucggauucaugaacgaagaccauugguucucaagagaaaacucccugaguggaguagagggggagggccuacacaaacuaggauacauacuaagggacauuagcaaaaucccagggggcaacauguacgccgaugacaccgcaggaugggauaccagaauaacggaagacgaccuccaaaacgaggcuaaaauaacugacauaauggagccugaacacgcacuauuagcgaaaagcauauucaagcugaccuaccagaacaaggugguuagggugcaacgcccagcgaaaaacggaaccgugauggaugugauuagucgcagggaccagaggggcuccggacaagucggcacauacgguuugaauaccuucaccaacauggaggcacagcucauuagacagauggaaucagaagggauauuuaguccgagcgaacuggaaacccccaaccuggcagaacgaguccuagacugguuggagaaauacgguguagaacgacucaaacguauggcaauaagcggagacgacugcguaguaaaacccauagaugaccgauuugccacggcgcucacagccuuaaacgacaugggaaaagucagaaaagauauaccgcagugggagccgagcaagggcuggaacgacuggcaacaaguuccuuucugcucccaccacuuucaucaacuuauaaugaaggacggaagagaaauaguaguaccgugccggaaucaggacgagcuagucgggcgagcgcgagucagccaaggcgcuggguggagucuaagagagacggcaugccucggaaaaagcuacgcacaaauguggcaauuaauguacuuucaccgacgcgaccuuagacuagccgccaacgcgaucugcagcgcggugcccguugauugggugccaacuucgcgaacgacuuggucaauacaugcgcaccaccaauggaugacgacugaagacaugcuaucgguuuggaaccggguguggauugaggaaaaccccuggauggaggacaaaacacauaucucaagcugggaggacgucccauaucugggaaaacgugaagaccaauggugcggaucacuaauaggccucacggcacgcccaacaugggcaaccaacauccaaguagcgauuaaccaagucagaaggcuaauagguaacgagaacuaccuugacuacaugacgagcaugaaacguuucaaaaaugaaucagagccggaaggggcacuaugguaa

SEQ ID NO: 23716 - RNA, 9879 nt, Artificial Sequence
  derived and/or modified CDS sequence (opt11) from DENV-1__HE795086__SS-prME
agcgugaccaugcuacucaugcugaugcccacagcccuggccuuccaccucacgacccgggggggggagccccacaugaucgugaguaagcaagagcgcggcaaaagucuguuguucaaaacgagcgccggggugaacaugugcacccucaucgccauggaccugggugaguucugcgaggacacuaugaccuacaaaugcccccgcaucaccgaggccgagcccgacgacguggacugcuggugcaacgccacggacacguggguaaccuaugggaccugcagccagacaggcgagcaccggcgggacaagcgaagcguggcccuggcgccccacgugggacuugggcuagagacgcgaaccgagaccuggaugagcagcgagggcgccuggaagcagauccagcggguggagaccugggcuuugcgccaucccggguucacggugaucgcccucuucuuagcacacgccaucggcaccagcaucacccagaaggggaucaucuucauccugcuaaugcuagugacacccuccauggccaugcggugcgucggaaucggcagccgcgacuucguagagggguuguccggcgcgacguggguggacgucgugcucgagcacgggagcugcgugaccaccauggccaaggacaagccaacuuuggacaucgagcugcucaagacggaggucaccaaccccgcggugcugcggaagcuguguauugaagccaaaaucucaaacaccaccacggacagccgcugcccuacucaaggcgaggcaacccucguggaagagcaggacgccaacuucgucugccggcgcaccuucguggaccggggcugggggaacggaugcgggcuauucggcaaaggaucccugaucacgugugccaaguuuaaaugcgugaccaagcucgagggcaagauaguccaauacgagaaccugaaguauagcgugauagugaccguccauaccggagaccagcaucaggugggaaacgagucgacagagcacggcaccaccgcgacaaucacgccccaagcccccagcacggagauacagcugaccgacuauggggcccugacccuggacugcagcccccggaccggccuggauuucaacgaaaugguccuccugacgaugaaggaaaaguccuggcuggugcacaagcaaugguuccuggacuuaccgcugccauggacuagcggggcauccaccagccaggaaaccuggaaccggaaggaccuccugguaacguucaagacggcccaugcuaagaagcaggaggucguggugcuggggucccaggagggugccaugcacaccgcccucaccggggcuacggagauacagaccagcggcacaaccacgaucuucgccgggcaccugaagugccgccugaagauggacaaacucaccuugaagggcaugagcuacgucaugugcaccgggagcuucaagcuggagaaggagguggcggagacccagcauggaacugugcucgugcagaucaaguacgagggcaccgacgcgcccugcaagauuccuuucuccacucaagacgaaaaaggggugacccagaacggccggcugaucacugccaacccgaucgugaccgacaaggagaagccagucaacauugaagccgagccgccguucggggagucuuacaucgugaucggcgcuggcgagaaggcuuuaaaacuguccugguucaagaaggggagcuccauuggcaagauguucgaagccaccgcgcgcggugcccggcggauggcgauccucggcgacacagccugggacuucgggagcaucggcggaguguuuacguccguugggaaguuagugcaccagaucuucggcaccgccuacggggugcuguucagcggggucuccuggaccaugaagaucgggaucggcguucuccugacuuggcugggccucaauagccgguccacgagucuguccaugaccugcaucgcugucggguuggucacccucuaucuaggcgugauggugcaggccgacaguggcugcgucaucaauuggaagggcagggaauuaaagugcggaagcggcaucuucguuaccaacgaggugcacacauggacagagcaguacaaguuccaggcggacuccccgaagcgccucagcgcugcgaucgguaaggccugggaagagggggucugcggugugcgguccgccacccgcuuggagaacauaauguggaagcagauuagcaaugagcugaaccacauccuucuggaaaacgacaugaaguucaccguggucgugggggauguggcgggcauccuggcccagggaaagaagaugauacguccccagcccauggaguacaaguacuccuggaaguccuggggcaaggccaagaucaucggcgccgacguccagaauacaacguuuaucaucgacgggccuaacaccccggagugccccgacgaccaacgcgcguggaacaucugggaaguugaagacuaugguuuugggaucuucaccaccaacauuuggcucaaguugcgggacaguuacacccaggugugugaccaccgccucaugucggcggccaucaaggauuccaaggccguccacgcagacaugggcuacuggauagagagcgaaaagaacgagaccuggaagcucgcgcgcgccucguucaucgaggugaagaccuguauuuggcccaagagccacacccuguggucuaacggcgugcuggagagcgaaaugaucauccccaagauauaugggggccccaucucccagcacaacuaucggcccggguauuucacgcagaccgccggaccuuggcaccucgggaagcuggagcuggacuucgaccucugcgagggcaccaccgucguggucgacgaacacuguggcaaccgagggccaagccuacgaacuaccacugucaccggcaagauaauccacgaguggugcugccggucaugcacgcugccgccccugcgauuuaaaggggaggauggcugcugguacggaauggagauccgcccagugaaggagaaggaggagaaucuggucaagagcauggucagcgccggcuccggugagguggacuccuucucccuggggcuucugugcaucucuaucaugauagaggaggugaugcgcucgcgguggucacgcaagaugcugaugaccggcacccucgccguauucuuccugcugaucauggggcagcucaccuggaacgaccucauccggcuguguaucauggugggcgcgaacgccuccgaccgcauggggaugggcacgacuuaccucgcucugauggccaccuuuaagaugcgccccauguucgcgguuggccuccuguuucggcgcuuaaccagccgggagguccuacuacugacgaucgggcugagucucguugcaagcgucgagcugcccaacagucuggaggaguugggagacggacuugccaugggcaucaugauccugaagcucuuaacggauuuccagucgcaccagcugugggccacccuccugucgcugaccuucaucaagacuaccuucagccuccacuacgcuuggaagaccauggcuauggugcuguccauugugagccuuuucccccucugccuguccaccacuucccagaagaccaccuggcuacccguucuccuggguucccugggguguaagccgcucaccauguuccucaucgcagagaauaagaucuggggccgaaagagcuggccacuaaacgaggggaucauggcaguggggaucgugaguaucuuacuguccagccugcucaagaacgacguccccuuggccgggccgcugaucgccggcggcaugcucaucgccugcuacgugauuuccggaagcuccgccgaccugucucuugagaaggccgccgaggugagcugggaggaggaggccgagcauucaggcgcgucccacaacauccucguggaagugcaggacgacgggacgaugaagaucaaggacgaggaacgggacgacacccuaaccauucuacucaaggccacgcuguuggcggugagcggcgucuacccccuauccauccccgccacccuguucgugugguacuucuggcagaagaagaagcaacggagcggggugcucugggacacgcccagcccgcccgaggucgagcgagcagugcucgacgacggcauuuaccgcaucaugcagcgcggcuugcuggggcgcagccaggugggcgucgggguguuucaggaaaacgucuuccacacgauguggcacgucacucggggcgcgguguuaauguaccaagguaagcgacucgaacccuccugggccagcgugaagaaggaccugaucuccuacggcgggggguggcgguugcaggggagcuggaacaccggugaggagguccaagugauugcuguggagcccggcaagaaccccaaaaacguccagacggcccccgggaccuucaagaccucagaaggagaggugggcgccauugcgcucgauuucaagccggggaccagcggcagccccaucguaaaccgagagggcaagauagucggucuguacggcaacgggguugugaccacuuccggcaccuacgucucagcgaucgcccaggccaaggcgagucaggacgggccccucccggagaucgaggacgaaguguuccgaaagcgcaaccucacuaucauggaccugcaccccggcucagggaagacucggcgcuaccugcccgccaucgugcgggaggcgaucaagcgcaagcuccggacccuuauucuggccccaacgcgcgucguggcaucugagauggcggaggccuugaaaggcaugcccaucagguaccagaccacagccgucaagagcgaacacaccggcaaggaaaucgucgacuugaugugccaugccacuuucaccaugcggcugcucucccccgugcgcgugcccaacuacaacaugaucaucauggacgaagcccacuucacggacccgagcuccauugcggcacggggguauaucagcacccgcgucggcaugggggaagccgcugcuaucuucaugacagcgaccccacccggcuccguggaggccuucccccagucaaaugcaguaauccaggacgaggagcgggacaucccggagcgcaguuggaacagcggguacgaguggaucaccgacuuucccggcaaaaccgucugguucgugcccucgaucaagagcggcaacgacaucgcaaacugccuacguaagaacgguaagcgcguuauccagcucucccggaaaaccuucgacaccgaguaccagaagacgaagaacaaugacugggacuacgucgugacgaccgauaucagcgagaugggcgcaaacuuccgcgccgaccgggugaucgauccucggcggugucucaagccggucauccugaaggacgguccugagcgcgugaucuuggccggccccaugcccgucacgguggccuccgccgcgcagcggcgcgggcgaaucggcagaaaccacaauaaggagggcgaucaguacaucuauauggggcagccccucaacaacgacgaggaccaugcccacuggacugaggccaagaugcugcuggacaacauuaacacgcccgaggggaucaucccagcccucuucgaacccgagcgcgagaagucagccgcgaucgacggcgaguaccgccugcgcggcgaagcccggaagaccuucguggagcugaugcgccgcggggacuugccggucuggcuaaguuacaaggucgcgucggagggcuuccaguacagcgaccgccgguggugcuucgacggcgaacgcaacaaucagguacuggaggagaacauggacgucgagaucuggaccaaagagggggaacggaagaaacuccgcccccgcuggcuugacgcccgcacguacuccgacccccuggcccucagggaauucaaggaguucgcggcgggacgacgcagcguguccggggaccugauccuggaaaucgguaagcucccccaacaccuuacccagcgcgcacagaacgcccuugauaaccucgugaugcugcauaacagcgagcagggcggucgggcuuaucgccaugcaauggaagagcugcccgacaccaucgagacccucaugcuguuagcccucaucgccguucugacgggaggggugacccucuucuuccucuccggccgggggcugggcaagacaagcaucggacugcuaugcgugauggcgucguccguccugcuguggauggcauccguggagccacacuggaucgccgccaguaucauccucgaguucuuccugaugguucugcucaucccugagcccgaucgacagagaacuccgcaggacaaccaguuagccuacgucgucaucgggcuucucuucaugauccugacuguggccgcgaacgagaugggcuuguuagagacgaccaagaaggaccuggggaucggccacguagccguggagaaucaucaccacgccgcaaugcuggacguggaccuccaccccgccagugccuggacccuauacgcagucgccaccacgaucaucacccccaugaugcgccacaccaucgagaacaccacggccaauaucagccugaccgccaucgcgaaucaggccgccauccucauggggcuggacaagggcuggccgauuuccaagauggacauuggcgugccccuucucgcccuggggugcuacucacaggugaacccgcugacccucaccgcggccguccugaugcuaguggcgcauuacgcgaucaucggcccagggcuccaggccaaagcgacgcgggaggcccagaagcgcaccgccgccggcauaaugaagaacccuaccguugacgggaucguggccaucgaccuggaccccgugguuuacgacgcuaaguucgagaagcagcugggccagaucaugcuucugauccugugcaccucccagauccuccugaugcgcaccaccugggcccucugcgagagcaucacccucgccaccggcccccugacgacccugugggaggggagccccgggaaguucuggaauacuaccaucgccgugucuauggcuaacaucuuccgggggagcuaccucgcgggcgccggccuugccuucucccugaugaagucccucgggggcgggcgccggggcacuggcgcccaaggcgagacgcugggcgagaaguggaagcgccagcugaaccaauuauccaagucagaguucaacacguacaagcgguccgggaucauggagguggaccgcagcgaggcgaaggaaggcuugaagcgcggggagaccacgaagcacgccgucucccgcggcaccgccaagcugcgcugguucgucgagcgcaaccucgugaagccggaagggaaggugaucgaccugggcugcggacgcggcggguggagcuacuacugcgccgggcugaaaaaggucaccgagguaaaggguuacaccaagggcgggcccggccacgaggagcccauaccuauggccacauacgguuggaaccuugugaagcuccacuccggcaaggacguuuuuuucauaccgccggaaaaaugcgacacccugcugugcgacauaggugaaagcuccccaaaccccacaauugaggaaggcagaacccuccgggugcugaagaugguggagccguggcugcgcgggaaucaguucugcauuaaaauccucaaucccuacaugcccagcgucguggagacgcuggagcaaaugcagcggaagcacggcggcaugcuggugcgcaacccacuuagcagaaacuccacccacgagauguacugggucuccugcgggaccggcaacaucgugagcgcagugaacaugaccagucgcaugcuauugaaccguuucaccauggcucaccgaaagccgacauacgaacgcgacgucgaccugggggccggcacacggcacguggccguggagcccgaggucgccaaccuugauaucaucggccagcgcaucgagaacaucaaguacgagcacaagagcacuuggcacuacgaugaggacaaccccuacaagaccugggcguaccacgggucuuacgagguaaaaccuagcgguagcgccuccucuaugguaaacgguguggugaagcugcucacaaagcccugggacgucauccccauggucacccagauagccaugaccgacaccacgcccuucggccagcagcggguguucaaagagaaggucgacacccgcacgcccaaggcaaagcgggggaccgcccagaucauggaggugacggcgaaguggcuguggggauucuugucccgcaacaagaagccgcggaucugcacccgggaggaguucacccggaaggugcggagcaaugccgcuaucggcgccgucuucguggacgagaaccaguggaacucugcaaaggaggcgguggaggacgagcgguucugggaccucguccaccgcgaacgggagcuacauaagcaggggaagugugcaaccugcguguacaacaugaugggcaaacgcgaaaagaaacugggugaguucggcaaagccaagggcagccgggccaucugguacauguggcucggcgcgcgcuuccuagaauuugaggcacugggauucaugaacgaggaucauugguucucccgggagaacucucucucugggguggagggcgagggguuacacaagcugggcuacauccuccgcgacaucuccaagaucccugggggcaacauguacgcugacgacacggccggcugggacacccggaucacagaagacgaccuacaaaacgaggccaagaucaccgacaucauggagcccgaacacgcgcugcucgcgaaauccaucuucaagcugacguaccagaacaaggucgugcgggugcagagaccggccaagaacgggacggucauggacgucaucagccgccgcgaccagcggggcagcggccaaguggggaccuacggccugaacaccuuuacgaacauggaggcccagcucauccgccagauggagagcgaagguaucuucucccccagcgagcuggagaccccuaaccuggccggccggguacucgacuggcuggagaagcacggcguggagcgccugaagcgaauggcgauuuccggcgacgacugcgucgucaagcccaucgaugaccgcuucgccacagcacucaccgccuuaaacgacauggggaaggugcggaaggauaucccgcagugggaacccagcaagggguggaacgacuggcaacagguccccuucuguagccaccacuuucaccagcugaucaugaaggacgggcgcgagaucguaguucccugccggaaccaggacgagcucgugggucgcgcaagagugucgcagggcgcgggguggagccugcgcgagaccgccugucucggcaaguccuaugcccagauguggcaacucauguacuuccaccggcgcgaccugcggcuggccgcgaacgccauuugcagcgccgugccgguggacuggguccccaccucccgcaccaccuggaguauccacgcccaccaccaauggaugacgacagaggacaugcucagcguguggaaccggguguggaucgaggagaaccccuggauggaagacaagacccacauaagcucaugggaggacguccccuaucuggggaagagagaagaccaguggugcggcagccugaucggccucaccgcccgagcgacgugggccaccaauauccaaguggccaucaaccagguucgccgccugauuggcaacgagaauuaucuggacuacaugacguccaugaaacgauucaagaacgagagcgauccggagggcgcccucugguag

SEQ ID NO: 23717 - RNA, 9879 nt, Artificial Sequence
  derived and/or modified CDS sequence (opt11) from DENV-1__AB189120__SS-prME
agcgugaccauguugcucaugcugcuaccaacagugcuaaccuuucaucugacgacccgcggcggugagccccacaugaucgucagcaagcaggagcggggcaagagccuccuguucaaaaccagugccggagugaacaugugcacucuuauugccauggaccugggcgagcucugcgaugauaccaugaccuacaagugccccagaaucaccgaaaccgagcccgacgacguggacuguuggugcaaugccacagaaaccugggugaccuacgggacgugcucgcagaccggcgagcaucggcgcgacaagcgguccguggcccuggcgccccacgugggccugggguuagagacccguaccgaaacguggaugagcucagagggcgcguggcggcaaauccagaagguggagacaugggcgcugcgccaccccggguucacagucaucgcacuguucuuagcucaugcgaucggcaccucgaucacgcagaaaggcaucaucuucauacugcugaugcucgucacgcccagcauggccaugcguugcguuggcaucggcaacagagauuuuguggaggggcucagcggggccaccugggucgacguugugcuggagcaugguucgugcgugaccacuauggccaaggacaaacccacacuagacaucgaacugcugaagaccgaagugaccaaccccgccguucuccguaagcugugcaucgaagccaaaaucagcaacacgaccaccgauagccguugcccgacccaaggcgaggccacccugguugaggagcaggacgcgaauuucguaugccggaggaccuucgucgauaggggcugggggaacggcugcggguuauucggcaaggggagccugaucacgugcgcuaaguucaagugcgucacgaagcuggaagggaaaaucguccaguacgagaaccucaaguacucgguuaucguuacuguacacaccggagaccagcaucagguugggaacgagacuaccgagcacggaaccaucgccacgauuacgccccaggcuccuacuucugagauccaguugaccgacuauggggcccugacguuagacugcagcccccggaccggccuggacuucaacgagaugguguugcucaccaugaaggaaaaguccuggcuggugcacaagcagugguuccuggaccucccgcugccuuggacuagcggcgcgagcacgagccaggagaccuggaaccgacaagaccugcucgucaccuucaaaaccgcccacgccaaaaagcaggaggccguggugcugggcucucaggagggcgcaaugcacacggcucugaccggggccaccgagauccagaccuccggcacgaccaccauauucgcgggacaccuaaagugccgcuugaaaauggacaagcugacccucaagggaauauccuaugucaugugcacagggagcuucaagcuggagaaggagguggcggaaacccagcacggcacuguguuaguucaggugaaguacgagggcaccgacgcucccugcaagauccccuucuccagccaagacgagaaaggggugacccagaacggccggcuggucaccgccaacccgauugucaccgacaaagagaagccagucaacauugaagccgagccgcccuucggggaaaguuacaucgucgugggagccggugaaaaggccuuaaagcuuuccugguuuaagaaggggagcagcaucggcaagauguuugaggcgaccgcccggggcgcuagacgcauggccauacugggugacacggcuugggacuucggguccaucggcggcguguucaccagcgucgggaagcucguccaccagaucuucggcaccgcguacggggugcuguucuccggcgucucuuggacuaugaaaaucgggaucggcauccuucucacauggcugggccugaacucgcgcagcacuucccucucuaugaccugcaucgccguggguauggugacccuguaccucggagucauggugcaggcagacucugggugcgugaucaacuggaagggcagggaguugaaaugcgggucgggcaucuucguaacgaacgaaguucacaccuggaccgagcaauauaaguuucaggcugacagucccaagcgucuuuccgcugcgauuggcaaggccugggaggagggugucugcggcaucaggagugccaccaggcuugagaacaucauguggaagcaaaucuccaacgaacucaaccacauccuguuggagaacgacaugaaguucaccguuguagugggggacgucagcggcauccucgcucaaggaaagaagacgaucagaccacagcccauggaacacaaguacuccuggaagagcuggggcaaggccaaaaucauuggcgcugacguucagaacaccaccuuuauaauugaugggcccaacaccccggagugcccugacgaccaacgcgccuggaauauaugggagguugaggacuacggcuucgggaucuucacgaccaauaucuggcugaagcugcgggacaguuacacccaggucugcgaccaccggcucaugagcgccgccaucaaagauuccaaggccgugcacgcagacaugggcuacuggauugagagcgagaagaacgagaccuggaagcuggcccgcgcuuccuucauugaggugaagacgugcgucuggcccaaaagccacacacuuugguccaacggcguguuagaaagcgagaugaucauccccaagauauacgggggcccgaucucccagcacaauuacaggcccggguacuucacccagacggcuggcccauggcaccuugggaagcuggagcucgacuucgacuuaugcgaaggcacgaccguggugguggacgagcacuguggcaaccgggggccgucucuacgaaccaccacgguaaccggcaagaucauucaugaauggugcugccgguccugcacccugccgccacugcgcuucaagggcgaggauggcugcugguacggaauggagauccgcccgguaaaagaaaaagaagagaaucugguaaagagcaugguguccgcgggguccggcgaggucgacucuuucucccuggggcugcugugcaucagcaucaugaucgaggaagugaugcggucccgguggagccgcaagaugcucaugaccggcacguugguggucuuccugcuccugacccuggggcagcugaccuggaacgaccugauaagguugugcauuauggugggcgccaacgccuccgacaacauggggaugggcaccaccuaccuggcccugauggccaccuucagaaugcgcccgauguucgcagucggacucuuauucagacgccugacaagccgggaggugcuuuugcugaccguggggcugucccucgucgcaagcguggagcugccgaacucccuggaggagcucggugacggucuggccauggguaucaugauacugaagcuccugaccgacuuccagagccaccagcuuugggccacccuccuaucgcugaccuucgucaaaaccacgcucagccugcauuaugccuggaagaccauggcgaugauacuuuccaucguuucgcuccucccccugugcuuauccaccacgagucagaagacgacauggcuaccgguucugcucggcucacugggguguaagccgcucacgauguuccucaucaccgagaauaaaaucuggggccgcaagagcuggccccugaaugaggggaucauggcugugggcaucgucaguauccuacucuccagccugcugaaaaacgacgugccccucgccgggccccugaucgcaggcggcauguugaucgcauguuacgugaucuccggaucuuccgccgacuugagccuggagaaggccgccaaggucuccugggaggaggaagccgagcacucuggugcaucccacaacauccugguggagauacaagacgacgggaccaugaagaucaaagacgaggagcgggacgacaccaucaccauucucuugaaggccacccugcucgccauuagcggcgucuacccgaugucaaucccugcaacacuguucgugugguacuucuggcagaagaagaagcagcgcagcggagugcugugggacacgccuagcccgcccgagguggaaaaggcuguccuggacgacggcauauaucggauccuccagcgcggccugcuggggcggagccagguaggcguggggguuuuccaggagggcguauuccacaccauguggcauguaacccgcggggcgguccucauguaccaggggaaacggcuggagccuuccugggcaagugugaagaaggaccugaucucuuacggcgguggcuggcgcuuccaggggaguuggaacaccggagaggaggugcaggucaucgccguggagcccgggaaaaaccccaagaacgugcagacggccccaggcaccuucaagacaucggagggcgagguuggggcgauagcccucgacuuuaagcccggcaccagcgggagccccaucgugaaccgggagggcaagauagugggccuguacgggaacggcgucgucacgaccuccggaaccuacguuagcgccaucgcccaggccaaggcuucccaagagggcccccugccggagauagaagacgaggucuuccgcaagcggaaccucaccaucauggaccugcaccccgguagcggcaagacgcgccgguaccugccagcgaucgugcgugaggcaauuaagagaaaacuccgcacccuggugcuggccccuacccgggucguggccuccgagauggcggaggcccuuaagggcaugcccauccgcuaccagaccacggccgucaaaagcgaacauaccgguaaggaaaucgucgaccuaaugugccacgccaccuucaccaugcgccugcuaagccccguucggguacccaacuacaacaugaucaucauggaugaggcccacuucacggaccccgcgagcaucgccgcccgcggcuacaucuccacccgggucgggaugggcgaagccgccgcgaucuucaugaccgccacgccgcccgggagugucgaggccuucccccaguccaacgccgugauccaagacgaggagaaggacaucccggagcggagcuggaacuccggcuaugacuggaucacggacuuccccgguaaaacaguaugguuuguaccgagcauaaaguccgggaacgacaucgcaaacugccugcgcaaaaacggcaagcgcgugauccaacugagccggaagaccuuugacaccgaguaucagaagacgaagaauaaugacugggacuacguagucaccaccgacaucagugagaugggggcgaacuuccgcgccgaccgggucauagacccccgccggugucugaaaccagugauacugaaggacggccccgagcgcgugauccuggcugggcccaugcccgucacaguggccagcgcagcccagcggcgggguaggaucggccgaaaucaaaacaaggagggggaucaguacaucuauaugggccagccacuaaacaaugacgaggaucacgcccacuggacggaggccaagaugcugcuggacaacauuaacacccccgaggggaucauccccgcccucuucgagcccgagcgagagaagagcgcggccaucgacggggaguaccgcuuacgcggggaggcacgcaagaccuucgucgagcugaugcgccggggagaccucccggucuggcugagcuacaagguggccagcgaagguuuccaauacuccgaccgccgcuggugcuucgacggggagcgcaacaaccaggugcuggaggagaauauggauguugagaucuggaccaaggaaggagagcggaaaaagcuccgcccccgcuggcucgaugcccgcacguacucggacccccuggcgcuucgggaguucaaggaguucgcggccgggcgcagauccgugucuggcgaccugauacuggagaucggcaagcucccccaacaccugacccagcgcgcccagaacgcccuggacaaccucguaaugcugcacaacuccgagcagggcggcaaggcguacaggcacgccauggaggaacugccggauaccauagagaccauuaugcuuuuggcguuaaucgccguucucaccgggggcgugacguuguucuucuuguccgggcgcggucucggcaagacguccauaggacuacugugcguuaugagcucaucugcgcuccuguggauggccuccguggagccacacuggaucgccgcgagcaucauccuggaguucuuccucauggugcugcugauccccgagcccgaccggcagcgcacgccgcaggacaaccaguuagccuacguggucaucggccugcuguucaugaucuugacgguggcggccaaugagaugggccuucuggaaacgaccaaaaaggacuugggcaucgggcacgccgcagccgaaaaccaccaccacgcggcaaugcuggacguggacuugcaccccgccuccgccuggacccucuaugccguagcgaccacgauaaucacccccaugaugcggcacaccaucgagaacaccacggccaacauuagccugaccgccauugccaaucaggcugcgauccugaugggccuugacaagggcuggccgaucuccaagauggacaucggggucccccugcuggcgcuuggcugcuauagucaagugaacccccugacccugacugcggccguauugaugcugguggcgcacuacgccaucauuggccccggcuugcaggccaaagcuacgcgcgaagcccagaaacggaccgcggccgggaucaugaagaacccaacgguggacggcauagucgccauugaccucgacccuguggucuacgaugccaaguuugagaaacaguuagggcagaucaugcugcucauccugugcaccucccagaucuuacucaugcgcacgacgugggcgcuaugcgagagcauaacgcuggcgaccgguccccucacgacccugugggaaggcucccccgggaaguucuggaauaccaccaucgcugucagcauggcgaacaucuuccggggcuccuaccuggccggcgcugggcucgcguuuuccuuaaugaagucccugggcgggggccgccgcgggacgggcgcccagggcgagacgcucggggagaaguggaagcggcaacugaaccagcucuccaagagugaauucaacaccuacaagcgcuccggcaucaucgaaguugaccggagcgaagccaaggaggggcucaagcgcggcgagaccacgaagcacgccguaucccgggggaccgcgaagcugaggugguucgucgagcggaaccuggugaaaccggaggggaaaguuaucgaccuaggcuguggacgcgggggauggagcuauuacugcgccggccucaagaaggugacugaaguuaagggguacaccaagggcgggcccggccacgaggagcccauacccauggccacguacggcuggaaccuagucaagcuucauuccgggaaggacgucuucuucaucccgcccgaaaaaugcgacacucuacucugcgacauaggcgagagcucccccaaccccaccauagaggaggggcggacuuuacgcgugcucaagaugguggaaccguggcugcggggaaaccaguucugcaucaaaaucuugaauccauacaugcccagcgucguggagaccuuagaacagaugcagcgcaagcacggcggcaugcuggugaggaacccccugagcagaaacagcacgcacgagauguacuggguuuccugcggcacuggaaacaucgugagcgcagugaacaugaccucccggauguuguuaaacagauucacuauggcccaccggaagccgacguacgagcgcgaugucgacuugggcgcgggcacccggcacguggccguggagcccgaagucgccaaucuagacaucaucgggcagcgcaucgaaaauaucaagaacgagcacaagucgaccuggcacuacgacgaggacaacccuuacaaaacgugggcuuaccacggcucauacgaggugaagccgagugggagcgccuccucgauggucaacggcguggugcgccugcuaacgaagcccugggacgucauccccauggugacacaaaucgcgaugaccgacaccacccccuuuggccagcagaggguauucaaagagaaggucgacacccgcacccccaaagccaagcggggaaccgcccagaucauggaggugacggccaaguggcucuggggcuuccugucccguaauaagaagccgcggaucugcacccgcgaggaauucacucggaagguacgcagcaacgccgcgaucggggccgucuucguggacgaaaaccaguggaacuccgccaaggaggccguggaagacgagcgguucugggaccugguacgccgggaacgcgagcuccacaaacagggcaagugcgccacgugcguguauaacaugauggggaaacgggagaagaagcugggcgaguuugggaaggccaaggggagcagggcuaucugguacauguggcugggcgcccgguuccucgaguucgaggcccugggcuucaugaaugaggaccauugguucucccgcgagaacagccuguccggcguggagggggaggggcuccacaagcugggguauaucuuacgggacaucagcaaaauccccggcgggaacauguacgcggacgacacggccgggugggacacccgcauuaccgaggacgaccuccagaacgaggccaagaucaccgacaucauggagccggagcaugcccugcucgcuacguccaucuucaagcucaccuaccagaacaagguaguccgggugcagcgcccggcgaagaacggcaccgugauggaugugauaagucggcgcgaucagcgcgggucgggccaggugggcacguaugggcugaacacguucaccaacauggaggcccagcugauccggcaaauggaaagcgaaggcaucuucucgcccagugaacuugagacccccaaccuggccgggaggguacuggacuggcucgaaaagcauggcaccgagcggcugcgaaggauggccauaucaggggacgauugcguaguuaagccaaucgacgacagauucgccacggcgcugaccgcccucaacgauaugggcaagaucaggaaagacaucccgcagugggagcccagcaagggcuggaacgacuggcagcaggugcccuucugcagccaccacuuccaccagcugaucaugaaggacgggagggaaauagugguacccugcagaaaccaggacgagcuggucgggcgcgcccgggugucccaaggggccggcuggagccuccgcgagaccgccuguuuagggaaguccuacgcgcagauguggcaguuaauguacuuucaccgaagagauuugcgccuggccgccaacgccauuugcagcgcgguuccugucgauuggguaccuaccucccgcacgaccuggagcauccacgcgcaccaccaguggaugaccaccgaggacaugcugaguguguggaaccgcgucuggaucgaggagaacccuuggauggaggacaagacccacgugagcuccugggaggacgugccguaccucggaaaacgcgaggaucaguggugcggcagccugaucgggcugacggcccgggccaccugggcaaccaacauccaggucgcuaucaaccaggugcgccgccucaucgggaacgagaacuaccuggacuacaugaccucuaugaagcgguucaaaaaugagagugacccggagggggccuuaugguga

SEQ ID NO: 23718 - RNA, 9879 nt, Artificial Sequence
  derived and/or modified CDS sequence (opt11) from DENV-1__AB189121__SS-prME
ucggucaccaugcuguucaugcuccugcccaccgcccuggcauuccaccucaccacccgaggcggggaaccucacaugauugugagcaagcaggaacgagggaaaagccuacucuucaaaaccucggccgggguuaacaugugcacccugaucgccauggaccuuggcgaacugugcgaggacacaaugaccuacaagugcccccgcauuaccgagaccgagccugacgacguggauugcuggugcaaugccaccgagaccugggugaccuacgggacguguagccaaacuggcgaacaccgaagagauaagcgauccguggcacuagcgccccacgugggccucgggcuggagacccgcaccgaaacuuggauguccucggagggcgccuggcgacagauucagaagguggagaccugggcucuccgccacccaggguucacagugauggcucuguuccuggcccacgcaaucgggaccagcaucacccaaaagggcaucaucuuuauccuccugaugcuggugacgccauccauggccaugcgcugcgucggcauuggcaaccgggauuucguggaagggcucagcggagccacguggguggacguagugcuggagcacggguccugcgugaccaccauggccaaagauaagcccacgcuggacaucgagcuccugaaaacugaggucacuaaccccgcagugcugcggaagcucugcaucgaggcgaagauuagcaacaccacgaccgacucgcgaugcccgacccagggcgaggcuacccugguagaggaacaggacacuaacuucgucugcaggcgcaccuuuguggaccgggggugggggaacggcugcgggcuguucggcaaggggucgcucaucacgugcgccaaguucaagugcgugacgaagcuggaggguaagaucguccaguacgaaaaucugaaauauuccguaauugucacaguccauacaggagaccaacaccaggugggcaacgagacgaccgagcaugguaccacggcuaucaucacgccccaagcgcccacgagcgagauccagcucaccgacuauggggcuuugacgcuggacuguagcccccgcaccggcuuagauuucaacgagaugguuuuacugacuaugaaggagaaguccuggcucguccacaagcagugguuucuggaccucccgcuccccuggaccuccggugcgagcacgagccaagagaccuggaaccggcaggacuuacugguaaccuucaagaccgcucacgccaagaagcaagaagucguggugcucggcucccaagagggcgccaugcacacggcccugaccggcgcgaccgagauucagacuagcgguacgacgacgaucuucgccgggcaccugaagugccggcucaagauggacaagcugacccugaagggcgucuccuaugugaugugcacaggguccuucaaacucgagaaggagguggccgagacccagcacgggacuguccugguccaagugaaauacgagggcacagacgcccccugcaaaauccccuucagcagccaggacgaaaagggggucauucagaacgggcgguugaucacggcgaacccuaucguaacggacaaggagaagcccgugaauaucgaggcggagccucccuucggagaguccuacaucguagugggcgccggcgagaaggcccugaagcucagcugguucaagaaagggagcagcaucgguaagauguucgaggcuaccgcccgaggggcccggagaauggccauccugggcgacaccgccugggacuucggauccauuggaggcguguuuacgucugucgggaagcuggugcaccaaaucuucggcaccgcauacgggguacuauucuccggcgucagcuggaccaugaagaucggaaucgggauucugcuuaccuggcucggcuugaacucccgaagcacauccuuauccaugacgugcaucgcaguggggaugguaacccucuaccugggcguuauggugcaggcagacucagggugcgugaucaauuggaagggacgggaguugaagugcgggucuggaauuuucgucaccaacgaggugcauacguggaccgagcaguacaaguuccaggcggacagcccaaagcgucucuccgcagcgaucggcaaggccugggaggaggguguaugcggcauacggagcgcuacccggcuggaaaacaucauguggaagcagaucaguaacgagcugaaccacauucuccuggaaaaugacaugaaguucacggucgugguaggugacgucagcggcauccuagcgcaggguaagaagaugauccguccccagccaauggagcacaaguauucguggaaguccuggggcaaggccaaaauaaucggcgcugacguacagaacaucacguucaucaucgaugggccgaacacgucggagugccccgacaaccagcgagccuggaauauaugggagguggaggacuacggcuucgggauauucacuaccaacaucuggcucaaacuucgggacagcuacacccagguaugcgaucacagacuaaugucugccgcaauuaaggacagcaaggcagugcacgcggacauggguuacuggauugaguccgagaagaacgagacauggaagcucgcucgagcgagcuucaucgaggugaagacauguaucuggcccaaaucgcacacacuguggagcaacggcguccucgagucagaaaugaucauccccaaaaucuauggaggccccguaucccagcauaacuaccgcccgggguacuucacccagacggccggcccuuggcaccuugggaagcuggagcuggacuucgaccucugcgagggcacgaccguggucguugacgagaacugcgguaaccggggucccucccugcgcaccacgaccgugaccggaaagaccauccacgaguggugcugccggagcuguacgcugccgccccuccgcuucaaaggugaggaugggugcugguacgggauggagaucaggccugucaaagagaaggaggagaaucuggucaaaucuaugguguccgcgggcuccggcgaagucgacuccuucagccuggggcucuuaugcaucuccaucaugaucgaggaaguuaugcgcagccgguggagccgcaagaugcugaugacgggaacauuggccguguuccuguugcucacuauggggcaguuaacguggaacgauuugauccgucucugcaucauggucggcgccaacgcguccgacaugauggggaugggcaccaccuaccuggcucugauggcgaccuuucgcaugcggcccauguucgcaguaggccuccuguuccggcgccuaacgucccgagagguccucuuacugaccguggggcucucucugguggccucgguugagcugccgaacagccucgaggaguuaggggacggauuggccaugggcaucaugaugcucaaacuucugacggauuuccagccccaccagcucugggcgacauugcugucccucacguuugugaagaccacguucagucugcauuacgcauggaagaccauggccaugauccugucaaucgugagccuacugcccuuaugcuuaaguacgacaagccagaaaaccaccuggcugcccguccugcucggcucccuggguugcaagccgcugacgaugcuccugauuaccgagaacaaaaucuggggacgccggagcuggccgcugaaugaggggaucauggccauuggcaucgugucuauacuccuguccagccuucuuaagaacgacgugcccuuggcugggccacuuauagcgggaggaauguugaucgccugcuauguuauaucgggcagcuccgccgacuuguccuuagagaaggcugccgaggucuccugggaagacgaggccgagcacucaggcgcgucccacaauauccucguggagguccaggacgacgggaccaugaagaucaaagacgaggagcgagaugacacccugaccauccugcucaaggccacgcugcuggcgaucagcggaguguauccuauguccaucccggccaccuuauucgugugguacuucuggcagaaaaagaagcagcggagcgggguccuuugggacaccccaaguccgccugagguggagcgcgcgguguuggacaacggaaucuaccggauucugcagagaggccugcugggucgaagccaggucgguguggggguguuccaggaaggagucuuccacacgauguggcacgugacccgcggagccgugcucauguaccaggguaagcgccuggaaccguccugggcauccgucaagcgggaccuaaucagcuacggcggaggguggcgguuccaggggucauggaacacuggcgaggagguccagguuaucgcaguagagccagggaaaaacccgaaaaacgugcaaaccacuccggggacguuuaagacgcccgagggcgaggugggggccaucgcgcucgacuucaagccuggcaccucuggcagccccaucgucaaccgcgaggguaagaucgugggccuauaugggaacggcguggucaccacgucggggaccuacguguccgccaucgcccaggccaaggcgagccaggaggguccguugcccgaaaucgaggacgagguguuccguaagcggaaccugaccaucauggaccuacaccccggguccggcaagacccgucgcuaccucccggcgaucguccgggaagccauaaaacgcaagcugcgaacccucguacuggcccccacgcgaguuguagccucggaaauggcggaagccuuaaaaggcaugcccauacgcuaucagacuaccgccguuaaguccgagcacacugguaaagagauaguggaccucaugugccacgcaacguucaccaugcggcuccugucuccagugcgcguuccgaacuacaacaugaucaucauggacgaagcccauuuuaccgaccccgcguccaucgcggcccgggguuacauuagcacgcgcguggggaugggcgaggccgcagccauuuuuaugacagccacgccuccugggucgguagaggccuuuccgcaguccaaugccgucauccaggacgaagagagagacauccccgaacgcuccuggaacagcgguuaugaguggauuaccgacuuccccggcaagacaguaugguucguacccaguaucaagagcgggaaugacaucgccaacugccuccggaagaacggcaagcgcguggugcaguuauccaggaagaccuuugacacugaguaccaaaagaccaagaauaacgacugggacuaugucguuacgaccgacaucagcgagaugggggcgaacuuccgcgccgaucggguaaucgacccgcgccggugccuuaaaccagugauccucaaggacggccccgaacgcgugauccuugccggacccaugccggucaccguggcgagcgcggcccagcggcgcggacggaucggacgcaaccccaacaaggagggugaccaguacguguacaugggccagcccuuaaacaacgacgaagaccacgcccacuggaccgaggccaagaugcuccuggacaacaucaauacgcccgaggggaucaucccggcccuguuugaaccugagcgcgagaagucggccgcgauugacggggaguaccggcuccgcggggaggcucggaagacuuucgucgagcugaugcgcagaggcgacuugccggugugguuguccuacaagguggcgagcgagggcuuccaguacucagaccgccgguggugcuucgacggggagcgcaacaaccaaguccuggaagagaacauggacguggagaucuggaccaaggaaggagagcggaagaaacuucgcccccggugguuggacgcucgcaccuacuccgacccguuagcgcugcgggaauuuaaggaguuugccgccgggcgucggagcguguccggugaccucauccuggagauuggaaagcugccccagcaucucacgcaaaaggcccagaacgcccuggacaaccuggucaugcuccacaacagcgagcagggaggcaaagcguacagacacgccauggaggagcugccagauaccauagagacccugaugcuccuggcgcuuauagccgugcugaccggaggcgugacccuguucuuccuguccgggagaggacucggcaagacgucuaucgggcugcucugugugauggcauccagcgcccuguuguggauggcaaguguggagccccacuggaucgccgccucaaucauauuggaguucuuccucauggugcugcugaucccggagcccgaccgacagcgcacgccccaggacaaccaacucgcguacguuguuaucggccugcuuuucaugauucucaccguagccgccaaugagauggggcugcucgagaccacgaagaaggaccucggcauugggcacgccgccgcggagaaccaccaccacgcugccaugcuagaugucgaucuccacccugccuccgccuggacccucuacgcgguggccaccaccauaaucacgcccaugaugcgacauacgaucgagaacaccaccgccaacaucagucugacggcuaucgcgaaccaggcggccauccugaugggccucgacaagggcuggccaauuuccaagauggauaucgggguuccccugcuagcccucggcugcuacucgcaggucaauccgcugaccuugaccgccgcgguacuaaugcugguggcgcauuaugcgaucaucggccccggccugcaggccaaggcgacacgggaggcgcaaaagcgaacggccgccgggauuaugaaaaaccccaccgucgacggcaucguggccauugaccucgaccccguggucuaugacgccaaguucgagaagcaacugggccagauaaugcugcucaucuuauguaccucucaaauccugcucaugcgcaccacgugggcgcucugcgaguccaucacccuggccaccggaccgcucaccacucugugggagggcagcccgggaaaguucuggaacaccaccaucgcgguaagcauggccaauaucuuccggggguccuaccucgccggcgcggggcuggccuucagccugaugaaaucgcuaggggguggccgcaggggcaccggcgcccaaggcgagacccucggggagaaauggaagagacagcugaaucaguuaucuaaguccgaguuuaauaucuauaagcgguccggcaucaucgaaguggaccgcagcgaggccaaagagggguuaaagcguggcgagaccaccaagcacgcgguaucgcgcgggaccgcaaagcuccguugguuugucgaacgcaaccuggugaagccggagggcaaggucaucgaccugggcugcgggcggggcggguggucauacuacugcgccggccugaagaaggugacggaagugaagggauauacgaagggcggacccgggcacgaggaacccauccccauggccaccuauggguggaaccuggugaaguuacacuccgguaaagacguguuuuucacgccacccgagaaaugcgauacgcugcugugcgacauuggcgagucgucccccaacccuaccauagaagaaggaaggacccugcggguacuuaagauggucgaacccuggcugcggggcaaccaauucugcaucaagauccugaaccccuacaugccgucugugguggaaacacucgagaaaaugcagcgcaagcauggaggaauguuagucagaaacccccugucccggaacagcacccacgagauguacuggguguccugcggcacgggaaauauuguaucugccgucaacaugaccucacguaugcucuuaaauagguucaccauggcccaccguaaacccaccuaugagcgcgacguagaccugggugccggcacgcgucacguggccguggagcccgaaguggccaaccucgacaucaucggccagagaaucgagaacaucaagaacgagcauaagagcacguggcacuaugacgaggauaauccguacaagaccugggccuaucacggcuccuacgaggucaaacccaguggcuccgcaagcaguauggucaacggggugguccggcuccuaaccaagcccugggacgugauccccauggugacgcagauugccaugacagacacgacaccguucgggcagcaacguguguucaaagagaagguggacacgcguaccccgaaggccaaacgcggcaccgcccagaucauggaggugaccgcccgguggcucuggggcuuucugucccgcaacaagaagccccggaucugcacgcgcgaagaguucacccggaagguccgcagcaacgcugcuauuggggccguguucguggacgagaaccaauggaacuccgccaaggaggcggucgaggaugagcgguucugggaccuggugcaccgcgagcgggaacuccacaagcagggcaagugcgcuaccuguguuuacaacaugauggggaagagagaaaagaagcugggcgaguucgggaaagcuaaaggcagccgggcaaucugguacauguggcugggagcucgguuucucgaguuugaggcguuaggcuucaugaacgaagaccacugguucuccagggagaacagccuguccggcgucgagggagagggccugcacaagcuaggguacauucugcgugauauaucgaagauaccgggaggcaacauguacgccgacgacaccgcagggugggacacgagaaucacagaggacgaccuccaaaacgaagccaagaucaccgacaucauggagccagaacacgcccugcuggcgaccuccaucuucaagcucaccuaucagaauaagguagugaggguccaacgcccagccaagaacggcaccgugauggacgugaucagccggagggaucagcggggauccggccagguagguaccuacgggcuuaauaccuucacaaacauggaggcccaacugauccgccagauggaaagcgaaggcauauucagucccagcgagcuugagaccccuaauuuagccgagcgugucuuugacuggcuggagaaacaugggaucgagcgccucaagcggauggccaucuccggcgacgacugcgugguaaagcccauagacgaccgcuucgcgaccgcucugacagcccuuaacgacauggggaaggugcggaaggacaucccccagugggaacccagcaagggcuggaacgacuggcaacaggucccguucugcucacaccacuuccaccagcucaucaugaaagacggccgugagauugucguucccugccgaaaucaggacgaguuagugggccgcgcccgggucagccaaggcgccggguggaguuuacgcgagacggcgugucucggcaaguccuacgcccagauguggcagcucauguauuuucaccgucgcgaccugcgguuagcggccaaugcgaucugcagcgcagugccgguggacuggguccccaccucccguaccacauggucaauucaugcccaccaucaguggaugaccacagaggacaugcucucgguguggaaucggguguggauagaggagaacccguggauggaagacaagacccacguuucguccugggaggacgugccauaccuuggcaagcgcgaggaccaguggugcggcagcuuaauuggccuuaccgcucgcgccacuugggcgacgaauauccagguggcaaucaaccagguccggcgccugaucgggaacgagaacuacuuagacuacaugaccucaaugaagcgcuucaagaaugagagcgaccccgagggggcgcugugguga

SEQ ID NO: 23719 - RNA, 9879 nt, Artificial Sequence
  derived and/or modified CDS sequence (opt11) from DENV-1__AB195673__SS-prME
agcgugaccaugcuguugaugcugcuucccaccgcccuuacuuuccaccugaccaccaggggcggcgaaccccacaugaucgugggcaagcaggagcggggaaagagccuguuauucaaaaccagcgccggggugaacaugugcacccugaucgccauggaccugggggaguugugcgacgacacuaugaccuacaagugcccccgcaucaccgagacggagcccgacgacguggauugcuggugcaacgcaaccgagaccugggucaccuacggcacgugcagccagaccggcgagcauagacgcgacaagcggagcguggcacuggcgccccacgugggacugggccuagagacccgcaccgagacguggaugucgagcgaaggggccuggcggcaaauccagaagguugagaccugggcacuccgccacccgggauucacggugaucgcccucuuccuagcccacgugaucgggaccucgaucacgcagaagggcauaauuuucauacugcugaugcucgucacccccagcauggccaugaggugcgugggcaucgggaaccgcgacuucguggagggccuguccggggcaacaugggucgacguggugcuggagcacggcagcugcgucaccacgauggcgaaggacaagcccacgcucgacaucgagcugcucaagaccgaggugaccaaccccgcagugcuccgaaaguugugcaucgaagccaagauauccaacacgaccaccgacagcaggugcccgacucagggcgaagccacgcucguggaggagcaggauaccaacuucgugugccggcgcacguucguggaccggggguggggcaacgggugcggccucuucgggaagggcucccuuauaacgugcgcgaaauucaagugugucacgaagcuggaggggaaaaucgugcaguacgagaaccucaaguacagcgugauugugaccgugcacaccggggaccagcaccaagucggcaacgaaaccaccgaacacgggacgaucgccaccaucacaccccaggcccccaccuccgagauccagcugacggacuacggcgcccuaacccucgacugcagcccccgaaccggccuggacuucaacgagauggugcuguugaccaugaaagagaaguccuggcuggugcauaagcaaugguuccuggaccucccucugcccuggacuucgggggccuccaccucccaggagaccuggaaccggcaggacuuacucgugaccuucaagacggcucacgccaagaagcaagagguagugguucugggaagccaggagggggccaugcacaccgcccugaccggcgccaccgaaauucagacgucagggaccaccaccaucuucgccggccaucucaagugcaggcugaaaauggacaaguugacgcucaaggggauuagcuacgugaugugcaccggcucauuuaaacuggagaaagagguggcagagacccagcacggcaccguccucguccaagugaaguaugaggggacagacgcccccugcaagauccccuucucgucccaggacgagaagggcgucacccagaacgggcggcuggugacggcaaacccgaucgugaccgacaaggagaagcccgucaauaucgaggccgagccucccuucggcgagagcuacaucguugugggcgcgggggaaaaggcccucaagcugagcugguucaaaaagggcaguaguaucgggaagauguucgaggcgacagcccgcggcgcgcggcgcauggcaauacugggggauaccgccugggacuucggcagcaucggcgggguuuucaccagcgugggcaaauuagugcaccagaucuucggaaccgccuacggcguucuguucaguggggugagcuggacgaugaaaaucgggaucggcauccugcucaccuggcuagggcuuaacucucgcuccaccagccucuccaugaccugcauugccgugggccucauuacgcuguaucucggggucauggugcaggcggacagcggaugcguuaucaauuggaaggggcgggagcucaagugcgguuccggcaucuucgucaccaacgaggugcacaccuggacagagcaguacaaguuucaggcagacagcccgaagcgccugagcgccgccaucggaaaggccugggaagagggcgugugcgggauccgaagugcgacccgccucgagaauaucauguggaagcagaucaguaaugagcugaaccacauucugcuugagaacgacaugaaguucacggucguagugggugacgucuccggaauccuggcccaaggcaaaaagucgauccggccccagcccauggagcacaaguacucauggaagucguggggaaaggcaaagaucaucggagccgacgugcagaacaccaccuucaucaucgacggacccaacaccccggagugccccgacgaccagcgcgccuggaauaucugggagguggaggacuauggauucggcaucuucacgaccaacaucuggcugaagcuccgggacuccuacacccaggucugcgaccaccgccuuaugucggcggccaucaaggacuccaaggccgugcaugccgacaugggcuacuggaucgagagcgagaagaaugagaccuggaaacuggcccgggccuccuucaucgaggugaagacgugcaucuggcccaagagccacacccuuuggucuaacgggguccucgagagcgagaugaucauccccaaaaucuacggugggccaaucucccaacacaacuaccgccccgguuacuucacccagaccgcugggcccuggcaccugggcaaacucgaacuggacuucgaccuuugcgagggcacgaccgugguagucgacgagcacugcgggaaccggggcccgagcuuaaggaccaccaccguaacagggaagaucauccacgaguggugcugccgcaguugcacccugccuccccugcgcuuuaagggggaggacgggugcugguacggcauggagauccggcccgugaaggagaaggaggagaaccuugugaagagcauggugucugccggcuccggggagguagacagcuucucucuggggcuguuaugcaucagcauuaugaucgaagagguaaugcgcucacgguggucacgcaagaugcugaugaccgggacgcuagcuguguuccuccugcugaccaugggucaguugaccuggaaugaccucauacgguugugcaucaugguaggugcgaacgccuccgauaacaugggcauggggaccacguaccuagccuugauggcgaccuuccgcaugcguccgauguucgccguuggguugcuguuccggcgccugaccagccgggaggugcugcuccugaccgucggccugucccucguggcgagcguggagcugccaaacucccuggaggagcucggggacggauuggccaugggaaucaugauccugaagcucuugacggacuuccagagccaccagcugugggcgacccuccugucacugaccuucgucaaaaccacguucagccuccacuacgccuggaagaccauggcaaugauccuuuccaucguuagccuguucccccugugucucaguaccacuagccaaaagacgacuuggcugcccgugcuccuggggucccugggcugcaagccgcucacgauguuccugauuacggagaacaagaucugggggcgcaaaagcuggccccugaacgagggcaucauggcggucggcaucgugagcauacuccuauccagccugcucaagaacgacgugccccuggccggaccucugaucgccggcgggauguuaauugcuugcuaugucauauccgggagcucugcggaccucagccuagagaaggccgcagaggugaguugggaggaggaggccgaacacagcggggcgucacacaacaucuugguggagauccaggacgacggcaccaugaaaauuaaggaugaggagcgggacgacacgaucaccauccugcugaaggcgacccuccuagccaucagcggggucuacccgaugucaauccccgccacccucuucgugugguauuucuggcaaaagaagaaacagcgcagcggcguguuaugggauacccccagcccacccgagguagagcgggccgugcuagaugacggcaucuaccgcauucugcagcgggggcugcucggacgcagccaggugggggucggcguguuccaggaagggguguuccauacuauguggcacguuacgcggggcgccgugcugauguaccagggaaagcgucuggagcccuccugggcgagcgucaagaaggaccucaucagcuacgggggcggguggcgguuccaggguagcuggaauaccggggaggaaguccaggugaucgcagucgagcccgggaagaaccccaagaacguccaaacagcccccggcaccuucaagaccucugagggggaagugggggccaucgcccuggacuucaagcccgggaccagcggcagucccaucguaaaccgcgagggcaaaaucgucgggcuauauggcaacgggguaguuacgaccucgggcacguacgucagcgcgaucgcucaggcaaaggccucccaagaggggccgcucccagagaucgaggacgaggucuuccggaagcgcaaccugacuaucauggaccugcaccccggcagcggcaagacgcggcgcuacuugcccgccaucgugcgugaggcgaucaaacgcaagcugcggacccuggucuuagccccgacccgcguggucgccuccgagauggccgaggcacugaaggggaugccuauccgcuaccagaccacggcagucaagagcgagcauacaggacgggagaucguggaccugaugugccacgcuaccuucaccaugcgccuccugucccccguacggguccccaacuacaacaugaucaucauggacgaggcccacuucacggauccggccagcaucgcggcacgcggguauaucucaacccggguaggcaugggggaggccgccgccaucuuuaugaccgcgacgccgcccggcagcguggaagcuuucccccaaucgaaugccgucauccaggacgaagagaaggacauuccggaacgcagcuggaauuccgguuacgacuggaucacggacuuuccggggaagaccgucugguucgugcccucuaucaaguccggcaacgacauugcaaacugccugcggaagaacgggaagagagucauccagcucucacggaagaccuucgacaccgaguaucagaagacgaagaacaacgacugggacuacguugugaccacugacauauccgaaaugggcgccaacuuccgcgcggaccgcgugaucgacccccgccggugccugaaaccggugauccugaaggaugggcccgagcgugucauccucgccggcccgaugccggucaccguggccagcgccgcgcagcgaagaggccggaucggccgcaaccagaacaaggagggcgaccaguacaucuauauggggcagccccugaacaacgacgaggaccacgcccauuggacggaggccaaaaugcugcucgauaacaucaacacccccgagggcaucauucccgcccuguucgagcccgagcgggaaaagucggccgcgaucgacggggaguacagacugaggggcgaggcccggaagacuuucgucgagcucaugcgccgcggcgaccugccgguguggcugaguuacaaggucgccagcgagggguuccaguacagcgacaggcgguggugcuucgacggcgagcgcaacaaccagguccucgaggagaacauggacguggagaucuggaccaaggagggggagcggaagaaacugcgcccccgguggcuggacgcccgcacguacagcgauccccucgcccugcgggaguuuaaggaguucgcggccggccgccgauccgugagcggcgaccugauccucgagaucggcaagcugccccagcaccugacccagcgggcccagaacgcccucgacaaccugguuaugcugcacaacuccgagcaaggcgggaaggccuaucggcacgcgauggaggagcuuccggacacuaucgagacccugaugcugcuugcccugaucgcgguguuaaccggcggagugaccuuauucuuccugagcggccgcggccugggaaagacgucgaucggccuccugugcguaaugagcuccagcgcguuguuauggauggcguccguggagccccacuggaucgccgccagcaucauccuggaguucuuucugauggugcuccugauccccgagccggaucggcagcgcaccccacaggauaaccaguuggccuauguggucauugggcuacuguucaugauccugaccguggcugcgaacgaaaugggccuccuggagacgacuaagaaggaccuggggaucggccacgcugcugccgaaaaucaccaucaugccgcgaugcucgacguagaccugcaccccgccucugccuggacccuguacgccguggccacaacgauuaucacaccgaugaugcggcacacaauugagaacaccacggcgaauaucucacuuaccgccaucgcuaaucaggcagccaucuuaaugggacuggacaaagguuggccgaucucaaagauggacauagguguuccccuccuggcacuggggugcuacagccagguaaacccccuuacccugaccgcggccgugcuaaugcucguggcccauuacgcgauaaucggccccgggcugcaggccaaggccacgcgcgaggcccagaagcggaccgcagcgggcaucaugaagaacccuaccgucgacggcauaguggccaucgaccuagaccccguagucuacgacgcuaaguucgagaagcagcucgggcaaaucaugcugcugauccucugcaccucccagauacuucugaugaggacgaccugggcccucugcgaaagcauuacccuggccacaggaccccugacgacauuaugggagggguccccaggcaaguuuuggaacacuacaaucgcugugagcauggccaacaucuuccgcggcuccuaucuggcgggggcaggccuugccuuuucccucaugaagagccucgggggaggacggcgcggaacgggcgcgcagggggagacccugggcgagaaguggaagcggcagcucaaccagcuguccaaaagcgaguuuaacauauacaagcgcuccgggauuguagaggucgaucggagcgaggcuaaggaaggccucaagcgaggggagaccaucaagcacgccguguccaggggcacugccaagcuacgcugguucguggagcggaaccuggucaagccugagggcaaggucaucgaucuagggugcggccgcggaggcuggagcuacuacugcgcgggacuaaagaaggugacggaggucaaagguuacaccaagggcgggcccggccacgaggaacccauccccauggccaccuacggguggaaccucgugaagcuguacuccggcaaggacguguucuuuaucccgcccgagaagugcgauacccuacucugcgacaucggggagagcuccccgaacccgacgaucgaggagggacggacccugcgcgucuuaaaaaugguugagccguggcuccguggcaaccaguucugcaucaaaauccugaaccccuacaugccaucaguggucgaaacccuggagcagaugcagcgcaagcacgggggcaugcucguccggaacccccugucccgcaacucuacccacgaaauguacugggugagcugcgggaccggcaacauuguaagcgccgucaauaugacgucccggaugcugcucaaccgcuucaccauggcccaccggaagccuacauacgagcgcgacguagaucugggugccgggacccgccacgucgcaguggagcccgagguagccaaucuggacaucaucggccagaggaucgagaacaucaagaaugagcauaagagcaccuggcacuacgacgaagacaaccccuacaagaccugggccuaccacggguccuacgaggucaaacccagcggcagcgccuccucaauggugaacgggguuguccgccuccugaccaagccgugggaugugaucccuauggucacacagauugccaugacggacaccacccccuucggccagcagcgggucuucaaggaaaagguggauacccgcacgcccaaggcgaagagagggacagcucagauaauggagguuaccgccaaguggcuguggggguucuuaucgcgcaauaagaaaccgcguaucugcacccgagaggaguucacucggaaggugcgaagcaacgccgccauaggcgcgguguucgucgacgagaaccaguggaacuccgccaaggaggccguugaagacgagcgguuuugggaccugguucgccgagagagagaacuacacaagcaggggaagugcgcaacuugcguauacaauaugaugggcaagcgagagaagaagcucggcgaguucggcaaggcgaaaggcucccgcgccaucugguacaugugguuaggggcccgguuccuggaauucgaggcacucggcuucaugaacgaagaccacugguucucccgcgagaacagccuguccgggguggagggggaggggcugcauaagcucggguacauccugcgggacauuagcaagauccccggcgguaacauguacgcggacgacacugcgggcugggacacccggauuacugaggacgaucugcaaaacgaggccaagauuaccgacaucauggaacccgagcacgccuugcuggccaccuccaucuucaaacugacguaccagaacaaggugguccgggugcagcgaccggcgaagaacgggacugugauggacgugaucucucgccgggaccaacggggcuccggccagguggggaccuacggcuugaacacguucaccaacaugggggcccagcugauccggcagauggagucggagggcauuuucucucccagcgagcuggagacgcccaacuuggccgggcgcgugcuggacuggcucgagaagcacggcaucgaacggcuccgccggauggcuaucucaggcgacgacugcgucgugaagcccauugaugaccgcuucgccaccgcccugaccgcacugaacgacauggggaaagugcggaaagacaucccgcagugggagcccucuaagggcuggaacgacuggcaacagguucccuucugcagccaccacuuucaccaacucaucaugaaagacgggcgcgagaucguugugcccugccggaaucaggacgagcugguuggucgagcccgggugucgcaaggggccggcuggagccugcgcgagaccgccugccucggcaaguccuacgcccagauguggcagcugauguacuuccaccggcgcgaccucagacuagcggccaacgccaucugcucugccgugccggucgacuggguucccacgucccgcaccaccugguccauucacgcccaccaccaguggaugaccacggaggacaugcugagugucuggaaucgagucuggaucgaggagaaccccuggauggaggacaagacccacgugagcagcugggaggacguuccuuaccuggggaagcgggaggaccaauggugcggcagccucaucgggcugaccgcccgcgccaccugggccacaaacauacaagucgccaucaaccaggugcggcgccuaauaggcaacgagaacuaccucgacuauaugacguccaugaagcgguuuaagaacgagagcgacccggagggggcacugugguga

SEQ ID NO: 23720 - RNA, 9879 nt, Artificial Sequence
  derived and/or modified CDS sequence (opt11) from DENV-1__AB204803__SS-prME
agcgugaccaugcugcuaaugcugcugccgaccgugcugacauuccaccucaccaccagggggggggagccccauaugauugugagcaagcaggagcggggcaagagccuccuuuucaagaccuccgccgguguuaacaugugcacccugaucgccauggaucugggcgaguuaugugaggacaccaugacguacaagugcccccggaucacugaaaccgagccagaugacguggacugcuggugcaacgcgaccgagacauggguaaccuacggaacaugcagccagaccggagagcaccggcgcgacaaacgguccgucgccuuggcgccccacgucgggcuggggcuggagacaaggaccgagacuuggaugagcuccgaaggcgcauggaagcagauccagaagguugaaaccugggcgcuccggcacccgggguucaccgugauagcuuuauuccucgcacacgccaucggcacguccaucacgcagaaggggauuaucuucauccugcugaugcucgucacccccuccauggcaaugcgcugcguaggaaucggcaacagagacuuuguggagggucugagcggggcgacuuggguugauguggugcuggagcaugggucgugcgucaccacuauggcuaaagacaagcccacccucgacauugaacuccuaaagacggaggugacuaaccccgccguccuccgcaagcucugcaucgaggcgaagauauccaacacaacaaccgacucccgcuguccgacgcaaggcgaagcaacgcuggucgaagagcaggacaccaauuucguaugucgccggaccuuuguggaccgcggaugggggaacggcuguggccucuucgggaaggggagccugaucacgugcgucaaguuuaagugcgugaccaagcuggagggcaagaucguacaauacgagaacuugaaguacuccguuaucgugacuguccacaccggcgaucagcaucagguugggaacgagacuacagagcauggcacgaucgcaaccaucacgccccaggcgccaacaagugaaauccaguuaacggacuacggagcucugacccuggacugcagcccccggacaggcuuagauuuuaacgagauggugcugcugaccaugaaggagaaauccuggcugguccacaagcagugguuccuugaucuaccucuccccuggacauccggcgccagcaccagccaggaaacuuggaaccgccaagacuuacucguuaccuucaagacugcacacgcgaagaagcaggaaguggucgugcugggcucccaagagggcgcaaugcauacggcccugaccggcgccaccgagauccagacaagcggaaccaccaccaucuucgccgggcaccucaagugccggcucaaaauggacaagcugacgcucaagggcacguccuacgugaugugcacagggcccuuuaaauuagaaaaggaggucgcggagacccaacaugggacugugcuggugcaggucaaguacgagggaacagacgcaccuuguaagaucccguucagcagccaggaugagaagggggugacccagaacgguagauugauuaccgccaaccccauuguuacagauaaagaaaaacccaucaacaucgaggccgagccgccguucggggagagcuacaucguugugggcgugggagaaaaggccuugaaacucaguugguucaagaagggaagcuccaucggcaagauguucgaggcgacagcccgcggugcucgucggauggccauccugggcgacaccgccugggacuucgguagcaucggcggagucuucaccuccauggggaagcucgugcaucagaucuucggcacggccuaugggguucuuuucagcggcgucuccuggaccaugaagauagggaucggaauccugcucaccuggcugggcuuaaacagucgcuccacuagccuguccaugacuugcaucgccguugggauggugacccucuaccuuggagugauggugcaggcagacagcgggugcgugaucaauuggaaggggcgggaacuuaaguguggguccggcauauucguaaccaacgaggugcacacauggaccgagcaguacaaguuccaggccgauuccccuaagagacugucugcggccaucggcaaggccugggaagagggggucuguggaauccguucugcgacgcggcuggagaacauaauguggaagcaaauuagcaacgagcugaaccauauccugcuggagaacgacaugaaguucaccguuguaguaggagacguaucuggaauccucgcccaaggcaagaagaugauaagaccccagccgauggagcauaaauacaguuggaagucguggggcaaagcgaaaaucaucggcgccgacgugcaaaacaccaccuucaucaucgacgggccuaauacaccugagugcucugaugaccaacgggcauggaacauuugggagguggaggacuacggcuucggaaucuucacuaccaacaucuggcuaaagcugcgcgacuccuauacccagguuugcgaccaccggcucaugagcgcggccauuaaggacucccgcgccguacacgcagauaugggcuacuggauagagagcgaaaaaaacgagacguggaaguuagcccgggccuccuuuauugagguuaagacguguaucuggcccaagagccacacacugugguccaacggcguccucgagagugagaugaucauccccaagaucuaugguggaccgaucucccagcacaacuaccgccccggguacuucacccagacagcgggcccuuggcaccuggguaaguuagaauuggacuucgaccugugcgaggguaccacuguaguagucgacgagcagugcgggaaccgcgggcccagccugcgcaccacgaccguuaccgguaaaaucauccacgaguggugcugccgguccugcacccuuccuccacugcgcuuuaaaggggaggacggcugcugguacgggauggagauccgccccguaaaggagaaggaggaaaaucuggucaaaagcauggugagcgccggaucuggcgaaguugacagcuucucccucgggcugcugugcaucagcaucaugauugaagaagucaugcgaucacgguggagccguaagaugcuaaugacuggcacgcuugccguuuuccugcuccugaccaugggccagcugaccuggaacgaucuaauacgguugugcaucaugguaggcgccaacgccagcgacaagauggggaugggaacgaccuaccuggcccucauggccaccuuucgcaugagaccgauguucgcggucggccugcucuucagagggcucaccagccgggaagugcugcuucucacggucggccuuucguugguggcaucgguugagcuccccaacucccucgaggaacugggugacggcuuagccauggguaucaugauguuaaagcugcugaccgacuuccagagccaucagcugugggcgacccugcuuucgcugaccuucgucaagacgaccuucagccugcacuacgccuggaaaaccauggcaaugacuuuaucgaucgugagccuguucccacuuugccucagcacgaccagccagaaaaccaccuggcugcccguguuacuagggucccucggcugcaagccgcucaccauguuccucauaacggaaaacaagaucuggggucggaaguccuggccgcugaacgaggggaucauggccgucgggaucgugucuauacuacuuuccagucuguuaaagaacgauguuccacucgcuggcccucugaucgccggcgggaugcugaucgccugcuacgucaucuccggcuccucggccgacuugucucucgagaaagccgcggaggucuccugggaggaggaggccgaacacaguggggccucucacaacaucuugguggaaguacaggacgacggaacaaugaagauaaaggacgaggagcgggacgacaccaucacuauccugcugaaagccacguugcucgccauuagcgggguguacccgaugucuaucccugccacccuguuugugugguauuucuggcagaagaagaagcaaaggaguggaguccugugggacacccccagcccacccgagguggaaagggccgugcuggacgacggcaucuaccguauccugcagcgcggccugcugggccguagccaggucggcgugggcguguuucaggaggggguauuccacaccauguggcacgugacccgcggggccgugcucauguaccaaggaaaacgguuagagcccuccugggccuccgucaagaaggaccugaucucuuacggugggggguggcgcuuccagggcagcuggaacaccggcgaggagguccaggugauugccgucgagccugggaagaaccccaagaauguucagacggcucccggcaccuucaagacauccgagggagaggugggcgcgaucgcacuagacuucaagcccgggaccucggguagcccgauuguaaaccgggagggcaagaucgucgggcuguacggcaacgggguggucaccaccagugggacauacgugagcgccauugcccaggcgaaagccagucaggaggggccccugccggaaauagaggacgaaguguuccgcaagcggaaucucacaauaauggaccugcaccccggcagcggcaagaccagacgguaccugcccgccauaguccgcgaggccauaaagcggaaacugagaacccuuguacuggccccgacccgggugguggcguccgagauggcagaggcccucaaaggaaugccaauccgcuaucagaccaccgcagucaagagcgagcacaccggaaaggagauuguggaccugaugugccacgcaacguucaccaugcggcuacugucccccguucgggugccaaauuacaauaugauaaucauggaugaagcccauuucacggaccccgccaguaucgccgcccgcggguauaucucuacccggguugguaugggggaagcggccgcuaucuucaugaccgccacgccucccgguucggucgaagccuucccccaguccaacgcugugauccaggacgaggagaaggacauuccggagcgcucauggaacuccggguacgacuggauuacggauuuccccgggaagacgguaugguucgucccuucaaucaaguccggcaaugacaucgcuaauugucugcggaagaacgggaaacgcgugauccagcugaguaggaagacguucgacacggaguaucagaaaaccaagaacaacgacugggauuaugugguaacgacggacaucucggaaaugggggccaacuucagggcugaccgggugaucgacccccgccggugccucaagccgguaauccugaaggacgggccugaacgcgugauccuggccggucccaugcccgugaccgucgcgucagccgcccagcggcgcggacgaaucggaagaaaccagaacaaggagggagaccaguacaucuacauggggcagccgcucaauaaugaugaggaucaugcucauuggaccgaggcgaagaugcugcuggacaauaucaacaccccugaaggaaucauucccgcccucuuugagccagagcgagaaaagucggcggccaucgacggcgaguacagguugcggggagaagcccguaagacguucguugaguuaaugcgccgcggggaccucccggucuggcugagcuacaaggucgccagcgaaggguuucaauauuccgaucgcagauggugcuuugacggggagcggaacaaucaaguccuggaggaaaacauggacguggagaucuggaccaaagagggggaacgaaagaagcuccggccccgguggcuugacgcccgcacguacagugacccgcuggcgcuacgggaguucaaggaauucgccgcuggccgccgcucgguuagcggcgaccugauccuugaaaucgggaaauugccgcaacaccugacccagaaggcgcaaaccgcgcuggacaaccucgugaugcuucacaacucagagcagggcgggaaggccuaccgucaugcgauggaagagcugccggacacuauugagacccucauguuacucgcgcucaucgcagugcuaacgggcggggucacuuuguucuuccucucgggcaagggccugggcaagacguccaucggccugcucugugucaugagcuccagcgcacugcuguggauggccuccguggagccccacuggaucgccgcaucaaucauacucgaauucuuccuuaugguuuugcuaauacccgagccggacagacagcguaccccgcaggacaaucagcucgccuacguggugauugggcuguuguuuaugauccuaaccgucgccgccaacgagauggggcugcucgaaaccacuaaaaaggaccuggguauuggccacgcagcagccgaaaaccaccaccacgccgcgaugcuggauguggaccuucacccagccuccgcguggaccuuauacgccguagcaaccacuaucaucacccccaugaugcggcacaccaucgagaacaccaccgccaauaucuccuuaacggccaucgcgaaccaggcagcaauccuaaugggccuggacaagggguggccgauuucaaagauggacaucggcgucccacuccucgcucugggguguuacagccaagugaacccccugacgcuuacagccgcgguguuaaugcuggucgcacauuacgccauuauugggcccggguugcaggcaaaagccacccgcgaggcacagaagcguaccgcggccgggaucaugaaaaauccgacgguggacggcauuguugcuaucgaccuggacccugucguguacgacgcgaaauucgaaaagcagcucgggcagaucaugcucuuaauccuuugcaccagccagauccuucucaugcgcacuacgugggcucugugcgaaucaaucacgcucgccaccggaccgcugaccacgcugugggaggggagccccggaaaguucuggaacaccaccaucgccgugagcauggccaacaucuuucguggcagcuaccucgcaggggccggccucgccuucucccugaugaaaagccucgggggggggcgucgaggcacgggcgcccagggggagacgcugggcgagaaguggaagcgacaguugaaccaacugagcaaauccgaauucaauaccuacaagcgcuccgggaucauggaggucgaccguucugaggccaaggagggccuuaagcgcggcgagacaacgaagcacgcggugagucggggcacggccaagcugcgcugguuuguggagcggaacuuagucaaaccggaggggaaaguaaucgaucuggggugcggccgcgggggcugguccuacuacugcgccggguuaaagaaggugaccgaggugaagggauacaccaaaggagggccgggccacgaggagcccauccccauggccacguacggguggaaucuggucaagcuccacucaggcaaggacguguucuucaucccccccgagaagugcgacaccuuacugugcgacauuggggaguccucccccaaccccacgaucgaggaaggccgaacccucagggucuuaaagauggucgaaccguggcugcguggcaaucaguuuugcaucaaaauccucaaccccuacaugcccagcguggucgagacucuggaacagaugcaacgcaagcacggggggaugcuggugcguaacccccucucccggaacagcacucaugaaauguacugggucucgugcgggaccggcaacaucgucucugcggugaacaugacaucccgaauguugcugaaccgcuucacaauggcucacagaaagccgaccuacgagagggacguggaucugggcgcgggaacucggcaugucgccguggagccagaaguggccaaucuggacaucaucggucaacgaaucgagaacauuaaaaacgagcauaagagcacauggcacuacgacgaggacaaccccuacaagaccugggcguaucacggcuccuacgagguccggccgagcggaagcgcuucuucgauggugaauggggucgucagguuacucacgaagccgugggacgugauucccauggucacacaaaucgcaaugaccgacaccacccccuucggucagcaacggguauucaaggagaagguggacacccggacucccaaggcgaagcgcggcaccgcccagauuauggagguaaccgcuaaguggcugugggguuuccucucgcggaauaaaaagccgcgcaucugcacucgggaggaguucacccgcaaagugcguuccaaugcagcaaucggcgccguguucgucgacgagaaccaguggaacuccgcaaaggaggcgguugaggaugagcgcuucugggaccucgugcaccgggagagagagcuucacaaacagggaaagugcgcgaccugcguuuacaacaugaugggaaagcgggagaagaagcucggggaauucggcaaggccaaggggaguagagcuauaugguacauguggcucggggcuagguuccuggaguuugaggcccucggguucaugaacgaggaccacugguucucccgcgagaacucccuauccgggguggaaggagaaggguugcacaagcuggguuacauccugagagacaucagcaagauucccggugggaauauguacgcugaugacacggccggcugggacacuaggaucaccgaggacgacuuacagaacgaggccaagauuacugauaucauggagccggagcacgcgcugcuugccaccuccaucuucaagcucacguaccagaacaagguaguccgagugcaacgacccgccaaauccgggacugugauggacgucaucucgcggcgcgaccaaagggggagcggccaggugggaaccuauggccugaauaccuucacgaacauggaggcccaacuuauccgccagauggaguccgaagggauauucucgcccuccgaguuagagacgccuaaucuggccggacgcguucucgacuggcuggagaagcaugggauugagaggcugaagcggauggcgauuaguggcgaugacugcgucgugaagcccauugacgaccgguucgccacagcucucaccgcccugaacgacaugggcaaaguuaggaaggacaucccgcaaugggaacccagcaaaggauggaacgauuggcagcaagucccuuuuuguucccaccacuuucaccaacugaucaugaaggacggcagagagaucguagugccaugcaggucccaggacgaacucgucggacgggcccguguuucccagggcgcuggguggagccuucgggagacggcuugccugggcaaauccuaugcccagauguggcagcucauguacuuccauaggcgggaccugcgccuugcagcaaaugcgaucuguucagccguuccggucgacugggugcccacgucccggaccacuuggagcauccacgcccaccaccaguggaugaccacugaggauaugcucuccguuuggaauagagucuggaucgaggagaacccauggauggaagacaagacccacgugagcucaugggaggacgugccuuaccuggggaagcgggaggaccaguggugcgggucucugauaggccucaccgcucgcgcaaccugggcgaccaacauccaggucgcgaucaaccagguucgucgcuugaucggaaacgagaauuaccuggacuacaugaccuccaugaagcgguucaagaacgaauccgacccggagggcgcccuuugguga

SEQ ID NO: 23721 - RNA, 9879 nt, Artificial Sequence
  derived and/or modified CDS sequence (opt11) from DENV-1__LC016760__SS-prME
ucuguaacuauguugcucaugcugaugcccacagcucucgccuuccaccucacuacccgcggcggggagccgcacaugaucgugagcaagcaagagcggggcaagagccugcuauucaagacuagcgcgggggugaacaugugcacccuuauagccauggaccugggcgagcugugcgaggacacaaugaccuauaagugcccccguauaacagaggccgagccagacgacguggauugcuggugcaaugccaccgacacauggguuaccuacgggacaugcagccagaccggggagcaccggcgggauaagcgguccguggcccucgcgccccaugucggacucggucuugagaccagaacagagacuuggaugagcucugagggcgccuggaagcagauccagcggguagagaccugggcccucaggcaccccggcuucacggucauagcucucuuccuagcgcaugccauaggcacgucaaucacccaaaaggggauuaucuuuaucuugcuuaugcuggugacccccuccauggccaugagaugcgugggaauaggcagccgcgacuucguggaggggcucuccggcgccacguggguggacgucgugcuggagcaugggagcugcgugaccaccauggccaaggauaagcccacucuggacauagaguugcuuaagacugaggucaccaacccagcagugcugcggaagcucuguauugaggccaagauuucuaacaccaccacagacagccguugcccuacccagggugaggccacucuggucgaggaacaggaugccaacuucgucugucggcgcacguucguggaccgaggcugggggaacgggugugggcuguuugguaaggggucccucaucacgugugcaaaguuuaagugcgugacuaagcuggagggcaagauaguccaguacgagaaccugaaguacagcgugauugugacaguacacaccggcgaccagcaucagguggggaacgaauccacagaacacggcaccacagcgacaaucacgccucaagcccccacgacugagauccagcucaccgacuacggcgcguugacacuggauuguagcccccgaacuggccuugauuucaacgagaugguccuucucacuaugaaggagaaguccuggcucguucacaagcagugguuccuggaccuaccgcuccccuggaccagcggggccuccaccagucaagagacguggaaccggcaagaccuacucguaaccuucaagaccgcucaugccaagaaacaagagguaguggugcucggcucccaagagggcgccaugcauaccgcccugacuggcgccaccgagauccagaccucaggaaccacgaccaucuuugcuggacaccugaagugccggcucaagauggacaagcuaacccuuaaaggcaugagcuacgucaugugcaccgggucguucaagcuugagaaggagguagcggagacgcagcacggcaccgugcugguacaaauuaaguaugaaggcacugacgcccccugcaagauccccuuuaguacccaggacgaaaaaggugugacgcagaacggccgguugauuaccgcgaacccgaucgugaccgauaaggaaaagcccgucaacauugaggccgagccgccauuuggagaguccuacaucgugaucggugcgggggagaaggcgcugaaguugagcugguucaagaaagggucaucuaucggcaagauguucgaggccacugcccgcggagcccggagaauggcgauacugggcgacacggccugggacuucggguccauugguggcguguucaccagcguuggcaaacuggugcaccagauauucgggaccgcguacggugugcucuucuccggcgucagcuggacuaugaagauugggaucggcgugcugcugacguggcuaggacucaacucccgcucgaccucccugagcaugaccuguaucgcagugggacuugucaccuuauaccugggcguuaugguccaggccgacuccgggugcguuauuaacuggaaaggucgggagcucaaaugcgguaguggcaucuuugugacaaacgaggugcacaccuggaccgaacaguauaaauuccaggcggacaguccgaagcgacuguccgcugccaucggcaaggccugggaagagggagucugcggcauccggucggccacccgcuuagagaacaucauguggaagcaaaucuccaacgagcugaaccacaucuuacuggagaacgacaugaaauucaccgucguggucggugauguggcgggcauccucgcgcaggguaagaagaugaucagaccgcagccgauggagcacaaguacagcuggaaguccuggggcaaggccaagaucaucggcgccgacgugcagaauaccaccuucaucaucgacgggccaaacaccccggagugccccgacgaucaacgagcguggaacaucugggaggucgaagauuauggguucgggaucuucaccacgaacaucugguugaagcuaagggacuccuacacccaggugugcgaccaccgccucauguccgccgccauuaaggauaguaaagcuguucacgcggacaugggcuauuggaucgaguccgagaagaacgaaaccuggaagcuggcacgggccagcuuuaucgaagucaagacaugcaucuggcccaagucccacacgcucuggagcaacggcguguuagaaucagagaugaucauacccaagaucuacgggggaccuauaagucagcauaacuaccgacccggguacuucacgcagaccgccgggcccuggcaccugggaaaacuggagcucgacuucgaccuaugcgagggcaccaccguaguaguugacgagcacugcggaaaccgggggccuucauugagaaccaccacggugacgggcaagaucauccacgaguggugcugucggagcugcacccugccgccccuccgcuaucgcggagaggaugggugcugguacgggauggagauccgccccgucaaggagaaagaggagaaccucgugaaauccaugguaagcgcaggcucaggagaggucgacuccuucagucucgggcugcuuuguaucuccaucaugauagaggagguaaugcgcucacguuggucucggaaaaugcucaugaccggcacccuggccgucuucuuucugcuaaucauggggcaauuaacguggaacgaccugauacgccucugcaucaugguaggcgcgaacgccagcgacaggauggggauggguaccaccuaccuggcacugauggcgaccuucaagaugcgaccgauguucgccguaggccuccuguuccgcagacugacgucccgagaggugcuccuccucaccauuggacucagccugguggcguccguggaguugcccaacaguuuagaagagcugggcgaugggcuggccauggggaucaugauccuaaagcuccuuaccgacuuccaaucccaccaguuaugggccaccuuacugagccuaaccuucaucaaaaccacuuucucgcugcauuaugcauggaagaccaucgcgauggucuugaguaucguuuccuuguuuccccuaugccugagcacgacgucccagaagaccaccuggcuccccgugcuguuggggagcuuggggugcaagccgcugacaauguuccuaauagccgagaacaaaaucugggggaggaaguccuggccucucaacgagggcaucauggcuguaggaaucgugucaauccugcugagcucccucuuaaagaacgacgucccccuugcagggccccucaucgccggcggcaugcuuaucgcaugcuacguaaucucaggguccuccgcagaccugucccucgagaaggccgcagaggucagcugggaagaagaggccgagcacuccggagcaagccacaacauccugguggaagugcaggacgaugggaccaugaaaaucaaggacgaagagcgcgacgacacccuuaccaucuuacugaaggcuaccuuacucgccguguccggaguguauccgcugagcaucccagccacgcuguucgucugguacuucuggcagaaaaaaaagcagcgguccggggugcugugggacacccccagcccuccugaggucgagcgcgcuguccuggaugaugguaucuaucggauaaugcagcgaggccuccuggggcggucucaggugggcgucggagucuuccaagaaaacguguuccacaccauguggcacgugacacggggagccguccucauguaccaagggaagcggcuggagcccagcugggccuccguuaagaaggaccugaucagcuacggcggcggguggcgccuccagggcuccuggaauacgggagaggaggugcaggucaucgccguugagcccggcaagaacccgaagaauguccagaccgcacccgguaccuucaaaacucccgaaggcgaagucggagcuaucgcgcuggacuucaagcccgggacgucgggcagucccauuguuaacagagaaggcaagauugugggccuguacggcaacggggucgugacgaccucuggcaccuaugugagugcuaucgcccaggccaaggcgucccaggagggcccgcuccccgagaucgaggaugaggucuuccgcaagcguaaccugacgaucauggaccuccaccccggaagcgggaagacaagacgguaccugccggccauugugcgcgaggccaucaagcguaagcugcgcacacuaauccucgcccccacccgcgucgucgccuccgagauggcggaggcccugaagggcaugcccauacgguaccaaacgacagccgucaagagcgagcacaccggcaaggagaucguggacuuaaugugccacgcuacauucacaaugcgccuccugagccccguacgggugccgaacuauaacaugaucaucauggaugaggcccacuucaccgaucccagcucuaucgcggcccgcgguuacaucucgacccgggugggcaugggagaggccgccgcgaucuucaugacugcgacgccucccggaucagucgaggcuuucccgcagagcaacgcugugauccaggacgaggagcgcgacauccccgagcgguccuggaacagcggguacgaguggauaacagacuucccaggcaagacggugugguucguccccucgaucaaauccgguaacgacaucgccaacugccugcgcaagaaugggaagcgggugauucaguuguccaggaaaaccuucgacacugaguaccagaagaccaaaaacaacgacugggacuacguggucacaaccgacauuucagaaaugggcgcgaacuuccgagccgaccgcgucaucgacccgaggcgcugccugaagccagugauccuaaaggacgggcccgagcgagucauucucgccggaccaaugccgguuacggucgcguccgccgcgcaacgccgggggcgcaucgggcggaaccacaacaaggagggggaccaguacaucuauaugggacagccacugaacaacgacgaggaucaugcgcacuggaccgaggccaagauguuauuggacaacauuaacacccccgagggaaucauuccggcccuguucgagccggagcgggagaaaagugccgcgaucgauggggaauaccguuuacggggugaagcccgcaagacauucguugagcucaugcggcggggggaccugccuguguggcucuccuacaaagucgccagcgagggcuuucaguacagcgaucggcgcugguguuucgacggcgaacggaauaaucaaguacucgaggagaauauggauguagagaucuggacgaaggagggggagcgcaagaaacugcguccccgcuggcuagaugcacgcacguacuccgacccccucgcccugcgcgaguucaaggaguucgcggcaggccggcgcagcgucuccggugaccugaucuuggagaucggaaagcugccacagcaccugacccagcgggcccagaacgcccuagauaaucugguuaugcuccacaacagugagcagggcggccgcgcguauagacacgccauggaggagcuccccgacacgaucgagacacugaugcugcucgcgcugaucgcagugcugacuggcggggucacccucuuuuuccuguccggcaagggguuaggcaagaccagcaucgggcuccugugcgugauggccuccagcguacugcucuggauggcgucuguugaaccccauuggaucgccgccucgaucauccuagaguucuuccugauggucuugcucauccccgagccagaccgccagagaacgccccaagacaaucagcucgccuacguggucaucgggcuuuuguuuaugauccugacgguagccgcgaacgagaugggccuccucgagaccacgaagaaggaccuggggaucggacacguggccgucgagaaucaccaccacgccgccaugcuagacgucgaccugcaccccgcguccgcguggaccuuguacgccguggccacuaccauaaucacaccgaugaugcgccacaccauagagaauacgacagcaaauaucagccucacagccaucgcuaaucaggcggcuauccugaugggacuggacaagggauggcccauauccaaaauggacaucggagucccccuccuggcccucgggugcuacagccaaguuaacccccuaacucuuaccgcggccguccuuaugcuggucgcccacuacgccauaauuggaccggggcuacaggccaaggcgacccgggaggcacagaagcgcaccgccgcgggaauaaugaagaauccgaccguugacgggaucguggccaucgaucuggacccagucguuuacgaugccaaauuugaaaaacagcuugggcagaucaugcugcugaucuuaugcacaucccagaucuugcugaugcguaccacgugggcccucugugagagcaucacucuggccacgggcccccuaaccacuuugugggagggguccccaggcaaguucuggaacacaacgauagccgugagcauggccaacauuuuucggggguccuacuuagcaggggcgggcuuggcauuuucccucaugaagucucuagggggcgggaggcggggcacuggggcccagggcgagacucuuggggaaaaguggaagcgacagcugaaccaguuauccaaaagcgaguucaacaccuacaagcguuccgggaucauggaggucgauagaagcgaagcgaaggagggccugaagcgcggggagacgaccaagcacgccgucucccgcggcacggcgaaacuccggugguucgucgagcguaaucuugugaagcccgaagggaaggugaucgaccugggcuguggccgggguggcuggagcuacuacugugcggggcuuaagaaaguaacugaagucaaaggcuacaccaagggcggcccaggccacgaggagccggugccgauggccacguacggguggaaccucgugaaguuacacuccggcaaggacguauucuucaucccgccggagaaaugugacacccugcucugcgacaucggggagagcucccccaacccgaccauagaggagggccgcacgcuucgggugcugaagaugguggagcccuggcugcgcggaaaccaguucuguauaaagauucugaaucccuacaugccaucugucguggagacccuggagcagaugcagcggaaacacggcggcaugcucgugcggaauccgcuaucccggaauucuacucaugagauguacuggguaaguugcgggaccggcaauauaguuagcgcgaucaacaugacuucccguaugcugcucaaccgguucacgauggcccacagaaagccuaccuacgaacgcgacgucgaucugggggccggcacccggcacgucgccguugagccugagguagccaaccuggacaucaucggacagcgcaucgaaaauaucaagugcgagcacaagagcacuuggcacuacgacgaggacaaccccuacaaaacgugggcguaccacgguuccuacgagguuaagccgagcggcuccgccagcagcaugguuaacgggguagugaaacuccugaccaagccaugggacgugauucccauggucacccagaucgccaugaccgauacgacccccuucggucagcagcgugucuucaaggagaagguggauacccgcaccccgaaggccaaacgggggacggcccagaucauggaggucacugcgcgcuggcuguggggcuuccucucccgcaacaagaaaccgcgcaucugcacccgggaggaguucacccgcaaggugcgcuccaacgccgccaucggggccguauucguggacgagaaucaguggaacucagcgaaagaggcagucgaggaugagcgcuucugggaccugguccaccgggagagggagcugcauaagcaggggaagugcgccacgugcguguauaacaugaugggcaagagggagaagaagcucggugaguucgguaaggccaaggggagccgggcuauaugguacauguggcugggcgcgcgguuccuggaauucgaagcuuugggcuucaugaacgaggaccacugguuuucccgagagaacagccuguccggcguggagggugagggguuacacaagcucggcuacauucugcgagacauaucgaagaucuccgggggcaacauguacgcggacgacaccgccggaugggacacccgcaucaccgaggaugaccugcagaacgaggcgaaaauuaccgagaucauggagccagagcacgcacagcucgccaaggcgaucuucaaguugacguaccaaaacaaggugguacggguccaacgcccggccaagaacgguacugugauggaugucaucagccgccgggaccaaagaggcucuggccaggugggaaccuacggucugaacacguucaccaacauggaggcccagcugauccggcagauggagucggagggcaucuuuagucccagcgagcuggagacccccaaccuggcugagcgcgugcucgauuggcuggagaaguacgguguagagcggcuaaaacguauggcaaucuccggggacgauugcguggugaagcccaucgacgacagauuugcuacggcacuaacggcgcugaacgacaugggcaagguacgcaaagacaucccgcaaugggagcccagcaagggguggaacgauuggcagcaggucccguucugcucccaucacuuccaccagcugaucaugaaggacggccgugagauagugguccccuguagaaaccaagacgagcucgugggccgggcccgcguuagccaaggggccggcuggagccugcgggaaaccgcaugccuaggcaaaagcuaugcccagauguggcaacucauguacuuucaccggcgagaccugcggcuggcggccaacgcuaucugcuccgcugucccggucgacugggugccgaccucccggaccacuuggagcauccaugcucaccaccaguggaugaccaccgaagacaugcucuccgucuggaaccgcguauggaucgaggaaaaucccuggaugaaagacaaaacacacauuagcucaugggaagacgugccauaccuaggcaagcgggaagaccagugguguggcagucuaaucgggcucacggcucgcgccacgugggccaccaacauccaggucgccaucaaccaagugcggcgucugaucggcaacgagaauuaucuggacuacaugaccuccaugaaacgcuucaagaaugagagugacccggagggggcccucugguga

SEQ ID NO: 23722 - RNA, 9879 nt, Artificial Sequence
  derived and/or modified CDS sequence (opt11) from DENV-1__LC128301__SS-prME
agcguuaccaugcugcucaugcugcugcccaccgcccucgcguuccaccugacgaccagaggcggggaaccgcacaugaucgugagcaagcaggagcggggcaagagcuugcuguuuaagaccucggccggggugaauaugugcacccugauugccauggaccugggggaacuaugugaggacaccaugacauacaaaugcccccgcauaacugaaaccgaacccgaugacguagacugcuggugcaacgccaccgagaccugggucacuuacgggaccugcagccaaaccggcgagcaccgcagagacaagcggucugucgcccuggcgccccaugugggccugggccuugagacacgcaccgagaccuggaugagcuccgagggcgcguggagacagauacaaaagguugagacgugggccuugaggcacccagguuucaccgugaucgcccuguucuuagcccacgcgaucggcacgagcaucacccagaaggggauaaucuucauccugcugauguugguuacgccauccauggcaaugagaugcgucggaaucgguaaccgcgacuuuguggaggggcugucaggagccaccugggucgacgucguccucgagcacgggaguugcguaacaaccauggccaaggacaagccuacguuagacaucgaacugcuaaagaccgaagucacaaauccugccguccucagaaagcuguguaucgaggccaagaucagcaauaccaccacugacucccgcugcccuacccagggcgaggccacccuaguggaagagcaggacacgaauuuugucugucgacgcacuuucguggacagagguugggggaacggauguggacuguucggcaaggguucccugauaacgugcgcuaaauucaaaugugugaccaagcuggagggcaagauaguccaguacgagaaccuaaaguauuccgugaucgugaccguccauacuggcgaucagcaccaagugggaaaugaaaccaccgagcacggcaccacggccacuaucaccccccaggcacccacuucugaaauacagcugacggacuacggagcccugacccucgacugcagcccccgcaccggacuggauuucaacgagauggugcuguuaaccaugaaggaaaagucuuggcuugugcacaagcagugguuucuggaccuaccgcugcccuggacguccggggccagcaccucacaggagacuuggaacagacaggaucugcugguuaccuucaaaacggcgcacgcuaagaagcaagaagucgugguacuaggcagccaggagggagccaugcacaccgcucugacuggagcuaccgagauccagacgagcggcaccaccaccaucuucgcuggccaucucaagugucgccuaaagauggacaaguugacucucaagggcgucucauacguuaugugcaccgguagcuucaagcuagagaaggagguggccgagacgcagcacggcaccgucuugguccaggugaaguacgagggcacggacgccccuugcaagaucccguuuuccagccaggacgagaagggggugacucagaacggccgacugaucaccgcgaacccgauugugacagauaaagagaagcccgugaacaucgaggcugagccgcccuucggcgagagcuacuuggucgugggugccggcgagaaggcccugaaacugaguugguuuaagaagggcuccucuauaggcaagauguucgaggcgacugcaagaggggcucgucgcauggccauccucggggauaccgcuugggacuucggcucuaucggcggcguauucaccagcgucgggaaacugauccaccagaucuucggcacggcguacggugugcuguucuccggcgugagcuggaccaugaagaucgguaucggcauacucuugaccuggcugggguugaacucccgcagcacgucccugucaaugaccuguaucgccgucgggaugguaacacuguaccucggcgucaugguccaggccgacuccgggugcgugauaaacuggaagggucgggaacuuaagugcgggagcggcaucuucgugaccaacgaaguucacacuuggacggagcaguacaaguuucaggcggacagcccgaagcggcuuuccgccgcgaucgguaaagccugggaggaaggaguaugcggcaucaggucggccacacgccucgagaacaucauguggaagcagaucuccaaugagcucaaucacaucuugcuugagaacgacaugaaguuuacgguggucgugggggauguaaacggcauccuggcucaagggaagaagaugauccggccccagcccauggagcauaaauacagcuggaaguccuggggcaaggccaagguuauaggcgccgacgugcagaacaccacauucauaauugacggcccaaacacaccggagugccccgacgaccagagggcauggaauauaugggagguagaggacuacggcuucggcauauucacgaccaauauuugguugaagcuccgggacagcuacacccagguuugcgaccaucgcuugauguccgcugccaucaaggauuccaaagcugugcacgccgacaugggcuauuggauugagucggagaagaaugagacauggaagcuaacgcgggcuagcuucaucgaggugaaaaccugcaucuggcccaagucccauacccucugguccaacgggguucuggaauccgaaaugauaauccccaaaaccuacgggggcccgauuagccagcacaacuaccguccgggcuauuucacacagaccgccggccccuggcaccugggaaaacucgagcuggacuucggccucugcgaagggaccaccgugguggucgaugagcacugcgggaaucggggaccgucccuccguaccaccacagugaccggcaagauaauucacgaguggugcugccggagcuguacccugccuccccuccguuuuaagggcgaagauggcugcugguacggaauggagauccggcccgugaaggagaaagaggagaaccucguaaggucuauggucagcgccggcagcggggagguagacuccuucagccugggccuucucugcaucuccaucaugaucgaggaggucaugcggagccgguggucccgcaagauguugaugaccgggacccuggcgguauuccuccugcugaucaugggccagcucaccuggaacgaucugauccgacugugcaucauggucggggcaaacgcgagugacaagauggggaugggaaccaccuaucuggccuuaauggcaacuuuccgcaugcguccgauguucgccgucggucuccucuuucgccggcucaccucacgcgagguguugcucuugacugucgggcugagccucguggccuccguugaacugcccaauagccucgaagagcucggggacggacuagccaugggaauuaugaugcugaagcugcugaccgacuuccagucccaccagcugugggcugcccuccugagccugacguuugucaagaccacguuuucccuccacuacgccuggaagaccauggccaugauucugagcaucauuucccuauucccucuaugcaugagcaccacgucccagaaaacuaccuggcugcccguacugcucgggagucuggguugcaagccgcugaccauguuccucaucacugagaacaagauaugggggcggaaguccuggccucuuaacgagggcaucauggccgugggcaucgucagcauccugcucagcucccugcugaaaaacgacguuccacucgcuggcccucuuaucgcgggcgggauguuaauagccugcuacgugauaagcgguuccagcgcggacuugucccuggaaaaggccgccgaggucagcugggaagaggaagcugagcauuccggugccagucacaacauccugguugaagugcaagacgacggcacuaugaagaucaaagacgaggagcgcgacgacacccucacaauccuguugaaggccacccuccuagcgauauccggcgucuauccuaugucgaucccugcuacacuauucgugugguacuucuggcagaagaagaaacaacgcuccggcguucucugggauacgccguccccucccgaggucgagcgcgcaguauuggacgacggcaucuacaggaucuugcaacgcggacugcucgggaaaucccaaguaggcgucgggguguuccaggaaggcguguuccacaccauguggcacguuacccguggcgccgugcucauguaccagggcaagcggcuggaacccagcugggccagcgugaagaaggaccucaucuccuacggcggcggguggcgauuccagggguccuggaauaccggagaagagguacaagugaucgccgucgagcccggcaagaaccccaagaauguccagacggccccugggacguucaagacgcccgagggagagguuggcgcgauagcccuggacuuuaaacccgggaccagcggcucccccaucgugaaccgagagggcaagaucgucgggcuguacggcaacggaguugugacgacaagcgggaccuacguuagcgccaucgcccaggcaaaggcgucgcaggagggcccgcucccagagaucgaggaugaaguguuucggaagcgcaaccucaccaucauggaccugcacccgggcagcgguaagacaagacgcuaucuaccggcaaucgugcgcgaggcaaucaagaggaagcugcggacccugguccucgccccaacccgugugguugcgucagagauggccgaggccuugaagggcaugcccauacguuaccaaacgacggccgugaagagcgagcacacagguaaggagauagucgaucugaugugccacgcuacguucaccaugcggcuacugucccccgugcgugucccgaacuacaauaugaucaucauggacgaagcgcacuucacagaccccgccagcaucgccgccagagguuacauuuccacacgcguagggaugggugaggcggcggccaucuucaugaccgcgacuccccccggcucgauggaggccuuuccgcaauccaacgcagcgauccaagacgaggagcgggacaucccagagcgcucuuggaacucaggauacgacuggaucacggauuuccccggaaagaccguaugguucguccccagcaucaaauccggcaaugacaucgcgaacugccugcgcaagaauggaaaacgcguggugcagcucucccggaagaccuuugauacugaauaccagaagacgaagaauaacgacugggacuaugugguaacgacugacaucuccgagaugggcgcuaacuuucgcgcagauagaguuaucgauccgaggagguguuugaaaccagucaucuuaaaggacggacccgaacgcgugauccucgcuggccccaugccuguaaccguggcgagcgccgcccaacggcgggggcguauugguagaaaccagaacaaagagggagaucaguacaucuauauggggcagccccucaacaaugacgaggaccacgcccacuggacggaggcgaaaaugcuucucgauaacaucaacacccccgagggcauuauccccgcucuguuugagccggaacgugagaaguccgccgccaucgauggugaguaccgcuuaagaggagaagcccggaagaccuucguggagcuaaugcgucgaggggaccugcccguauggcugagcuacaagguggcuuccgagggguuccaguacucugaccguaggugguguuucgacggcgaaaggaacaaccaggugcucgaagagaacauggauguagagaucuggacuaaggagggcgagcggaagaagcugcgaccccgguggcuggacgcccgcacuuauucugauccccuggcccugcgggaguucaaggaguucgccgcugggcggcgguccguuagcggagaccugauccuagagauaggcaaacugccgcagcaccuuacccagcgcgcucaaaaugcccucgacaaccuagugaugcuucacaacucagaacaaggcgggaaggccuaccggcacgccauggaggagcuuccggacaccauagaaacuuuaaugcugcucgcgcucaucgccgugcugaccggaggcgugacccuuuucuuucugagugggcgcggacuggguaagaccaguaucgggcuccuguguguaauggcaagcuccgcccugcuuuggauggcuagugucgaaccccacuggaucgcggcguccauuauccuggaguucuuccuaaugguguuacugaucccugagccagaccgacagcgaacuccccaagauaaucagcuggcguacguggucauagggcucuuguuuaugauccugacagucgccgcuaacgagaugggacuacuggagacgaccaagaaggacuuggggaucggccacguggcggccgagagccaucaccaugccgcaaugcucgacgucgaccugcaccccgcgagugcguggacgcucuacgcaguggccaccacgaucauaaccccgaugaugcggcacaccaucgagaauaccacggcgaacaucagcuuaaccgcaaucgcgaaucaggccgccauacucaugggucuugauaagggguggcccaucagcaaaauggacauaggagugccccuacuagcccuaggguguuacucacagguaaacccgcuaacccugacggcggcugugcugaugcucguggcccacuaugcaauuaucggcccgggguugcaagccaaggcgacgcgagaggcacagaagcggaccgccgcuggcaucaugaagaauccuaccguggacgggauuguagcuaucgaucuggaccccgugguguaugaugcuaaguuugaaaaacagcucgggcagaucaugcugcucauccucugcaccucgcagauccuccugaugcggacgacuugggcccuaugcgagagcauaacacuggcgacuggccccuugacuacucucugggagggcuccccgggcaaguucuggaacacgaccauugccgugagcauggccaacaucuuccgcggguccuaccuugcaggggccggccuagccuucagcuuaaugaagagccucggaggcgggcgccgagggacaggcgcccagggggagacccucggcgaaaaguggaaacggcaacucaaucagcuguccaagagcgaauuuaacaccuacaaacguagugggaucauggagguagaccggagcgaggcuaaggagggccugaagaggggugagaccacgaagcaugccgucucccggggcaccgcuaaacuacgcugguuugucgagcgcaaccucgugaaacccgagggcaaagucaucgacuuagggugcgggagagggggcuggagcuauuacugcgcugggcuaaagaaggugacggagguuaaaggcuacacaaagggugggccgggccacgaggaaccaauccccauggcuacauacggguggaaucucgucaagcuguacuccggaaaagacgucuuuuucaccccccccgagaagugcgacacacuucucugcgacauuggggagagcagucccaacccgacgauugaggagggccggaccuugcgcgugcugaagauggucgagcccuggcugcggggaaaccaguucugcaucaagguacuaaacccguacaugcccucaguggucgagacgcuggagcagaugcagcguaagcacgggggcaugcuugugcggaauccgcuaucccgcaauagcacccacgagauguauuggguguccugcggaaccggcaacaucguuagugcuguaaacaugaccagucggauguuacucaacagguuuacgaugacacacagaaagcccaccuaugagaaggacguggaccugggcgcggguacccgccacgucgcuguagagccugagguggccaaccuggacaucauuggccaaagaauugagaacaucaagaaugagcauaagagcacauggcacuacgaugaagacaacccguacaaaacuugggcauaccauggguccuacgaggucaagccgagcgguuccgcgucuagcauggugaacggagucgugcggcucuugaccaagcccugggacgucauccccauggucacccaaauugccaugacggacaccaccccauucggccagcagcggguauuuaaagagaaagucgacacccggacgccgaaggcaaagcgagggacggcccaaaucauggaggucaccgcccggugguuguggggguuccuaucccgaaacaagaagccccggauuugcacacgcgaggaguucacgcgcaaagugcgcucgaacgcggccaucggugccguauucgucgaugagaaccaauggaacuccgcuaaagaggcuguggaggacgagagauucugggaccuggugcaccgcgagcgugagcugcacaagcaggggaaaugcgcgacaugugucuacaacaugaugggaaagagagagaagaaacucggggaguucggcaaggccaaaggaagccgggcaauuugguacaugugguugggggcccgcuuucuggaguucgaggcgcucggguucaugaaugaagaccacugguucucccgggagaacucgcugagcgggguagagggcgaggggcugcacaagcuaggcuauauacuccgcgacauuucgaagauccccggcgggaacauguacgccgaugacacugccggcugggacacccgcauuacggaagaugaccuccaaaaugaagcaaagaucacagacauuauggaaccugaacaugccuuauuagcgacguccaucuucaaguuaacuuaccagaacaagguuguccggguacaaagaccagcgaaaaacggaacugugauggacgucaucagucgccgcgaucaacggggcaguggucagguugggaccuacggcuuaaauacguucaccaacauggaggcccagcuuaucagacagauggagagugaggggaucuuccuaccauccgaguuggagacgcccaaccuggcggaaaggguuuuagauuggcuagagaagcacgggaccgagcggcugaagcguauggccaucaguggggaugacuguguagucaagccuauugacgaccgcuucgcaaccgcacuaacugcuuuaaacgacauggguaaggugcggaaggacaucccgcagugggaaccguccaagggcuggaacgacuggcagcaagucccauucugcagccaccacuuucaccagcugaucaugaaggacggccgcgaaauuguggugccgugucggaaucaggacgagcuggugggacgcgcgagggucucccaaggggccggguggagccuccgcgaaacagcgugucuggguaaauccuacgcgcagauguggcaguugauguacuuccaccggcgcgaccuccggcuagcggcaaacgcaaucugcagcgcagugcccguagacuggguacccacaagucgcaccaccugguccauacacgcacaucaccaauggaugacgacagaggacaugcugagcguguggaauagggucuggaucgaggagaacccauggauggaggauaaaacccacgugucuagcugggaggacguuccguaucucggcaagagggaagaccaguggugcgggaguuuaaucgggcugaccgcccgggcgacaugggcgacuaacauccaggucgccaucaaccaaguacgucgucucaucggcaacgaaaacuaccuggacuacaugacuaguaugaagcgcuucaagaaugagucagaccccgagggggcccugugguga

SEQ ID NO: 23723 - RNA, 9879 nt, Artificial Sequence
  derived and/or modified CDS sequence (opt11) from DENV-1__LC011945__SS-prME
agugugaccaugcuucucaugcugaugcccaccgcccuggccuuccaccucaccacccgggguggggagccccacaugaucguguccaagcaggagcggggcaagucgcugcuguucaagacaucugccggaguaaacaugugcacccucauugccauggaccugggcgagcuaugugaggacacgaugaccuauaaguguccccggaucaccgaggccgagccugacgacguggacugcuggugcaaugccaccgacacgugggugaccuacgggaccugcagccagaccggggagcauaggcgcgacaaacgguccguggcccuggcgccgcacgugggccuggggcuggagacgagaaccgagaccuggaugagcuccgagggagccuggaagcagauccagcgugucgagacaugggcccuccgccaccccggguucacggucauugcuuuguuccuggcgcacgccaucggcacuagcaucacccagaaagggaucaucuucauacuccugaugcuggugacacccuccauggccaugcggugcguuggcaucggcagccgcgacuucguagagggguuauccggcgccacguggguggacguagugcuggagcaugggagcugcgugaccaccauggccaaggacaagcccacccuggacaucgaacuccuaaagacggaagucaccaaccccgccguguuacggaagcucugcauugaggccaaaauauccaacaccaccacugacagccguugcccgacccagggagaggccaccuugguggaggagcaggacgcaaacuucguuuguaggcgcaccuuuguggaucggggcugggggaauggcugcgggcuguuuggcaagggaucccucaucacgugcgccaaguucaagugcgugaccaagcuggagggcaagaucguccaguacgaaaaccugaaguacagcgugaucgucaccguccacacgggcgaccagcaccaaguugggaacgaguccacggaacauggcaccaccgcgacgaucacgccccaggcccccacgacagagauccagcucaccgacuauggggcucuaacucuggacugcucuccccgcacgggccucgacuucaaugagaugguccuucugaccaugaaagagaaguccuggcucguucacaaacagugguuccuggaccuuccguugccuuggaccagcggggccagcaccucccaggagacguggaaccggcaggacuugcuggugaccuucaagaccgcucacgcgaaaaagcaggagguagucgugcucggcagccaggagggcgccaugcacaccgcccugacgggugccaccgagauccagacuuccggaacuacgaccauauuugccgggcaccuaaagugccgucucaagauggacaagcugacccugaagggcaugagcuacgucaugugcaccggauccuucaaacucgaaaaagagguagcggagacgcaacauggaaccgugcugguucaaaucaaguacgagggcaccgacgcccccuguaagauccccuucaguacccaggaugagaagggugucacgcaaaacggcaggcugaucaccgccaacccgaucgugaccgauaaagagaagcccgucaacaucgaggcugagccgcccuuuggggaguccuauauaguaaucggagcuggcgagaaggcccugaaacuuagcugguuuaaaaagggguccagcaucggcaaaauguucgaggccaccgcucgcggggcccggcgcauggcgauccugggcgacacugccugggacuucggaaguaucggcggaguuuucacaagcgucgggaagcuggugcaccagauuuucggcaccgcauacggggugcuguucuccggcgucaguuggaccaugaagaucgggaucggcgugcuucugacguggcucggcuuaaacagucgcagcaccucccugagcaugacgugcaucgccguggggcucguaacccuguaccuuggcgucaugguccaggccgacucagggugcguaaucaacuggaagggccgggagcucaaaugcgggucuggcauauucgugacgaacgaggugcacaccuggaccgagcaauauaaguuucaggcggacagcccgaaacgccugucugccgcaaucggcaaggccugggaggagggugucugcggcauccggagcgccacccgccuggagaacaucauguggaagcaaaucuccaacgagcucaaccacauccugcuggagaacgacaugaaguucacagugguggucggagacguggcuggcaucuuggcccaagggaagaaaaugauccggccccagccgauggagcacaaguacagcuggaaauccuggggcaaggccaagaucaucggugccgacgugcagaauacgaccuucaucaucgacgggcccaacacgccagagugccccgaugaccagcgcgcguggaacaucugggaggucgaggacuacggcuuugggaucuucaccacgaacaucuggcugaagcugcgggauaguuacacccaggugugcgaccauagacucauguccgccgccaucaaggacagcaaggccgugcacgccgacaugggcuacuggaucgaguccgagaagaacgagacuuggaagcuggcccgugccucauucaucgaggucaagacuugcaucuggccaaagucccacacgcuguggagcaacggcgugcucgaguccgagaugaucauucccaagaucuacggaggcccgaucagccagcacaauuaccggccgggguacuucacccaaaccgccggucccuggcaccuggggaagcuggagcucgacuucgaccugugcgaaggcacgacggugguuguggacgagcacugcggaaaccgugggccaagucugcgcaccaccaccgugacggggaagaucauccaugagugguguugcagaagcugcacccugccgccccuacgcuaccgcggggaggacggcugcugguacgggauggaaauccgccccgucaaggaaaaggaggagaaccuagucaaauccauggugagcgccggcagcggugaggucgacuccuucagccucgggcugcugugcaucuccauuaugaucgaggaagugaugcgcucacgcuggucacguaaaaugcuuaugaccggcacccuggccguguucuuucugcucaucauggggcaacucacguggaacgaucucauccgccuaugcaucaugguaggcgcgaacgcuagcgacaggauggggaugggcaccaccuaccuggcccugauggccaccuuuaagaugcggccgauguucgcggugggccuccuguuucgccggcugacuucccgcgaggugcuccugcugaccauagggcucagccucguggccucaguggagcugccaaacagcuuagaggagcugggcgaugggcuggccaugggcaucaugauccucaagcugcucaccgacuuccagucccaccaacucugggccacccugcugagccucacuuucaucaagaccacguucucacugcacuacgccuggaagacaaucgcgaugguccugagcaucgucucccucuuccccuugugccuaagcaccaccucccagaagacgacguggcucccuguucuacugggcagccucgggugcaagccguugaccauguuccugaucgccgagaacaagaucuggggacggaaguccuggccccuaaacgaggggaucauggccguuggcaucgugagcauccugcuaagcucccuccugaagaacgacguuccccuagccgguccacuuaucgccggcgggaugcugaucgcguguuacgucauaagcggauccucugcggaccuaagucuggagaaggccgccgaggugucgugggaggaggaggcagagcauucuggggccagccauaacauccuaguggaaguccaggacgacgguaccaugaagaucaaagacgaggagcgugacgauacccugacuauccugcugaaggccacccugcucgccgucuccggcguguacccgcugagcaucccagccacgcucuucguaugguacuucuggcagaagaagaagcagcgguccggugugcucugggauacccccuccccgcccgagguggagcgcgccguccuggacgacggcauauaccggaucaugcagcgcgggcugcuggggcggucccaggugggcgugggggucuuccaggaaaacguauuccacaccauguggcacgugacccgcggagcggugcucauguaccaggguaagcggcuggaacccagcugggccuccgucaagaaggaccugaucucuuacgguggcggguggcgccuccagggcuccuggaacacgggcgaggaggugcaggucaucgcaguggagcccggaaaaaaucccaagaaugugcagaccgcgcccgggacauuuaagacccccgagggcgaggucggcgccauagcgcuggauuucaagcccggcacaagcggcucccccauagugaaccgggaggggaagauugugggcuuauacggcaacggggucgugacuaccagcggcaccuacguuagcgccauagcucaggccaaggcgucccaggaggggccccuccccgagaucgaggacgagguauuccgcaagcggaaccugacgauaauggacuugcaucccggcagcgggaagacgcgccguuaccucccggccaucguacgcgaggcgaucaaacgaaagcugcguaccuugauacuggcacccacccgcguagucgccuccgagauggcggaggcccugaagggcaugcccauccgguaccagacgacggccgucaagucugagcacacugggaaagagaucguggaccugaugugucacgccaccuucacgaugcgccuccugucccccguccggguuccgaacuauaacaugaucaucauggacgaggcgcauuucaccgaccccagcuccaucgcggcccgcggguacauaagcaccagggugggcaugggcgaggcagccgcuaucuucaugaccgcgacgccgcccggcuccgucgaggcguuuccgcaaagcaacgcagugauccaggacgaagagcgcgauaucccggagcggucuuggaauagcggguacgaguggauaaccgacuuucccggcaagaccgugugguucguccccuccaucaagucaggcaacgauauugccaacugccuccgaaagaacggaaagcgggugauccaguugucacgcaagaccuucgauacggaguaccagaagaccaagaacaacgauugggacuacguggucaccaccgacaucagugagaugggcgcgaauuuuagggccgacagagugaucgacccgcggcguugccugaagcccgugauccugaaggacgguuccgagcguguuauccucgccggccccaugcccgugacgguugccuccgccgcgcagcgccgagggcgcaucggacggaaucacaacaaggaaggcgaccaauacauuuacauggggcagccguugaacaacgaugaggaccacgcccauuggaccgaggccaagaugcugcucgacaacaucaauacccccgagggcaucauccccgccuuguucgagcccgaacgcgagaaguccgccgcgauugacggggaguaccgccugcguggcgaggccagaaagaccuuuguggagcucaugcgacgcggggaucugccgguguggcugagcuacaaaguugcgagcgagggcuuccaguacuccgaccggcgcuggugcuucgacggcgagcggaacaaccaggugcucgaggagaacauggacguagagauuuggacgaaggagggggagcgaaagaagcugcggcccagguggcuggacgcccggacauacagcgacccccucgcccugcgcgaguucaaggaguucgcugccggccggcgcucggucagcggggaccugauucuagagaucggcaaacugccccagcacuugacccagcgugcccagaacgcgcuugacaaccuggugaugcugcacaacagcgagcaaggcgggagggcuuaccggcaugccauggaagagcucccggacaccaucgagacgcugaugcugcucgcgcugaucgccgugcuaacuggcggugucacacucuucuuccugagcggcaaggggcugggcaagaccuccaucggucuccugugcgugauggccagcuccgugcuguuguggauggcguccgucgaaccccauuggauagccgcuuccaucauccuagaguucuuccugauggugcugcugauccccgagccugaccgccagcgcacgccgcaagacaaccagcuggccuauguggucaucgggcuccuuuucaugauccugacgguggccgcgaacgagaugggccuccuggagaccacuaaaaaagaccuagggauaggccacguggccgucgagaaccaucaccacgccgccaugcucgacguggaccugcaccccgcguccgcauggacccuguacgccguggccacuaccaucaucacccccaugaugcggcacaccaucgagaacacgaccgccaauauuuccuugacggccauugcgaaccaagcggccauacugaugggguuggacaaaggcuggccaauaagcaagauggacaucggcgucccccuccuggccuuaggcugcuacucucaagugaacccccucacauuaacggcggccgugcugaugcuagucgcacacuacgccauuauaggccccggguuacaggccaaggcgaccagagaggcccagaagcguaccgccgccggcauaaugaagaacccgaccguugaugggaucgucgccaucgaccuggaccccgucguguacgacgcuaaguuugaaaagcagcucgggcagaucaugcuguugauccuuugcacgucacagaucuugcugaugcgcaccaccugggcccucugugagucgaucacccuggccacgggcccgcugaccacccucugggaggggagccccggcaaguucuggaacaccacgaucgccguguccauggccaacaucuuccgggggagcuaccucgcgggcgccggacuggccuucucacucaugaaaucccucgguggcgggagaagagggacaggggcccaaggagaaacccugggugagaaguggaagcgccagcucaaccagcugagcaaauccgaguucaacaccuacaaaaggagcgggauuauggaggucgaccgcucugaggcgaaggaaggccugaagaggggggagacgaccaagcacgcugucagucgcgggacagccaagcuccggugguucguggagcgcaaccuugucaagccggaggggaaggugaucgaucuaggcugcggccguggcggaugguccuacuauugcgcaggacugaagaaggugaccgaggucaagggguauacuaagggcggccccggccacgaagagcccguccccauggccaccuacggguggaaucuggugaaauuacacagcggcaaagacguguucuuuaucccccccgagaagugcgacacccugcucugcgauaucggggaguccagcccaaaccccaccauugaggaaggccgcacgcugcgcguguuaaaaauggucgagccuugguuaagggggaaucaguucugcauaaagauccugaaccccuacaugcccagugugguggagacccuggagcagaugcaacguaaacacggugggauguugguccgcaacccucugagccggaacuccacccacgagauguacugggucagcugcgggaccggcaacaucguguccgcgaucaacaugaccagccgcaugcugcucaaccgguucacaauggcccaccgcaagccgaccuacgagcgcgacguggaccugggggccggcacccggcacgucgcgguggagcccgagguggccaauuuagauauaaucggacaacgcaucgaaaacaucaagugcgaacacaagagcaccuggcacuacgacgaggacaaccccuacaagacgugggccuaucacgggagcuacgaggucaagccgucggggagcgccagcuccauggugaacggggucgugaagcuccugaccaagcccugggacguuauccccauggucacccagaucgccaugaccgauacgacccccuucggccagcagcggguguucaaagagaagguggacacccgcaccccgaaggccaagcgggguacggcccagauuauggaggucaccgcgcgcuggcuguggggcuuccucagccggaacaagaaaccgcgcauuugcacccgggaggaguucacccgcaaggugcgauccaaugccgcaaucggcgccguuuucgucgacgaaaaccaauggaacagcgcgaaggaggccguagaagacgagcgcuuuugggaccuagugcaccgggagcgugaguugcacaagcaggggaagugugccacgugcguauacaacaugaugggaaagcgugagaagaaguuaggggaguucggcaaggcuaaggggagucgggccaucugguacauguggcugggggcgcgguuccuggaguucgaggcccugggcuucaugaacgaggaccacugguucucccgcgagaacucccugagcgggguggagggcgagggccugcacaagcucggguauauccuccgggacaucagcaaaauaagcggggguaacauguacgccgacgacaccgcaggcugggauacccgcaucaccgaagacgaccuccagaacgaagcgaagaucacagagaucauggagcccgagcaugcgcagcuagccaaggcgauuuuuaagcugacauaucaaaacaaagugguccggguacagagacccgcaaaaaacgggaccguuauggacgucaucucccgccgggaccagcgcggcagcggccagguagggaccuacggucuaaauacguucaccaacauggaagcccagcucauuagacagauggagucggaggggaucuucagcccauccgagcuugagacccccaaccuggcggagcgcguccucgacuggcuggagaaguauggcguggaaaggcugaagcguauggccaucaguggggacgacugcgucgugaagcccaucgacgaccgguucgccaccgcccucaccgcacugaacgacaugggcaagguccggaaggacaucccccaaugggagccauccaaggguuggaacgacuggcagcagguccccuucugcucucaucacuuccaccagcugaucaugaaggauggccgggaaaucguuguccccugccgcaaccaggacgagcuagugggccgggcgcgcgugucccagggagcaggcuggucccuccgggagaccgccugccuggguaagucguacgcccagauguggcagcucauguauuuucaccggagggaccugcgccuggcggccaaugccaucugcucugccgucccaguggacuggguuccgaccagccggacuaccugguccauacacgcccaccaucaguggaugaccaccgaggacaugcugucaguguggaacagaguauggaucgaggaaaaccccuggaugaaggauaaaacucauauauccagcugggaggaugugcccuaucugggcaagagagaggaccaguggugcggaagucugaucggccugacggcgcgcgccaccugggccaccaacauccaggucgcgaucaaccagguacgccgacucaucgggaacgaaaauuaccuggacuacaugaccaguaugaagagauuuaagaacgaguccgaccccgagggggcucuuugguga

SEQ ID NO: 23724 - RNA, 9879 nt, Artificial Sequence
  derived and/or modified CDS sequence (opt11) from DENV-1__LC011949__SS-prME
agcgugaccaugcuguugaugcuggugcccaccgcccuggccuuccaccucaccacucggggcggggaaccccacaugaucgugagcaagcaggagcguggcaagagccugcuguucaaaaccuccgccggggugaacauguguacccucaucgccauggaucugggggagcugugcgaggacacuaugaccuacaaaugcccccguauaacugaggccgagccugacgacguggacugcuggugcaaugcgaccgacacguggguaaccuacgggaccugcagccagaccggcgagcaccggagggacaagcggucgguggcccucgcaccccacgugggccuggggcuggagacacggaccgaaaccuggauguccuccgagggcgcauggaagcagauucagcggguggagaccugggcucuccggcaccccggguucacgguaaucgcccuguuccuagcgcaugcgauuggcacgagcauaacccagaaggggauuaucuuuauccugcuuaugcucguuacgcccuccauggccaugcggugcguggggaucggcucacgagauuuuguggaaggacucuccggagccacuugggucgacgugguguuagagcacggaagcugcgucacuacgauggccaaggacaagcccacccuggauaucgagcuccugaagacggaggugaccaauccugcggugcuuagaaagcucugcauugaggccaagaucuccaacaccaccacugacagccgcugcccgacucagggcgaagccacucuggucgaggaacaagacgcgaacuuugugugcaggcgcacuuucguggacaggggcuggggaaauggcugcggucuguucggcaagggaucccucaucacaugcgccaaauucaagugcgucacgaaguuggagggcaagaucgugcaguacgagaaccugaaauacagcgugauuguuacugugcacaccggcgaccagcaccaggucgggaacgaguccacugaacauggcacuaccgcuaccaucacgccccaagcccccacgaccgagauacagcucaccgauuacggggccuugacccuggacugcaguccccgcacgggccucgacuucaaugagauggugcugcugaccaugaaggagaaguccuggcucgugcacaagcagugguuucuggaucugccccuccccuggacaagcggggccagcaccucccaggagacguggaaccgucaggaucuacuggucaccuucaagaccgcccacgcgaagaagcaggaaguggugguccucggaagucaggaaggcgccaugcacaccgcccugacgggggccaccgaaauacaaaccuccggcacuacuaccauuuuugccggccaccugaagugucgccucaagauggacaagcugacucugaagggcaccaguuacgugaugugcacgggguccuucaagcuggagaaggaggucgcggagacccagcacggaaccguccuagugcagauaaaguacgagggcacagacgcccccugcaagauacccuucagcacgcaggaugagaaggggguuacccagaauggcaggcuuauuaccgccaacccgaucgucaccgauaaggagaaaccagugaacaucgaggcagagccgcccuucggggaguccuacaucgugaucggcgcgggagagaaggcccuuaagcucucgugguucaagaagggguccuccaucgguaagauguucgaggccacggcccgcggggcacggcgcauggcaaucuugggcgacaccgccugggacuucgggaguaucggcggcgucuucacuagcgucgggaagcuggugcaccagaucuucgggaccgcuuauggcguccucuucuccggcgugagcuggacgaugaaaaucgguaucggcgugcugcugaccugguugggccugaacucccguagcacgagccucagcaugaccugcaucgccgucgggcucgugacucuguaccuaggcguuaugguccaggccgacaccgggugcgugaucaacuggaagggacgggaacucaaguguggguccggcaucuucguuaccaacgagguucacaccuggacggagcaguacaaguuccaggcugacagcccgaaaaggcugagcgcggccauugguaaggccugggaggagggugugugcgggauuaggagcgccacucgacuugagaacaucauguggaaacagaucuccaacgagcuaaaccacauccugcuggaaaacgacaugaaguucaccguugucgugggggauguugcgggcauccucgcgcaggggaagaagaugauccggccccaacccauggaauacaaguauuccuggaagucgugggguaaggcaaagauuaucggcgccgacgugcagaacaccaccuuuaucauugacgggcccaacacgccggaaugccccgaugaccagcgcgcguggaacaucugggagguugaggacuauggcuucgggaucuuuaccaccaacaucuggcuuaagcucagagacucauacacccaggugugcgaucaccgccucaugucagccgccauuaaagacucaaaggccguucacgccgauaugggcuacuggauagagagcgagaagaacgagacguggaaacuggcucgggccuccuucaucgagguuaagacgugcauauggccgaagagccauacauuaugguccaaugguguuuuggaauccgagaugaucauacccaagaucuauggcgguccgaucucccagcacaacuaccgcccaggcuacuucacacagacagccggccccuggcacuuagggaagcuggagcucgacuucgaucugugugaaggaaccaccgucgugguggacgagcacugcgguaaccgggggccgagccugcgcaccacgacugucacgggcaaaaucauucacgaguggugcugucgguccugcacccugccgccccuccgcuuccggggggaggacggcugcugguacgggauggagauccgccccgugaaggaaaaggaagaaaaccuggugaagagcauggucuccgcaggcucuggcgagguggacucguucagccucggccugcuuugcaucucgaucaugauagaggaggugaugcggucccgcuggucgaggaagauguugaugacaggcacccuggccgucuuuuucuuacucaucauggggcagcucaccuggaaugaccuaaucagacucugcauuauggugggugcgaaugccucugaccgcauggggaugggcaccacguaccuggcccucauggccaccuucaagaugcggcccauguucgccgugggccuccuguuccgccgguugaccagcagagaaguccuccugcugacgauugggcuaucccugguggcgagcguggagcuucccaacuccuuagaagagcugggggacgggcuagccauggguaucaugaucuugaaguugcuuacggauuuccaaucccaucaguuaugggccacccugcugucacucacguucauuaagaccacguucagccugcacuacgccuggaaaaccauggccauggucuuauccauugugagcuuguucccccuaugcuuaucaaccaccucucagaagacaacgugguugcccguucugcugggaucccucggcugcaagccgcugaccauguuccucaucgccgagaacaaaaucuggggccgcaagucauggccacucaacgaagguaucauggccgugggcaucgugaguauccugcugagcagccuccucaagaacgacgucccccuggccgggccccucaucgccggaggcaugcugaucgcgugcuacguaauauccggaagcuccgcugaccugucccucgagaaggccgcagagguguccugggaagaggaggccgagcauagcggcgcaagucacaacauccucgucgaggugcaggacgauggaacuaugaaaaucaaggaugaggaacgcgacgacacccugacaauccuccugaaggccacccugcucgcggugagcggagucuacccguuaaguaucccugccaccuuauuugugugguacuucuggcagaagaaaaagcagcgcagcgggguccucugggacaccccgagcccgcccgagguggagcgcgccgugcuggacgacggcaucuaccggaucaugcaacgcgggcugcuggggcggucccaggugggugucgggguguuccaggagaacguguuccacacgauguggcaugucacacgcggagcgguguugauguaccaaggaaaacggcuggagcccuccugggccagcguaaagaaggaucugauuuccuacggaggcggcuggcgccuccagggcagcuggaacaccggggaagaaguccagguaaucgcuguggaacccggcaagaaccccaagaacguucagacggccccugggacguucaagaccccagagggcgaggugggcgcaaucgcccuggacuuuaagcccgguaccuccgguagccccaucgugaacagagaggggaagaucgucggcuuguaugguaacgguguaguaaccacguccggaacguacgucucagccauugcccaggcuaaggcgucccaggaggggccgcuccccgagaucgaagaugagguguuuaaaaagcgcaacuuaaccaucauggaccugcaucccggcuccgggaagacccggagauaccuccccgccaucgugcgcgaggcaaucaagaggaagcuucggacgcugaucuuagcgcccacccgcgucguggccagugaaauggccgaggcccugaaaggcaugcccauacgcuaucagaccacagccgugaaguccgagcacaccggcaaggaaaucgucgaccuuaugugccacgccaccuucacaaugcgguuguugucccccgugcgcgucccaaacuacaacaugaucauuauggaugaggcccacuucacugaccccuccagcaucgcggcccggggcuacaucuccacccgcgucgguaugggcgaggcugcagcuaucuucaugacagcgacgccgccaggcucaguggaggccuuuccucagaguaacgccguaauccaggacgaggaacgggauauacccgagagaagcuggaauagcggguacgaguggaucaccgacuuccccggcaaaacggucugguucgugcccagcaucaagucaggcaacgacaucgccaacugccugcggaaaaacggaaagcgcguuauccagcucagccgaaagaccuucgauaccgaauaccaaaagacgaagaacaacgacugggacuacguggugacgaccgacaucucggagaugggcgcuaacuuccgagccgaccgggugaucgacccgcgccggugccugaagcccgucaucuuaaaggacggcccugagcgcgugauccucgccggccccaugccggucaccguggccagcgccgcgcagcguagggggcggaucggccgcaaccacaauaaggaaggcgaucaguacaucuacauggggcagccccugaacaacgaugaggaccacgcccacuggaccgaggccaaaauguuacucgacaacaucaacacgcccgagggcauaauccccgcgcuuuucgagccggagcgggagaaguccgcagcgaucgacggggaguaccgccuacgcggcgaggcgcguaagaccuucguggaguugaugcgccguggggaucugcccgucuggcugagcuacaagguggccucugagggcuuccaauacuccgaccgccgguggugcuucgauggggagcgcaauaaccaggugcucgaggagaacauggacguagagaucuggaccaaggagggggagcggaagaagcugcgcccacgguggcuggacgcccgcacuuacagcgacccgcucgcccuacgggaguucaaggaguucgccgccggccgccggagcaucucaggggaccugauccuugagaucggcaagcugccucaacaccugacgcagcgcgcccaaaacgcccucgauaaccuggugaugcugcacaacuccgagcagggcgggcgagcguaccgccacgcaauggaggagcuccccgauaccaucgagacucugaugcugcucgcccugaucgccguacuuaccggcggggucacccucuucuuccugucuggacgggggcugggaaagaccuccaucggcuuacugugugugauggccagcuccgugcugcuguggauggcauccgucgagccccauuggauugccgcguccaucauccuggaguucuuccugaugguacuccugauccccgagccggaccgccagcggacgccccaagacaaccaauuagcuuacgugguuaucgggcuccuguucaugauuuuaacgguggccgcgaacgagaugggccuacuggaaacgaccaagaaggaccuggggaucggccauguugcugucgagaaccaccaccacgccgcaaugcucgacguggaccugcauccggcgucugccuggacccuguacgccgucgccaccaccaucaucacgccgaugaugcgccacaccaucgagaacaccacggccaacaucagucucacggccaucgcgaaccaggccgccauccugauggggcuugauaaaggcuggcccauaagcaagauggacaucggagugccccuccuggcccuagggugcuacucccaagugaacccccugacccugaccgcugcggugcugaugcucgucgcccacuacgccaucaucgguccggggcugcaggccaaggcuacccgggaggcacaaaagcgcacggccgccggcaucaugaagaacccgacgguggacgggaucguggccaucgaccuagacccagucguuuacgacgcgaaauucgagaaacaacucggccagaucaugcuucugauucucuguaccagccagauccugcugaugcgcacaacgugggccuuaugcgagucaaucacccuggccacgggcccccugaccacgcucugggaggggagcccgggaaaguucuggaacacgacuaucgcuguguccauggccaacaucuuuagagggagcuaccuggcgggggccggccuggccuucucccucaugaagucccucgguggcgggcgccgagggaccggggcccagggcgagacgcugggcgagaaguggaagcgccagcucaaccaguugagcaaguccgaguucaauaccuauaaacggucugggauuauggaggucgacagguccgaggcgaaggagggccugaagcgcggggagaccaccaagcacgccgugagccgcgguacagccaaguugcggugguucguggagcgaaaccuggucaagcccgaggggaaggugaucgacuuagguugcggccgcgguggcuggagcuacuacugcgcagggcugaagaaggugaccgagguaaagggcuacaccaaggguggccccgggcacgaggagcccaucccgauggcuacuuacggguggaacuuagugaaguugcacagcggcaaggacguuuucuucaucccacccgagaaaugcgauacguuauugugcgacaucggggagucgagccccaauccgaccaucgaagagggccgcaccuugagaguccugaagaugguggagcccuggcuccgcgggaaccaguuuugcauaaagauucuuaauccuuacaugcccuccguggucgagacccuggagcagaugcaacggaagcacggcggcaugcucgugcgcaacccucugagccggaacuccacccacgaaauguacugggugucuugcgggacgggcaacaucgucuccgcagugaauaugacuagccgcauguuacuuaaccgguucacuauggcacaccgcaagccuaccuacgagcgggauguugaccugggggcaggcacgcgacaugucgccgucgagcccgagguagcaaacuuagacaucauaggccagcgcauugagaacaucaagcacgagcacaaguccacguggcacuacgacgaggacaaccccuauaagacgugggccuaucacggaagcuacgagguuaagccguccgguagcgccuccaguauggugaacggugucgugaagcuccugacuaaacccugggaugugauacccauggucacccagaucgccaugacagacaccaccccguuuggccagcaacggguguuuaaggagaaaguggauacuagaaccccgaaggccaagcgggggacagcacagaucauggaggucacagcacgcuggcuguggggguuccucagccggaacaagaaaccacguaucugcacgcgggaagaguuuacccgcaaggugcgguccaaugccgccauaggcgcuguguucgucgacgagaaccaguggaacagcgcgaaggaagccguggaagaugagagauucugggaccugguucaccgggagcgcgagcugcacaagcaggggaagugugcgaccugugucuacaacaugaugggcaagagggagaagaagcucggggaguucggcaaggccaagggaucacgggccaucugguacauguggcugggcgcgagguucuuagaguucgaagcccucggauuuaugaacgaggaucacugguucucacgcgagaacucccuaagcgggguggagggagagggucuucacaagcucggcuacauauuacgggacauaaguaaaauccccgggggcaacauguacgccgacgauacagccggcugggacacgcgcaucacggaggacgaccugcaaaaugaggccaaaauaaccgacaucauggagccggaacacgcgcuccuggccaaggccaucuucaagcugaccuaccagaacaaggugguccgagugcaacgccccgcgaagaacgggacggucauggacgucaucucccgccgggaccagcgcggcuccggacaaguggggaccuacggccucaacaccuucaccaauauggaagcccagcugaucagacagauggaaagcgaggggaucuucuuacccagcgagcuagagacaccgaaccuugcggagcgcgugcuggacuggcuugagaaguacggcgucgagcggcuuaagcgcauggccaucagcggggacgacugcguggucaagccgauugacgaccgguucgccacggcgcugacggcgcucaacgacauggguaaggucaggaaggacaucccccagugggagcccaguaagggcuggaacgauuggcaacaggucccguucugcagccaccacuuccaccaacugaucaugaaggacgguagagagaucguggucccgugccgcaaccaggacgagcuggucggccgcgcacgcgugagccagggggcgggcuggucgcuccgggagacugcaugccuggggaaguccuacgcccagauguggcagcugauguacuuucaccgccgggacuuacgacuggcggcgaacgccauaugcagcgccgucccuguggacugggugcccacgagccgcaccaccuggagcauccacgcacaccaucaguggaugaccacggaagacaugcugagcgucuggaaccgcguguggaucgaggagaaccccuggauggaggacaagacccauaucaguucgugggaggacgugccguaccuggggaagcgggaggaucaguggugugggucccugauuggccugaccgcucgugccaccugggccaccaacauccagguagccaucaaccaggugcgccgucucaucggcaaugagaacuaccuggauuacaugacgagcaugaagcgcuucaagaacgagagcgaccccgagggggcccugugguga

SEQ ID NO: 23725 - RNA, 9879 nt, Artificial Sequence
  derived and/or modified CDS sequence (opt11) from DENV-1__HM469966__SS-prME
agcgugaccaugcugcucaugcugaugcccaccgcccuggccuuccaccucaccacccggggcggggagccccacaugaucgugagcaaacaagaaagaggcaagagccuauuauucaagacaagcgcuggggugaauaugugcacgcucaucgccauggaucuuggcgaguuaugcgaggauacuaugaccuacaaaugccccaggaucacggaggcagagcccgacgacguggacugcuggugcaacgcaacggacacgugggugaccuacgggaccugcagccagacuggcgagcaccggagagauaagcggucaguagcccuagcgccccacguuggcuugggucuggagacucgaaccgagaccuggaugagcuccgagggcgccuggaagcagauacagagagucgaaaccugggcccuccgccaucccggguucacggugaucgcucucuuccuggcccaugccaucgguaccucgauuacccagaaagguaucaucuucauccuccuaauguuagugacucccuccauggccaugcggugcgucggcauuggaagccgcgacuucguggagggccucaguggcgcgacguggguagacguugucuuggagcauggguccugcgugaccaccauggccaaggacaagcccacccuggacauugagcuccugaagacagaggugaccaaucccgccgugcuccggaagcucugcaucgaggccaagauauccaacaccacuacggauagccgcugcccgacccagggcgaagcaacccucguggaagaacaggacgccaacuucgucugccggcgcaccuuugucgaccgcggcugggggaacgguuguggacuguuuggcaagggcucgcucaugaccugugccaaguucaagugugugaccaagcuggaagguaaaaucguccaauacgaaaauuugaaguacagcgugaucgugaccgugcacaccggggaccagcaccagguugggaacgaauccacggagcacggcacaaccgcgacuaucaccccccaggccccaacgacugagauccaguuaaccgacuacggggcccugacccuggacugcagcccaaggacgggcuuagacuucaacgagaugguauugcugacuaugaaagagaaguccuggcucgugcacaagcagugguuccuggaccugccauugcccuggaccucgggggcgagcaccagccaggaaacguggaacaggcaggaccugcuugucacuuucaagaccgcgcacgcgaagaaacaggaagucguggugcuuggcagccaggagggcgccaugcacacggcucugacuggagccaccgagauucaaaccucugguaccacgaccaucuuugccgggcaucugaaguguagauugaagauggauaagcugacucuuaagggcaugagcuacguaaugugcaccggguccuucaagcucgagaaggagguggcggagacgcaacacggcaccgugcuggugcaaaucaaauacgagggcacggacgcaccguguaagauccccuucagcacccaagacgagaagggggugacccaaaacggaagauuaaucaccgccaauccgauugugaccgauaaagaaaagcccgucaacauagaagccgagccacccuuuggggagucuuacaucgugaucggcgcgggcgaaaaggcccuuaaacucagcugguucaaaaaggggucgagcaucggcaagauguucgaggcuaccgcgagaggggcccggcgcauggcgauauuaggcgacaccgcaugggauuucgguuccaucggcggcguguucaccagcgucgguaagcuggugcaccagaucuuuggcaccgccuauggaguccuguucuccggcguuagcuggacuaugaagaucgggaucggagugcugcugacguggcuuggccugaacucgcgcagcaccucccugucaaugaccugcaucgccguugggcucguaacccuguaccugggggugauggugcaggccgauuccgggugcgucaucaacuggaagggucgggagcucaaguguggaagcggcauuuucgugaccaacgagguucacaccuggacugagcaguacaaauuccaggcggacaguccgaagcgccuguccgcagcuaucggcaaggccugggaggagggggucugcggcauucggagcgccacccgccuggaaaacaucauguggaagcagaucaguaacgagcucaaucacauucugcuggagaacgacaugaaauucacuguaguggucggggacguagcgggcauccucgcccaggggaagaaaaugauacggccccagcccauggaguacaaguacagcuggaaguccuggggcaaggccaaaaucaucggcgccgacgugcagaacacgacauucaucaucgacggccccaacaccccagagugccccgacgaccagcgcgcguggaacauuugggagguugaagacuacggcuucgguaucuuuaccacaaacauauggcugaagcugcgggauuccuacacucagguaugcgaucaucgcuuaauguccgcugcgaucaaggacagcaaggccguccacgcagacaugggcuacuggaucgaguccgagaagaaugagaccuggaaacuggcgcgggccucguuuauagaggucaagacaugcaucuggcccaagagucacacgcuguggagcaacgggguccucgaguccgagaugauaaucccgaagauuuacgggggcccaaucagccagcacaacuacagaccuggguacuucacccagaccgccggccccuggcaccuugggaaacuugagcucgacuucgaccugugcgagggcacgacggugguuguugacgagcauugcggcaaucgggggccgucccugcgcaccaccaccgugacgggcaagauaauccaugaguggugcugccgaagcuguacccuaccgccccuacgcuuccgcggggaggacgggugcugguaugggauggagauccgccccgucaaggagaaggaggagaaccuggugaaguccauggugagcgccggcagcggcgaggucgacuccuucagccugggguugcuguguaucuccauuaugaucgaggaggugaugcggagccgcuggucacgaaagaugcucaugaccgggacccuagcuguguucuuccugcuaaucauggggcagcucacauggaaugaccugauccgccucugcaucauggugggcgcgaacgccucugacaggauggggaugggaaccacauaucuggcccugauggccaccuucaagaugcggcccauguuugccgugggccuccuauucaggcgguuaacgucccgcgaggugcuccucuuaacaaucgggcucagccugguugccuccguggagcugcccaacagccucgaggagcugggcgaugggcucgccaugggaaucaugauucuuaaacugcuaacggacuuccagucccaccagcucugggccacucuccuuagccucacguuuaucaagacaaccuucucccugcacuacgccuggaaaaccauggcuaugguucuaagcaucgugucgcucuucccccugugccugaguaccaccucccagaagacuaccuggcuccccguccuguuagguucccucgggugcaagccgcugacgauguucuugaucgccgaaaacaagaucuggggccggaagaguuggccccucaacgagggcaucauggccgucgggaucgugucuauccugcuaagcucccuccugaagaaugacgucccgcuggccggcccccuuaucgcuggcggcaugcugauagcgugcuacguaaucagcggguccagcgccgaccugaguuuagagaaggccgccgagguaagcugggaggaggaggccgaacacuccggcgcgagccauaacauucugguggagguccaggacgacgggaccaugaagauuaaggacgaggagcgcgacgacacucugaccauccuccugaaggccacccugcucgccguguccggcgucuacccgcucucuauccccgcaacacuauucgucugguacuucuggcagaagaagaagcagcggagugggguccucugggauacccccagcccgccugagguggaacgcgccgucuuggacgacgguaucuaccggauaaugcagcgcggccugcuggggcgaucccaggugggcgucggggucuuccaggagaauguguuccacaccauguggcaugugacccgcggcgcaguccucauguaccaggggaaacggcuggagccaagcugggcauccguuaagaaggauuugaucagcuacggcggcgguuggcgccuccagggcuccuggaacaccggugaggaggugcagguaaucgccgucgagcccggcaagaauccaaagaacgugcaaacugccccggguaccuuuaagacccccgagggcgaggucggcgccauagcucuggacuucaagcccggcacguccggcucccccauagugaaccgggaggggaagaucgugggucucuacggcaacggggucgugaccaccaguggcacuuaugugagcgccauugcccaggccaaggcgucccaggaagggccgcuucccgagaucgaggacgaggucuuccgcaagcggaaccucacgaucauggaccuacaccccgguagcgggaagacccgccgguaccucccggccaucguucgcgaagcaaucaaacggaagcuccgcacccugauucucgcgcccacccgcguggucgccagugagauggcggaggcccugaaggguaugccaauuagguaccagacaacggccgucaagagcgagcacaccggcaaggagauaguggaucugaugugccacgccacuuuuacgaugcgccuccugucccccguccgggugccgaacuauaacaugaucauuauggacgaggcccacuucaccgaccccuccuccauugcugcccgcggcuacaucagcaccagagugggcaugggagaagccgccgcaaucuucaugaccgcgacgccgcccggcagugucgaggccuuuccacaaagcaacgcuguaauccaggacgaggagcgggacauccccgagcgcucauggaacagcggguacgacuggauaaccgauuuccccggcaagacgguaugguucguccccagcaucaagagcggcaacgauaucgcgaacugcuuacgcaagaaugggaagcgggucauccagcucuccagaaagaccuucgauacggaauaccagaagaccaaaaauaacgacugggauuacgugguaaccaccgacaucagcgagaugggcgcgaacuuccgugccgaccgcgugaucgacccgcggcgcugccugaaacccgugauccugaaggacggacccgagagaguagugcucgccggccccaugccggucacggucgccuccgcagcgcagcgcagagggcgcaucggccgaaaccacaacaaggaaggcgaccaguacauuuacauggggcagccccugaacaacgaugaggaccacgcccacuggacggaagcaaagaugcugcucgauaacauaaacaccccugagggcaucauccccgcccuguucgagccggagcgagaaaagucugcugcaaucgacggugaguacaggcugcggggcgaggcccgcaagacuuucguggaacucaugcggcgcggggaccuccccgucuggcuguccuacaaaguugccagcgagggauuccaguacagcgaccggcgcugguguuuugacggcgagcggaacaaccaagugcucgaggagaacauggacgucgagaucuggacgaaggagggggagcgcaagaaacugcggccuagaugguuggaugcccgcacauacucggacccccucgccuuacgcgaauucaaagaguucgcggccggccggcgcagcguauccggggaucugauccucgagaucggcaagcugccgcagcaccuaacccagcgggcccagaaugcccucgauaaccuggugaugcuucacaauagcgaacagggcgggcgcgcguaccggcacgcaauggaggaacucccggauaccaucgagacccugaugcuucucgcccugaucgccguacuaaccggcggggugacccuauucuuccuguccgggcgcgggcugggcaagaccagcaucggccuccugugugugauggcauccagcguccugcucuggauagcgaguguggagccgcacuggaucgcugccuccaucauucuggaguucuuucugauggugcuccugauucccgaaccggaccggcaacggacgccgcaggacaaccaacucgcuuacguggucaucgggcucuuguucaugauuuugacggucgccgcgaacgagaugggucuccuggagacgaccaaaaaggaccuggggauuggacacgucgccguggagaaccaccaucacgcagcuauacuagacguggaccugcaccccgccuccgcguggacuuuguaugccgucgccacgaccaucaucaccccgaugaugcggcacaccaucgagaacacgaccgcuaacauaagccucacggccaucgcaaaccaggccgccauccugaugggucuggacaagggauggccgaucuccaagauggauauuggcgucccacuucuugcccuggggugcuacagccagguuaaccccuugacccugacggcggccguucugaugcucguggcgcacuacgccaucaucggcccugggcugcaagcaaaggcgacccgcgaggcccagaaacgcaccgccgccgggaucaugaagaaccccaccguagaugggaucgucgccaucgacuuggaccccgugguguacgacgcgaaauucgagaagcagcucggccagaucaugcugcugauccucuguacaucccaaauccugcuaaugcguaccaccugggcccucugcgagagcauuacucuggcaacugggcccuuaaccacccucuggaagggguccccgggcaaguuuuggaacaccacgaucgccgucucuauggccaacaucuuucgcgguuccuaccuggcuggugcaggccuggccuucucacugaugaagagccugggaggcgguaggcgcgggaccggugcccagggcgaaacccugggcgaaaaguggaaacggcagcucaaccagcugucuaagucggaguuuaacaccuauaagcgcucugggaucauggagguggaucguagcgaggcgaaggagggccuaaagcgcggcgagacgaccaaacacgcggucucccgcggcaccgccaagcuccgcugguucgucgagcggaaccuggugaagcccgagggcaaggugaucgaucugggcugcggccgcggggguuggaguuauuacugcgccgggcuuaagaaaguuaccgaagugaaggguuacacgaaaggcggcccaggccacgaggagcccaucccaauggcgaccuacggguggaaccucgugaaguuguacuccggcaaggacgucuucuucaucccgccggagaagugcgacacccuucucugcgauauaggcgagucgucccccaauccgaccaucgaggagggccggacgcugcgcguucuuaagauggucgagccuuggcuccgagggaaccaguuuugcaucaagaucuugaaccccuacaugcccagcgucguggagacccuugagcagaugcaacgcaagcacggcggcaugcuagugagaaacccgcucucccgaaacucgacccacgagauguauuggguguccugcggcacuggcaauauagugagcgcagugaacaugaccucccggaugcugcucaaccgcuucacgauggcacacaggaagccuaccuacgaacgugacguugaccuaggggccgggacccgccacguggccguggagcccgaagucgccaaucuggacaucaucggccagcguauagagaacaucaagcacgaacacaagucgaccuggcacuacgaugaggauaacccguacaaaacgugggcuuaccacggguccuacgaggugaagccaagcggcuccgcgagcagcauggucaacggggucgugaagcuccugacaaagccaugggacgucauucccaugguaacccagaucgccaugaccgauacgacccccuucggccagcagagaguguucaaggagaagguagacacccggacaccgaaggcaaagcgcggaacggcgcaaaucauggaggugaccgcgcgguggcuuuggggauuccuuucccgcaacaagaagccuagaaucuguacccgcgaggaauucacccggaaagugcgcaguaacgccgccauuggcgcugucuucguggaugaaaaccaguggaacuccgcgaaggaggcuguggaagacgagcgguuuugggaucugguacaucgcgagcgggagcugcacaagcaggggaagugcgccacgugcgucuacaacaugaugggcaagagagagaagaagcuuggggaauucggcaaggccaaggggagccgcgcuaucugguacauguggcugggugcacgcuuucuagaauucgaggcacuuggcuucaugaacgaggaccacugguuuucccgggagaacagccuguccgggguggagggggaagggcugcacaagcuaggauacauucugcgggacaucagcaaaauccccgggggcaacauguacgcagaugacaccgcgggcugggacacccgaaucaccgaggacgaccuucagaacgaggcuaaaaucacagacaucauggagccggagcacgcucuccuggccaaggccaucuucaaguuaaccuaccagaacaaaguagugcgagugcagcgcccugccaaaaacgggaccguaauggaugugaucagccggcgagaccagcgcggaagcggccagguggggaccuacggccucaacacauuuaccaacauggaggcccagcugauccgccaaauggagucugaggggauauucagcccgagcgagcuagagacucccaaccucgcggagcggguucuugauugguuggagaaguauggcguggaacgccucaagcggauggccaucagcggcgacgacugcguggucaaaccgaucgacgacagauucgccaccgcccugacggcccugaacgacaugggaaagguacggaaggacaucccccagugggaacccuccaaagguuggaacgacuggcagcaaguucccuuuuguagccaucacuuccaccagcuaaucaugaaggacggacgcgagaucguggucccuugccggaaccaggacgaguuggugggccgcgcccgggucucccagggagccggcuggagcuuacgcgaaacagccugccuggggaaaaguuacgcccagauguggcaacugauguauuuccacaggcgagaccuccggcucgcggccaacgcaauaugcuccgcagugccgguggacuggguccccacgagccgcaccaccuggaguauccacgcccaccaucaguggaugaccaccgaggauaugcugagcguauggaacagaguguggaucgaggagaacccuuggauggaggacaagacucacauuuccagcugggaggaugucccuuaccugggcaagcgagaggaccaguggugcggaucgcucaucggccugacggcgcgcgccaccugggccaccaauauccagguggccaucaaccaggugcggaggcugaucggcaacgagaacuaccuggacuacaugacaagcaugaaacgguucaaaaaugaauccgacccggaaggggcgcugugguaa

SEQ ID NO: 23726 - RNA, 9879 nt, Artificial Sequence
  derived and/or modified CDS sequence (opt11) from DENV-1__JX669462__SS-prME
agcgugaccaugcugcucauguuacugcccaccgcuuuggccuuucaccugaccacgcgcggcggggaaccccacaugauuguuucgaagcaggaacguggcaagagucuccucuuuaagaccagcgcgggggucaauauguguacccugaucgcuauggaucugggcgaguuaugcgaggauacaaugaccuacaagugcccccgcaucaccgaggcugagccggacgacguggacuguugguguaacgccaccgauaccugggucacguacgggaccugcagccagaccggugagcaccguagagagaagagaucaguggccuuggcgccgcacguaggcuuagggcuggagacccgcaccgagacuuggaugagcagcgagggcgcauggcgccagauacagcgcguggagacuugggcacugcggcauccuggguuuacuguuaucgcauucuuucuggcccacgccauugguaccagcauaacccagaaggggaucaucuuuaucuuguuaaugcuggugacucccucaauggccaugcgcuguguaggaaucggcaaccgggacuucguggagggccucuccggcgcgacuuggguugacgucgugcuggaacacggguccugcgugaccacaauggcgaagaacaagcccacgcuggacaucgagcuccugaagacggagguaaccaaccccgcgguguuacgcaaacucugcaucgaggccaagaucucgaacacuacuaccgauucccggugcccuacucagggcgaggccacacugguggaggagcaggacgccaacuucgugugccgccggaccuucgucgacagaggcuggggaaacggguguggacuguucggcaaggggagccuccuaacuugcgccaaguucaagugcgugaccaagcuagagggcaagaucgugcaguacgaaaaccucaaguacuccgugauuguaacgguccacaccggggaccagcaucagguggggaacgaaacuacugagcacgggacgaucgccaccaucacgccccaggcgcccacgucagagauccagcugaccgauuacggggccuugacccucgacugcucaccucgcacgggccucgacuucaaugagaugguacugcucacgaugaaagagaaaagcuggcugguccacaaacagugguuccucgaucucccccuccccuggacuuccggggccagcaccucacaggagaccuggaaccgccaggaccuauuagugacguuuaagacugcacacgcgaagaagcaggaggucgugguucugggaucucaggaaggggcuaugcacacagcccugacgggggcaacagagauccagaccagcggcaccaccacgaucuuugccgggcaccucaaaugccgacugaagauggacaagcugacccucaaagggauguccuacgucaugugcacagggucauucaaguuagagaaagaggucgcggaaacccagcacggaacggugcugguccaggugaaguacgaggggacggacgcgcccugcaagauuccauuuuccacgcaggacgagaaagggguuacccagaacggacgccucaucacggccaacccgaucgucaccgacaaggaaaagcccguaaacauugagaccgagccgcccuucggggagagcuacaucguggucggggccggcgaaaaagcguugaaauugagcugguucaagcggggguccuccaucggcaaaauguucgaggccaccgcccgcggggcccggcggauggcuauccucggcgacacggcgugggauuucggcagcauuggcggcguguucaccagcguaggaaagcucguccaccaggucuucggcaccgccuacggggugcuguucucaggaguuuccuggaccaugaagaucgggaucggaaucuugcuaacuuggcugggccucaauagccgauccaccagccucuccaugaccugcaucgccgucggcauggugacccuguaccugggcguaauggugcaggcagauucugggugcgucaucaacuggaaggggcgagaacucaagugcgggaguggcauauucguuacgaacgaagugcauaccuggacggagcaguacaaauuucaggccgacaguccuaagcgcuuguccgcagccauuggcaaggcaugggaggagggggugugcggaauccgaagcgccacacgacuggagaacaucauguggaagcagaucagcaacgaacucaaucacauccugcuagaaaacgauaugaaguucacggucgugguaggggacgcuaacggcauccucgcgcagggaaagaagaugauccggccacagccgauggagcacaaguacagcuggaagucauggggcaaggcuaagaucauaggcgccgacauccagaacaccaccuuuaucauugacgggcccgacaccccggagugccccgacggccagcgcgccuggaacauaugggagguugaggauuacggguucggcguauucaccacgaacaucuggcuuaaacucagagacuccuacacccagaugugcgaccaucgucuaaugagcgcggccaucaaggauuccaaagccgugcacgcggacaugggcuacuggaucgagucggagaagaacgagaccuggaaguuagcccgggcgaguuucaucgaggucaagacaugcacguggccaaagagccacacccugugguccaacggagugcuggagagugagaugaucaucccuaaaauuuuuggcgggccgaucucccagcacaacuaccgcccugguuacuucacccaaacugccgggcccuggcaucugggcaagcuggaacucgacuucgaccugugcgagggcacgaccguuguggucgacgagcauugcgggaacaggggcccgagccugcgcacuaccacggucaccgguaagauuauccaugaaugguguugccgguccugcacccuaccgccacuacgcuucaggggagaggacgggugcugguacggcauggagauacgccccgugaaggagaaggaggagaaucuugugagaaguaugguguccgcaggaaguggggaggucgacagcuucucccucggcauucuaugcgugucuaucaugaucgaggaaguuaugcgcucccgcuggagccgcaaaauguugaugaccgggacgcuugcggucuuccuguugcugaucaugggccagcugaccuggaacgaccugaucagacucugcaucaugguuggggcgaacgcaucagacaggauggggauggggaccaccuaucuggcccugauggccacgcucaagaugcgaccgauguucgcggugggucuacuguuccggcgucugaccucgcgggaagucuuguugcucaccaucggucuguccuugguggcaagcguugagcuccccaacucccucgaggaacuuggagacggccucgcuaugggaauaaugaugcugaaacugcucaccgaguuccagccccaccaacuauggacaacucugcuaagccuuaccuucgugaagaccacguuaagccuagacuacgccuggaagacaacugccaugguacugagcaucgugucucuguuccccuugugccuguccaccacuucacagaagaccaccuggcugccgguguugcuggggagcuucgggugcaagccccugacaauguuccuaauaaccgagaacaagaucugggggcgcaaguccuggccucugaacgaaggcauaauggccauaggaaucguguccauccuucuuagcucgcugcugaaaaaugacgucccccuagcgggcccgcuaaucgccgguggaaugcuaaucgcuugcuacguaaucuccgggaguagcgcagaccucucccuggagaaagcagcagaagugucaugggagcaggaagcugaacacaguggcgccagccacaacauacucguagagguucaggacgacgguacgaugaagaucaaggaugaggagcgcgaugauaccuuaaccauacuacuuaaggccacacuacuggcaguguccggggucuaccccaugagcauccccgcaacgcuguucgugugguauuuuuggcagaagaagaagcagcgcuccggcguguugugggacacaccaagcccacccgaagucgagcgggccgugcuggaugacggcauuuaccgcauccugcagcgaggacugcucgggcgcucccaggucggggucgggguguuccaggacgggguauuccacacaauguggcacgucacucggggcgcgguucuaauguaccaaggcaagcgccuagagcccagcugggccuccguaaagaaggaccucaucagcuacgggggcggguggagauuccaaggcuccuggaacacgggggaggagguccaggugaucgccguugagccgggcaagaacccgaagaacguccagaccacucccggcaccuucaagacgcccgagggggagguuggagcgaucgcccuggacuucaagcccgggaccucuggcucaccgaucgugaaccgcgaaggcaagaucgucgggcuuuacggcaacgggguggugaccaccagcggcacguacgucagugccaucgcccaagccaaagcgucacaggaagggcccuugcccgagaucgaggaugagguauucaagaagcgcaaccuaaccaucauggaccugcacccaggcagcggcaagacccgccgguaccuacccgcaaucguccgcgaggccaucaagaggaaacugcggacccuaauccucgcgcccacgcgggucgucgccuccgagauggccgaggcguugaaggguaugccuauccgcuaccagacaaccgccguaaagagcgagcauaccggccgugagaucgucgaccuaaugugccacgcgaccuuuacuaugcggcuucuguccccgguccgcguucccaacuacaauaugaucaucauggacgaagcgcacuucaccgaccccgccagcauugccgccagaggguacauauccaccagaguugggaugggggaagcagcagccaucuucaugaccgccacgccgccgggcucgguggaggccuuuccccaauccaacgccguaauccaggacgaggagcgggacauacccgagcgauccuggaacuccgguuaugacuggaucaccgacuuccccgggaagacaguuugguucguacccucaauuaaauccggcaacgacaucgcgaacugccugcggaaaaaugggaagcgcgugauccagcucagccgcaagacauucgacacagaguaucagaagaccaagaacaacgacugggacuacgucgugaccacggacaucuccgaaaugggcgccaauuuccgcgcagaccggguaauugacccacgucggugucugaagcccgucauuuugaaggacgggcccgaacgcgugauccucgcugguccgaugcccgucaccguggccuccgccgcccagcggcgaggccgcaucgguagaaaccagaacaaagagggggaucaauacguguacauggggcagccucugaacaacgaugaagaccacgcgcauuggacagaggccaagaugcugcuggacaacaucaacacgcccgagggcaucaucccugcgcuguucgagcccgaaagggagaaguccgccgccaucgacggggaguacagacuacgcggcgaggcucggaagacguucguggaacucaugcgccggggcgaccuucccguguggcuaaguuauaagguggcauccgagggguuccaguacucugaucgccgaugguguuucgauggggaacgaaacaaccagguucucgaggagaacauggacguggagaucuggaccaaggagggggagcguaagaaacuucgcccacgcugguuggacgcucgaacguacuccgauccgcucgcucugagggaguuuaaagaguucgcagccggucgccggagcguguccggcgaccuuauccucgaaaucgggaagcugccccagcaccugacccucagagcccagaacgcacuggacaaucuggucaugcuccacaacuccgagcaaggcggaaaagcauacaggcacgccauggaggagcugcccgacaccaucgagacucugaugcucuuggcccugauugcaguacugaccgguggugugacacuguucuuccugagcggcaagggacugggcaagaccucgaucggucuccuaugcgucacugccuccucugcccuccuguggauggccagcguugaaccccacuggaucgcagcguccaucauuuuggaguucuuccucauggugcuguuaaucccggagcccgaucgucagcggacgccccaggacaaccagcuggccuacguagugaucgggcuauuguucaugauccucaccguagccgccaacgagaugggccuacuggagaccacgaagaaggaccucgggauaggcuaugucgcggcggagaaccaucaacacgcgaccaugcuagacguugaccugcacccugcgucagccuggaccuuauacgcggucgcuaccacugucaucacccccaugaugcgccauaccaucgagaacaccacagccaacauuucccugaccgcuaucgccaaccaggccgcgauccuuauggggcuagacaagggauggcccaucagcaagauggauauaggcgugccucugcuggcucuuggcugcuacucccaagugaacccguuaacucugaccgccgccgucuugaugcugguggcgcacuaugcgaucaucggacccggguugcaagccaaggcaacgcgcgaagcucaaaagcggaccgcggccgggauuaugaagaauccuacgguggacggcauagucgcuauagacuuggaucccgugguguacgacgccaaguucgaaaagcagcuugggcaaauaaugcuacucauccugugcacgagccagauucugcuaaugcgcacaaccugggcgcugugugaauccauaacgcuggcgaccggcccgcucacgacccuuugggaggggucucccggcaaguuuuggaacaccaccaucgcugucucaauggcaaacaucuucagagggagcuaccucgccggggcuggccuugcuuucucgcugaugaagucacucgggggagggcgccgagggacaggagcucagggggagacccucggcgagaaguggaagagacaguuaaaccaacugucuaaauccgaauuuaacacuuauaagcggagcgguauaauggagguugacagaucggaagccaaggaaggccuaaagcgcggggagaccacgaaacacgccguuagcagaggcacagcgaagcugcggugguuuguggagcgcaauuuggugaaacccgagggaaaggugauugaucucgggugcgggcgcgggggcugguccuacuacugugcagggcucaagaagguaaccgaggugaagggcuacaccaagggcggcccaggccacgaagaaccgauuccaauggcuaccuacggcuggaacuuggugaaacugcauagcgggaaagacguauuuuucaugccgcccgagaagugugacacguuacugugugacaucggggaguccuccccgaaccccaccauagaggagggucgcacucuccggguacucaagauggucgaacccugguugcgcggaaaccaguucugcaucaagauccuaaaucccuauaugcccuccguuguggagacacucgagcagaugcagcggaaacauggaggaaugcuaguucgcaacccccugagccggaacuccacgcaugagauguacugggucucuugcgggaccggcaacauugugagcgcaguaaacaugacaucacguaugcugcucaauagguucacaauggcccaucggaaacccacguaugaacgggacguugaccugggcgcggggaccaggcacgucgccguggagcccgaggucgccaaucuagacaucaucggccagcgaaucgaaaacauuaagaacgagcacaaaucuaccuggcauuacgacgaagacaaccccuacaagaccugggcguaccauggcucuuacgaggugaaacccuccggcagcgcguccucaauggugaauggcguggugcggcugcuuacgaagcccugggacguuauccccauggugacccagauagcaaugacagauacuacgccguuuggccagcagaggguauuuaaggaaaagguugauacacggacaccccgugcaaagagaggcacaacgcagaucauggaggugaccgccaaguggcuauggggguuccugucccggaacaagaaaccgcgcaucugcacuagggaggaguucacccggaaggugcgaagcaacgcugcaaucggcgcggucuucguugacgagaaccaauggaacuccgcgaaggaggcaguggaagacgagagauucugggauuuagugcaccgagaacgcgaacuacacaagcagggaaagugcgcaacgugcguguacaacaugaugggcaagcgcgagaaaaagcugggugaguucggcaaagcgaaagguucccgggccaucugguauauguggcuuggggcccgcuuccucgaguucgaggcacugggcuuuaugaacgaggaccauugguucagccgcgagaacucgcugagugggguggagggcgagggcuugcauaagcugggcuauauccugcgcgacauuuccaaaaucccgggcggaaauauguaugccgacgauacugcuggcugggacacccgcaucaccgaggacgaccuccagaacgaggccaagauuacggacaucauggaacccgagcacgcauugcuggcuaccagcaucuuuaagcucaccuaucaaaacaaggucgugcggguacagcgccccgcgaaaaacgggacuguaauggaugugaucucgcggcgggaccagcggggaaguggccaggucgggacuuacggccugaacaccuuuaccaacauggagguccagcugauccggcaaauggagucagaggggauuuucuugccuagcgagcuggagacuccuaaccuugcugagcgggcccucgauugguuggagaagcacggcgccgagagguugaagcguauggcuaucucuggugacgacugugucguuaagcccaucgacgaucgcuucgcgacugcgcucacugcccugaacgacauggguaagguccggaaagacauaccucaaugggagcccucgaagggcuggaacgacuggcaacaggugccguucugcucccaccacuuccaccaguugaucaugaaagacggcagggaaaucguagugccaugccgcaaccaagacgagcucguuggccgcgcccgggugagccagggggcuggauggagucugcgcgagaccgccugccuggguaagucguacgcgcagauguggcaacucauguacuuccaucggcgagaccugcggcuggcggcuaacgccaucuguucagcugucccuguggacuggguuccugcgagccgcacaacguggucgauccaugcccaccaccaauggaugacgacugaagacaugcucuccguguggaaccgcguguggaucgaagagaaccccuggauggaggauaagacgcacgugaguuccugggaggagguaccauaucugggcaagcgcgaggaccagugguguggcagccucaucggucucacagcccgggcaacgugggcgaccaauauccagguggccauaaaccaggucaggcgccuuaucgggaacgagaacuaccuggauuacaugacguccaugaagcgauucaaaaacgagagcgaccccgagggcgcccucugguga

SEQ ID NO: 23727 - RNA, 9879 nt, Artificial Sequence
  derived and/or modified CDS sequence (opt11) from DENV-1__JX669463__SS-prME
agcgugaccaugcugcucauguugcugcccaccgcccucgccuuccaccugacgaccagaggaggggaaccucacaugaucgugucgaaacaggagcggggaaagagcuugcuguucaagaccagcgcgggggugaacauguguacccuaaucgccauggaccugggcgagcucugcgaggacaccaugaccuacaaaugcccccgaaucaccgaggccgaacccgacgacgucgacuguugguguaacgccaccgacaccugggucaccuacggcaccuguagccagaccggcgagcacaggcgcgagaaaagguccguugcauuagcgccucacgugggccuggggcuggaaacucgcaccgagaccuggaugagcucggagggcgcauggcgacagauccagcgcgucgagaccugggcccugcggcacccugguuucacggugaucgcguucuuccuggcgcacgcaaucggcaccaguaucacucagaaagguaucauauucauuuugcugaugcuugugacccccuccauggccaugcgaugcgucggcauuggcaaucgggacuuugucgagggccuuagcggcgcaaccuggguagacguggugcuggaacacggguccugcgugaccaccauggccaagaauaagcccacucuggacaucgagcucuugaagacggaggucaccaaccccgcgguucugcgcaaacucugcaucgaggccaagaucuccaacaccacgacggacucccggugcccgacgcaaggcgaggccacccugguggaggagcaggacgccaacuuugucugucgucggaccuuuguggaccgcggcugggggaacggcugcgggcuguucgggaagggcagccuccugacgugcgcuaaguucaagugcgugaccaagcuggagggcaagaucguccaauacgagaaccucaaguacuccgugaucgugaccguccacaccggcgaccagcaccagguggggaacgagacgaccgagcacggcaccaucgcgacgaucacgccucaggccccgacgucagagauacaacucacagacuacggggcccuaacccucgacugcagcccccggaccggccuggacuuuaacgaaaugguccuacucacgaugaaggagaaauccuggcugguucacaagcagugguuucuggaucucccgcugcccuggaccuccggagcuagcaccucccaggagaccuggaaccgccaagaccugcucgugacguucaagaccgcucaugcgaagaagcaggaggucguggugcugggcucccaggagggcgccaugcacaccgcccugacaggggcgacugagauccagaccagcgguacgaccacgaucuuugccgggcaccucaaaugccggcugaaaauggacaagcugacccucaaggguauguccuaugucaugugcaccgggagcuucaagcuggagaaggagguugcagagacccagcacggcaccgugcugguucaagugaaauaugagggcaccgacgcacccugcaaaauccccuucuccacucaggacgaaaaaggcgugacccagaauggucgccuuaucacggcuaauccgaucgucaccgacaaagaaaagcccguuaacaucgagacugagccacccuucggggaguccuacaucguggucggcgccggcgagaaggcgcucaagcucucuugguucaagcgggggagcuccaucggcaagauguucgaggccaccgcccgcggggccaggcggauggccauauuaggggacacggcgugggacuucgguagcaucggcggcguguucacaucgguggggaaacugguccaccagguguucggcaccgccuacggggugcuguucagcggugucucuuggacuaugaagaucgggaucggcauccugcucaccuggcuaggccucaacucacgcucuaccagccucuccaugaccugcaucgccguggggauggugacucuguaucugggcgugaugguucaggccgauucugggugcgugaucaacuggaaggggcgggagcucaagugcggaagcgguaucuucgucacgaacgaagugcauaccuggacagagcaguacaaauuccaggccgauagccccaaacgucugagcgcagccaucggcaaggccugggaggaaggggugugcggcauccguuccgcgacccgccuggagaacaucauguggaagcagaucagcaacgaguuaaaccacauccuacuggagaacgacaugaaguuuacggucgugguuggggacgcuaacggcauccucgcgcaggggaagaaaaugauccggccccagcccauggagcacaaguacuccuggaaguccugggguaaggcaaagaucaucggcgccgacauccagaauacuaccuucaucaucgacgggcccgacaccccggagugcccggauggccagcgggccuggaacaucugggaggucgaggacuacggauucggcguguucaccacgaacaucuggcugaagcugcgggauuccuacacacagaugugugaccaccgccugaugagcgcggcuauuaaggacuccaaggcugugcacgccgacaugggcuacuggaucgagagcgagaagaacgagaccuggaaacuggcccgggcguccuucaucgaagucaaaaccuguacguggccaaagucacauacgcugugguccaacggggugcucgagagcgaaaugaucauccccaagauuuucgggggcccgauuucccagcacaacuaccgccccggcuacuuuacucagaccgcggggcccuggcaucuggguaagcucgagcucgacuuugaccugugcgaggguacuaccguuguuguggacgaacacugcgggaaccggggcccgagcuugagaaccacaacgguaaccgggaagaucauccacgaguggugcugccgguccugcacucugccgccccugagguuccggggcgaggacgggugcugguauggcauggagauccggcccgucaaggaaaaagaggagaaccuggugcguagcaugguauccgcggggagcggggaggucgacagcuucagucucggcauacugugcgucagcauuaugaucgaggaggugaugcgcucccgcuggagccggaagaugcugaugaccgggacgcucgccgucuuccugcuguugaucaugggccagcugaccuggaacgaccugauccgacucugcaucauggugggcgccaaugcgagugaccggaugggcaugggcaccaccuaucuggcgcugauggccacguugaagaugcgcccgauguucgccgugggguuauuguuccggcgccucaccagcagggagguucugcuacucacgaucggccugucccugguagccagcgucgagcuuccaaauucccuggaggaacucggagacggccuagcgaugggcaucaugaugcugaagcugcucaccgaguuucaaccccaucaacucuggacaacccugcugagccugaccuucguaaaaaccacguuguccuuggacuacgccuggaagaccaccgccaugguucucagcauaguauccuuguucccguugugccugagcaccacgucccagaagaccaccuggcugccgguauugcuggggagcuucggcuguaagccccucaccauguuucucaucaccgagaauaagaucugggggcgcaaguccuggccucugaaugaagggaucauggccauaggcaucgugagcauucugcucagcagccugcugaagaacgacgucccccucgccggaccguugauagccggcgggaugcugaucgcuugcuacgugauuagcgguuccagcgccgaccucucgcuggagaaggccgcagaagugucgugggaacaggaggccgagcacucaggggccagccacaacauccugguggagguacaggacgauggcacgaugaagauaaaggacgaggagcgggacgacacgcucaccauuuuguuaaaggccacccucuuggccgugucgggggucuaccccaugaguauccccgccacacuauuugugugguacuucuggcagaaaaagaaacaacgcagcggcgugcucugggacaccccuuccccgcccgagguagagcgggccguacuggacgacggcauuuaccguauccuucaacgggggcuucucggccgcucacaggugggugucgguguguuucaagacgggguguuccauaccauguggcacguaaccagaggcgcgguguuaauguaccagggcaagcgccuggagccuagcugggccuccgugaagaaggaccucauaagcuacggaggcggguggcgguuucagggcagcuggaacacuggagaggagguccaggugaucgccguggaacccggcaagaacccgaaaaauguacaaaccacucccgguaccuucaagacgcccgagggggaggugggagccauagcgcuggacuucaagcccgggaccuccgguagcccgaucgugaaccgcgagggcaagaucgucgggcuguacggcaacggaguggugaccacuagcggcacauacgucuccgccaucgcccaggcuaaggcgucccaggaaggaccccuccccgagaucgaggaugagguguuuaagaagcggaaucugaccauaauggaccuacacccggguagcggcaagacccgcagguaucuccccgcgaucguucgcgaagccaucaagcgcaaacugcggacccugauccucgccccaacgcgcgucguagcaucggagauggccgaggccuuaaagggaaugcccauccgguaucagaccaccgccgucaaaucagagcauaccggccgcgaaaucgucgaccugaugugucacgccacguucaccaugcggcucuuaagcccggugcgcgugcccaacuacaacaugaucauaauggaugaggcgcacuucaccgaccccgccagcaucgccgcccguggguacaucuccacccgcgucggcaugggggaggccgcggcaaucuuuaugacagccacgccucccggcagcguagaggccuucccccaaucgaacgcaguaauacaggacgaagaacgggacaucccggaacgguccuggaacucaggcuacgacuggaucacugacuuucccgggaagacagucugguucguccccagcaucaaguccggaaacgauauagcaaacugccugcgcaagaaugguaagcgcgugauccagcuaagccggaagacguuugauaccgaguaccaaaagaccaagaauaaugacugggauuacgucgugacuacggacauaucugagaugggcgccaacuuucgggcggaccgggugaucgauccccggcggugccugaaaccagucauccucaaggacggccccgaacgcgucauccucgccgguccuaugcccgugaccguagcgagcgcagcgcagcggcgcggucgcauagggcggaaucagaauaaggagggcgaccaguauaucuacauggggcagccucugaauaaugacgaggaccacgcccauuggacugaggccaagaugcugcucgacaacaucaauacccccgagggcaucaucccugcguuauucgagcccgagcgcgaaaaguccgccgccaucgacggggaguaccgcuugcgaggcgaggcgcggaagacguucguggaguugaugcgccgaggcgaccugcccguguggcugaguuacaagguggccagugaaggguuccaguacagcgaccgccguuggugcuucgacggagagcgcaacaaccagguucucgaagaaaacauggacgucgagaucuggaccaaggaaggggagcggaagaagcuccgcccucgcuggcucgacgcgcgcaccuauuccgacccgcuugcccuacgggaguucaaagaguucgccgccggccggcguagcgugagcggcgaccuuauccucgagaucgggaaguugccgcagcaccugacacuucgagcccagaacgcucuggacaaccuggugaugcuccacaauucagagcagggcgggaaggccuaucggcacgccauggaggaacugccugacaccaucgagacacuaaugcuccuggcgcugaucgcggucuugaccggcggggugacccucuucuuucuaucagguaaggggcucgggaagaccuccaucgggcugcuguguguaacggccagcucugcgcuuuuguggauggccagcgucgagccccacuggaucgccgcguccauaauucuggaauuuuuccuuauggugcugcugaucccggagccggacagacagaggacgccccaggacaaucagcucgcauacguggucaucggccugcuuuucaugauccucaccguggccgccaacgagaugggccuacuggaaaccacgaagaaggaccucgggaucggcuacguggcggcagagaaccaccagcacgccacaaugcuggacgucgaucugcacccugcguccgccuggacucuauacgccguggcuacuacggugauaaccccgaugaugcgucacaccaucgaaaauaccacagccaacaucucgcugaccgcaaucgccaaucaggccgcgauccucaugggucucgacaaggguuggccuaucagcaagauggacauaggcgucccccugcuggcgcucggcugcuacagucagguuaauccgcugacgcugaccgcugcugugcucaugcuuguagcccacuaugccaucaucggucccggguuacaggcaaaggccacgcgcgaagcucagaagcggaccgccgccggcaucaugaagaaccccaccguagacggcaucguagccaucgaccucgaccccgucguguacgacgccaaguucgagaagcaguuagggcagaucaugcugcucauccugugcaccagccaaauccugcucaugcgaaccaccugggcccugugcgaguccaucacccucgcaaccggcccguuaacgacgcugugggagggguccccgggcaaauuuuggaacaccaccaucgccguauccauggccaacauuuuucgggggagcuaccuugccggagccggccucgcguucucccuaaugaagucccucgggggcgggcgccgggguacgggcgcccagggggagaccuuaggcgagaaguggaaacgccagcugaaccagcugagcaagagcgaguuuaauaccuacaaacggucagguaucauggaggucgaccgcucagaggcgaaggagggccucaagcgcggggaaaccacgaagcacgcaguaagccgcggcaccgccaaacugcggugguucguugagcgaaaccuggucaagccugagggcaaggugaucgaccuggggugcggccgcgggggcugguccuacuacugcgccgggcucaagaaggugaccgaggucaagggauacacaaagggcgggcccggccacgaggagccgauuccgauggccacguauggauggaaccuggugaaacuucacagcggcaaggacguguucuucaugccgcccgagaagugcgacacgcuccugugcgacauuggagaguccagcccgaaccccaccaucgaggagggcaggacccugcguguguugaagaugguggagcccuggcugcgcgggaaccaguuuugcauuaagauccugaacccauacaugccguccguagucgaaacccucgaacaaaugcaacggaaacacgggggaaugcuggugcgcaacccccuaagccggaacaguacgcacgagauguacugggugagcugugggaccggcaacauugucuccgccgugaacaugaccagccgcaugcuccugaaccgcuucaccauggcccaccggaagcccacuuacgagcgcgacguggaccugggcgcggggacucggcaugucgccguggagccagagguagccaaccucgacauaaucggacagcgcaucgagaacaucaagaacgaacacaagagcaccuggcauuacgacgaagacaacccguacaaaaccugggccuaccacgggagcuacgagguaaagcccuccggcagcgccuccagcauggugaacggggucgucaggcugcugacgaaaccgugggacguuauccccauggucacgcagaucgcgaugacagacaccacgccguuuggccagcagcgaguguucaaggagaagguggauacccggacgccgcgugccaagcggggcaccacgcagaucauggaaguaacagcgaaguggcucuggggauuccuaucccgcaauaagaaaccccggaucuguacccgcgaagaguucacccggaagguccgcagcaacgcagcuaucggcgcgguguucguagacgagaaccaguggaacagugccaaggaggccguggaggaugagcgguucugggauuuagugcaccgcgagcgggagcuccacaagcagggaaagugcgccacgugcguuuacaacaugaugggaaagcgcgagaagaagcugggggaguuugguaaggcgaagggcuccagagcuauuugguacauguggcugggggccagauuccucgaguucgaggcccugggcuucaugaaugaggaccacugguucagccgggagaacucccugagcgggguagagggcgaggggcuccacaaguuaggguacaucuugcgagacaucuccaagauuccuggcgggaacauguacgccgaugacaccgcgggaugggacacucgcauaaccgaagacgacuugcagaacgaggccaagaucacggacaucauggagccggagcacgccuuacuggcgacgagcaucuucaaauugaccuaccagaacaagguugugcgggugcaacgccccgcgaagaaugggacugugauggacgucaucucccggcgcgaccagcgaggaagcggccagguggguaccuacggucuaaacacauuuaccaacauggaggugcagcuaauccgccaaauggaauccgaggggaucuucuuaccuagcgagcuggagaccccgaaccuagcagagcgggcccucgacuggcuggagaagcacggcgccgagcggcuaaagcggauggcuaucuccggggacgacugcguggucaagccgaucgacgaccgcuucgcaacggcgcucacugcacucaacgacaugggcaaggugcggaaggacaucccccagugggagcccaguaagggcuggaacgacuggcagcaggucccuuucugcucccaucauuuccaucaguugaucaugaaggacgggcgcgagauaguggugccuugucggaaccaggaugagcuaguaggccgcgcccgggucucccagggugcuggcuggucacugcgggagaccgcuugucugggcaagucuuacgcgcagauguggcagcucauguacuuccaucggcgggaccugcgccuggcagccaaugcuaucugcuccgcgguacccgucgacugggugcccgccagccgcaccaccuggaguauccacgcgcaccaccaguggaugacgacagaggacaugcuuaguguuuggaaccgcguauggauugaagagaacccguggauggaggacaagacccacgugagcuccugggaggaagugccguaccugggcaagcgggaggaccaguggugcggcucgcugaucgggcugacagcccgcgccacgugggcgaccaacauccaggucgcuaucaaccaggugcggaggcugauuggcaacgaaaacuaccuggacuacaugaccuccaugaagcgguucaagaaugagagcgaucccgagggggcccucugguga

SEQ ID NO: 23728 - RNA, 9879 nt, Artificial Sequence
  derived and/or modified CDS sequence (opt11) from DENV-1__JX669464__SS-prME
ucgguaacaaugcuguuaaugcuauugcccaccgcccucgccuuccaccugaccacccggggcggggaaccccacaugauuguuucgaagcaagagcgcggcaagagucuccucuucaagaccagcguagguguaaacauguguacccugaucgcgauggaccucggcgagcucugcgaggauaccaugaccuauaagugcccccgcaucaccgaggccgagccugaugacguugacuguugguguaacgccaccgacaccuggguuaccuacgguaccugcagccagaccggcgagcaucggcgagacaagcgguccguggcgcuggcgccccacguuggcuuggggcucgagaccagaaccgaaaccuggaugagcuccgaaggagcguggaagcagauccagaaggucgagaccugggcccugcggcacccaggauucaccgugaucgcgcuguuccucgcucacgcgaucgguacuagcaucacucagaaggggaucaucuucauacugcugaugcucguuacccccucuauggccaugcgcugcgugggcaucggcaaccgggacuuugucgaggggcugagcggcgccacgugggucgacguggugcuggagcacggcuccugcgucaccaccauggcgaagaacaaacccacccucgacaucgagcugcuaaagacggaagugacgaacccggcagugcuccguaagcugugcauagaggcgaaaaucagcaacaccaccacggacucccgcugcccgacccaaggcgaagccaccuuaguugaggagcaggacgcuaauuucgucugcagacggaccuucguggaccgggggugggguaauggcugcggccucuucggcaaagggucacugcugacgugcgccaaguuuaaaugcgucaccaagcucgagggcaagauugugcaguacgagaaccugaaguauuccgugaucgugaccgugcacacuggcgaucagcaucagguggggaacgagacgaccgaacacggcacgaucgccaccauaacuccgcaggcccccacgagcgagauacagcugacggacuacggugcccucacccucgacugcagcccgcguaccggccucgauuucaacgaaaugguauuguugacgaugaaggaaaaguccuggcucgugcacaagcagugguuccuugaccugccgcugcccuggacguccggggccuccaccucucaggagaccuggaaccgacaggacuugcucgucacauuuaagaccgcccacgcaaagaagcaggaagucgugguccugggcucccaagagggcgcgaugcacacagcccucaccggggccacggagauccaaaccagcggcaccaccacaaucuucgccgggcaucugaagugucgucuaaagauggacaagcugacacugaaggggauguccuauguaaugugcacugguucguuuaaguuggagaaggagguggcagaaacccaacacggaacaguccugguccaagugaaguacgagggcaccgacgcacccugcaagauaccuuuccucacccaagacgagaaaggggucacccagaacggccgccugauaacggccaacccaauugugaccgacaaggaaaagccagugaacaucgagaccgagccgcccuucggggaguccuacaucgucgugggcgccggagagaaggcucugaagcucagcugguucaagaaaggcucgagcaucggcaagauguucgaagcgaccgccaggggggcccgccggauggccauccugggcgacacggcaugggacuucggauccauuggcggccuguucaccagcguggguaagcucauccaccagguauucggcaccgcuuacggagucuuauucucgggugugagcuggacgaugaagaucgggaucggcauccuguugacguggcuaggccucaacucccgaagcacgucccucagcaugacaugcaucgcugucggaauggucacacuguaccuuggggugaugguccaagccgauuccgguugcguaaucaacuggaagggcagggagcucaagugcgguagcggcauuuucguaacaaacgagguccauacauggaccgagcaguacaaguuccaggccgacucgccgaagcggcugagcgcggcgauagggaaggccugggaagagggagugugcggcauccgcagcgccacccggcucgagaacauaauguggaaacagaucuccaacgagcucaacuacauccuucuggagaacgacaugaaauucacagugguagucggggacgugaacggcauucucgcccaggggaagaaaaugauacgcccccaacccauggaacauaaguacagcuggaaauccuggggcaaggccaagaucauaggcgcggacauacaaaacaccaccuucaucaucgacgggccugacaccccggagugcccugacgaccagcgggccuggaacauuugggaggucgaggacuacgguuuugggaucuucaccacgaauaucugguugaagcugcgcgacucucacacgcagaugugugaccaccggcucaugagcgccgccaucaaggauagcaaggcggugcaugcggacaugggcuacuggaucgaguccgaaaaaaacgagaccuggaaacuagcucgcgccagcuucauagaagugaagacuugcaucuggcccaagucgcacacgcucuggagcaacggcguucuggaguccgagauggugaucccgaagaucuauggcggcccgaucagccagcacaacuaccggccuggguacuuuacacagaccgcuggucccuggcaccuggggaagcuggagcucgacuucgaccuaugcgaaggcaccacagugguaguggacgagcacugcggcuaucgugggccgucccuuagaaccaccaccgugacggggaaaauuauccacgaguggugcugccgcagcugcacucugccgccguugcgguuucgcggggaggacggaugcugguacggaauggagauucggcccgucaaggagaaggaagagaaccuggugaggucaauggugucagcgggauccggcgaaauggacagcuuuagccuugggaucuugugcguguccauccucaucgaggaaguuaugcggucacguuggucgaggaagauguugaugacgggcacucuggcaguauuccugcuccucauuaugggccagcuaacguggaacgaucugauccgucugugcaucauggugggcgccaacgcaagcgaccggaugggaauggguaccacauaccuagccuugauggccacguucaagaugagaccgauguucgcuguagggcugcucuuucgccgccucacgagucgcgaagugcugcugcucacaguagggcugagccugguggccuccguagagcuccccaauagccuggaggagcucggagacgggcucgcuaugggcauaaugaugcuaaaacugcuuaccgacuuccagccccaucagcuguggaccacgcugcucuccuugacguuuauccgaaccucgcugucccuugacuacgccuggaagacuauggccauggcccugagcaucgugucucuguucccccucugcuugagcacuaccucccagaagacuaccuggcugccggugcuccuaggcagcuuuggguguaaaccccuuacaauguuccucaucacagagaauaagaucuggggccgcaaguccuggcccauuaacgagggaaucauggccguaggcaucgugagcauccugcucuccagccuguugaagaaugauguuccccuugccgggccgcucaucgcgggcggcaugcuuaucgccugcuacgucaucagcggcaguagcgccgaccugucccucgagaaggcagcugaggugagcugggaggaggaagcugagcacucaggcacuagccacaacauacuggucgagguccaggacgacggcacaaugaagaucaaagacgaggagcgcgaugauacccugacaauccuccugaaggccacguuacucgccgucucaggcguguaccccaugagcauaccggcuacccucuuuguaugguacuucuggcagaaaaagaagcagcgauccggugugcuaugggacacccccucuccgccugagguggagcgggccgugcuggacgacggaaucuacaggauccuccagcggggcuuacucgggcguucccaggugggcgucggggucuuccaggacggcguguuccacacaauguggcacgugacccgaggggcgguccuaauguaccaaggcaaaagacuggaacccagcugggccuccgugaagaaggacuugaucagcuacggggggggcuggcgguuucaaggguccuggaacacgggcgaggaggugcaggucaucgccguugagcccgguaagaacccgaagaacguccagaccacgccaggcaccuucaaaauccccgagggcgaggucggagccauugcccucgacuucaaacccggcaccagcgguuccccgaucguaaaucgugaggguaagaucgugggcuuguacgggaacggcguagugaccacuagcgggacuuacguguccgcgaucgcgcaggccaaggccacucaagaaggcccccuacccgagaucgaggacgaggucuucaagaagcggaaccucaccaucauggaucugcacccggggagcggcaagacgcgccgcuaccugcccgccauugugcgcgaggcgauaaagcggaagcuacgcacacugauucuggcaccaaccagagucguagcuucagaaauggccgaggcucucaagggcaugcccauccgguaccagaccaccgccgucaaguccgaacauaccgggagagagaucguugaccugaugugccaugccaccuucacaaugcgguuacucuccccgguucguguccccaauuacaauaugauaaucauggacgaagcgcacuucacggaccccgcguccauugcggcccggggguacaucagcaccagaguggggaugggcgaagccgccgccaucuucaugaccgcuacgccccccgggagcgucgaggcauucccccaaagcaacgccguaauccaagacgaagagcgggauauccccgagcgcaguuggaacagcggcuacgacuggaucacugacuuuccgggcaagacaguuugguucguccccucaaucaagagcgggaacgacaucgcaaacugccugaggaagaacggcaagcgcgucauccaacugucccggaaaaccuucgauacugaguaccaaaaaacgaagaacaacgacugggauuacguggucaccacugauaucuccgagaugggagccaacuuccgcgcggaccgggugaucgauccccgccggugccucaaacccgugauccugaaggaaggccccgagcgcgucauccuggccggccccaugccagugaccguugccuccgcggcacagcggcgcggccggaucgggcgcaaucagaacaaggagggcgaccaauacauauacaugggacaaccccucaacaacgacgaggaucaugcccacuggacggaggccaagaugcugcuggacaacauaaacaccccagaggggaucaucccggcccuuuuugaacccgaacgcgagaaauccgccgcgaucgacggcgaguaccgguugcgaggcgaggcccggaaaacuuucguagaguugaugagacggggggaccugcccguguggcuguccuacaaaguagcgagcgagggcuuccaguauuccgaccgccgguggugcuuugacggugagcggaacaaccagguacuggaggagaauauggacguggagaucuggacaaaggaaggcgagcggaagaagcuccgcccccgguggcucgacgcccgcacuuacagcgacccccucgcccugcgggaguucaaggaguucgcggccggacgccggucgguaagcggcgacuugauccuugaaauugguaaacucccccagcaccuaaccuugcgcgcccaaaaugcacucgacaaccuggugauguugcauaacagcgagcagggugggaaagccuaucggcacgccauggaggagcuucccgacaccauagagacgcugaugcuacucgcccuaaucgcugugcuaaccggaggcgucacccucuucuuucuguccgggaagggacugggcaagaccucaauagggcuccugugcguuauggccagcagcgcgcugcuguggauggccagugucgagccccacuggauugccgccagcaucauccuggaauucuuucugauggucuugcugaucccagagcccgaccgccagcggacgccucaggacaaccagcuggccuacguggucaucggcuugcuguucaugauccugacagucgcggccaaugagauggggcuccuggagaccacgaagaaggaccuaggcaucgggcacguugcgguggaaaaccaucaccacgccacaaugcuggaugucgaucuccgcccagccuccgcguggaccuuauacgccguugccacgaccgugauuacacccaugaugcggcacacaaucgaaaacacgaccgcaaacaucagccugaccgcuauugcgaaccaggcugccauacucaugggucuggacaaaggcuggccgaucuccaagauggauauuggcguccccuugcuagcuuuaggcugcuacagccaagugaacccgcugacacugacugcugcuguccugaugcuugucgcccauuaugcgaucaucgggcccggccuucaggcgaaggcgacucgcgaggcgcagaagcgcaccgcggcugguauaaugaaaaaucccaccgucgacggcaucguaacgaucgaccuagacccggucguguacgacgcgaaauuugagaagcagcucggacagaucaugcugcugauacucuguacaucccagaucuugcugaugcgaaccaccugggcucucugcgagagcaucacgcuugccaccgggccgcuaaccacccucugggaaggcuccccggggaaauucuggaauacuaccaucgcagugucgauggcaaacaucuuccggggcuccuaccuggcuggcgcagggcucgccuucuccuugaugaaaucgcugggcgggggccggagaggaaccggcgcccagggcgagacauuaggagagaaguggaagcggcaacucaaccagcugucgaaguccgaguucaacaccuauaagaaguccggcaucauggaggucgaccgcagcgaggccaaggaggggcucaagcggggcgagaccaccaagcacgcagugucgcgcgggaccgcuaaacugcggugguucguggagcgcaaccucgucaagcccgaggguaaggugauugaucugggcugcgggcgaggcggcuggagcuauuauugcgccgguuugaaaaaggugacugaagucaagggguacacaaagggcggccccgggcacgaggagccgauccccauggccaccuacggcuggaaccuagucaagcugcacuccgggaaggacguguuuuucacgccgccggagaaaugugacaccuugcucugcgacaucggugagagcucaccgaaccccacgaucgaagaagggcgcacccugcgggucuugaagaugguggagcccuggcuccgaggcaaucaguucugcaucaagauccugaaucccuacaugccaagcguggucgagacccuggaacagaugcagagaaaacacggugggaugcucgugcgcaacccgcugucccggaacaguacccacgagauguacuggguguccuguggaacugggaacaucguaagcgccgugaacaugacaucccgcauguuacugaaccgguucaccauggcucacagaaagccuaccuacgagcgugacguggaccugggcgccggcacacggcacgucgccguggagcccgaaguagcuaacuuagacaucauaggccagcguaucgagaacauaaagaacgagcacaagagcaccuggcacuaugacgaagacaacccguacaaaaccugggccuaccacggcucuuacgaggucaaaccuuccggaucagcgagcucgauggugaacgggguggugcggcuccugaccaaaccuugggaugugauccccauggucacgcagaucgccaugaccgacaccaccccuuucgggcaacagcgcguguucaaggagaagguggacacccgcacgccccgggccaagcggggcaccgcccaaaucauggaagucaccgccaaauggcuguggggcuuccuuagccgcaacaagaagccccggaucugcacgcgcgaggaguucacccggaaggugcgcaguaacgcggccauaggggcugucuuugucgaugaaaaccaauggaauagcgccaaggaagcgguggaggacgagcgcuucugggaccugguacaccgcgaacgggagcugcacaaacagggaaaaugcgcaacgugcguguauaacaugauggggaagcgcgagaagaagcucggugaguucgggaaagcgaagggcucucgugccaucugguacauguggcugggcgccagguuucuugaguucgaggcucucggguuuaugaaugaggaucauugguuuucccgggaaaacagcuuaucuggagucgagggggagggccugcacaagcucggguacauuuuacgcgacauaagcaagaucccuggcgguaacauguacgcggacgacaccgccgggugggauacgcggaucacggaggacgaccugcagaacgaggcgaagauuacugacaucauggaacccgagcacgcccuccuggcgacguccauauuuaaguugacguaccaaaauaaggugguccgggugcagaggcccgccaaauccggcaccgugauggaugucaucagcagacgagaucagcgggggaguggccagguaggcaccuacgguuugaacacguucacgaacauggaggugcagcuaauccgccagauggaguccgaggggauuuuccugccuagcgagcucgagaccccuaaccuagccaagaagguucuggacuggcucgagaagcacggggccgagaggcugaagcgcauggcaauauccggugaugacugcgugguaaaacccaucgacgacagauuugcgaccgccuugaccgcccugaacgauauggggaagguccgcaaggacaucccccagugggagcccagcaagggguggaaugacuggcaacaggucccguucugcucccaucacuuccaccagcugaucaugaaggauggccgggagauugugguccccuguagaaaucaagacgaacugguggggcgugcccgcguuagccagggcgccggguggagucuccgcgagacggcgugccugggcaagaguuacgcccagauguggcagcugauguacuuccaccgcagagaccucagacuggcagccaaugcaauaugcuccgcagucccgguggacugggucccgacgucucgaacuacuuggucaauccacgcucaccaccaauggaugacuacggaagauaugcuguccgucuggaaucgcguguggaucgaggagaacccguggauggaggacaagacccacgugagcuccugggaagaggucccguaccucgggaagcgggaggaucaguggugcggcagccugaucggccuaaccgccagggccaccugggcaaccaacauacaaguggccaucaaccaggugcgccgguuaauugggaacgagaacuaucucgacuauaugaccuccaugaagcgcuucaagaacgagagcgaccccgagggcgcccugugguga

SEQ ID NO: 23729 - RNA, 9879 nt, Artificial Sequence
  derived and/or modified CDS sequence (opt11) from DENV-1__JX669465__SS-prME
agcgugaccaugcugcucaugcugcugccgaccgcccucgccuuccaccugacgacccgggggggggagccccacaugaucgugagcaagcaggagcggggcaaaagccuccucuucaagaccagcgucggggugaacaugugcacccugauagcgauggaccugggcgagcucugcgaggacacuaugaccuacaaaugcccccguaucaccgaggccgagcccgacgaugucgacugcugguguaacgccaccgauaccugggucaccuacgguaccugcagccagaccggcgagcaccggcgcgacaagcguuccguggcacuggcgccccacgucggucuggggcucgagacucguaccgagaccuggauguccuccgagggcgcguggaagcagauccaaaaggucgagacuugggccuugcgacaccccggguuuaccguaaucgcucuguuccucgcccacgcgaucgggaccaguaucacccagaagggcaucaucuucauccuacugaugcucgucacccccuccauggcaaugcgcugcgugggcaucgguaaccgggauuucguggaggggcugagcggcgccacgugggucgacguggugcuggaacacggguccugcgucacaacuauggcaaaaaacaagcccaccuuagauauugagcugcugaagacggaagugaccaaccccgcagugcuccggaagcuguguaucgaggcgaagaucagcaacaccaccacggacucgcgcugcccgacccagggcgaggccacccuggucgaggaacaggacgccaacuucgugugccgccggaccuucguggaccgcggaugggggaacggcugcggcuuguuuggcaagggaucacugcugacgugcgccaaguucaaaugcguuaccaaacucgagggcaagaucgugcaguaugagaaccugaaauauuccgugaucgucaccgugcacaccggugaccagcaucaggucgggaacgagacgaccgagcacggcaccauagcgacgaucacgccccaggcacccacgucggaaauccaacuaaccgacuacggggcccucacccuagacugcagcccccgaaccggccuggacuucaacgagauggugcuccuaacgaugaaggaaaagucuuggcuaguucacaagcaaugguuccuugaccuaccgcugcccuggaccuccggggcgucuaccagccaggagaccuggaaccgccaagaccuccuagucaccuucaagacugcucacgccaagaaacaggagguggugguccugggaucccaggagggcgcgaugcacaccgcccucaccggcgccacggagauccagacuagcggcaccaccacgauauucgccgggcaccugaagugccggcuuaagauggacaagcucacccugaaggguauguccuacgugaugugcacaggguccuuuaagcuggagaaggaaguggcugagacccaacaugggaccguccugguccaggugaaauacgagggcaccgacgcgcccugcaagaucccauuccucacacaagacgagaagggagucacucagaacggccgccugaucacggccaacccgauagugaccgacaaggagaagccagugaacaucgagaccgagccgcccuucggggaguccuacaucgucgugggcgccggugagaaggcccugaagcucuccugguucaaaaagggguccagcaucggcaaaauguucgaggcgaccgcccgcggggcgcgccggauggccauccugggagacacggcuugggacuuuggguccaucggcggccuguucaccagcguggggaagcucauccaccaaguauucggaaccgcguacggggugcuguucucuggcgugucuuggaccaugaagauugguaucggaauacugcucacguggcugggccugaacuccaggagcaccuccuuaagcaugaccugcauugccguugggaugguaacccuauaccuggggguaaugguccaggcugacuccgggugcgugaucaacuggaagggccgcgaacucaagugugggagcgguaucuuugugacaaacgagguccauacguggacagagcaguacaaguuccaggccgacucccccaagcggcugagcgccgcgaucggcaaggccugggaggaggggguguguggcaucagaucugccacccgucuagagaacaucauguggaagcagaucagcaacgagcucaauuacauccugcuggagaaugacaugaaguucaccguggucguaggggacgugaacggcauccucgcccaggggaagaagaugaucagaccccagccuauggagcacaaauacagcuggaaguccuggggcaaggcgaagaucauaggggcggacacgcagaacacgaccuuuaucaucgacggccccgauaccccggaaugccccgacgaccaaagggccuggaacaucugggaagucgaggacuauggcuucggaaucuuuacgacuaacaucuggcugaagcugcgugacagccauacccagaugugcgaucaccgccucauguccgccgcgauaaaggauucaaaggcggugcacgccgacaugggcuauuggaucgagucggagaaaaacgagaccuggaaacuggcgcgcgccagcuucaucgaagugaagacguguaucuggccgaagucccacacccuguggagcaacggcgugcucgaguccgagauggugauaccgaagacauacgggggcccgaucucgcagcauaacuauaggcccggguauuucacccagacggccgggcccuggcaccuggggaagcuggagcucgacuucgaucugugcgaaggcaccacagucguuguggacgagcacugcggcuacagggggccgucccugcguacaacgaccguuaccgggaagaucauccacgagugguguugccgcagcuguacccugccgccccuccgguucagaggagaggauggcugcugguacgguauggagauccggcccgugaaggagaaggaggaaaaccuggugcgcuccauggugagcgcuggcuccggugagauggacaguuucagccuugggauccugugcgucuccauccuuaucgaggaagugaugcggagccgcuggucacggaagaugcucaugacgggcacucuggccguguuuuugcuccugaucaugggucagcuuaccuggaacgaccucauccgccuguguaucauggucggcgcaaacgccagcgaccgaauggggaugggcaccacguaccuggcccucauggccaccuucaagaugcggccgauguucgccguggggcugcuguuccgccgguuaacaucccgcgaagugcugcuccuuacagucgggcugagccugguggccuccguugaacuacccaacagccuggaggagcugggcgacgggcucgccaugggcaucaugaugcugaagcuccucacggacuuccagccccaccagcuuuggaccacucugcucagccugacauucauccggacgagccuaucccucgacuacgcauggaagacuauggcgauggcccugaguaucguguccuuguucccccucugcuugagcacgaccucacagaagaccaccugguugcccgugcucuugggcagcuucggcugcaagccccuaaccauguuccucaucacggagaacaagauuuggggccgcaaguccuggcccaucaacgaggggaucauggccguaggcauuguguccauccugcuguccagccuccugaagaacgacgugccccuagccgggccgcucaucgccgggggcaugcugauagccuguuaugucaucagcggguccagcgccgaucugucccucgagaaggcggccgaggugagcugggaagaagaggcggagcacuccggcacaagccacaacauccucguggagguccaggacgacgggacgaugaagaucaaggaugaggagcgggacgacacccugaccauccuccucaaggcaacccugcucgccguguccggcguguaccccaugagcauacccgccacgcuguucgucugguacuuuuggcagaagaaaaaacagcggagcgggguccugugggacacccccagcccgcccgaggucgagcgggccguccuggaugacgguaucuaccgcauccuccagcggggucugcuggggcgcucccaggugggcguuggggucuuccaggacggcguguuccacaccauguggcacgugacccgcggggcuguccucauguaucaggggaagagacuagagcccagcugggccucggugaaaaaagaccucaucagcuacggugggggcuggcgguuccagggguccuggaacacgggggaggagguacaggugaucgccguggaacccgggaagaaccccaagaacgugcagaccacccccggcaccuucaagacgcccgagggcgaagucggcgccaucgcucucgauuucaagcccgguacgagcggguccccgaucgugaaccgcgaaggcaagaucgugggccuguacgggaacggcgucgugaccaccagugggacguacgugagugcgaucgcccaggcuaaagccacccaggagggaccccugcccgagaucgaggacgaggucuucaagaagcggaaccugaccauuauggaccuacacccggggagcggcaagacccgccgguaccuucccgccaucguaagagaggcgaucaagcggaagcuccgcacucugauccuggcucccacacgcgugguugcauccgaaauggccgaagcgcucaagggcaugcccauccgguaucagaccaccgcugugaagagugagcacacggggcgcgagaucguggaccuaaugugccacgccaccuucaccaugaggcuucucuccccugugcgcgugcccaacuacaacaugaucauuauggacgaggcccacuucaccgacccagccagcauagcggcccgaggcuacaucucaacgcgcgugggaaugggcgaggcagccgccaucuucaugaccgccacgccacccggauccgucgaggccuucccccagaguaacgcagucauccaagaugaagagcgggacauacccgagcgcuccuggaacagcggcuacgauuggaucaccgacuuccccggaaagacugugugguuugucccauccauuaaaaguggcaacgauaucgccaacugccuacggaagaacggcaagcgcgugauccagcugucccggaagaccuucgauacggaguaucagaaaacgaagaacaacgacugggacuacguggucacgaccgauauuagcgagaugggggccaacuuccgcgcggaccgggugaucgacccccgccggugcuugaagcccguuauccugaaggagggccccgagcgcgucauccucgccgggccgaugcccgugaccgucgccuccgccgcgcagcgucgcggucggaucggccgcaaccaaaacaaggagggggaccaguauaucuacaugggccaaccccucaacaacgacgaggaucacgcccacuggacggaggcaaaaaugcugcuggauaacaucaacacgcccgaggggaucauaccggcccucuucgagcccgagcgcgagaagucagccgcgaucgacggagaguaccggcugagaggggaggcccggaaaacuuucguggagcugaugcggcggggagaucucccgguguggcuguccuacaaggucgccagcgagggcuuccaguacucggaccgccgguggugcuucgauggcgaacgcaacaaccaagugcuggaggagaacauggacguggagaucuggaccaaggagggcgagcggaagaaacuccgcccacggugguuagacgcccggaccuauagcgauccgcuggccuuacgggaguucaaggaguucgcggccggucgccggucuguuagcggcgaccugauccuggagauagguaaguuaccccagcaccugacccugcgcgcccaaaaugcccucgacaaccuggugaugcugcacaacagcgagcagggagggaaggccuaccggcacgcgauggaggagcuccccgacacgauagagacucucaugcuguuagccuugaucgccgugcugaccgggggagucacccucuucuuccuguccgggaaaggcuuaggcaagacuagcaucgggcuccugugcgugauggccuccagcgcgcugcucuggauggccuccguagagccccacuggauagcagcaagcaucaucuuagaauucuuccugaugguccucuugauaccggagcccgaucgccagcggacgccccaggacaaccagcuggccuacguggugaucggacuacuguuuaugauacugaccguugcggcuaacgagauggggcuccuggagaccacgaagaaggaccugggcauagggcacguggccguggagaaccaccaccaugccaccaugcucgacgucgaccugcgcccagccuccgcguggacccuguacgcaguggccaccacagugauaacccccaugaugcgacacaccauagagaauacuacggccaacauaagccucacagccaucgcgaaccaggccgccauccugaugggccuggacaagggcuggcccaucuccaagauggacaucgggguuccccugcuggcccuggguugcuacagccaagugaacccacucacccugaccgccgcggugcugaugcuagucgcccacuacgccaucaucgggcccggccugcaggccaaggcuacccgcgaggcccagaagcgcaccgcggccgggaucaugaagaaccccacaguggauggaaucgugaccaucgaccucgaccccgucguguacgacgccaaguuugagaagcagcucggccagauuaugcugcugauccugugcacgucccagauccugcugaugcggaccaccugggcgcucugugagucuaucacguuggccaccgggccgcugaccacccucugggagggcucgcccggcaaguucuggaauaccacgaucgcugugucgauggccaacauuuuccgcggcucuuaccuagccggcgccgggcuggccuuuagccucaugaagucccugggcgggggccggcgugggaccggugcccagggcgagacccugggggagaaauggaagcggcagcucaaucagcugagcaaguccgaauucaacacguacaagaaguccgggaucauggaagucgaccggucugaggcgaaggaaggccugaagcggggcgaaacgacuaaacaugccguaucacgcgggaccgcgaaguugcggugguucguggagcggaaccucgugaagcccgagggcaaggugaucgaucugggcugcgggcggggcggguggagcuacuacugcgccggccugaagaaggugacugaggugaaaggguacaccaaaggcggccccgggcacgaagagccgauccccauggcgacguacggcuggaaccucguuaaauuacauuccgggaaggacguguucuuuacaccccccgagaagugcgacacccugcucugcgacaucggcgagucaagcccgaaccccacgaucgaggaggggcgcacccugcggguuuugaagaugguggagcccuggcuccgcggaaaccaguucugcaucaagauccugaaccccuacaugccaagcguggucgagacucuagagcagaugcagcggaagcauggggggaugcucgugaggaacccccugucccgcaacaguacccacgagauguauuggguauccugcggcaccgggaacaucguguccgcugugaacaugacgaguagaaugcugcucaaccgguucaccauggcccaccgcaagcccaccuacgagcgcgacguggacuugggugccggcacccggcacgucgcaguggagccugaggucgccaaccuggacaucauagggcaacgcaucgagaacaucaagaaugagcacaaaucaacguggcacuacgaugaagauaacccguacaagacaugggccuaccacggcuccuacgaggucaagcccagcggguccgcgagcucaauggugaacggaguuguucggcuccugaccaagcccugggacgugauccccaugguuacccagaucgcuaugacggacaccaccccauucgggcagcagcggguguucaaggagaaaguggauacacggacaccccgcgccaagcggggcaccgcccagaucauggaggucaccgcaaaguggcuguggggcuuccucagccgcaacaagaagccccggaucugcacccgcgaggaguuuacgcgaaaggugcguuccaaugcggcuaucggggccguguucgucgacgaaaaccaguggaacucggccaaggaagccguggaggacgagcgguuuugggaccuggugcaccgggagagggagcuacacaagcagggcaagugcgcgacuugcguauacaacaugauggguaagagggagaagaagcucggcgaguuugggaaggccaagggcagccgggccaucugguacauguggcugggggcccgcuuccuggaguucgaggcgcucggcuucaugaaugaggaccacugguucucccgggagaacagccuguccgggguggagggggagggccugcacaagcucggguauauccuccgcgacaucuccaagauuccgggcggaaacauguacgccgacgauacugccgguugggacacccgaauaacggaggacgaccugcagaacgaggccaagaucaccgauaucauggagcccgagcacgcacuccuugccaccuccaucuucaagcugacuuaccagaacaaggugguccgcguccagcgccccgcaaagagcggcacugucauggacguuaucucccggcgcgaccagcguggaagcggccaggugggaaccuacgggcucaacaccuucacaaacauggaggugcagcucauccggcagauggagucugagggcaucuucagccccucagagcuggagaccccgaaccucgccaagaagguccuggacuggcuggagaagcacggggccgagcggcucaaacgcauggccaucagcggcgaugacugcguggugaagcccauugacgacagguucgcgaccgcccugaccgcguuaaacgacauggggaagaucagaaaggacaucccccagugggagccaucaaagggcuggaacgacuggcagcaaguccccuucugcucacaccacuuucaucagcucaucaugaaagacggcagagagauuguggugcccugcagaaaucaggacgagcucgucggucgugcccgcgugucccagggcgccggguggagccuccgggagaccgcgugccucggcaagagcuaugcacagauguggcagcuaauguacuuccaccgccgggaccugcgccucgcugcgaacgcgaucuguagcgcggugcccgucgacugggugcccaccucucggacgaccugguccauccacgcccaccaccaauggaugaccaccgaagacauguugagcguauggaaccgcgucuggaucgaggaaaacccguggauggaggacaagacgcacguguccuccugggaggaggugcccuaccuggggaaacgcgaggaccaauggugcggcucccucaucggccugaccgcccgcgccacuugggcaaccaacauccagguagccaucaaccaggugcgccggcugaucgggaacgagaauuaccuugacuacaugacgagcaugaaacgcuucaagaacgagucggaucccgagggcgcccugugguaa

SEQ ID NO: 23730 - RNA, 9879 nt, Artificial Sequence
  derived and/or modified CDS sequence (opt11) from DENV-1__JX669466__SS-prME
ucggugaccaugcuuuugaugcuguuaccgacugcacucgccuuccaucugaccacccgcggcggggagccucacaugauugucagcaagcaggagcggggcaaaucacugcuguucaaaacauccgccggggugaacaugugcacccugauugccauggaccugggagagcucugcgaggacaccaugacuuacaagugcccucggaucaccgaggccgaaccagacgacguggacugcuggugcaacgccaccgacacaugggucaccuacgggaccugcagccagaccggggagcaccggcgcgagaaaagauccguggcccuggcgccccacguaggccugggccuggagacccgcaccgagaccuggaugagcuccgagggcgccuggcggcagauccagcgcgucgagacaugggcucugcggcacccuggguucaccgugaucgccuucuuccuggcgcacgccaucgguaccuccaucacucaaaaagguaucauuuucauacuacugaugcuggucaccccauccauggccaugagaugcgucggcaucggaaaccgugacuucguggaggggcucagcggcgccacguggguagaugucgugcuggagcacggguccugcgugaccaccauggccaagaacaaaccuacccuggacauugagcuccugaagacggaggugacaaaucccgcggugcuacgcaaacucugcauugaggccaagaucagcaacaccaccacggauucccgauguccgacccaaggcgaggccacccucguggaggagcaggaugccaauuucgucugucgucgcacguucguggaccgcggcugggggaacggcugugggcuguucggcaaggggagccuccugacaugcgccaaauucaagugugucaccaagcuggagggcaagaucgugcaguacgagaaccucaaguacuccgugaucgugaccguccauaccggcgaccaacaccagguagggaaugaaacgaccgaacacggcaccauagcgacaaucacgccccaggcgcccacgucggagauccagcugaccgacuacggggcccugacccucgacugcaguccccggaccggccuggacuucaacgagaugguccugcucacgaugaaggagaagagcuggcuugugcauaagcagugguuccuggaccuuccacugcccuggacuucaggggcuagcaccucucaggagaccuggaaccgccaggaccuacucgugacauucaagaccgcgcacgccaagaagcaggaggucguggugcugggcucccaggaaggagccaugcacacugcccuaaccggugcgacggagauccagaccagcggcaccaccaccauauucgccgggcaccucaagugccggcugaagauggacaagcugacgcucaagggcauguccuacgucaugugcaccgggucuuucaaacuggagaaggagguagcggagacgcagcacggcacgaucuuaguacaggucaaguaugagggcaccgacgcucccugcaaaauccccuuuuccacgcaagaugagaagggugugacccagaacggcaggcugauuacggccaacccgaucgugaccgacaaagagaagcccgucaacaucgagaccgagccgcccuucggugagagcuacaucguggugggugccggcgagaaggcgcuuaaacuguccugguuuaagcgggggagcuccaucggcaagauguucgaggccaccgcacgcggugcccgccgcauggccaucuugggcgacacggcgugggacuucgggucgaucggcggugucuuuaccuccguggggaaacucgugcaccaggucuucggcacugccuacggcguccuguucucuggcguguccuggaccaugaagauugggaucgguauccugcucacguggcugggccugaauagccgcuccaccagccuguccaugacaugcauagcggucgguauggugacccuguaccugggugugaugguccaggccgauuuagggugcgugaucaacuggaaggggcgggagcugaagugcgggagcggaaucuucgugacgaaugagguccacaccuggacggaacaauacaaguuccaggccgacucaccgaaacgucugagcgcggcuauuggcaaggccugggaggagggcgugugcggcauccggagcgccaccagacucgaaaauaucauguggaagcagaucuccaacgaguugaaccacauccugcucgagaacgacaugaaguucaccgugguggugggggacgccaacggcauccuagcgcagggaaaaaagaugauacggccccagccuauggaacacaaguacagcuggaaaagcugggguaaggccaagaucauaggugccgacauucaaaacacgacuuucaucauugacgggccugacaccccggagugccccgacggccagcgcgcuuggaacaucugggagguggaagacuacggguucggagucuuuaccacgaacaucuggcugaaguuacgcgacagcuauacucagaugugcgaccaccggcugauguccgcggccaucaaggacagcaaggccgugcacgccgauaugggauacuggaucgaaucugaaaagaacgagaccuggaagcuugcacgggccagcuucaucgaggugaagaccugcaccuggcccaagucgcacacguuguggagcaaugggguccuggagagugagaugaucauccccaagaucuucgggggcccgauaagccagcacaauuaccgccccggauacuuuacccagaccgcggggcccuggcaccugggcaaguuggagcuagacuuugaccugugcgagggcaccaccgugguggucgaugagcacugcggcaaccguggaccgucccuccgcacaacgacggugaccgggaagauaauacacgaaugguguugccggucaugcacccucccgccccuucgcuuccggggcgaggacgggugcugguacggcauggaaauaagaccaguaaaagagaaggaggagaaccuuguccgauccaugguuagcgcgggcuccggggagguggacaguuuuagucugggcauccugugcgucuccauaaugaucgaagaggugaugcgaagccgcuggucccggaaaaugcucaugaccgggacacuggccguguuccugcuacugaucaugggccaacugaccuggaacgacuugauccgccuuugcauuauggucggggcgaacgcgagcgaccggaugggcaugggcacaaccuaccuggccuugauggccacguucaagaugagaccgauguucgccguagggcugcuguuccgacgcuugacuucacgggagguucugcugcuaaccaucgguuuaucccugguggccucaguggaguugcccaacucgcuggaggagcugggggacggccucgcuaugggcaucaugaugcugaaguuacucaccgaguuccagccacaccagcuguggaccacccugcuuucucugaccuucgucaaaaccacgcugagccucgacuacgccuggaagacaaccgccauggugcugagcaucgugagccucuuccccuugugccugucaaccaccagccaaaagacgaccuggcugccgguccucuuaggcuccuuuggcugcaagccacuaacaauguuccucaucacggagaacaaaaucugggggcgcaaaagcuggccccugaacgagggcauaauggcgaucgggauugugagcauacugcucagcucccuucugaagaaugacgugccacuggcgggcccccuaaucgccggcgggauguugaucgcaugcuacgucauaagcggcagcuccgcugacuuaagccuggagaaggccgcggagguuagcugggagcaggaggccgagcauaguggggccucucacaauauccugguagagguccaagacgauggcacgaugaagaucaaggacgaggagcgggacgacacccucaccauccuccugaaggccacuuuacuggccgugagcgguguguaucccaugaguauccccgccacgcuguucgugugguacuucuggcaaaagaagaagcaacggucuggcgugcucugggacaccccaagcccgccugagguggagcgggccguccuggacgacggcaucuaccgcaucuuacagcgcgggcugcuuggccgcucgcagguggggguaggcgucuuccaggacggaguguuccacaccauguggcacgugacccguggcgccgucuuaauguaucaaggcaaacgacuggagccuucuugggcgagcgugaaaaaggaccucaucuccuacggaggcggcuggcgguuccaaggcuccuggaacacgggggaggaggugcaagucaucgccguggagccuggcaaaaacccgaagaacgugcagaccacccccgguaccuucaagacgcccgagggagaagucggcgcgaucgcgcuggacuucaagccagggacuagugggagcccgaucgugaaccgcgagggcaagaucguggggcuguacgguaauggugucgugaccaccuccgggacguaugugagcgccaucgcccaggccaaggcaucgcaggaggggccccuccccgagaucgaagacgaggucuucaagaagcggaaccuuaccaucauggaccugcacccuggcagcggcaagaccaggagauaccucccugccauagugcgcgaagccauuaagcgcaaguuacggacccugauccucgcccccacgcgcguggucgcaagcgagauggccgaggcccugaaagggaugcccauccgauaccagaccaccgccgugaagagugagcacaccggacgcgagaucguggacuuaaugugucaugcuacguuuacaaugcggcuccuaagcccaguucgcgugcccaacuauaauaugaucaucauggacgaggcgcacuucacagacccggccuccaucgcugccaggggguacaucagcacacgcgugggaaugggggaggccgcggccaucuucaugacggccacaccgccugggucagucgaggccuucccccagucgaaugccgugauccaggaugaggagcgggacauccccgagcgcaguuggaacagcggcuacgacuggaucacagacuucccaggcaagaccguaugguuugugccauccaucaaaagcggcaacgacaucgcgaacugccugcggaaaaacgguaagcgcgugauccagcuaucgcggaagacuuucgacaccgaguaccaaaagaccaaaaacaacgacugggacuacguggucacaacggacaucuccgagaugggcgccaacuuccgagccgaccggguaaucgaccccagacggugccugaagcccgugauccugaaggacgggccagagcgcgucauacucgccggcccgaugccagugaccgucgcgagugccgcgcagcggcgcggccgcauagggcggaaccaaaacaaagagggcgaccaguacguauacaugggccagccccugaacaaugacgaagaucacgcccauuggaccgaggccaagaugcugcucgacaacauuaacacgcccgagggcaucaucccggcgcucuucgagcccgagcgagagaagucugccgccaucgacggggaguaucggcuacgcggcgaggcucggaagacguucguggagcucaugcgccggggggaccugcccguuugguuguccuacaaaguugccagcgagggguuccaguauucggacaggcggugguguuucgacggcgagcgcaacaaccaggugcucgaggagaacauggacguugagaucuggaccaaagaaggggagcggaagaagcuacggccccgguggcuggacgcgcgcaccuacagcgacccgcucgcgcugcgggaguucaaggaguucgcggccggcaggcgcucggugagcggcgaccugauauuggagauugggaagcugccucagcacuuaacacucagggcucagaacgcccuggacaaccuggugauguuacacaacucagagcagggcgggaaggcauaccggcaugcaauggaagaauugcccgacacaaucgaaacgcuaaugcuucuggcucugaucgcgguacucacaggcggggucaccuuguucuuccuguccggcaagggcuuagggaagaccagcaucggccugcuuugcguuacggccagcucagcucuccuguggauggccucugucgagccccauuggaucgcggcuucgaucauccuggaguucuuccuaaugguacugcugauccccgaacccgauagacaacggacaccccaggauaaccagcucgccuacguggucaucggucugcuguucaugauacucaccguugccgcuaacgagaugggccugcuggagacgacgaagaaagaccuagggaucggcuaugucgccgccgagaaccaucagcacgccacuaugcuagacgucgauuugcauccugccucggccuggacccuuuacgcagucgcgacaacggugaucacucccaugaugagacacaccauugagaacaccaccgcuaacaucagccugaccgccauagcuaaccaggcagcgauccuuaugggccucgacaaaggcuggcccaucaguaagauggacauaggcgucccauuacucgcgcucggauguuacagccaaguaaacccgcugacccugacggccgcgguguuaaugcugguagcucacuaugcaaucauuggccccggguugcaggccaaggccacacgcgaggcccagaagcggacagcagccggcaucaugaaaaaccccacgguugauggcaucguugccauugaccucgaucccgugguguaugacgcuaaauucgagaagcagcuggggcagaucaugcugcucauccuaugcaccagccaaauucuacucaugcgcacaaccugggcauugugcgaaagcaucacccuggcgacgggcccgcuuacgacccucugggaagggucccccgggaaguuuuggaauaccaccaucgcagugucuauggccaacaucuuccgggguucuuaucuggccggugcuggccucgcguucucacucaugaagagccucgggggggggcgccgggguacgggcgcccagggugagacccuuggcgaaaaguggaagcggcagcugaaccagcugagcaagucugaguucaacaccuauaagcggagcggaaucauggaggucgaccgcagugaggccaaggagggccugaaacgcggggagaccacgaagcaugcagugucccgaggcacagcgaaacuccggugguucguugagcguaaccuggucaaaccugagggcaaagugaucgaccugggauguggccgcgggggcuggagcuauuacugcgccgggcucaagaaggugacggaggugaagggguacaccaagggggggcccggccaugaggagccgauaccgauggccaccuauggguggaacuuggugaagcugcacaguggcaaagauguuuucuucaugccgccagagaagugcgacacgcucuugugcgacauuggggaaagcucuccgaacccgaccaucgaagagggucgcacguugcggguccucaagauggucgaacccuggcuacgaggcaaucaauucugcaucaagauccugaaccccuacaugccguccguggucgaaacguuggaacagaugcagcgcaagcacgguggcaugcuugugcgcaacccccugucccggaacagcacgcacgagauguacuggguaucgugcgggaccggcaacaucgucagcgccguaaacaugaccucccgcauguuacuuaaccgcuucaccauggcccaccggaaaccgacguacgagcgcgacguggacuuaggagcggggacccggcacguugcugucgaacccgagguggccaaccucgacaucaucggccagcgcaucgagaacaucaagaaugagcacaaaagcaccuggcacuacgacgaggacaaccccuacaagacuugggccuaccauggauccuacgagguuaagcccagcggaagcgccagcucaauggugaacggagucguucggcugcugacgaaacccugggacgugauuccgauggucacgcagaucgcgaugacggacaccacaccguuuggucagcagcgcguauucaaggaaaagguggacacacgaacgccccgggccaaaaggggcaccacgcagaucauggaggucaccgccaaguggcuauggggguuccugagccggaacaagaagccccggaucugcacccgcgaggaguuuaccagaaagguccgcuccaaugccgccaucggcgcuguguucgucgacgagaaccaauggaauagcgcaaaggaggccgucgaagaugagcgguucugggaccuggugcaccgggagcgggagcuccacaagcaaggaaagugugcaacgugugucuauaauaugaugggcaagcgcgagaaaaagcucggcgaauuugggaaggcgaagggcagccgggccaucugguacauguggcucggggcucgguuccucgaguuugaggcccugggcuuuaugaaugaggaccauugguuuucccgggagaacagccuguccggaguggaaggagaggggcuccauaagcugggcuacauccugcgcgacaucagcaagaucccgggcgggaauauguaugcagacgacaccgcuggcugggacacucgcaucaccgaggacgaccuucaaaacgaggccaaaaucacugacaucauggagcccgagcacgcccugcuggcgaccucgaucuucaagcucaccuaccagaacaaaguggugcgggugcaacgcccggcuaagaacgggaccguaauggaugucaucagccggcgcgaccagagggguuccggccaggugggcacguacggccugaacaccuuuaccaacauggagguacagcuuauacgccaaauggagagcgaggggaucuuccuacccuccgagcucgaaaccccgaaccuggccgaacgggcccucgacugguuggaaaagcacggggcugaacgccugaagcggauggcaauaagcggggaugauugcgucguaaaacccaucgacgaucgcuucgccacggcguugaccgcccugaacgacaugggcaaggugcggaaggacaucccccagugggagccuuccaaaggcuggaacgacuggcagcaggugccguucugcagccaucacuuucaucagcugauaaugaaggacgggcgggagaucguggugcccuguagaaaccaggacgagcuagucggccgagcccgcgucucgcaaggggcuggcuggaguuugcgcgagaccgccugucucgggaagucuuacgcgcagauguggcagcugauguacuuccaccggagggaccuccggcuggcagccaacgcaaucugcagcgcggugcccguugacuggguacccgccucccgcacaaccuggagcauucacgcccaccaccaauggaugacgaccgaggacauguugagcguguggaaccgcgucuggaucgaggagaacccguggauggaggacaagacccacguguccagcugggaggagguacccuaccugggcaagcgggaggaccaguggugcggcagucugaucgggcucacugcccgcgccacgugggcgaccaacauccaagucgccaucaaccaggugcggcgccuaaucggcaacgagaacuaccuggacuacaugacgagcaugaagcgguucaagaaugagucggaccccgagggggcccucugguga

SEQ ID NO: 23731 - RNA, 9879 nt, Artificial Sequence
  derived and/or modified CDS sequence (opt11) from DENV-1__JX669467__SS-prME
agcgugaccaugcugcucaugcugcugccuacugcacuugccuuccacuugaccacccggggcggggaaccccacaugaucgugagcaagcaggagcggggcaagagccuucuguucaagaccagcgcgggggugaacauguguacccugaucgccauggaccugggcgagcucugcgaggacaccaugaccuacaagugcccccgaaucacggaggccgaacccgacgacguggacuguuggugcaaugcgaccgacacuugggucaccuacgggacgugcagccagaccggcgagcaccggcgggacaagcgguccguggcccuggcgccgcaugugggccuggggcuugagacucggacggagaccuggaugagcuccgagggcgccuggaagcagauccagaaggucgagacaugggcccugaggcacccgggguucacggugaucgcccuguuccucgcgcacgccaucggaaccagcaucacccagaaggggaucaucuucauccuccugaugcucgugacccccuccauggcaaugcgcugcguugggaucggcaaccgggacuucguggaagggcugucgggcgccacguggguggacgucgugcuggagcacggguccugcgugaccaccauggccaagaacaagcccacccucgacaucgagcuccugaagacggagguaacuaacccggcgguucuccgcaagcuguguaucgaggcaaagaucagcaacaccaccacggacucccggugcccgacacagggcgaggccacacugguggaggagcaggacgccaacuucguaugccgccggaccuucguagaccgcggcugggggaacggcuguggccucuucggcaaggggucacugcugacgugcgccaaguucaaaugcgugaccaagcucgagggcaagaucgugcaguacgagaaccugaaguacuccgugauagugaccgugcauaccggcgaccagcaccagguggggaaugaaacgaccgagcacggcaccaucgcgaccaucacgccccaagcccccacaagcgagauccagcucaccgacuacggggccuugacacuggauugcagcccccggaccggccuggacuucaacgagaugguccuccugacgaugaaagagaagucguggcuggugcauaagcagugguuccucgaccucccgcugcccuggaccuccggggccagcaccagccaggagaccuggaaccgccaggaucuacuggugacguucaaaaccgcccacgcgaagaagcaggaagucguggugcuaggcucccaggagggugccaugcacacggcccucaccggggccaccgagauccagaccagcggcaccaccacgaucuucgccgggcaccugaagugccggcucaaaauggacaaacuuacccuaaagggcacguccuacgucaugugcaccgggagcuucaaguuagaaaaggagguugcggagacgcagcauggcaccgugcugguccaggugaaguacgagggcaccgacgcacccugcaagauccccuucuccacccaggacgagaagggcgugacgcaaaacgggcgccucaucaccgccaacccgauugucaccgacaaggagaagccagugaacauagagaccgaaccacccuucggggagucguacaucguggugggggccggcgagaaggcgcugaagcuguccugguucaagaaggggagcucgaucggcaagauguucgaggccacugcccgcggagccaggcggauggccaucuuaggcgacacugcgugggacuucgggagcauuggcggcguguucaccuccguggggaagcugguccaccagguguucggcacggcuuacggggugcuguucaguggcgucuccuggacgaugaagaucgggaucggcauccuccugaccugguuagggcucaauagcagaucaaccagccugucgaugacuugcauugccguggggauggugacgcuguaccucggcgucauggugcaggccgacagcgggugcgugaucaauuggaagggccgcgaguugaagugcggguccggcaucuucgucaccaacgaggugcacaccuggacugagcaguacaaguuccaggccgacagcccgaagcgacugagcgcggcaaucggcagagccugggaggagggggugugcggcauccgguccgccacccgccucgagaauaucauguggaagcagaucagcaacgagcuaaaccacauccuucuggagaacgacaucaaguucacggucgugguggggaacgccaacggcauccuggcgcagggaaagaagaugauacggccccagccuauggagcacaaguacuccuggaaguccuggggcaaggcuaagauaaucggcgcggacauccagaacaccaccuucaucaucgacgggcccgacacaccggagugccccgacgagcagcgcgccuggaacaucugggagguagaggacuauggcuucgggauuuucacgacaaacaucuggcugaagcuccgggacuccuacacucagaugugcgaccauaggcucaugagcgcugcaaucaaagacuccaaggccguccaugccgacaugggcuacuggauugagagcgagaagaacgagacuuggaagcuggcccgggcguccuucaucgaggugaaaacgugcaucuggcccaagagccacacccucugguccaacggcguccuggagagcgagaugauaauccccaagauguacgggggcccgaucucccagcacaacuacagacccgguuacuuuacccagaccgccggccccuggcaccuggggaagcucgagcuggacuucgacuugugcgagggcacgaccgugguggucgacgagcacugcggcagccgggggccuucccuccgcacaaccacagugacggggaaaaucauccacgaguggugcugccggagcugcacccugccgccccugagguuccgcggggaggacggcugcugguacgggauggagauccgcccugugaaagagaaggaggagaaccuugucagauccauggucagcgccggcuccggcgagguggacuccuucagucucgggauccugugcgucuccauuaugaucgaggaggugaugcgcucccguuggucucgcaagauguugaugaccggcacgcuggccguuuuccugcuccugaucauggggcagcugacguggaacgaccucauccgccugugcaucauggucggugccaacgcgagcgacaagauggggaugggcacaaccuaccuggcccuaauggccacguucaagaugcggccgauguucgccguagggcugcuguuccgccggcucaccucccgcgaggugcugcugcucaccaucgggcugagccuggucgccuccguggagcuccccaauagccuugaggaacuaggcgacgggcucgcgaugggcaucaugaugcugaagcugcuuaccgaguuccagccccaucagcuguggacgacccugcucucccugaccuucaucaagaccacgcugagccucgauuacgccuggaagaccacggccacuguucugagcauaguuucacuauucccccucugccuguccacgaccagccagaagaccaccuggcuuccgguucuccuaggcucguucgggugcaagccccugaccauguuccucauaacggagaacgagaucuggggccgcaagagcuggccccugaacgaggggauaauggccaucggcauuguguccauccugcucagcagccugcugaaaaacgacgugccacuggcggggccgcugauugccggaggcauguugaucgccuguuacgugaucuccgggagcuccgccgaccucagccuggagaaagcugcggaggucuccugggaggaggaggccgagcacagcggcaccucccacaacauccuggucgaagugcaggaugaugggaccaugaagaucaaagacgaggaacgcgacgacacccucacgauacuuuugaaggccacgcuccuggccgucaguggcguauaccccaugagcauccccgccacccuauucgugugguacuucuggcagaagaagaagcagcggucugggguccucugggacacccccuccccgcccgagguugagcgcgcggugcuggaugacgguaucuacagaaucuuacagcggggccuguuggggcgcucgcaggucggcguggggguguuccaggacggcguguuccacacgauguggcaugugacccgcggagccgugcuaauguaccagggcaagcggcuagagcccuccugggccagcgucaagaaggaccucaucuccuacggcgggggcuggcgcuuccaggggagcuggaacaccggcgaggagguccaggugaucgccgucgagccagggaagaauccgaaaaacgugcagaccacucccgguacguucaagacccccgaaggcgaggugggcgccaucgcgcuggacuucaagcccggcaccuccgggagccccaucgucaaccgggagggcaagaucgugggccuguacggcaacggcguggucacaaccuccgggaccuacgugagcgccaucgcccaggccaaggccagccaggagggcccacuccccgaaaucgaggacgagguguucaagaagcgcaaccugacaaucauggaccugcacccggggucaggcaagacgcggcgcuaccuccccgcgaucguccgggaggccaucaagcgcaaacugcggacccugauucucgcccccacccgggugguggccagcgagauggcagaggcccugaagggcaugccgauccgcuaccagaccacggccgucaaguccgagcacaccgggcgggagauaguggaccugaugugccacgccaccuucaccaugcgccuccugagccccguccggguccccaacuacaacaugaucaucauggacgaggcccauuucacggaucccgcguccaucgccgcccgcggauacaucagcacccggguugggaugggcgaggccgcagcgaucuucaugacggccacgccgcccggguccguagaggcauucccccagagcaacgcagucauccaggacgaggagcgcgacauccccgagcgguccuggaacagcggauacgacuggaucacagacuuccccggcaagaccgugugguucgugcccuccaucaagagcgggaacgacaucgccaacugccugcgcaagaacggcaagcgggucauccagcucucccgcaaaaccuucgacaccgaguaccaaaagacgaagaacaaugacugggacuauguggugaccacagacaucagcgaaaugggggcgaacuuccgggcggaccgcgucauagacccgcggagaugccugaaacccgugauccugaaggacggccccgagcgagugauccucgccgggccgaugccugucaccguggccucggcggcccagcgccggggccgcauaggccggaaccaaaacaaggagggggaccaguacgucuacaugggucaaccccugaacaacgacgaggaccacgcccacuggacggaagccaagaugcugcucgauaacaucaacacgcccgaggggauaaucccggcccuguucgagccagaacgcgagaaguccgcggcgaucgauggcgaauacaggcugcgcggggaggcccguaagaccuucguggaacucaugcggcguggcgaccuccccgucuggcuuuccuacaaggucgccucggagggcuuccaauacuccgaccggcgauggugcuuugacggggagcggaacaaucagguucucgaggagaacauggacguugagaucuggacgaaggagggcgagcgcaaaaagcugagaccccgcuggcuggacgcacggaccuauagcgacccgcucgcccugcgagaguucaaggaguucgccgccgggcggcgcagcgucaguggcgaccugauacuugagaucggcaaguugccccagcaccugacgcuccgggcccagaacgcucuggacaaccuugugaugcuccacaacagcgagcaagggggcaaggcguaccgccacgccauggaggagcugcccgacaccaucgaaacccugaugcuccuggcacugaucgccgugcucaccgggggcgucacucuguucuuccuguccgggaagggccucggcaaaaccagcaucggucuccugugcgugaccgcauccucggcccuccuguggauggccuccguggagccccacuggaucgccgccagcaucauccuugaguucuuccuaaugguccugcugaucccggaaccugaccggcaacggacaccccaggacaaccagcucgccuacguggugaucggccuguuguucaugauccuuacggucgcagcaaacgagaugggucugcuggagaccaccaagaaggaccucgguaucgggcacguggccgcugagaaccaccagcacgcgaccaugcuggacguggaccuacacccggccagugccuggacacucuacgccgucgccaccaccgugaucacccccaugaugcggcacacgaucgagaacaccaccgcuaacaucagccucaccgccauugccaaccaggccgccauccugaugggccucgacaagggcuggcccaucucaaagauggaccugggggugccccugcucgcacuagguugcuauucucagguaaauccgcugacgcugaccgccgccgugcugauguuaguggcccacuacgcgaucauugggcccggucuccaggccaaggccacgcgcgaggcccagaagcggaccgccgcggggaucaugaagaaucccacggucgacggcauaguggccaucgaccuggaccccguggucuacgacgcaaaguucgagaagcaacugggccagaucaugcuccugauucugugcaccucccagauccuccugaugcguaccaccugggcccugugcgagagcaucacgcucgccaccgggccgcugaccacgcugugggagggcucccccgggaaguucuggaauacgaccaucgccgugagcauggccaacaucuuccgcggcuccuaccucgcaggcgcgggacuggccuuuagccuuaugaaauccuuaggggguggccggcggggcaccggcgcgcagggcgagacucugggggagaaguggaagcggcagcugaaccaguugagcaagagcgaguucaacacguacaagcgcagcggcaucauggagguggaccggagcgaggccaaggaggggcugaaacgcggcgagaccaccaagcacgccgucucccgggggaccgccaaacuccgcugguucguggagcgcaaccuggugaagccagaggguaaggucaucgaccucggguguggccgcggcggguggagcuacuauugcgcgggccugaagaaggugaccgaggugaagggcuacacgaagggcggucccgggcacgaggaaccgaucccuauggcuaccuacggcuggaaucugguaaagcuccauuccgggaaggacguguucuucaugccgcccgagaagugcgauacccugcugugcgacaucggcgagagcuccccgaaccccaccauagaggaggggcggacgcuccgcgugcugaaaauggucgagcccuggcugcgaggcaaccaguucugcauaaaaauccucaaccccuacaugcccagcguggucgagacccuggagcagaugcagcgcaagcacggcgggaugcuuguccggaauccccuaucccgcaacagcacacacgagauguacuggguguccugcggcaccgggaacaucgugagugccgucaauaugacgucccggaugcugcugaaccgguucacuauggcccaucggaagcccaccuacgagcgcgacgucgaccucggcgccggcacccgccauguggcagucgagcccgagguggccaaccucgacaucaucggacagcguaucgagaacaucaagaacgagcacaagagcacguggcacuacgacgaggacaacccguacaagaccugggccuaccacggcaguuacgaggugaagcccagcggguccgccucuuccauggucaauggcgugguccgccuacucacaaagcccugggacgugauccccauggugacccagauugcaaugacggacaccaccccauucgggcagcagcgggucuucaaggagaagguggacacacggacaccccgggcgaagcgcggcaccgcgcaaaucauggaggugaccgccaaauggcuguggggcuuccugagccggaacaagaagccacgcaucugcacacgggaagaguucacgcgaaagguccggagcaacgcagccaucggggcgguuuucguugacgagaaccaguggaacuccgccaaggaagccgucgaggacgagcgcuucugggauuuaguccaccgugagcgcgagcugcacaagcagggcaagugcgcgaccugcguguacaacaugauggggaagcgugagaagaaacugggcgaguucgggaaggcaaagggcagccgcgccaucugguacauguggcugggcgcgcgguuccuggaguucgaggcccugggcuucaugaacgaggaucacugguucucccgagaaaacagccuguccggagucgaaggggagggccugcacaagcugggguauauccuccgggacaucagcaagaucccgggcgggaauauguacgccgacgacaccgcggggugggacacccgaaucacggaggacgacuuacagaacgaggccaagaucaccgacaucauggagcccgagcacgcccugcucgcgacuuccaucuucaagcugacauaccagaauaagguggugcgcgugcagcgccccgccaagaacggcacggugauggacgugaucagccgccgggaccagcgcggguccgggcaggucggcacuuacgggcugaacaccuucaccaacauggaagugcagcucauccggcagauggagucugagggcaucuucuuccccuccgagcuggagagcccgaaucuggcggagcgcguucucgacuggcuggagaagcacggggccgagcgccugaagcgcauggccauuuccggcgacgacugcgucgugaagcccaucgacgaucgauuugcgacggccuuaaucgcgcugaaugacauggggaagguacgcaaggacaucccgcaaugggaacccagcaaaggcuggaacgacuggcagcaggucccguucugcucccaccacuuccaccaacugauuaugaaggauggucgggagaucguggugccuugccgcaaucaggacgagcucguggggcgggcccgugugucccagggcgccggguggagccugcgugagacagccugucugggcaaguccuacgcccagauguggcagcucauguacuuccaucgccgggaccugaggcuggcggccaacgccauuugcagcgccguaccagucgacugggugcccaccucccggaccaccugguccauccacgcacaccaccaguggaugacgaccgaggacaugcucagcguguggaaccgcgucuggaucgaggagaauccguggauggaggacaagacucacgugagcuccugggaagaggugcccuaccuggggaagcgggaggaccaguggugcggcagccugaucggccucaccgccagggcgacgugggcaaccaacauccagguggcuaucaaccaggugcgccgccugaucgggaacgagaauuaccuggauuacaugaccucaaugaagcgcuucaagaaugagagcgaccccgagggcgcgcucugguga

SEQ ID NO: 23732 - RNA, 9879 nt, Artificial Sequence
  derived and/or modified CDS sequence (opt11) from DENV-1__HM469967__SS-prME
agcgugaccauguugcuaaugcugaugccgaccgccuuggccuuccaccuuacaacucggggcggggagccccacaugaucgucaguaagcaggagagaggcaagagccuccuguucaagaccagcgcggggguuaacaugugcacccugaucgccauggaccugggcgagcucugcgaggacaccaugaccuacaagugccccaggaucaccgaggccgagccggacgauguagacugcuggugcaacgccaccgauaccugggucaccuaugggacuugcagccagaccggcgagcaccggcgagauaagcggucgguggcccucgcaccccacgugggccuggggcuggagacgcgcaccgagacauggaugucaucggagggcgccuggaaacagauccagcggguggagacaugggcccuccgacaccccggguucacggugaucgcccuguuccuggcgcacgccaucggcaccagcaucacccaaaaggggaucaucuuuauccuccucaugcuggugacccccuccauggccaugcggugcgucggaaucggcagccgcgacuucguggagggguuaagcggcgccacgugggucgacgucgugcuggaacacgggagcugcgugaccaccauggcgaaggacaagcccacucuagacauugagcuacugaagacggaggucaccaaccccgcggugcugcgcaaguugugcaucgaggccaagaucucaaacaccaccacggacagccggugcccgacccagggcgaggccacccugguggaggaacaggacgcgaacuuugucugucggcguaccuucguggacaggggaugggggaacgggugcgggcuuuucggcaaagggucccucauaacgugcgccaaauucaaguguguaaccaagcuugagggcaagaucguccaguacgagaaccugaaauacagugugauugugaccguccauaccggugaucaacaccagguggggaacgaguccacggagcacgggaccaccgcaaccaucacgccccaggcccccacgaccgagauccagcucaccgacuacggggcucugacauuagacugcagcccucgcacgggccucgacuucaacgagaugguccuucugacuaugaaggagaaguccuggcuggugcacaagcagugguuccuggacuuaccccuccccuggaccagcggggcgagcaccucccaggagacguggaaccggcaggaucuacuggucaccuucaaaaccgcccacgcgaaaaagcaggagguuguugugcucgggagccaggagggagccaugcacacggcccugacaggggcaacagagauccagaccuccggcaccaccacgaucuucgcgggacaccugaagugcagacucaagauggacaaguuaacacugaagggcaugagcuaugucaugugcacagggucauucaaguuggagaaggagguagcggagacgcagcacggaacugugcugguccagaucaaguacgagggcaccgacgcccccugcaagauccccuucaguacacaggaugagaaaggggugacgcagaacggccggcugaucaccgcaaacccgaucgugaccgacaaagagaagccuguaaacaucgaggccgagccuccguucggagaguccuacauugugaucggcgcgggcgaaaaggcccugaagcucagcugguucaagaagggguccagcaucggcaagauguucgaggccaccgcccgcggagcccggcgcauggcgauucuuggcgauacagcgugggacuucgguucgaucggcggcguauucaccagcgucgggaagcuggugcaucagaucuucggcacggccuauggggugcuguucuccggggucagcuggaccaugaagaucggcauuggcgugcugcucacauggcucggucugaauucccgcagcacuucccugagcaugaccuguauagccguugggcucgucacccucuaucuaggcgugauggugcaggccgacuccgggugcgucauaaacuggaagggccgggagcucaagugugggagcggcaucuucguuacaaacgaggugcacaccuggaccgagcaguacaaguuccaggcggacagcccgaaacgccuguccgccgccaucggcaaagccugggaggaaggcgucugcggcauacggagcgccacccgccuggagaacaucauguggaagcaaaucuccaacgagcucaaucacauccuguuagagaacgacaugaaguucaccguggugguaggggacguggcgggcauccucgcccaggggaagaagaugauccggccacagcccauggaguacaaguacagcuggaaguccuggggcaaagcuaagauaaucggcgcagacgugcagaacacgaccuucaucaucgacgggcccaacaccccggagugcccugaugaccagcgcgcguggaacaucugggaggucgaggauuacggguucgggaucuucaccacgaauauauggcugaagcugcgcgacagcuacacccaagucugcgaccaucgucucauguccgcggccaucaaggacagcaaggccgugcacgccgauaugggcuacuggaucgaguccgagaagaaugagaccuggaagcuggcgcgggcuagcuucaucgagguuaaaaccugcaucuggcccaaaagccacacgcuguggagcaacggggugcucgaguccgagaugaucauccccaagauuuacgggggcccgaucucucaacacaacuaucgccccggguacuucacccagacugcuggucccuggcaccuggggaaguuggaacuggauuucgaucugugcgagggcaccacgguggucguggacgagcacugcggcaacagagggccgagucugcgcaccacgaccgucacgggcaagaucauccacgaauggugcugccggagcugcacacugccaccccuccgcuuccgcggggaggacggcugcugguacgggauggagauccgccccgucaaggagaaggaggagaaccuggugaaguccauggucucugccggcagcggcgaggucgacuccuucucucucgggcugcugugcauauccaucaugaucgaggaggugaugcgguccagauggucccgcaagaugcucaugaccggcacccuagccguguucuuccugcucaucauggggcagcugacguggaaugaccugauccgccucuguaucaugguaggggcgaacgccucagaucgaauggguaugggcaccaccuaccuagcccugauggccacuuuuaagaugcggccgauguucgcggugggcuuacuauuccgccgucugacuucccgcgaggugcuccuauugaccauagggcucucucuggucgcuucgguggagcugccaaacucgcucgaggagcuaggggacgggcuggccaugggaaucaugauccucaagcugcugaccgacuuccagucccaccagcucugggccacacugcugagccucacguucaucaaaaccaccuucucccugcacuacgcauggaagaccauggcaaugguccugagcaucgugucccucuucccacuuugccugagcacuaccucccagaagaccaccuggcucccuguccugcugggcagccucgggugcaagccgcugacgauguuccugaucgccgagaacaagauuuggggccggaagagcuggccccucaacgaggggaucauggcagucggcaucguaucuauccugcugagcucccuccugaagaacgacguaccccuggccgggccccucaucgccgggggaaugcugaucgcuugcuaugucaucagcgggucgagcgcggaccucucccucgagaaggcugccgaggucagcugggaggaggaggcugagcacuccggcgcgucgcacaauauccugguggaaguccaggacgacgggaccaugaagaucaaggacgaggaacgcgacgauacccugaccauccucuugaaggccacccugcucgccguguccggcguguacccgcugagcauccccgccacgcuuuucguuugguacuuuuggcaaaagaagaagcagcggucuggggugcugugggauaccccuagcccaccuaaaguggagagggccguccuggaugacggcaucuaccggaucaugcagcgcggccugcugggacggucccaagugggcgugggggucuuccaagagaaugucuuccauaccauguggcaugugaccagaggcgccgucuuaauguaccaggggaagcggcuggagcccagcugggcauccgugaagaaggaccugaucagcuacgggggcggauggcgccuccaaggcucuuggaacaccggggaggaggugcaggucauugccguggagccugggaagaacccaaagaacgugcagaccgcgccagggacguuuaagacccccgagggcgagaucggcgccaucgcucuggacuucaagcccgggacgagcggcagccccaucgucaaucgggaggggaaaaucgugggccuguacggcaacgggguggucacgaccucaggcaccuacguaagcgcaaucgcccaagccaaggcaucccaagaggggccgcuccccgagaucgaggacgaggucuuccgcaagcgaaaccugacgaucauggacuuacacccgggcagcggaaagacccgccgguaccucccggcaaucguccgcgaagccaucaagcggaagcugcggaccuugaucuuagcccccacccgcgugguggccucugaaauggcggaggcccugaagggcaugcccauacgguaccagacgacggccguaaagagcgagcacacgggcaaggagaucgucgacuuaaugugccacgccaccuucacgaugcgcuuacuaucccccgugcgggucccaaacuacaacaugauuaucauggacgaggcccacuucacggaccccagcuccaucgccgcccgcggguacaucucgacuagagucggcaugggcgaggcggcggccaucuucaugaccgcaaccccgccgggcuccguagaggccuucccucagucuaacgccgucauccaggacgaggagcgcgacauccccgagcgcuccuggaacagcggcuaugaguggauaacagacuuucccggcaagaccgugugguucgugcccuccaucaaggccggcaacgacaucgcgaacugccugcgcaagaacggaaaacgggucauucagcugagccgcaagaccuuugauacggaguaccagaagaccaagaacucggacugggacuacguggugacuaccgacauaagcgagaugggggccaacuuccgggccgaccgcgucaucgacccgcggcgcugccugaagcccgugauucugaaagacggucccgagcggguaauccuggcuggccccaugccggucacgguggccuccgccgcucagcgcagagggcgcgucggccggaaccacaacaaggagggcgaccaguacaucuacauggggcagccccugaacaacgacgaagaucacgcccacuggaccgaggccaagaugcugcucgacaauaucaacacccccgagggcaucauucccgcucuguucgaaccggaacgcgagaaguccgcagcaaucgacggcgaguaccgccuccggggcgaggcccgcaagaccuucguggagcucaugcggcgcggggaccugcccguguggcuguccuacaaagucgccucagagggcuuccaguacagcgaccggcgcugguguuucgacggcgagcggaacaaccaggugcucgaggaaaacauggauguggagaucuggacgaaggagggggagcgcaaaaaacugcggcccagguggcucgacgcccggaccuacuccgacccccucgcgcuacgcgaguucaaggaguucgccgccggccggcgcagcgucucaggggacuuaauccucgagaucggcaaguugccgcagcaucugacgcagcgggcgcagaaugcucucgacaaccuggugaugcugcacaauagcgagcagggagggagagcuuaccggcaugcuauggaggagcuccccgacaccaucgagacgcucaugcugcucgcccugaucgccgugcucaccggcggggucacccucuucuuccuguccggccgcgggcuggguaagaccaguauaggccuccugugugucauggcguccagcgugcuccucuggauggccuccgucgagccccacuggaucgccgcgagcaucauccuggaguuuuucuugauggugcuccugaucccagagccggaucggcagcguacgccccaggacaaccagcuggcauacguagugaucgggcuccuguucaugauccugaccguggcggccaacgagaugggccuccuggagacuacuaagaaggaucuggguaucggccauguggccguugagaaccaccaucacgccgccaugcuagauguggaucuccaccccgcgucugccuggacccuauacgccguggccacaaccauaaucaccccgaugaugcggcauaccaucgagaacacgaccgccaacaucagucugacggcgaucgccaaucaagccgccauccugauggggcuggauaagggcuggcccaucuccaagauggacaucggcgucccccucuuggcgcuggggugcuacucacaggugaacccgcucacccugacggccgccguguuaaugcucgucgcccacuacgccaucaucggcccggggcugcaagcaaaggccacuagggaagcccagaagcggacggcagcgggcaucaugaagaaccccaccguugaugggaucguagcgaucgaucuggauccggucguauacgacgccaaguucgagaagcagcucggacagaucauguuacugauccugugcacgucccagauccugcugaugcggaccaccugggcuuugugcgagagcauaacccuggccacggguccccugacuacccucuggaagggguccccggguaaguucuggaacaccacgaucgccgucucuauggcaaacaucuuucgcggguccuaccuggccggcgcgggccuagccuucagcuugaugaaaucccucggcggcgggagacgcgggaccggggcgcagggagagacacuuggggagaaguggaagcggcagcucaaccaguugucuaagucugaauucaacaccuacaaacgcuccgggauaauggaagucgaccggagcgaggccaaagagggccuaaagcgcggugagaccacgaagcacgccgucagucggggcaccgccaaacucaagugguucguagagaggaaccuggucaagccggaagggaaggugaucgaucugggcugcggccgcggggguuggagcuacuauugcgccgggcugaagaaggucaccgaggugaagggcuacacuaagggcgggcccggccacgaggagcccauaccgauggcgacguauggguggaaccucgugaagcuucacagcggcaaggacguguucuucaucccgccggagaagugcgacacucugcucugcgacauuggugagucgucgcccaacccgaccauagaggagggcaggacgcugcggguccugaagaugguggagcccuggcuccguaagaaccaguucugcaucaagauccugaaccccuacaugcccagcguggucgagacccuggagcaaaugcaacggaaacacgggggcauguugguccgcaacccguuaucccggaacagcacccacgagauguacugggucuccugcggaaccgggaacauagucagcgccgugaacaugacuucacgcaugcugcucaaccgguucacaauggcccaucgcaagcccaccuaugagcgcgacguggacuuaggcgcagggacccggcacgucgccguggagccagagguggcgaaccuggacaucauaggccagcgcaucgagaacaucaagcacgagcacaagagcaccuggcacuacgaugaggacaaccccuauaagacgugggccuaccacggcuccuacgaggucaagcccuccggcuccgccagcagcauggugaacggcguggugaagcuccugaccaagcccugggacgugauccccauggucacccaaaucgccaugacugauacgacccccuuugggcagcagcgcguguucaaagagaagguggacacccgcaccccgaaggccaagcggggaacggcgcagauaauggaggucacggccagguggcuuuggggguuccucucccggaacaagaagccccggaucugcacgcgggaggaguucacccgcaagguucggagcaacgccgccaucggcgcggucuuugucgacgagaaccaguggaacucagccaaggaggccguggaggaugagcgcuucugggaccuggugcaccgggagcgagaguugcacaaacaggguaagugcgccacaugcguuuacaacaugauggggaagcgggagaagaaauuaggcgaguucgggaaggccaaaggcagccgcgcgaucugguacauguggcugggggcacgguuccuggaguucgaggcccucggcuuuaugaacgaagaucacugguucucccgcgagaacagcuuguccggcguugagggcgagggccugcacaagcuaggauacauccugcgagacaucagcaaaauacccggcgggaacauguaugccgacgacacggccggcugggauacccgcaucaccgaggacgaucugcagaaugaggcgaagaucacggacaucauggagccugaacacgcgcuccuggccaaguccaucuucaagcugaccuaccagaacaaggugguccgggugcaacgaccggcuaagaacggcaccgugauggacgucauuagccgccgggaccagcgcgguuccggccagguggggaccuauggccucaacacguucaccaacauggaggcccagcugauccggcagauggagagcgagggaaucuucuccccuucagagcuggagacccccaaccucgcggagagagugcuggacuggcuggagaaguacgggguagagcggcucaagcgcauggccauuuccggugacgauugcguggucaagccgaucgacgaccgguuugcuaccgccuugaccgcgcugaacgacauggguaagguucgcaaggauaucccccagugggagcccagcaagggcuggaacgacuggcagaaggugcccuucugcucacaccacuuccaccagcucaucaugaaggacggucgggagauaguggucccaugucgcaaccaggacgaacuggugggccgugcgcgcgugagccagggcgccgguuggagccugcgggagaccgcuugccucggcaaguccuacgcccagauguggcagcugauguacuuccaccgccgggauuuacguuuggcggccaacgcaaucugcagcgccguacccguggauugggugcccaccucccggaccacguggagcauccacgcccaccaccaguggaugacaaccgaagacaugcuauccguauggaacagaguuuggaucgaggagaaccccuggauggaggacaagacgcacaucagcuccugggaggacgugccguacuuggggaaacgugaggaccaauggugcggcucccuaaucgggcuuacugcccgugccaccugggccaccaacauccaagucgccaucaaccaaguucgccgcuugauuggcaacgagaacuaccucgacuacaugaccaguaugaaacgcuuuaaaaacgagagcgaccccgagggcgcucugugguag

SEQ ID NO: 23733 - RNA, 9879 nt, Artificial Sequence
  derived and/or modified CDS sequence (opt11) from DENV-1__JX669468__SS-prME
uccgugaccaugcugcucaugcuucugccuacugcacuggccuuucaccugacgacccgcgguggggagccccacaugaucgugagcaagcaggagcggggcaagucgcuccuguucaagaccuccgccggugugaauaugugcacucugaucgccauggacuuaggcgagcucugcgaggacaccaugacauacaagugcccccguaucaccgaggccgagccugacgacguggacugcuggugcaaugccaccgacaccugggucaccuacgguaccugcagccagaccggcgagcaccgacgugauaagcggagcguggcacuggcgccccacgugggccucggucuugagacgcgcaccgagacauggaugagcuccgagggggccuggaagcagauccagaaggucgagacaugggcccugcggcaccccggguucacgguaauugcccuguuccucgcgcacgcaaucggcaccagcaucacacagaaggggauuaucuuuauccugcugaugcucgugacccccucuauggccaugcgcugcguagguaucggaaacagggauuucguugaagguuugagcggcgccacguggguggacguggugcuggagcacgguuccugcgugaccacuauggcgaagaacaagcccacauuggacaucgaacugcugaagacggaagucaccaaccccgcagugcuccgcaagcugugcaucgaggcgaagaucucgaacacaaccacagacucaagguguccgacgcagggcgaagcgacccugguggaagaacaagaugccaacuucgucugccgccgaaccuuuguugaucgcgggugggguaacggcugcggccuguucggcaagggaagccuguuaacgugcgccaaguucaagugcgugacuaaguuggaaggcaaaaucguucaguacgaaaaccugaaguacuccgugauagugaccgugcacaccggcgaccagcaccagguagggaaugagacgaccgaacauggaacgaucgccaccauuacgccccaggcacccacuuccgagauccaacugaccgacuauggggcucucacccuggacugcagcccucggaccggccuggacuuuaacgagaugguccuccugaccaugaaggagaaaagcuggcuaguccacaagcagugguuccucgaccuuccgcugcccuggaccuccggggcgagcacaagccaagaaaccuggaaccgccaagacuuacuggucacguucaagaccgcccacgcgaagaaacaggaggucguggugcugggcucccaggaaggcgccaugcacaccgccuugacuggugccacugagauccagacaagcgguaccaccacgauuuucgcaggacaucugaagugccggcugaagauggacaagcugacccugaagggcacguccuacgucaugugcacaggcagcuuuaagcuggagaaagagguggcggaaacgcagcacggcaccgugcuggugcagguaaaguacgagggcacggacgcccccuguaaaauccccuucucuacccaggacgagaagggggucacgcagaacggccguuuaaucacugcgaaccccaucgugaccgauaaggaaaagccugugaacaucgagaccgagccgccauucggggagaguuacaucguggucggcgcaggcgagaaggcacugaaacuuuccugguucaaaaaggggagcuccauuggcaagauguuugaggcuacugcucguggggcccgccgcauggccauccugggugauaccgcgugggauuuuggaucuaucggcggcgucuucacuuccguggggaaauugguccaccagguauucggaaccgccuacggggugcuauucucgggcguuucauggacgaugaagaucgguaucggcauacuccugacauggcucgggcucaacucgagguccacgagccuguccaugaccugcaucgcagugggaauggugacgcuguaccuuggggugauggugcaggcagauucaggguguguaauuaacuggaagggccgcgaacucaaaugcgggaauggcaucuucgucaccaacgaggugcauaccuggacggagcaauacaaauuccaggcugacucuccgaagaggcuauccgcggccauaggccgcgccugggaagagggggucugcggcauccgaagcgccacccgacuugaaaacaucauguggaagcagauuuccaacgaacugaaccacauccugcucgaaaacgacaucaaguuuacggucgugguggggaacgccaauggcauacuggcgcaggggaagaagaugauucggccucagcccauggaacacaaguacagcuggaagaguugggggaaggccaaaaucaucggcgcagacauccaaaacacuacauucauuaucgaugggccagacaccccggagugccccgaugagcagcgcgccuggaacaucugggaggucgaggacuacggcuucgggaucuucacaacgaauauuuggcugaagcuccgggacagcuauacgcagaugugugaucacaggcugauguccgcggcaaucaaagacagcaaggccguucacgccgacaugggcuacuggaucgagagugagaaaaacgagaccuggaaguuagccagagcgucauucaucgaggugaagacgugcaucuggcccaagucacacacccucuggagcaauggcguuuuggaguccgaaaugauaaucccaaaaauguacgggggcccgaucagccaacauaacuaccgacccggguauuucacgcagaccgccggccccuggcaccuggggaagcucgagcucgacuucgaccugugcgagggcacgaccgugguuguggacgagcauugcggcucgagggggccgagccuccgcaccaccacggugacaggcaagaucauccaugaguggugcugccguucuugcacccugccgccccugcgcuuccguggagaggacgggugcugguacgggauggagaucaggcccgugaaggagaaggaggagaaucucgugcgaucaauggucuccgccggcagcggagaggucgacagcuucuccuuagggauccugugcguuucaaucaugaucgaggaagucaugcgcucccguuggagccgaaaaaugcucaugacaggcacacuggccguguuccuccuacugaucaugggacagcugacauggaacgaccucauccgccucugcaucaugguuggcgccaaugcguccgacaagaugggaauggguaccaccuaccuggcccucauggccacguuuaagaugagaccaauguucgcaguugggcugcuguuucggcggcucacuucacgcgagguauuacuacucacuaucgggcugagcuugguagccagcguggagcuccccaauucccuggaggagcugggggaugggcucgcgaugggaauuaugaugcugaagcugcucaccgaguuccagccccaccagcuguggacgacccugcucagccugaccuuuaucaaaacgacgcugucccucgacuaugccuggaagaccacagccacuguccugagcauaguaucccuguucccccucugccugagcacgaccucccaaaagaccaccuggcugccggugcuccugggcucauucgggugcaagccacugaccauguuccucaucacggagaacgagauauggggccggaaguccuggccuuuaaacgaagggaucauggcgaucggcaucguuagcauucuguuguccucacugcugaagaaugacguuccacucgcggggccgcucauagccggcggcaugcuuauagcgugcuacguuauaucaggguccagcgcggauuugucccuagagaaggccgcugaggucagcugggaggaggaggccgaacacaguggcacgagucacaacauccugguggagguccaagaugacggaaccaugaagaucaaagacgaggagcgcgacgauacucucacaauucuucugaaggccacccuacuggccgucuccggcguguaccccauguccaucccagccacacuguuugugugguacuucuggcaaaagaagaagcagcggucgggggucuugugggacacccccaguccacccgagguugagcgcgcagugcuggacgacgguauauaccggauacugcaaaggggccugcucgggagaucccagguaggaguggguguguuccaagauggcguauuccacacgauguggcacgugacccgcggggcugugcugauguaccagggcaagagacuggagcccucgugggccucggucaagaaggaccuaauaagcuauggagggggcuggcgcuuccaaggguccuggaacaccggcgaggagguccagguuaucgcuguugaacccgggaagaacccaaagaacgugcagacuacgccaggcaccuucaagacgcccgaaggagaaguuggggccaucgcgcuggacuucaagccaggcaccagcggguccccgauaguaaaccgggagggcaagauagugggccuguacgggaacggcguggugaccaccagcgggaccuacguguccgccaucgcccaagcuaaggccucgcaggagggcccacuccccgagauugaggacgagguguuuaagaaacgcaaucugaccauaauggaccugcacccuggguccggcaagacgcggcgcuaccuccccgcgauuguucgggaggcuauaaagcgcaagcugcgcacuuuaaucuuagcccccacucgcgugguggccuccgagauggcggaggcccuuaaaggaaugcccauucgcuaucagaccacggccgucaagucagagcacaccgggcgugagaucgucgaucugaugugccacgccaccuucacuaugcggcuccucucucccgugcggguucccaacuacaacaugaucaucauggacgaggcucacuucacggaccccgcuagcauugccgcucgcggcuacaucagcacgcgggugggaaugggcgaggccgccgcgaucuucaugaccgccacgccgcccggaagcguggaggccuuuccccaguccaacgcugucauccaggacgaagaacgcgauauucccgagcggagcuggaacuccggauacgauuggauaacggacuucccuggcaagaccgugugguucgugccuaguaucaaguccgggaacgauaucgccaauugccugcgcaagaacggcaagcgggucauccagcucagcagaaagaccuucgacaccgaguaccagaagacgaagaacaacgacugggauuacguggugaccacggacaucuccgagaugggagcgaacuuccgugcggaccgggucaucgacccccggcgcugccugaagcccguaauacugaaggacggcccugagcgcgucauucuggcggggcccaugcccgucaccguggcuucggcggcccaacgaagaggccgcaucggaagaaaccaaaacaaagaaggcgaccaguacgucuauaugggccagccccucaacaaugacgaggaccacgcucacuggacugaagccaagaugcugcucgacaauauuaacacccccgaagggauuaucccugcccuguucgaacccgagcgagagaagucggcggcaaucgacggcgaguaucgccuaagaggggaagccagaaagacauucguggaguugaugcggagaggggaccugcccguguggcugaguuacaaagucgcuagcgagggcuuccaauauagcgaccggcguugguguuucgacggggagcggaacaaccagguauuagaagagaacauggacguggaaaucuggaccaaagaaggcgagaggaagaaacuuagaccccgcuggcuugacgcgcggaccuauuccgacccgcucgcccugcgcgaguucaaagaguucgccgcggggcggaggagugucucgggcgaccuaauucucgagauuggcaaacugccccagcaccugacgcuccgcgcccagaacgcccuagacaacuuagugaugcuccacaacuccgagcaaggcgggaaggccuaccgccacgccauggaggagcugcccgacacuauagagacuuugaugcuccuggcacugauagccguguuaaccgggggcgugacacucuucuuccucagcgguaagggccugggcaagaccuccauugggcuucuaugcguuaccgcuaguuccgcacuccucuggauggccagcguugagccccauuggaucgcugccucaauuauccuagaguucuuccuaaugguccugcuaaucccggagccagaucggcagcgcacaccccaggacaaccagcucgcguauguggugauuggcuuacuuuuuaugauccucacgguggcugcuaacgagauggggcugcuagagacgaccaagaaggaccucggcaucgggcacguggccgcugaaaaccaucagcacgcaacgaugcuggauguggaccugcacccagcguccgcauggacauuguacgccgucgccaccaccgugaucacgcccaugaugcggcacacgaucgagaacaccacagccaacaucucccugacugcaauugccaaccaggccgcaauccucaugggccuggacaagggcuggcccaucagcaagauggaccugggcgugccguugcuggcacucggaugcuauucccagguuaacccgcugacucucaccgccgccguguugaugcugguugcucacuacgcgaucaucgggccaggccuccaggccaaagccacucgcgaggcccagaagcggaccgccgcuggaaucaugaagaaccccacggucgacggcauuguggccauagaccuagaccccguggucuaugacgcaaaguucgagaagcagcugggccagaucaugcuccugauucugugcaccagccagauccuacucaugcgcaccaccugggcacugugugagucuaucacguuggccaccgggccgcucacgacccuuugggagggaagccccgggaaguucuggaacacgacuaucgcgguguccauggcgaacauauuccgcggcagcuaccucgcgggagccgggcuggcguucucccugaugaaaucucugggcgggggccgacgcggcacaggggcgcagggcgagacucugggcgagaaguggaagcggcagcugaaccagcucagcaagucggaguucaacacguacaagcgauccggcauaauggagguggaucggagugaggcgaaagagggucucaagcgcggcgaaaccacuaagcacgcaguuagccgggggaccgccaagcugcgcugguucgucgagaggaaccuggugaagcccgagggcaaaguuaucgaccucgguuguggucguggcgggugguccuacuacugugccggacugaagaaggugaccgaagugaagggguacacuaagggcggcccggggcacgaggagccgauccccauggcuaccuacggauggaaccuggucaagcuccauagcgggaaggacguguucuuuaugccgcccgaaaagugcgauacccuuuugugcgauaucggagagucaagcccgaaccccaccaucgaggaggggcggacccuccgcgugcuaaaaaugguugagccuuggcuccggggcaaccaguuuugcaucaagauccucaaucccuacaugcccuccgugguggagacccuugagcagaugcagcgcaagcacggugggaugcugguacggaaccccuugucccgcaauuccacccacgagauguacuggguaagcugcggcaccgggaacaucguuuccgccgucaacaugacgagucgcaugcuauuaaaucgguucacgauggcgcaucgcaagcccaccuacgagcgggacguggacuugggcgccgguacccgacacguagcagucgaaccagagguggcaaaccuggacaucaucgggcagaggaucgaaaacaucaagaacgagcacaaguccacguggcacuacgacgaggacaaccccuacaagacgugggccuaccacgggaguuaugaggugaaaccgucuggguccgcuucauccauggucaacggcguuguccgccuauugaccaagcccugggaugucaucccaauggugacccagaucgcgaugacagacaccaccccguucggccagcagcgggucuucaaggagaagguggacacacgcacuccccgggcaaagcgcggcaccgcccagauaauggagguaaccgccaaguggcuguggggauuuuugucucggaacaagaaaccccgaauaugcaccagagaggaguucacacgcaaaguccguucgaaugccgccauuggggcgguguucguggaugagaaucaauggaacagugccaaagaggcuguggaggacgagcgcuucugggaccucgugcaccgggaacgcgagcugcacaagcaggguaagugugccacuugcguguacaauaugauggggaagcgggagaaaaagcugggcgaguucggaaaggcuaagggcucccgcgccaucugguauauguggcugggcgcgcgguuucuggaguucgaggcccucggguucaugaacgaagaccacugguucagccgggagaacucccucagcgggguggagggggaggguuuacauaagcuggguuacauuuuacgggacauauccaagaucccgggaggcaacauguacgccgaugacaccgcugguugggauacccgcaucacggaggacgauuuacagaacgaggccaagaucaccgacauaauggagcccgaacacgcacugcuggccaccucuaucuucaagcugaccuaccaaaacaagguggugcgcguccaaagaccugccaagaauggcacggugauggacgugauaucccggcgggaccagagagggagcggucaggucggcaccuacggacugaacaccuuuaccaacauggaggugcagcuaaucagacagauggaguccgaaggcaucuucuuccccagugagcucgaguccccaaacuuagcggaacgcguuuuggacuggcuggagaagcacggcgccgagcggcuuaaacgcauggcgaucucuggcgacgacugcguagugaagccgauugacgacagauucgccacggcacucaucgcauugaacgauauggggaaagucaggaaagacauuccccagugggagccuuccaaagguuggaaugacuggcagcagguccccuuuugcucccaccacuuccaucagcugaucaugaaagauggccgggagauaguggugcccugccguaaccaggacgaacucgucggacgggcccgcguuagccagggugccgguuggagccugcgggaaaccgccugccugggaaagaguuacgcgcagauguggcaacugauguacuuccaccgaagagacuuacgccucgcggcaaaugcgaucugcagcgccguucccgucgacugggugcccaccagccggacuaccugguccauccacgcgcaccaucaguggaugacgacugaggacauguugagcguuuggaaccgcgucuggaucgaggagaacccguggauggaggauaagacacacguguccagcugggaagagguaccauaccucggaaagcgcgaagaccaauggugcggcucccugaucggucucaccgcccgcgccacgugggccaccaacauccagguagccaucaaccaggugcgccgguugaucgggaacgagaacuaccuggacuacaugaccagcaugaagcgcuucaagaacgagucugaucccgagggcgcgcuaugguga

SEQ ID NO: 23734 - RNA, 9879 nt, Artificial Sequence
  derived and/or modified CDS sequence (opt11) from DENV-1__JX669469__SS-prME
ucagugacgaugcugcucaugcugcugcccacagcucucgcauuccaucuaacgacccggggcggcgagccccauaugaucgugucuaagcaggagagaggcaagagccucuuguucaaaacgagcgcgggggugaacaugugcacccucaucgcaauggaccugggugagcucugcgaggacacaaugaccuacaagugcccccggauuacugaggccgaacccgaugacguggacugcuggugcaacgcgaccgacaccugggucaccuacgggaccugcucgcaaaccggcgagcaccggcgggacaagagguccguugcccuggcgccccacgugggccuaggucucgagacccgcaccgagaccuggaugaguucggagggcgcauggaagcaaauccaaaaagucgagaccugggcccugaggcacccgggguucacgguuaucgcccuauuccucgcgcacgcuauagggacaagcaucacucagaaggggauuaucuucauacugcugaugcucguaacucccucaauggccaugcgcuguguuggcaucggcaaccgggacuucguggagggccuuagcggggccacguggguggacguggugcucgagcaugggaguugcgugaccacuauggccaagaacaagcccacccucgacauagagcuucugaaaacggaagucaccaaccccgccgugcuucgcaagcugugcauaaaggccaagaucucgaacaccacaacggacucgcggugucccacacagggggaggccacccugguggaggaacaggaugcuaacuucguuugccgccggaccuucguggaccgcggcugggggaacgguugcggccucuucgggaaggggagccuucugacgugcgccaaguucaagugcguuaccaaacucgaggggaagaucguccaauacgagaaccugaaguauuccgugaucgugacaguccacacaggggaccagcaucagguggggaacgagacgacagaacacggcaccaucgcgaccaucacgccccaggccccgaccagcgaaauccaguuaacggauuacggggcucucacccuagacugcagccccaggaccggacuggacuucaaugagaugguccuucugacaaugaaggagaagaguuggcuggugcauaagcaaugguuccucgaccugccgcugcccuggaccucuggcgcuucaaccagccaggagaccuggaaccgccaggaccuucuagugacguucaagaccgcccacgcgaagaagcaagaggucguugucuuagggucccaggagggcgccaugcacaccgcgcuaaccggggccacggagauccaaaccagcggcaccaccacgaucuucgcggggcaccuaaaaugcagauugaagauggacaaacucacccugaagggcacguccuacgucaugugcaccggcucauucaagcucgagaaggaaguggcggagacgcagcauggcaccguacugguccaggugaaguaugaggguaccgacgcgcccugcaagauccccuucagcacccaggacgaaaagggggugacgcaaaacggccgccugaucaccgccaaccccauagucaccgauaaggagaagccagugaacaucgagaccgagccgcccuucggcgaaucguauaucguagucggcgcaggcgaaaaggcgcugaagcuauccugguucaagaaggguucuuccaucggcaagauguucgaggccacggcccgcggggcccggcggauggccauccuuggcgacaccgcgugggacuucggcagcaucggcggcguauucacauccgucgggaagcugguacaccagguguucgggaccgcauacggggugcuguucucaggcgucucguggacgaugaagaucggaaucgguauccucuuaaccuggcugggacucaacagcagauccaccagucuguccaugacuuguaucgccguggggauggugacacuguaucucggugucauggugcaggccgacagcgggugcgugaucaacuggaagggacgcgagcugaaaugcggguccggcauauucgucaccaacgaggugcacaccuggaccgagcaauauaaguuccaggccgacucaccuaagcgguuaagcgcugcgauuggccgugcuugggaggagggugugugcgguauccgguccgcgacccgccucgaaaacaucauguggaaacaaaucagcaacgaguuaaaucacauccuguuggagaacgauaucaaguucaccgucgugguggguaaugccaauggcauccuggcgcagggcaagaagaugauacguccgcaaccaauggagcacaaguauucauggaaaucauggggaaaagcaaaaaucauaggcgcggacauccagaacaccacauuuauuaucgaugggcccgacaccccggagugccccgaugaacagagggcuuggaacaucugggaggucgaggauuacggauucggcauuuucacgacaaacauuuggcugaagcuacgggacuccuacacccaaaugugcgaccaucgucugaugucugcggccauuaaagacucgaaggccguucaugccgauaugggcuacuggauagagagcgagaagaacgagaccuggaaguuggcccgggcgagcuucaucgagguuaagacgugcaucuggcccaagagccacacccucuggucgaacggcguacuggaguccgagaugaucauccccaagauguauggcggcccgaucucccagcauaacuauagacccggguacuucacacaaaccgccggcccauggcaccuggggaagcucgagcucgacuuugaccugugcgagggcacuaccgucgugguagacgagcacugcggcucccgggggccgucuuugagaaccacuaccgugaccggcaagauuauccacgaguggugcugccggagcugcacccugccuccacugcgauucagaggggaggacggcugcugguaugguauggaaauccgacccgugaaggaaaaggaagagaaccucguccgguccaugguaagugccggcagcggggaaguggacuccuucagccuggggauuuuaugcguauccauaaugauagaggaggugaugcgcuccagguggucccgcaagauguugaugacaggcacccuagccguguuucuguuauuaauuauggcacagcuuaccuggaaugacuuaaucagauuaugcauuauggucggggcgaacgccagcgacaagauggguauggggaccacauaccuggcgcugauggccacguuuaagaugcggccgauguucgccgugggguuacuguuccgccgguuaaccagcagagagguguugcugcuuaccaucggccugagccuggucgccuccguggagcuacccaauagcuuggaggagcuaggugacgggcucgccauggggaucaugaugcugaaacuucucaccgaguuucagccccaucagcucuggacgacacuccucucuuugacauucaucaaaaccacccugucucuggacuaugccuggaagacaacggccaugguccugucaaucgugagccuuuucccccucugcuuguccacuacgucgcagaaaaccacguggcugccaguguuacucggauccuucggcugcaagccacugaccauguuccucauuaccgagaaugagauauggggccgcaagagcuggccgcugaacgagggcaucauggcgaucgggauagucucgauucugcucagcuccuugcugaagaacgacgugccucuagcgggcccgcuuauugccggcggcaugcuuaucgccugcuacgugauuucaggcuccuccgcggaccucagcuuagaaaaggcggcagaaguauccugggaggaggaggccgaacauagcgggacgucccauaacauacuggucgaagugcaggacgacggcaccaugaaaaucaaggacgaggagcgggacgacacccucaccauacugcugaaggcaacgcuccuggcagugagcgggguauaucccauguccauccccgcgacccuguucgugugguacuucuggcagaagaagaagcaacggagcggcguccucugggacaccccgaguccgccagagguugagcgcgccgugcuggacgacgguaucuaucggaucuuacagcgcggcuuguuggggcgaagccaggugggggugggcguguuccaggacggaguguuucacaccauguggcacgugacacgcggugcugugcugauguaccaggguaagcggcuggagcccuccugggccagcgugaagaaggacuuaaucuccuacgggggcggguggcgcuuccagggcaguuggaacaccggggaggagguccaggucaucgcgguggagcccggcaagaacccgaagaacguccagacaacgccagggacguuuaagacccccgagggcgaggugggugcgaucgcgcuggacuucaaaccugggacuucaggcagcccgaucgugaaccgcgaggguaagaucguggggcuguauggcaacgguguggucaccacauccggcaccuacgugagcgcgaucgcccaagccaaggcaucacaggaggggccgcuuccugagauugaagacgaggucuucaagaagcgcaaccugacuaucauggaccugcauccgggcuccgggaagacccggagauaccuccccgccauaguccgggaggccauaaagcgcaagcuacgaacgcugauccucgcccccaccaggguggucgccagcgagauggcggaggcccugaagggcaugcccauaagauaucagacaaccgcugucaaguccgagcacacgggccgggagauaguggaccugaugugccaugcuaccuuuaccaugcgccuccugagcccuguucgggugcccaauuauaacaugaucaucauggacgaggcgcacuucaccgaccccgccagcaucgcugcacgcggauacaucuccacacggguggggaugggggaggccgcggccauauucaugaccgccacgccacccggcuccgucgaggccuucccccaaagcaacgccgucauucaggacgaggagcgugacauuccagaacgguccuggaacagcggauaugacuggaucacagacuuuccagggaagacggugugguucgugccgagcauaaagagcggcaacgauaucgcgaauugccugcgcaagaacggaaagcgagucauccagcucucccgcaagacauuugauacagaguaccagaagaccaagaauaacgauugggacuauguggucacgaccgacaucagcgaaaugggcgccaacuuccgggccgacagggucauagacccucggcggugccugaagcccgugauccugaaggacgggcccgaaagggugauccucgcaggcccgaugcccgucacaguggcguccgcugcgcaacgcagagggcgcaucgggcggaaccaaaauaaggagggugaccaauacgucuacaugggucagccccugaacaacgaugaggaccacgcccacuggacagaggccaagauguuguuggacaacaucaacacccccgagggcaucauuccggcgcuauucgaaccggagcgcgaaaaguccgccgccaucgacggggaguaccgccugcggggcgaggcccgcaagaccuuugucgagcucaugcggcggggcgaccuacccguuugguuauccuacaaggucgcgagcgagggcuuccaguauagugaccgacgcuggugcuuugacggagagcggaacaaccaggugcucgaggagaacauggauguggaaaucuggaccaaggagggggaacgcaagaaacugcggccccgguggcuggacgcccguaccuauuccgacccgcucgcccugcgcgaguucaaggaguucgcagcgggacgccgcucugucuccggggaccugauccuagagaucggcaagcugccucaacaccuaacguugcgggcgcaaaacgcacuggacaaucuugugaugcuccauaauucggagcagggugggaaggcguaccgccacgccauggaggagcugcccgacacgaucgagacccugaugcuccuggcucugaucgccgugcucaccggcggcgucacccuguucuucuuauccggaaaagggcucggcaagacgagcaucggguugcugugcgugaccgcuuccagcgcucuccuguggauggccucugucgagccccacuggaucgccgcgucaaucauccuggaguucuuucuaaugguccuguuaaucccggaacccgaccgucagcgcacgccccaagacaaccagcucgccuacgugguuaucgggcuguuguucaugauuuuaaccgucgcggcgaacgagaugggccugcuggaaacuaccaagaaagaucucgggaucggccaugucgcugcggagaaccaccaacacgccacaauccuggacguggaccugcacccggccuccgcauggacccucuacgcggucgcgacaacugugaucacccccaugaugcggcacacgaucgagaacacaaccgccaauaucaguuugacggccaucgcuaaccaagcggcuauucugauggggcuggauaaggguuggccuauuaguaaaauggaccugggcguaccccugcuagcccuggggugcuacagccaggucaacccccugacucucacggccgcagugcugaugcugguggcgcacuacgcaauaauaggacccggucuccaggcgaaggcuacccgagaggcccaaaagcgcaccgcggccggcaucaugaaaaaccccaccgucgacgggaucgucgcuaucgaccuggaucccguggucuaugaugccaaguucgagaaacaacugggccagaucaugcuucucauacucuguacgucacaaaucuugcugaugcgcaccacuugggcgcugugugagagcaucacccuggcaacggggccgcucacaaccuuaugggaggggucccccggcaaguucuggaacacgaccaucgccguaaguauggccaacaucuuccgcggguccuacuuagccggagccggcuuagccuucagccugaugaagucccucgggggcgggcggcgcggcacgggagcccaaggcgagacacugggcgagaaguggaagagacaacugaaucaacucaguaagagcgaauuuaacacauacaagcgaucaggcaucauggagguagaccggagcgaggccaaggaaggccugaaacgcggugagacgaccaagcacgccgucucccgaggcaccgcgaaacuucgcugguucguggagaggaaccuaguaaagcccgagggcaagguaaucgaccuuggaugcgggcgcgggggcuggaguuacuacugcgccgggcuaaagaaagugaccgaggugaagggauauacuaagggcgggcccggccaugaggagccgauccccauggcgacguacggcuggaaucucgugaagcuccacuccggcaaggauguguuuuucaugccgccagaaaagugcgacacccuauuaugugauauaggggagagcuccccgaacccgaccaucgaggagggccggacccuccgagugcucaagauggucgagccauggcugcgggggaaccaguucugcaucaagauccuuaaccccuacaugccaagcguaguggaaacgcuggagcagaugcagcgcaagcacggcgggaugcugguccggaaccccuugucgcgcaacagcacccaugagauguacuggguguccugcgggaccggcaacaucgugagcgcggucaacaugaccucucggaugcugcugaaccgcuucacgauggcacauagaaaacccaccuaugagagagacguggaccucggggcaggcaccaggcacguggcaguugagcccgagguggcuaaccuagacauaauuggccaacggauugaaaacaucaagaacgaacacaagucuacguggcauuaugacgaggacaauccguauaagaccugggcauaccacggaucguacgaagucaagcccagcggguccgccagcuccauggucaacggggugguccgccugcucacaaaacccugggacgugauacccauggugacucagaucgccaugacggauacgaccccguucggccaacaacgagucuucaaggagaagguggauacacgcacgccgcgggccaagcgcgguaccgcccagauaauggaaguuacugcaaaaugguugugggguuucuuaagccggaauaagaagccucgaaucuguacccgggaggaguucacccgcaaaguccggucgaacgcugcgaucggcgccguguucguggacgagaaccaguggaacuccgcaaaagaggccgucgaggacgaacguuucugggaccucgugcacagagagagagaacugcacaagcagggaaaaugugcgacguguguuuacaacaugaugggcaagcgggagaagaaacugggggaguucggcaaggccaaaggaagccgcgccaucugguacauguggcuaggcgcccgcuucuuggaguucgaggcccucggcuucaugaacgaggaccauugguucucccgagagaauagccugucuggggucgagggcgaaggacugcacaaguuaggguacauccuccgggacauuuccaagauccccggagggaacauguacgcugacgauaccgccggaugggauacccgcauaaccgaggacgauuugcagaaugaagccaagaucacggacaucauggaacccgaacacgccuugcuugcgaccuccaucuucaagcugaccuaccagaauaagguggugcggguccaacgccccgcgaagaacggaacagugauggacgugaucagccgucgggaucagcgcgggucuggucaggucggaacguacggcuuaaacaccuucaccaauauggagguacagcuaauccggcagauggagagcgaagggaucuucuuccccagugagcuagaguccccgaaccuagccgagcgcguacuugauuggcuggagaagcauggagccgaacggcugaaacgcauggcgaucuccggggacgacugcgucgugaaaccuaucgacgaucgguucgcaaccgcucuuaucgcgcugaaugacauggguaaggugcgcaaggacaucccccagugggagcccagcaaagguuggaaugacuggcaacaagugccguucugcucacaccauuuccaccaguugaucaugaaagacggccgggagaucguagugccgugccgaaaucaggaugagcucgucggccgggccagggugagccagggggccggcuggagucugagagagacggccugucugggaaagagcuacgcccaaauguggcagcugauguauuuccaccgccgggaucugaggcuggcggccaaugccaucugcagugcaguccccgucgacugggugcccacuucccggaccacguggagcauccaugcccaccaccaguggaugaccacggaggacaugcucuccguguggaaccgcgucuggaucgaggagaacccauggauggaggacaagacccacgugagcuccugggaggaaguuccauaccugggcaagcgagaagaccaguggugcgggagcuuaaucggccucaccgcucgcgccaccugggccacgaacauacaaguugcgaucaaccagguccgccgucugauaggcaacgagaacuaccuggacuacaugacguccaugaagcguuuuaagaacgagagcgaucccgaaggggcccucugguga

SEQ ID NO: 23735 - RNA, 9879 nt, Artificial Sequence
  derived and/or modified CDS sequence (opt11) from DENV-1__JX669470__SS-prME
agcgugacgaugcuguuaauguugcugcccaccgcccucgccuuccaccucacuacccggggcggggagccccauaugaucguuucaaaacaagagcggggcaaaagccuccuguuuaagaccagcgcgggggugaacaugugcacccugaucgccauggaucugggcgagcucugugaggauacgaugaccuacaagugccccaggaucaccgaggccgaaccggacgacguggacugcuggugcaacgccaccgacaccugggucaccuacgggaccuguagccagaccggggagcaccggcgggacaagcgaucaguugcccuagcgccccacgugggacugggguuggagacccggacagagaccuggaugucguccgagggcgcuuggaaacagauacagaaggucgagacaugggcccugcggcacccuggcuucacggucauugcccuguuccucgcgcacgccaucggaacguccauuacacaaaagggaaucaucuucauauugcugaugcucgugacacccuccauggccaugcggugugucggcaucggcaaucgagacuucgucgaggggcugagcggggccacguggguagacguggugcuggagcaugguaguugcgugacuaccauggccaagaauaagcccacccuugacaucgagcugcucaagacggaagucacuaaccccgcgguucugcgcaaacugugcaucgaggccaaaaucagcaacaccaccacggacucccguugccccacccagggcgaggccacccugguagaggaacaggacgcgaacuuugugugccgccggaccuucguggaccgcggcugggggaacggcugcgggcuguucggcaagggcagccuacugacaugcgcuaaguucaagugcgugaccaagcucgaaggcaagauuguccaguacgaaaauuugaaguacuccguuaucgucaccguccacaccggcgaccagcaccaagugggcaacgagacuaccgagcacggcacgaucgccacuaucacaccccaggcgcccacgagcgagauccagcugaccgacuacggagcccugacccuggacuguagcccccggacuggccuggacuucaacgagaugguucucuuaacaaugaaagagaaguccuggcugguccacaaacagugguuccuggaccugccauuacccuggaccuccggggcgucaaccagccaggagaccuggaaccgucaagacuuacuugugaccuucaaaaccgcccacgcaaagaagcaggagguaguggugcugggcucacaggagggcgcgaugcauaccgcccucacuggggccacggagauccagaccucgggaacuacuacuaucuucgcugggcacuuaaagugccgguugaagauggacaaguugacccugaagggcaugagcuacguuaugugcaccgggagcuucaagcuggaaaaggagguggcggagacccaacacggcacgguccugguccaggugaaguacgagggcaccgacgcccccugcaagauccccuucucgacacaggacgagaaaggggucacgcagaaugggcgccucaucacggccaauccgauagucaccgacaaggagaagccugugaauauagagaccgagccgcccuuuggagagucauauaucgugguaggcgccggcgagaaggcauuaaagcuguccugguucaagaaggggagcuccaucggcaagauguuugaggccacggcucgcggggcccgccgcauggcaauccucggcgauacagcaugggacuucggguccauugggggcguguucaccucuguggguaagcuaguccaccaaguguucggcaccgcauacggcgugcuguucagcggcguuucauggaccaugaaaauugggaucggcauacuucuaacuuggcugggccucaacaguagguccaccagcuuaucgaugaccuguaucgugguggggaugguuaccuuguaccucggcgugaugguccaggccgacagcgggugcgucaucaauuggaagggccgcgagcucaagugcggauccggcaucuucgugacgaacgaggugcacacauggaccgaacaguacaaauuccaggccgacagcccgaagagacugagcgccgcgaucggccgagccugggaagagggcgugugcgguauccgguccgccacuagacucgagaauaucauguggaagcagauaagcaacgagcugaaccacauccugcucgagaacgauauuaaguucacaguggugguugggaaugccaauggcauccuggcgcaggggaagaagaugauccggccgcagcccauggagcauaaguauuccuggaaaagcuggggcaaggcgaagaucauuggagccgauauacagaacacgacauuuauuaucgacgggccggacaccccggagugcccugacgagcagcgagcguggaacauaugggagguggaggacuacggcuucgguauuuucacaacgaacaucugguugaagcugcgggacucguacacucagaugugugaccaccgccucaugagcgccgcgaucaaagacuccaaggccguucaugccgacaugggcuacuggaucgagagugagaagaacgaaaccuggaagcuggcccgggcguccuucaucgaggucaaaaccugcaucuggcccaagucacacacgcucuggaguaacggcgugcuagaaucagagaugaucauccccaagauguacggagggcccaucucccaacauaacuaccgucccggcuacuuuacacagacagccggaccauggcaucucgggaagcucgagcucgacuucgaucugugcgagggcaccacuguagucguggaugagcacugcggcagccgggggccuucccuccgcaccaccacagugacggguaagauaauccacgaguggugcugccgcucuuguacgcucccacccuugcgauuccgcggggaggacgggugcugguacgggauggagauucggccuguaaaggagaaggaggagaaucucgugcggagcaugguuagcgccggcagcggcgaagucgacuccuuuagccucggaaucuugugcguguccaucaugauugaggaggugaugcgcagccgguggucccgcaagaugcuaaugacuggcacccuagccgucuuccuguuguugaucauggggcagcugacauggaacgaucucauccgccuaugcaucauggugggugccaaugcaucggacaaaauggguauggguacgaccuaccuggcgcucauggcaaccuucaagaugcggccgauguucgcuguugggcugcuguuccgccggcucacgaguagagaggucuugcuccuaaccauugggcugucucugguagccuccgucgagcuccccaacucuuuggaagaacucggcgacgggcuugcaaugggcauaaugaugcucaagcugcucacagaauuucagccccaccaacuguggacgacacuguuaucccugacuuucaucaagaccacccugagccucgauuaugccuggaagacaaccgcgaugguguuauccaucguuagccuguucccauuaugucucaguaccaccagccagaaaacgaccuggcugccgguccuccugggauccuuuggcugcaagccccugacgauguuccucaucacggagaaugagaucuggggccgcaagucuuggccccucaacgaagggaucauggccguggguaucguuuccauccugcucagcagccugcugaagaacgacgucccccucgccgggccgcugauagcagggggcaugcugauagccugcuacguaaucagugggucguccgccgaucucagccuggaaaaggcagcugagguguccugggaggaagaggcagaacauagugguacaucacacaacauccugguagaagugcaggacgacggcacgaugaagauaaaagacgaagaacgcgacgauaccuugaccauccugcuuaaggcgacccucuuggcagucaguggcguguaccccauguccauucccgccacccuguuugugugguaccucuggcagaaaaagaagcagcggagcgggguccucugggacaccccuagcccacccgaggucgagcgcgccgugcuggaugacgggaucuacagaauccugcaacgcggccuccuggggcgcagccaggugggcgucgggguguuccaggacggcguguuccauaccauguggcaugucacgcguggggcggugcugauguaucagggcaagcgguuagagcccuccugggccucaguaaagaaggaccuaaucuccuacggagguggcuggcgcuuccagggguccuggaacacaggagaagagguccaggugaucgccguggaacccggcaagaauccgaagaacgugcagaccacccccggcaccuuuaaaaccccugagggcgagguaggggccaucgcucuggauuucaagcccggcacuucuggcagccccaucguuaacagggagggcaaaaucgugggccuuuauggaaauggcguggugaccaccuccgguacguacgucagugcgaucgcccaggccaaggccagccaagagggaccacugcccgagaucgaggacgaaguguucaagaagcgcaaccugacuaucauggaucuccacccgggauccgggaagacccggagauacuuacccgccauugugagagaggcgaucaagcgcaagcugcggacccucauccuagcccccacacgcguaguagccucggaaauggccgaggcgcuaaaaggcaugcccaucagauaccagacuacugcgguaaaaagcgagcacaccgggcgagagaucguugaccucaugugccacgccacguucaccaugcgcuugcugagcccgguucgggugccaaacuacaacaugaucaucauggacgaggcccauuucaccgacccggcauccaucgcagcccgcggcuacaucagcacccgggucgggaugggugaggcugccgccaucuucaugacggcgacgccgcccgggaguguggaggccuucccccagagcaacgccgugauccaggacgaggaacgcgacauacccgaacgguccuggaauagcggcuacgacuggaucaccgacuuuccggguaagaccgucugguucgugccuuccauuaagagcgggaacgauaucgccaacugccucagaaagaacggcaagcguguuauucagcuuucccgcaagacuuucgacaccgaauaccagaaaaccaagaacaacgacugggacuauguagugaccacggacaucucugagaugggugccaacuuccgggcggaccgugugaucgacccgcggcggugcuuaaaacccguuauccucaaagacggccccgagcgggugauccuugcagguccgaugcccgucaccguggccuccgccgcgcagaggcgcgggcguauaggccgaaaccagaacaaggagggggaccaguacguguacaugggucagccacuaaacaacgaugaggaccacgcccacuggaccgaggccaagaugcuucuggacaauaucaauacgcccgaggggaucaucccugcccuguucgaacccgagcgcgaaaaguccgcggcaauagacggagaguaccgccuccgcggagaggcccgcaagacguucgucgagcugaugaggcgcggcgacuuacccguuuggcucuccuauaagguggccagcgagggauuccaguacuccgaccggcgcuggugcuucgauggggagcggaauaaccaaguccuggaggagaacauggauguggagauuuggacgaaggagggggagcggaagaagcugcgacccagauggcuugaugcccggaccuacuccgauccguuagcccugcgcgaguucaaggaguucgcugccgggcggcgcucggucuccggcgaccucauccuggagauaggcaagcugccccagcaucucacccugcgggcccagaacgcccuggacaaucucgucauguugcacaacagcgagcagggcggaaaggccuaucgccacgcuauggaagaguugcccgacaccauagagacguugaugcuucucgcgcucaucgcaguucuuacagggggcgugacccuguucuuccucuccgggaagggucuaggcaagaccuccaucgggcugcucugcgucacagccagcagcgcgcuguuguggauggcuuccguagagccccacuggauagcggccagcaucaucuuggaguucuuccuuauggugcuucucauacccgagcccgaccggcaaagaacuccccaggauaaccagcuggccuacguggugaucggccuucuauucaugauacugaccguggcggccaacgaaauggggcuguuggaaaccaccaagaaggaccugggcauaggacaugucgccgccgagaaccaccagcacgccaccauguuggauguggaccuccacccggcguccgcauggaccuuauaugcgguggccaccacgguuaucacccccaugaugcggcauaccaucgagaauaccacugccaacauaucacugaccgcgaucgcgaaucaggccgccaucuugauggggcuggacaagggcuggccuauaagcaagauggaccugggggugccccuccuggcccugggcugcuacagccaggugaacccgcucacccugacugcggccguucugauguugguggcucacuacgcgauuaucgggcccggccuucaggcgaaggcuacgcgcgaggcgcagaagcggacagccgccgggaucaugaagaaucccaccguagacggcaucgucgcgaucgaccuugaccccgugguguacgacgccaaguucgagaaacagcuuggccaaaucaugcucuuaauccucuguacaucccagaucuugcugaugcgcacgacuugggcccucugugaaagcaucacccuggccacgggcccgcugacgacccucugggagggcucuccagggaaauucuggaacaccaccaucgccgucagcauggcgaacauuuuccgcggguccuaucucgccggcgccgggcuggccuuuucacucaugaagagucugggcgggggccggcgugggacgggcgcccagggugagacguugggggagaaguggaagagacagcuuaaccaacucagcaaaagcgaguucaacaccuacaaaagauccggcaucauggagguggaccggagcgaggcgaaggagggccuuaagagaggggaaacuacgaagcacgcagugaguaggggcacugcaaaguuacgcugguucguggagcgaaaccuugugaagcccgagggcaaagugauagacuuagguugugggcgcggcggguggagcuacuacugcgccggacugaagaaggucaccgaggugaagggguacaccaaagguggccccggccacgaggagccgaucccaauggcgacauacggcuggaaccucgugaagcugcacuccgggaaggaugucuuuuucaugccgcccgagaagugcgacacguuacucugcgacaucggggaaucaagcccuaaccccacgaucgaggaggggcggacccugcgcgugcuaaagaugguugagcccuggcuucggggcaaucaauucugcaucaagaucuuaaauccauacaugccgagcgugguggagacccuggagcaaaugcagcgcaaacauggcgggaugcuaguacggaacccgcugucaagaaacucuacgcacgagauguauugggucuccugcggcacugggaacaucgugagcgccgugaacaugaccucgcgaaugcugcucaaccgcuucacuauggcccaccguaagcccacguacgagagagacgucgaucuaggcgcuggcacucgacacguggcagucgaaccagaggucgcgaaucuggacaucauaggacaacguauagaaaacaucaagaacgaacacaagagcacguggcacuacgacgaggacaacccguacaaaaccugggccuaucacggcuccuacgaagugaagcccucuggguccgcaagcuccauggucaacggcguggugcggcuccugacgaaacccugggacgucaucccaauggucacccaaaucgccaugaccgacaccacgccguucgggcagcagcggguguucaaggagaagguggacacgcgaacgccccgggccaagcgaggcacugcgcagaucauggaggugacggcaaaguggcuguggggcuuccuaagccggaacaaaaagccccgcauaugcacccgggaggaguucacccgcaaggugcggagcaacgccgcaauaggggcugucuuuguggacgagaaccaguggaacuccgcgaaagaggcagucgaggaugaacgauuuugggaucuggugcaccgagaacgcgaacugcacaagcagggcaagugcgcaaccugcguuuacaacaugauggggaagagggagaagaagcucggcgaguucgguaaagcuaagggcagccgggcgauaugguacauguggcugggagcgcgauuucuggaguucgaagcccugggguucaugaacgaggaccacugguucagccgcgaaaauagccugaguggaguugagggcgagggccugcacaagcucggcuauaucuugcgggauauaagcaagauccccggcgguaacauguacgccgacgacacugccgggugggacacccgcaucaccgaggacgaccugaggaacgaggcgaagauaaccgauauaauggaaccagagcaugcacuacuggcuacuuccauuuucaagcugaccuaccagaacaaggucgugcgcgugcagcgcccggccaaaaacggcaccgugauggaugugaucucgcggagggaucaacggggguccggccaggugggaaccuacggguugaacacguucacuaauauggagguccaauugaucaggcaaauggagagcgaaggcaucuucuuccccuccgagcucgagucaccgaaucuugcugaacgggucuuagacugguuagagaagcacggggcggagagauugaagcggauggccaucuccggcgacgauugcgugguaaaacccaucgacgaucgcuuugcaaccgcccucauagcuuugaaugacauggggaagguacggaaggacaucccucagugggaacccagcaagggcuggaacgacuggcagcaagucccauucuguucccaccacuuccaccaguugaucaugaaggacggcagggagaucgucgugccgugccggaaccaagaugaacugguggggcgcgcgcgggucucacagggcgccgguuggagccugcgagagaccgccugccucggcaaaucuuacgcgcagauguggcagcugauguacuuucacagacgcgaccugcggcucgccgcuaacgccaucugcagcgccgugcccguggacugggucccgacgucacggaccacauggagcauccacgcccaccaccaauggaugaccacugaggacaugcuguccgucuggaaccguguguggaucgaagagaauccguggauggaggacaagacgcacguuagcuccugggaggaggugccuuaccuggggaagcgcgaggaccaauggugcggcucccuaaucggcuugaccgcgcgagccaccugggccaccaauauucaaguggcgaucaaccaggucagacgccugauuggaaacgaaaacuacuuagacuacaugacguccaugaagcguuuuaagaacgagagcgaccccgaaggggcucugugguga

SEQ ID NO: 23736 - RNA, 9879 nt, Artificial Sequence
  derived and/or modified CDS sequence (opt11) from DENV-1__JX669471__SS-prME
agcguaacgaugcuccugaugcuguuacccacggcucucgcuuuccaccugacuacgcgagggggcgaaccgcacaugauaguauccaaacaagaaaggggaaaaucccuccuuuucaaaacgucggccgggguaaacauguguacacuaauagcgauggaccuaggugaauuaugcgaagauacaaugacauacaaaugccccaggauaacggaagcggaacccgacgacgucgacugcuggugcaaugccacagacacguggguuacuuauggcacuugcagccagacgggcgaacaccgccgcgacaaaagguccgucgcccucgcaccccaugucggauuaggucucgaaacacgaacagaaacauggauguccagugaaggcgcauggaaacaaauacagaaaguugaaacuugggcacucaggcaccccggcuucaccguaauagcucuguucuuagcacacgccauagguacaaguauuacacaaaaagguauaauuuuuauccuccugaugcuagucacacccagcauggcaaugaggugcguagguaucgguaaucgcgacuucguggaaggccugucuggcgcgacuuggguagacgucguccuagagcauggaucaugcgucacaacaauggccaaaaacaaaccgacccuggauauugagcuacuaaaaaccgaagugacuaacccugccgugcugcggaaacuaugcaucgaagcaaaaauaaguaauacaaccacagacucacgaugucccacacaaggagaagccacgcucguggaggagcaagaugcgaacuucgucugcaggcgaacguucguagacagaggguggggcaacgggugcggguuguucgguaaggggucccuacugacgugcgcuaaauucaagugugugaccaaauuggaaggaaagauaguacaauacgaaaacuuaaaauauucaguaauugucacggugcacacaggagaucagcaccaagugggaaacgagacgaccgagcacgggacgaucgcgacgauaacaccccaagcaccaaccagcgaaauacagcucacagacuacggcgcccuaacucuagacuguucuccacgaacaggguuagacuucaacgaaaugguacuacucacgaugaaagagaagaguuggcuaguccacaagcagugguuucuggaucuaccccuacccuggacgucgggagccagcacgucacaggaaaccuggaaccggcaagacuuacuggugacauucaaaacggcacacgccaagaaacaagaagucguaguccucggcucccaggaaggggcuaugcacacggcacuaaccggagcaaccgaaauucaaacaagcgggacaacaacgauauucgcgggacaccucaaaugccggcucaagauggauaaacuaacauuaaagggaaccucguacgucaugugcacaggaucauucaaacuugagaaagaaguugcugaaacccaacauggcaccguacugguacaagugaaauaugaagggacugaugcucccuguaagaucccauucaguacccaggacgaaaaaggaguuacgcaaaacggcaggcugauaacagcaaaccccaucgugaccgacaaggagaaacccguuaacauagaaacagagccgccauucggggaaucauacaucgucguuggagcgggagaaaaggcucuuaaguugucgugguuuaagaaaggaagcagcaucgggaagauguucgaagcaacagcgagaggcgcacgacgaauggcgauacuaggagacacagcaugggacuucgggagcauaggaggcguauuuacaagcgugggcaaacucguacaccaagucuuuggaaccgcguacggaguccuguucagugggguaaguuggacuaugaaaauuggcaucgggauuuugcucacaugguuaggccucaauaguagauccacaagucucucuaugacaugcaucgcggucggaaugguaacucucuaccuuggagucauggugcaggcagacuccggaugcgucauaaauuggaaaggccgcgaacucaagugcggaagugguauuuuuguuaccaacgagguccacacguggacggagcaguauaaauuccaagcagacucccccaagcgccuaagcgccgcaauugggcgugccugggaagagggcgucugcggaauuagaagcgcuacaagacuagagaacaucauguggaaacaaauaucaaacgaguugaaccauaucuuacuagaaaaugauauuaaauucacuguagucgugggaaacgccaaugggauacuagcgcaggguaaaaagaugauacgaccacaacccauggagcacaaguacagcuggaaaagcuggggaaaggccaagauaauaggagcggauauccaaaacacaacauucauaauagacggccccgacacccccgagugcccagacgaacaacgcgcguggaacauaugggagguagaggauuauggcuucggaauauucacaacaaacauauggcuaaagcugagagauucguauacccaaaugugcgaccaccgauuaauguccgccgcaaucaaggacucgaaagccguacacgcagacaugggcuacuggaucgaaucugaaaagaacgagacauggaaacuagcaagggccucguucaucgaagucaaaacauguauauggccgaagucacacacacuuuggagcaacggcguccuggaguccgaaaugauaaucccgaaaauguacggaggaccuaucagucagcacaacuaccgcccuggauauuuuacgcaaaccgccggcccauggcaccucggaaaacuagaacuggacuucgaccucugugagggaaccaccguagucguagaugaacauugugggucucgcgggccuucgcuacgaacaacgaccgucacaggaaaaaucauacacgaauggugcugccguaguugcacccuaccaccgcuccgcuucagaggggaagacgggugcugguacggcauggagaucagaccaguaaaagaaaaggaagagaaucucguccggucaauggucuccgccggaucaggggaaguggacuccuucagccucgguauacuuugcguaagcauaaugaucgaagaagugaugcgcucucgauggagcagaaaaaugcuaaugaccggaacccuggccgucuuccuauugcuaaucaugggccaacugacauggaaugaccucauccgccucugcaucauggucggcgcaaacgccucagacaaaaugggcaugggcaccacauaucuugcacuaauggcgacacugaagaugcgcccaauguucgcagucggccuucuguuccgaagacuuaccucaagggaaguccuccuccucacgaucggauugucccucguagcgagcguugagcucccaaacucacucgaagaacucggcgacggacuugcuaugggcaucaugaugcugaaacucuugacagaguuccagccccaucaacuauggaccacacucuuaucccuaacguucaucaagacaacucuaucgcucgacuaugccuggaagacuacagccaugguccucagcauugucucccuuuucccgcugugccugagcacaaccagccagaagaccacguggcugcccguguuacuugggagcuucggaugcaaaccccucacaauguuccuaaucacggaaaacgaaauaugggggagaaagucguggccacuaaacgagggaaucauggcgauuggaauuguguccauccuacuaucaucccuccugaaaaacgauguaccccuugcaggcccccuaaucgcaggcgguaugcucaucgccuguuaugugaucucgggauccuccgcagaccuauccuuagaaaaagcugcugaagugagcugggaggaagaagccgaacacucaggcacgucccauaacauccuaguagagguacaagacgauggcaccaugaaaaucaaagacgaagaaagagacgacacccugacgauucugcucaaggccacucuccuugcggugucagggguauacccgaugucaauuccugcaacccuguucguaugguauuucuggcagaaaaagaaacagcguucugguguacucugggacacacccagucccccggaaguugagcgagccguccuagacgacgggauuuauaggauacuacagaggggccugcucgggaggagccagguagggguaggaguauuccaagacggcgucuuccacacgauguggcacgugacaagaggggccguguuaauguaccaagguaagaggcuugaacccucaugggccucugucaaaaaggaccuaauaagcuacgggggaggcuggcgauuccagggaagcuggaacacgggagaggaaguccaggucaucgcagucgaacccgggaagaaccccaagaacgugcagacuacaccuggcacguuuaagacaccugagggcgaaguaggggcgaucgcgcuagacuuuaagcccggaacaagcgguagcccgaucguaaacagagaggguaaaauuguggggcucuauggaaacggaguggucacaacgagcggaacauacgugagcgcuauagcccaagcuaaagcaagccaggaagggccccuaccagagauugaggacgaaguguuuaagaaacgcaaccucaccauaauggaccuacaccccgggucagguaaaacacgacgauacuugccagcaauuguccgcgaagccaucaagagaaagcugagaacacucaucuuagcgcccacgcggguuguagcgagcgagauggcagaagcacuaaaagggaugccaaucagguaucaaaccacggcaguaaaaagcgagcacacaggucgggaaauugucgaccugaugugucaugcuacauucacaaugcgauuacucagccccguacgagugccuaauuacaacaugauaauaauggaugaagcccacuucacaguacccgcgagcauagcggcgagagguuacaucagcacacgagucggaaugggggaagcugcagcgaucuucaugaccgcaacuccacccgggaguguagaggcuuucccacaauccaacgcggucauucaagacgaagaaagggacauacccgaaaggucauggaacuccggauacgacuggaucacugauuuucccggaaaaacaguuugguucguccccaguauuaaguccgguaacgauaucgccaacugccuccgcaagaacggcaaacgcgucauacaacucucgcggaagacauuugacacugaguaccagaaaacaaagaacaacgacugggacuacguggugaccacagacauuuccgaaaugggggcuaacuuccgcgcggaccgggucauagaccccagacgcugccucaaaccagugauccuaaaggacggucccgagagggugauucuagcuggacccaugccgguaacagucgcaucggcggcacaacgccgcggacgaaucggacggaaccaaaacaaagaaggagaucaauauguguauaugggacaaccccuaaacaaugacgaggaucacgcucauuggacggaagcaaagaugcuacuggacaauauaaacacaccggagggaauaauccccgcacuauucgaaccggagcgggagaaaagugcagcaauagauggggaguaccguuuaaggggagaggccagaaaaaccuucgucgaauuaaugaggcgaggugaucuaccaguauggcucagcuacaaaguugcguccgagggauuccaguacagcgacaggagguggugcuuugauggagagcggaacaaccagguccuugaggaaaacauggacgucgagauuuggacuaaagagggcgaacgcaagaaacuccguccgcgauggcucgaugcucgaacguacuccgacccacuugcguugcgagaguuuaaagaguucgcggcagggcgacgauccguuucgggggaucucauacuggaaauagggaaacucccccaacaucuuacgcaacgcgcacagaacgcacucgacaaucucgucaugcuccacaauucugaacagggcggaaaagccuaccggcacgccauggaggagcugccggauacaaucgaaacacugaugcuacuggcucucauugcaguccuaacgggcggcgugacacucuucuuucugagcgguaaggggcucggcaaaacaagcauaggacugcuaugcguaacagcaucauccgcgcuucucuggauggccuccgucgaaccccacuggaucgcagcguccauaauccuagaguucuuucugaugguacuacucaucccagagccggacagacaacgaacaccacaagacaaccaacuagcauaugucgugaucggacuccuuuucaugauacuaaccguagcagcaaacgaaauggguuugcuagaaaccaccaagaaagaccuagguauaggccacguagccgcagaaaaccaucagcacgcaacuaugcuggacgucgaccuacacccagccagcgcauggacgcucuacgcggucgcaaccacuguuaucacucccaugaugcggcauacgauagagaacacaaccgcaaacauaagucuaacggcuaucgccaaucaggcugcaauacugaugggccucgacaaaggauggccaauaagcaaaauggacuuaggagugccgcuccuagcacuugggugcuauagucagguaaacccacuaacccucaccgccgcggugcucaugcuuguggcucacuacgccaucauagggccgggucugcaagcaaaagcaacacgcgaggcccaaaagcgaaccgcggccggaauaaugaaaaaccccacagucgacggaauaguagccauagauuuagacccgguaguguacgacgcaaaguuugaaaaacaguuagggcagauaaugcugcucaucuuaugcacgagucaaauucuuuugaugcgaacaacaugggcacuaugugaguccauaacccucgccaccggaccccuaaccacauuaugggaaggcuccccggguaaauucuggaacacgacgauagcgguauccauggccaacauauuccgaggcucuuacuuggcaggagcgggacuggcguucagccugaugaaaucucucggcggcggccggcgcggcacaggugcgcaaggcgagacacugggcgaaaaguggaagcgacaacuuaaccaacuuaguaaaagcgaguucaauacauacaagagaucaggcaucauggaagucgaccguucagaagccaaagaggggcucaagagaggcgagacgacgaaacacgcaguaucgagggguacggcaaaauuacgcugguucgucgaaagaaacuuagucaagccggaaggcaaagugaucgaccuaggguguggcagaggcggcuggucauacuauugcgcaggauuaaagaaaguuacagagguuaaaggauauacgaaagggggaccaggucacgaagaaccgaucccuauggcaacauacggguggaaccuaguuaaacuacauagcggcaaagacguguucuucaugccaccggagaaaugcgauacccucuuaugcgacaucggugaaaguuccccgaacccgacaaucgaagaagggcguacgcucagagugcucaagaugguagaaccauggcuccgcgggaaccaauucugcauuaaaauacuaaaccccuacaugccuagcguaguggagacucucgaacagaugcaacgaaaacacggagggaugcuuguaagaaacccgcucagcagaaauagcacccacgagauguacuggguauccugcggcacuggaaacauaguuucagccgucaacaugacaucuaggaugcuccucaaucgguucacgauggcccaccggaagccaacauacgacagggacguagaccugggcgcgggcaccagacacguugcaguagagccggagguagcaaaucuugacaucauagggcagcgcaucgagaacaucaaaaaugaacacaaaucaacauggcacuacgacgaggauaacccuuacaaaacgugggcuuaccacgggagcuaugaggugaaaccaagcgggucagcuaguucuaugguuaacggcgugguccgacucuuaacuaaacccugggacguaauccccaugguaacccaaaucgcgaugacggacacaaccccguuuggccagcaacguguguucaaagagaaaguggacacacgaaccccaagagcaaagcguggaaccgcccaaaucauggaaguaacagcaaaguggcuauggggcuuccuaagucgcaacaagaaaccgcggauauguacccgcgaggaauuuaccagaaaaguccgcagcaacgcagcuauaggugcgguauuugucgacgagaaccaauggaacucagcaaaggaagcggucgaagacgaacguuucugggacuuaguccaccgagagagggaacuacauaaacaaggcaaaugcgccacgugugucuacaacaugaugggaaaacgagagaagaaauugggagaguucggcaaggcaaagggcagccgagcuauaugguacauguggcugggcgcacgguuccucgaguucgaggcgcuuggcuuuaugaaugaggaccauugguuuagccgggaaaacagccucagcggaguagaaggagaggggcugcacaaguugggauacaucuugcgggacauaucaaaaauaccuggaggaaacauguaugccgacgacacagcggguugggauacacgcauaaccgaagacgaccuacaaaacgaggcaaaaauaaccgacauaauggagcccgagcaugcacuauuagccacaucuauauuuaagcuaacauaucaaaacaaagucgugcgcgugcaacgcccggcuaagaacgggaccgucauggacguaauaagcagaagggaccaacgagggucaggccaaguagguacauacggacucaacacuuucacuaacauggaagugcagcucauacgccagauggaaagcgaaggaauauucuucccgagcgagcucgagucgcccaaccuagcagaacggguacucgauuggcuagaaaaacacggggcugaacggcuaaagcgcauggcaauaucaggcgacgacugcguaguaaaaccaauagacgaccgguuugcaaccgcacuuaucgcacuaaaugacauggggaagguaagaaaggacaucccacaaugggagccgucaaaaggauggaacgacuggcagcaagugccauuuuguagucaccacuuccaucagcugaucaugaaggacggccgggagaucguagugcccuguaggaaccaggaugaacuggugggacgggcgcgggucagucaaggugcaggcuggucgcucagggaaacagcaugcuuaggcaaauccuaugcucaaauguggcaacuuauguacuuccaccgaagagaucuaagacuggccgcaaaugcaauaugcagcgccguuccgguagacugggugcccacaucccgaacaacaugguccauccacgcgcaccaccaguggaugacaaccgaggauauguugucggucuggaaucgaguauggauagaggagaaccccuggauggaggacaagacgcaugucaguuccugggaagaaguucccuaccugggaaagagggaagaccaauggugcgggucccuaauuggacuaaccgcaagggcaacgugggccacaaacauccaaguugcaauaaaccagguacguagacuuauuggcaacgaaaacuaccucgacuauaugacgucaaugaagagguuuaagaacgagagcgacccagagggagcccugugguga

SEQ ID NO: 23737 - RNA, 9879 nt, Artificial Sequence
  derived and/or modified CDS sequence (opt11) from DENV-1__JX669472__SS-prME
agcguuaccauguugcucaugcuucugcccacggcauuagccuuccaucucaccacccggggaggagaaccgcacaugaucgugucaaaacaggaacggggaaagaguuuacuguucaaaaccagcgccggggugaacaugugcacauuaaucgcgauggaccuuggugaguugugugaggauaccaugaccuacaaguguccccggaucaccgaagccgaaccagacgacgucgacugcuggugcaacgccaccgacaccugggucacauacgggaccugcagccagaccggagaacaccgucgagacaaacgcaguguggcccuggcaccacauguagggcuuggacucgagacacgcaccgagaccuggaugucgucagagggcgccuggaagcagauccagaaggucgagacuugggcccuaagacacccaggcuucacggugauagcccuguuucuggcgcacgccaucggcacaagcaucacacaaaaggggaucaucuucauccugcuuauguuggucacccccucaauggccaugagaugcgucggcaucgggaaccgggauuucguggagggucucagcggcgccacguggguugacgucgugcuugaacacggguccugcgugacaacaauggccaagaauaagcccacccucgacaucgagcugcugaagacggaggucaccaaucccgcggugcucaggaaauuaugcaucgaggccaagaucucuaacaccaccacggacagucggugcccuacccagggcgaggccacccugguggaggagcaggacgccaacuucgucugccggcggaccuucguggacaggggcugggggaacggcugcggcuuguucggcaaggggagccugcugacgugcgccaaguucaagugcgugaccaagcuagagggcaagaucguccaguacgaaaaucugaaguacuccgugaucgugacaguccacaccggugaccagcaccaagucggcaaugagacgaccgagcacggaaccauagcaaccaucacaccacaggcccccacgagcgagauccagcuuaccgacuacggggcucucacccucgacugcagccccaggacgggccuggacuucaaugagaugguccuccucacgaugaaagagaagucauggcuggugcacaaacagugguuccucgauuugccccuacccuggaccuccggggccagcaccagccaggagacuuggaacagacaagaccugcuggugacguuuaagaccgcacacgcaaagaagcaggaggucgucguacugggcucucaggagggggcgaugcacaccgcccucaccggggcuacggaaauccagaccucaggcacgaccacgaucuucgcgggacaccuuaagugccgguuaaagauggacaaguugacucugaagggcaccuccuacgucaugugcaccggcagcuucaagcuggagaaggagguagcggaaacgcagcacggcaccgugcugguccaggugaaguacgaggguacugacgcgcccugcaagaucccauucaguacccaggacgagaaggggguaacgcagaacggccgccucauuacagccaacccaaucguaaccgacaaggagaagcccgugaauaucgagacugagccgcccuucggggagagcuacauaguuguaggcgccggcgaaaaggcgcuuaaacuuuccugguuuaagaaggggagcuccauaggcaagauguuugaagccacggcacgcggggccagacggauggccauacucggcgacaccgcgugggauuuugggagcauaggcggcguguucaccucgguggggaaacugguccaccagguguucggcacggcuuacggugugcuguucagugguguauccuggacgaugaaaaucgggaucggaauacuccugaccugguugggcuuaaacagccgcuccacgagccugaguaugaccugcauugccgucgguauggugacgcuguaucucggcgucauggugcaagccgacagcggcugcgugauuaacuggaagggccgagagcuuaagugcggguccggcauauucgugaccaaugaggugcauacuuggaccgagcaguacaaauuccaggccgacaguccgaagcggcugagcgcagccauaggccgcgccugggaggaggggguguguggcauccgcuccgccaccaggcucgagaacaucauguggaagcaaaucagcaacgaguuaaaucacauccugcucgagaacgacaugaaguucacuguaguggucgggaaugccaacggcauccuugcccaggggaagaagaugauaaagccucagcccauggagcacaaguacuccuggaaguccuggggcaaagccaaaaucaucggagccgacauccaaaauacuaccuuuaucaucgacggccccgacaccccggaaugccccgacgaacagcgggccuggaacaucugggagguugaggacuacggcuucgggaucuucacgaccaauaucuggcucaaguugcgcgacuccuacacccagaugugcgaccaccggcucaugagcgcggccaucaaggacucgaaggccgugcaugcagauaugggcuauuggaucgagucagagaagaacgagacguggaaguuggcccgagcguccuuuauagaggugaaaacguguaucuggcccaagagccacacgcuuugguccaacgguguccuggagagcgagaugaucauucccaagauguacgggggaccgauuagucagcacaauuaccggcccgguuacuucacgcaaacagccggucccuggcaccugggcaagcuggagcuggacuucgaucugugcgagggaacgacgguuguggucgacgagcauugcggcucuagggggccgucccuccggaccacgacggugacuggcaagaucauccacgaguggugcuguaggagcugcacacugccgcccuuacgguuccguggggaagacggcugcugguacgggauggagauccggccuguaaaggagaaggaggagaaccucguccgcucaaugguaucugccggaagcggcgaaguggacuccuucagccuggggaucuuaugugucuccaucaugaucgaggaggugaugcggagccgcuggucccggaagaugcucaugaccgguacgcuggcaguguuccugcuccuuaucauggggcagcucaccuggaacgaccucauacgauuaugcaucauggucggcgcgaacgcgagcgauaagauggggaugggcaccaccuaccuggccuugauggcuacguuuaagaugaggccgauguucgccgugggguuacuguuccggcgccugacgucccgggaggugcugcugcucacaauaggucugagccuggucgccuccguggagcuccccaauagcuuagaggaguuaggugacgggcucgcuaugggcaucaugauguugaaguuacucaccgaguuccagccccaccagcuguggacgacccuacucucccugaccuucaucaagacuacgcugagccucgauuacgccuggaagaccacggccacaguccuguccaucgugagccuguuuccccucugccuguccacgacaagccagaagacgaccuggcugccggugcuacugggcaguuucgggugcaagcccuuaaccauguuccucaucacggagaacaaaauauggggccgcaagagcuggccccugaacgaagggaucauggccauuggaaucgucuccauccugcucaguagccugcugaagaacgacgugcccuuggcggggccgcugauagccggcggcaugcucaucgccugcuacgugaucucugggagcucagccgaccucucccuggagaaggccgcggaggucuccugggaggaggaggcagagcacagcggcaccucacacaacauccugguggaagugcaggacgacgggacuaugaaaaucaaagacgaggagcgggacgacacccucacgauccugcugaaggccacccucuuggccgucagcgguguguaccccauguccaucccggccacacuauucgugugguacuuuuggcagaagaagaagcagcgcagcggggugcucugggauacccccuccccgcccgagguggagcgggcggugcuggacgacggcaucuacaggauucugcagcguggccugcuggggcgcagccaggucggcguggggguguuucaggacggagucuuucacacgauguggcacgugacacgcggggccguauuaauguaccagggaaagcgccucgaacccaguugggccucuguuaaaaaggaucucaucucuuacggcggggguuggcgcuuccaggggagcuggaauaccggcgaggagguccaagugauagccguagagcccgggaagaacccgaagaacgugcagaccacgcccggaaccuucaagacccccgaaggcgaggugggggccauagcgcuggacuucaagcccggcaccagcgggagcccgauaguuaaccgagagggcaagaucguaggccuguacgggaacggcguggucacaaccuccgggaccuacgugucggcaaucgcccaggccaaggccagccaagagggaccccuccccgagaucgaggacgagguguucaaaaagcggaaccugaccaucauggaccugcacccggggucuggcaagaccagacgguaccucccugcgauaguacgugaggccauuaagagaaagcugcgcacuuuaauccuugcccccacccgggugguagccagcgagauggcggaggcccugaagggcaugccgauacgcuaccagaccacggccgucaaguccgagcacaccggccgcgagauaguggaucugaugugccaugcuaccuuuacaaugcggcuccugagcccgguucgcgucccgaacuacaauaugaucaucauggacgaagcccacuucacggacccugcguccaucgccgcgcguggcuacaucucuacccgcguugggaugggcgaggccgccgcgaucuuuaugaccgcaacgccacccggguccgucgaggccuucccccagagcaacgccgugauacaagaugaggagcgggacauccccgaacguucguggaacagcgguuacgacuggaucacggacuuccccggcaagacgguaugguuugucccguccaucaaaagcgggaacgauaucgccaacugccugcggaagaacggcaagcgcgucauccagcucucccggaaaaccuucgacaccgaguaccagaagacgaaaaacaacgauugggacuacguggugaccaccgacaucagcgagaugggggcgaacuuccgcgcugaccgggucaucgacccacgccggugccugaaaccaguuauccugaaggacgggccggagcgcgugauccucgcggguccgaugcccguuaccguugcguccgcggcucagcggcgcggccggaucggccgcaaccagaacaaggagggggaccaguauguguacaugggccagcccuugaacaacgacgaggaccacgcccacuggacggaagccaagaugcuacucgacaacaucaacaccccagaggggaucauaccggcccuguucgaacccgagagagagaagucugcggccauugacggagaguaccgccugcgcggggaggcccggaaaaccuuuguggagcucaugcgccguggcgaccugcccguuuggcuguccuauaaggucgccucggagggcuuucaauacuccgaccgacguugguguuucgacggagaacgcaacaaucaggugcuggaggaaaacauggacguggagauuuggaccaaggagggagagcggaagaaacugcgcccccgcuggcuggaugcacgcaccuacagcgacccgcucgcgcugcgggaguuuaaagaguuugccgccgggcgacgaagcguauccggcgaccugauccucgagauaggcaagcucccccagcaccugacacuccgcgcccaaaacgcccuagauaaccuggugaugcuccacaacuccgagcagggcgggaaggcuuaccgucaugccauggaggagcuacccgacacuauugagacacucauguuacuggcacugaucgcagugcucaccgggggcgucacucuguucuuccugucggggaagggccucggcaagaccuccaucggucugcuuugcgugaccgcgucgagcgcccuccuuuggauggcauccguggagccccacuggaucgcugccaguaucauccuugaguucuuccuaaugguccuguuaaucccagagcccgaccgccagcggacgccccaagacaaccaacucgcguacgucgugaucggccugcuguuuaugauacucacuguagccgcgaacgagauggggcugcuggagaccaccaaaaaggaccucgggaucgggcacguggcugccgagaaccaccagcacgcgaccaugcuggacguggaccugcauccggccuccgccuggacgcucuacgccgucgccacgacugugaucacccccaugaugcgccauacuauugagaacaccaccgcgaacauaagccuuaccgcuaucgccaaccaggccgccauucugaugggccucgacaaaggcuggcccaucuccaagauggaucugggggugccccugcucgcccugggcuguuacucacagguaaauccgcugacgcucaccgcagcuguacugaugcucgucgcccauuacgcgaucauugggcccggccuacaggcuaaggccaccagagaggcccagaaacgcaccgcagcugggauaaugaaaaaccccacggucgacggcauuguggcgauagacuuggaucccgugguauacgacgccaaguucgagaagcagcucggccagauuaugcucuugauccugugcaccagccagauccuccugaugaggacuacaugggccuuaugugagagcaucacgcucgccaccggcccguugaccacccugugggaggggagccccgggaaguucuggaauaccaccaucgcugugagcauggccaacaucuuccgcggcuccuaccucgccggcgcuggccuggccuucucccugaugaaaucccucggcgggggucgacgggggacgggcgcgcaaggcgagacgcugggagagaaguggaagcgccaacugaaccaauugucuaagagcgaguucaauacguacaagcggagcggaaucauggagguggaccgcagcgaggccaaagaagggcugaagcggggcgagacaacuaagcacgccguaucucgcggcaccgcgaagcugagaugguucguggagcgcaaucuggugaaaccagagggaaagguuaucgacuugggcugcgggaggggcggguggagcuacuacugcgcgggcuugaagaaaguuaccgaggugaagggguacacgaaagggggcccugggcacgaggagccgauccccauggccacuuacggcuggaaccuggucaaguuacacuccgggaaggacguguucuuuaugccgcccgaaaagugugacacccugcugugcgacaucggggagucuuccccgaaccccaccaucgaggaggggcgcacucuacgggugcugaagauggucgagcccuggcuacguggcaaccaguuuugcaucaagauccugaaccccuauaugccgucggugguggagaccuuggagcaaaugcagcguaagcacggcggaaugcugguccgcaacccccucucccggaacagcacccacgagauguacugggucuccuguggcacaggcaauaucgugagcgcugucaacaugaccucccgcaugcugcucaaccgguucaccauggcccaccgcaagcccaccuacgagcgcgacguagaccuuggggcaggcacccgccacguggcggucgagccggagguggccaaccuagacaucaucgggcagcgcaucgagaacauaaagaacgagcacaagagcacguggcacuacgacgaggauaacccguauaagaccugggccuaccauggaucauacgaggugaagcccagcggguccgcaagcuccauggugaacggcguggugcguuuacucacuaagcccugggacgugauucccauggugacccagaucgccaugacggacaccacuccguucgggcaacagcgugucuucaaggagaagguggauacgcggacuccucgcgcgaaacggggcacagcccagaucauggagguuaccgccaaguggcuguggggguuucugucgcggaacaagaagccccguauauguaccagagaggaauuuacgcggaagguccgcagcaacgcagccaucggggcgguuuucguggacgagaaucaguggaacucggccaaggaagcugucgaggacgagcgcuuuugggaucucguucaccgcgagcgggagcugcacaaacaaggcaagugcgcaaccugcguguacaacaugauggggaagagggagaaaaaguugggugaguucggaaaggcgaagggcucuagagcaaucugguacauguggcucggcgcccgcuuccuggaauuugaggcccugggguucaugaacgaagaccacugguucagccgagagaacagccucuccggugucgaaggggaaggccugcacaagcuaggguacauacuaagagacauaagcaagaucccgggcgguaauauguacgccgaugauaccgcggggugggacacccggauaacggaggacgaccuacagaacgaggccaagaucacggauaucauggagccugagcacgcccugcucgccaccuccauauucaagcugaccuaccagaacaaggucgugaggguccagcggcccgcgaagaacgguacggugauggaugugauaagccgccgcgaccagcggggguccggucaggucggcaccuauggguugaacaccuucaccaacauggaggugcagcucauacgucagauggagagcgagggcaucuucuuuccgagugagcuggaaucuccaaacuuagcggagcguguguuggacuggcuggagaaacacggggccgagcggcugaagaggauggccauauccggcgacgacugcguuguaaagcccaucgacgaucgcuuugccacugcccucauugcgcugaacgacaugggaaaagugcggaaggacauaccucagugggagcccagcaagggcuggaaugauuggcagcagguuccguucugcucccaccauuuccaucagcugaucaugaaggacggccgcgagaucguugugccuugcagaaaucaggacgagcuugucggacgcgcccgggugagccagggcgccggauggucccugcgcgaaaccgccugccugggcaagagcuacgcccagauguggcagcucauguacuuucaccggcgggaucugcgucuggcugcgaacgccaucugcagcgccgugcccgucgacugggugccaacgucccgcaccacuuggagcauccacgcgcaccaccaguggaugaccaccgaggauaugcucuccguguggaaccgggucuggaucgaggagaacccguggauggaggauaagacccacguguccuccugggaggaggugccuuaucuagggaaacgcgaggaccaguggugcgguucucugaucggccucacagccagagccacuugggccaccaacauccaggucgccaucaaccaggugagacgacugaucgggaacgagaacuaucuggacuacaugacuucgaugaagcgguucaaaaacgagagugauccggagggcgcgcucugguga

SEQ ID NO: 23738 - RNA, 9879 nt, Artificial Sequence
  derived and/or modified CDS sequence (opt11) from DENV-1__JX669473__SS-prME
agcgugaccaugcuucucaugcugcuccccaccgcccucgcuuuccaccucaccacccggggcggggaaccccacaugaucgugagcaagcaggagcgcggcaagagccuccuguucaagaccucagcgggagugaacauguguaccuugaucgccauggaccucggcgagcucugcgaggacaccaugaccuauaaauguccccgcauuaccgaggccgagcccgacgacguggacugcuggugcaacgccacugacacauggguuaccuacgggaccugcagccagaccggcgagcaccggcgcgacaagcgguccguggcccuggcaccccacgugggccugggucucgagacucgcaccgagaccuggaugagcuccgagggcgccuggaagcaaauccagaaggucgagacgugggcccugcggcaccccggguucacgguuauugcacuguuccuggcgcacgcaaucgggacuagcauaacgcagaaaggaaucauuuucauccugcuuaugcucgugacgcccuccauggccaugcgcugcguugggaucggcaaccgggacuucguggaaggguuaagcggcgcaacguggguggaugucguuuuggaacauggguccugcgugaccacgauggccaagaacaagcccaccuuagacaucgaauuacugaaaacggaggucaccaaccccgcugugcuccgcaagcuaugcaucgaggccaaaaucucuaauacgaccacggacucccggugcccgacucagggcgaggccacccugguggaggagcaggacgcaaacuucguaugccgccggaccuuuguggaccgcggcugggggaacggcugcggguuguucggcaaggggagcuugcugacgugcgccaaguuuaagugcgugaccaaacucgagggcaagaucguccaguacgagaaccugaaguacucggugaucgugaccguucacaccggcgaccagcaccagguggguaacgaaacgaccgaacacgguacaaucgcaacaaucacgccacaggcccccagcagugagauucagcugacggacuacggagcacugacgcuagacugcucgccccggacgggccuggacuucaaugagaugguccuccugaccaugaaagagaaaagcuggcuggugcauaaacagugguucuuggaccugccgcugcccuggacuucuggggccagcacuucccaggaaacuuggaaucgccaggaccucuuggugaccuucaagacggcacacgcgaagaagcaggaggugguggugcugggaagucaggagggcgccaugcacaccgcccuaaccggggcgaccgagauccagacguccgguaccaccacuaucuucgcagggcaccugaagugccggcugaaaauggacaaacucacgcugaagggcaccagcuacgucaugugcaccgggucuuucaagcuggaaaaagagguugcggagacccagcacggcacggugcugguccaggugaaguaugagggcaccgaugcacccugcaaaaucccguucucaacccaggacgagaaggguguuacccagaauggccgccucaucacugcgaaccccaucgucaccgacaaggagaagcccgugaauaucgagaccgagccgcccuucggggagagcuacauuguggucggcgccggcgagaaggcgcugaagcugagcugguucaagaagggguccuccaucggcaagauguucgaggcaacggcccgcggggcccgccggauggcaauuuuaggcgacacggcuugggacuucggcuccauuggcggcguguucaccagcguaggcaagcucguacaccagguauucggaacggccuacggcgugcuguucucaggcgugagcuggaccaugaagaucgggaucggcaucuuacugacguggcugggccucaacuccagauccacgucccuuagcaugacuugcaucgccgugggcauggugacccuguaccucggcguaauggugcaagccgacuccgggugcgugaucaacuggaagggucgggaacugaagugcggcagcggcaucuucgucacgaaugaggugcacaccuggaccgagcaguacaaauuccaagccgauagcccgaaaagacugucggcggccauugguagagccugggaggagggggugugcggcauccggagcgccacccgccucgagaacaucauguggaagcagauauccaaugagcugaaccacauucuccucgaaaacgacaugaaauucaccgucguugucgggaacgccaacggcauccuggcucaggggaaaaagaugaucaaaccccagcccauggagcacaaguacagcuggaagaguugggggaaagccaagaucaucggcgccgauauucagaaugccacguuuauaauagaugggcccgacacccccgaaugcccagacgagcagcgggcguggaacaucugggaggucgaggauuacggcuucgggaucuucacuaccaacaucuggcugaagcuccgcgacagcuacacucagaugugcgaccaucggcugauguccgccgccaucaaggacucaaaggccgugcacgccgacaugggcuacuggauagaguccgagaagaacgagaccuggaaguuagcgcgcgccagcuucauugaggugaagacgugcaucuggcccaagucccacacucucuggagcaacggcguacuggaguccgagaugaucauccccaagauguacggaggacccaucagccagcacaacuaccgccccggguacuucacacaaaccgccgggccguggcaccuugggaagcucgagcuggacuucgaucuuugcgaggguacuaccguggucguggacgagcacugcggcucccgagggccaagccuccggacgaccaccgugaccggcaaaaucauccacgaguggugcugccgauccugcacgcugccgccccugcgguucagaggggaagacgguugcugguacgguauggaaauccggcccgugaaggagaaggaggagaaccucguucgcagcauggugagcgccggcuccggcgaaguggacucuuucucccuggggauuuugugcgucagcauaaugauagaggaggugaugcggucccgcuggagccggaagaugcugaugaccgggacucuagccguguuccugcuccugaucauggggcagcugaccuggaacgaccucauucgacugugcaucauggucggcgcgaacgccagcgacaagauggggaugggcacgaccuaccuggccuuaauggccacauucaagaugcgcccgauguucgcugucggguuguuguuccggagacucaccagccgggagguccugcugcucacgaucggccugagccuggucgccaguguggaacuccccaacucccuggaagaguugggagacgggcucgccaugggcaucaugaugcugaagcuguuaaccgaguuucagccccaccaacuuuggacuacucugcucucccugacauucaucaaaaccacccugucccucgacuacgccuggaagaccacugcaacaguccugagcaucgugucccuguucccccuaugccugagcacaacgagucagaagacgaccuggcugccggugcuccugggcagcuucgggugcaaaccccugaccauguuccucaucaccgagaacaaaauuuggggcaggaaguccuggccccugaacgaggggauaauggcgauuggcaucgucucgauccugcucagcucccugcugaagaacgacgucccucucgccggcccguugaucgcuggcggaaugcugaucgcguguuacgugaucagugguuccagcgcagacuuaucacuggagaaagcggccgaggugagcugggaggaggaggccgagcacagcggcaccagccacaacauccuggucgagguacaagacgacggcaccaugaaaaucaaggacgaggagcgggaugauacccuaaccaucuugcugaaggccacccuccuggccgucucgggcguguaucccaugagcauccccgcgacacucuucgugugguauuucuggcagaagaagaagcagcgcuccgggguccucugggacacccccagcccgccugaaguggagcgcgccgugcuggacgacggcaucuaccgcauucugcagcggggacuacucggccgcucccaggucggcguagguguuuuccaggauggcgucuuccacaccauguggcacgugacccgcggggccgugcugauguaccagggcaaacgccuggagcccagcugggccuccgucaagaaggaccucaucagcuacggcgggggcuggcgguuccaggguuccuggaauacuggagaggaaguccaggugaucgccgucgagcccgggaagaaccccaagaacgugcagacgacgcccgguaccuucaaaacccccgagggugaggugggggcgauugcucuggacuucaagcccggcaccagcgggucccccaucgucaaccgcgagggcaagaucgugggccuguacgggaacggcguaguuaccaccagcgggacguacgugagcgcgauagcccaggccaaggcgucccaagagggcccccuccccgagaucgaggacgaaguguucaagaaacggaaccugaccaucauggaccugcacccggggagcggcaagacgcgccgguaccuccccgccaucguccgcgaggccauuaaacggaagcugcgcacacugauccucgcgcccacgcgggugguggcguccgagauggccgaggcccugaagggcaugccgaucagauaccagaccaccgccgucaaaucagagcacacugggcgcgagauaguugacuugaugugccacgccacauucaccaugcggcugcugucccccgugagaguccccaacuacaacaugaucauaauggacgaggcgcacuucaccgaccccgcuagcaucgccgcccgggguuacaucuccacccgcguugggaugggagaggcugcggcgauuuucaugacggcaacaccgccuggcagcguggaagccuucccccaguccaacgccgucauccaagacgaggaacgggacauccccgagcgcaguuggaacuccggcuacgacuggaucaccgacuucccaggcaagaccgugugguucgugcccucaauuaaguccgguaaugacaucgcgaacugucugagaaagaacggcaagcgcgucauccagcucagccggaagacguuugacacugaauaccagaagacaaagaacaacgacugggauuacguggugaccacggacaucuccgagaugggggccaacuuccgcgccgaucgggucauagacccccgccggugccucaagccggugauacugaaggacggaccagaacgugugauccucgccgguccgaugcccgucacuguggcgagcgcggcccagcggcgcggacggauaggcaggaaccagaacaaagagggggaccaauacgucuacaugggccagccacugaacaacgacgaggaucacgcccacuggaccgaggccaagaugcugcucgauaauaucaacacccccgagggcaucauaccggcgcuguucgagcccgagcgggagaaguccgccgccaucgacggcgaguaccgucugcgcggggaggcccggaagacguucguggaacucaugcgccgcggcgaccuccccguguggcugagcuauaaggucgccuccgagggguuucaguacagugaccgccgguggugcuuugacggggagcgcaacaaccaggugcuggaggaaaauauggacgucgagaucuggaccaaggagggcgagcggaagaagcugcgcccccguuggcuggacgcgagaaccuacagcgacccucucgcgcugcgagaguucaaggaguucgccgccgggcguaggucagucagcggcgaccuuauccucgagaucggcaagcugccccagcaccugacacuccgcgcucagaacgcgcuggacaacuuggugauguugcauaacuccgagcaggguggaaaggcuuacagacaugccauggaggagcugcccgacaccaucgagacacugaugcuccuggcgcugauagcgguacucaccgggggcgucacgcuguucuuccuaagcgguaagggccucggcaagacauccaucgggcugcugugcgugacggccagcucagccuugcuguggauggccagcguggaaccccacuggaucgccgcgucuaucaucuuggaguucuuucuuaugguccuacugaucccggagccggaucgccaacguacgccccaggacaaccagcuagccuacgucgugauugggcuccuguucaugauccucaccgucgccgccaacgagaugggguuacucgaaaccacaaagaaggaccucggcaucgggcaugucgccgcggagaaccaccagcacgccacaauguuagacguggaucuccacccggcuagcgccuggacucucuacgccguagcgaccacggugaucacaccaaugaugcgccacaccaucgagaacaccacggccaacaucucgcugaccgcgaucgcgaaccaggccgccauucugaugggccucgacaagggguggcccaucagcaagauggaccugggugugccccugcucgcacugggcugcuacagccaagucaacccucugacccucaccgccgccgugcugauguugguugcgcacuacgccaucaucgggcccggccuccaggcgaaggccacgcgcgaggcccagaagcgcaccgccgccgggaucaugaagaauccgaccgucgacggaaucguggccaucgaccuggaccccgugguguacgacgccaaguucgaaaagcagcugggccagaucaugcuucugauccuuuguaccucgcagauccugcugaugcggacgaccugggcccugugcgaauccaucacccucgcuaccgguccgcugaccacgcugugggaagggagcccagggaaguuuuggaacaccaccaucgcaguguccauggccaacauauuccgcggcucguaccucgccggggccgggcuggcguucucccugaugaagucccuaggugggggccgccgggggacgggugcccagggcgagacccugggggagaaauggaagcgccagcugaaccagcucagcaaguccgaguuuaacacguacaagcggagcggcaucauggaggucgaccgcuccgaggccaaggaggggcugaagcggggagagaccacgaagcacgccguuagccgcgggaccgcgaagcugcggugguucguggagcgcaacuuaguuaagcccgagggcaaggucaucgaccucggcugcgggcggggcgggugguccuacuacugcgcaggccugaagaaggucaccgaggucaagggauacaccaaggguggccccgggcacgaggaacccaucccgauggccacguacggcuggaaccuggucaagcuccacagcgggaaggacguguuuuucaugccgcccgagaaaugcgacacgcugcugugugacaucggcgaguccagcccuaaucccacgaucgaggaggggcgcacccuuaggguccucaaaauggucgagcccuggcugcgcggcaaccaguucuguaucaagauccucaaccccuacaugccgucuguuguagagacccuggagcaaaugcagcggaagcacggcgggaugcugguccgcaacccccucucucggaacuccacgcacgagauguacugggugagcugcggcacugggaacaucguaucggcgguuaacaugacgagccgcaugcugcugaaccgguucacaauggcccaccgcaagcccacauaugagcgggacguggaccucggcgcaggcacgcgccacguggccgucgagccagaaguagcgaaccuggacauuaucggacagcgcaucgagaauauuaagaacgagcauaaauccaccuggcacuaugacgaggauaacccguacaagacgugggcauaccacggcagcuacgaggugaagcccuccgggagcgccucuucgauggucaacggcguggucaggcugcuuaccaagcccugggacgugauccccauggugacccagaucgccaugaccgauaccacgccguucggccagcagcgcgucuucaaggagaagguggacacacguacgccucgggccaaacggggcaccgcccagaucauggaggugacggccaaguggcuguggggguuccugaguaggaacaagaagccccggaucugcaccagagaggaguucacccggaagguccgcucaaacgcggcaaucggagccguguucguggacgagaaccaguggaauagcgccaaggaagccguagaggacgagcgguucugggaccucgugcaccgugagcgggagcugcacaagcagggcaaaugcgcgaccugcguguauaacaugauggggaagcgagagaaaaagcugggagaguucgggaaagccaagggcucccgggcaaucugguacauguggcuaggcgcucgauuccucgaguucgaggcacuuggguuuaugaacgaggaucacugguucagcagagagaacuccuugagcggcguagagggggagggccugcauaagcugggguacauccuccgcgacaucuccaagaucccgggcggcaacauguacgcggacgacacugccgggugggacacccggaucacugaagacgaccugcagaacgaggccaagauuaccgacaucauggagccugagcacgcccuguuagcgacgagcaucuucaagcugaccuaucagaacaagguggugcgcguccagagaccagcgaagaacgggaccgugauggacgugaucucccgcagagaccagcgggggagcggccagguggguaccuacgggcugaauacguucaccaacauggaggugcagcuuauccgccagauggaguccgagggaauuuucuuccccagcgagcuggaguccccgaaccuggccgagcgggugcucgacuggcuggagaagcacggggcggagcgccugaagcggauggccauuagcggcgacgacugcguagugaaacccaucgacgaccgcuucgccaccgcccuuaucgcccuaaacgacauggggaaggugcggaaggacaucccgcagugggagcccagcaagggcuggaacgacuggcagcaagucccguucuguagccaccacuuucaucagcugaucaugaaggacgggcgcgagauaguugugcccugccgaaaccaggaugagcucguagggcgcgcccgggucucccagggcgccggguggagucugcgggagaccgccugcuugggcaagagcuacgcgcagauguggcaguugauguacuuccaccggcgcgaccugcggcuggcggccaaugccaucugcuccgcggugcccgucgauugggugcccacaagccgcaccaccugguccauccacgcccaucaccaguggaugacaacggaggacaugcucagcguguggaaccgggucuggauagaggagaacccuuggauggaggacaagacgcacguauccagcugggaggaggugcccuaccuggggaagcgcgaggaucagugguguggcagucugaucggccucaccgcgcgcgcuaccugggccaccaauauccaaguagcgaucaaccaggugaggcggcugaucgguaacgagaacuaccuggauuacaugacgagcaugaagcgguucaagaacgaguccgacccugagggcgccuuaugguga

SEQ ID NO: 23739 - RNA, 9879 nt, Artificial Sequence
  derived and/or modified CDS sequence (opt11) from DENV-1__JX669474__SS-prME
agcgugacuaugcugcucauguuacugcccaccgcccucgccuuccaccuaaccacccggggcggggagccccacaugaucgugagcaagcaggagaggggcaagucgcuccuauucaagaccuccgcgggggugaacaugugcacccugaucgcaauggaccugggcgagcucugcgaggacaccaugaccuacaagugcccccgcaucaccgaggccgagcccgacgacguggacugcuggugcaacgccaccgacaccugggucaccuaugguaccugcagccagaccggcgagcaccggcgcgacaagagguccguggcccuggcgccccacgugggucuggggcucgagacacgcacagagaccuggaugagcucugagggggccuggaaacagauccagaaggucgagacgugggcccugcggcacccgggguucacggugaucgccuuauuccucgcgcacgccauaggcaccagcaucacccagaagggaaucaucuucauccugcugaugcucgugacccccuccauggccaugcgcugcgucggcauaggaaaccgggacuucguggagggacugagcggcgccacuuggguggacguagugcuggagcacggguccugugugaccaccauggccaagaacaagcccaccuuggacaucgaacuccugaagacggaggucacaaaccccgcggugcuccgcaagcugugcaucgaggccaagaucagcaauaccaccacggauuccagaugccccacccagggcgaggccacacugguggaggagcaggacgccaacuucgucugccgccggacguucguggaccgcggaugggggaacggcugcggucucuuuggcaaggggagccuccugacuugcgccaaguuuaagugcgugaccaagcucgagggcaagaucguccaguacgagaaccucaaauacuccguuaucguaaccguucacacuggcgaccagcaccagguggggaaugagacgaccgagcauggcaccaucgcgaccaucacgccucaggccccuacgagcgagauccaguugaccgacuacggagcccucacacuggacuguagcccccggaccggcuuggacuucaacgagaugguccuccuuacuaugaaggaaaagaguuggcuggugcacaagcagugguuucucgaccugccgcugcccuggaccuccggggccagcaccagccaggagaccuggaaccgccaggaccuccuggugacguucaagaccgcccacgcgaagaagcaggagguuguggugcugggcucccaggagggcgccaugcacaccgcccucaccggggcaacggagauccagaccagcggcacuaccacgaucuucgccggacaccugaagugcagacugaagauggacaagcucacccugaagggcauguccuaugucauguguaccgggagcuucaaacuggaaaaggagguggcggaaacccagcacggcacggugcugguccaggugaaguacgagggcaccgacgcucccugcaagauccccuucuccacccaggacgagaagggggugacccagaacgggcgccucaucacggccaacccgaucgucaccgauaaggagaagcccgugaacaucgagaccgagccgcccuucggagaaagcuacaucguugucggcgccggcgagaaagcgcuuaagcugucaugguucaagaaggggagcuccaucggcaagauguuugaggcuaccgcccgcggcgcccgccggauggccauccucggcgacacugcgugggacuuugggagcaucggcggcguguucacguccguggggaagcugguacaccagguguucggcaccgccuauggggugcuguucagcggagucucauggaccaugaagaucgggaucggcauucuauuaacaugguugggccucaauagccgcagcacaagccugagcaugaccugcaucgccguggggauggugacccucuaccucggcgucauggugcaagccgacagcgggugcgugaucaacuggaagggacgcgagcugaagugcggaaguggcaucuucgucacuaacgaggugcacaccuggaccgagcaguacaaguuccaagcugacagcccgaagaggcugagugcggccaucggccgcgccugggaggagggggugugcggcauccgguccgccacucgcuuagagaauaucauguggaagcagaucagcaacgagcugaaccacauccugcucgagaaugacaugaaguucaccguggugguggggaacgccaacgguauccuggcgcaggggaagaaaaugaucaaaccccagcccauggaacacaaguacuccuggaaguccugggggaaggccaagauuaucggcgccgacauccagaacgccacguucauuaucgacgggcccgacaccccggagugccccgacgagcagcgggccuggaacaucugggaagucgaggacuacgguuuugggaucuucaccaccaacaucugguugaagcuccgcgacagcuacacgcagaugugcgaccaccggcugaugagcgccgccaucaaggacuccaaagccgugcacgcagacaugggcuacuggaucgaaagugagaagaacgagacauggaagcuggcucgcgccuccuucaucgaagugaagaccuguaucuggcccaagucucacacacucugguccaacggcguccuggagagugagaugaucauccccaagauguacgggggcccgacgucacagcacaacuaucggcccggguacuucacccagaccgcaggccccuggcauuuagggaagcuugagcuggacuucgaccugugcgagggcaccacggugguugucgacgagcacugcgguaguagggggccgucccuccggacgaccaccgugacgggcaagaucauccacgaguggugcugccgcucguguacccucccgccccugcgguuucgcggggaggacggcugcugguacgggauggagauacggcccgugaaggaaaaagaggaaaaccucguccgcuccauggugagcgccggcucuggcgaaguugacuccuucagccuggggauccucugcgucucgauaaugaucgaggaggugaugcgcagcagguggucucggaagauguugaugaccggcacccuggccguguuccuucuccuaaucauggggcagcugacguggaaugaccucauccgccucugcaucauggucggcgcgaacgccagcgacaagauggggauggguaccaccuaccuggcccucauggccaccuucaagaugcguccgauguucgccguggggcugcuguuucggcggcucacgucccgggaggugcugcugcucaccaucgggcugagccuggucgcguccguggagcuccccaacagccuggaggagcugggcgacgggcucgcaaugggcaucaugaugcugaagcugcucacggaauuccagccucaccagcuguggaccacgcugcucucccuaaccuucaucaagaccacgcugagccucgacuacgcguggaagacgaccgccaccguccuguccaucgucagccuauucccgcucugcuuauccaccacgagucaaaagaccaccugguugccggugcuccugggauccuucgggugcaagcccuuaaccauguuccucauuaccgagaacgagaucuggggucgcaagagcuggccccugaacgaagggaucauggcuaucggcaucgucuccauccugcucagcagccuguugaagaaugauguuccccucgccgggccguugaucgccggcggaaugcugaucgccuguuacguaaucuccgggagcucagccgaccucagccuggagaaggcggcagaagucuccugggaggaggaggccgagcacucaggcacgucccacaacauccugguagaggugcaggacgaugggacgaugaagaucaaggacgaggagcgggacgacacacucacgauacugcugaaggccacgcuccuggccaucagcggcguauaccccauguccaucccagcaacccuguuugugugguacuucuggcagaagaagaaacagcgcagcgggguccucugggacacgcccuccccgcccgaggucgagcgggccgugcuggacgacggcaucuaccgcauccugcagcggggccugcucgggcgcagccaggugggcguggggguuuuccaggacggcguguuucacaccauguggcacguuacgagaggggcugugcugauguaccaagggaagcgccuggagcccuccugggcaagcgugaagaaggaccucaucuccuacggcggcggcuggcgguuccaggggagcuggaacaccggugaagagguccaggugaucgccguugagcccgggaagaacccgaagaacguccagacgacccccggcacguucaagacccccgagggcgaggugggggcgauugcccuggacuucaagcccggcaccagugggagcccgaucguaaaccgagaggguaagaucgucggccuguacgggaacggcguggugaccaccuccgggaccuacgucagcgccaucgcccaggccaaggcgagccaggaagguccccuccccgagaucgaggacgagguguucaagaagcggaaccugaccaucauggaccugcacccggggucaggcaaaacccgccgguaccuccccgccaucguucgugaggccaucaaacgcaagcugcgcacgcugaucuuggcccccacccgggucguagcgagcgagauggccgaggcccugaagggcaugcccauacgcuaccagaccaccgccgugaagucggagcacacggggcgcgaaaucgucgacuuaaugugccacgccacuuucaccaugcggcuccugagcccggugcgcgugcccaacuacaacaugaucaucauggacgaggcucacuucaccgaccccgccuccaucgccgcuagaggcuacaucagcacgagagucgggaugggcgaggcugcggccaucuucaugaccgcgacgccgccuggguccguggaggcguucccccagagcaacgccgugauccaggacgaagagcgggacauccccgagaggucauggaacucaggcuacgacuggaucacugacuuucccggcaagacggucugguucgugcccuccauaaagagcgggaacgacaucgcgaacugccugcggaaaaacggcaagcgcgugauccagcucucccggaaaacauucgacaccgaguaccagaagaccaagaacaacgacugggacuacgucgucacgaccgacaucagugagaugggggccaauuuccgcgccgaucgggugaucgacccacgucggugcuugaaacccgucauccugaaggauggccccgagcgcgugauccuugccggaccgaugcccgugacggucgcguccgccgcccagcggcgcggccggaucggcagaaaccagaacaaggagggggaccaguacgucuauaugggccagccccucaacaacgacgaggaccacgcccacuggaccgaggccaagaugcugcuggacaacaucaacacgcccgaggggaucaucccggcgcuguucgagcccgagcgggagaaaucagccgccaucgacggcgaguaccgccugcgcggggaggcacggaagaccuucgucgagcucaugcgccggggcgaccugccgguguggcuguccuacaagguggccagcgagggcuuccaguacuccgaccgccgguggugcuucgacggagaacgcaacaaccaggucuuagaggagaacauggacguggagaucuggaccaaagagggcgagcggaagaagcugagaccccgguggcuggacgcgcgcaccuacagcgacccgcuagcccugcgggaguucaaggaguucgcagccgggcgccguagcgugucaggcgaccugauccucgaaauuggcaagcugccccagcaccugacccuccgcgcccaaaaugcgcuggacaaccuggucauguuacacaacagcgagcagggcgggaaggcauaccggcacgccauggaggagcugcccgacacgaucgagaccuugaugcuccuggccuugauugcggugcucaccgggggcgugacccuguucuuccuguccgggaaaggccucggcaagacgagcaucgggcugcugugugucacggccuccagcgcccuccuguggauggccucuguggagccccacuggauugccgcgagcaucaucuuagaguucuuucuaauggugcuguuaauuccggagcccgaucgccagagaaccccccaggauaaccagcucgccuacgucgugauaggccugcuguucaugauccucacuguggcagccaacgagaugggguugcucgagacgacaaagaaggaccuaggcauugggcacgucgccgcggagaaccaccagcacgcuacaaugcuggacguggaucugcacccggccuccgccuggacgcucuacgccguggcgacgaccguuaucacccccaugaugcgccacacuaucgagaauacgaccgccaacaucagccugaccgccaucgccaaccaggccgcgauccugaugggccucgacaagggcuggcccaucuccaagauggacuuaggggucccccugcucgcacuaggcugcuauagccaagugaacccgcugacccuaacggccgccguccugaugcugguggcgcacuacgccaucauugggcccggacuacaggccaaggccacccgggaagcccagaagcgcaccgcugccggaaucaugaagaaccccaccguggacggcaucgucgccaucgaccucgaccccgugguguacgacgccaaguucgagaagcagcuggggcagaucaugcuccugauccugugcacgucucaaauccuccugaugcggaccaccugggcccugugcgagagcaucacucuggcgacggguccgcugaccacccugugggagggcucccccgggaaguucuggaacaccacgaucgccgucagcauggcuaacaucuuucgcggcuccuaccucgcuggagccgggcuggcguucagccuaaugaagucccucggcggggggcgccgggggaccggcgcccagggcgaaacccuaggggagaaguggaagcggcaacugaaccagcucagcaagagcgaguucaacaccuacaagcgguccggcauuauggagguggauaggagcgaggccaaagaggggcugaagcggggcgagacgaccaagcacgccgugucaagagggaccgcgaagcugcggugguuugucgagcguaaucuggugaagccagaggggaaggugaucgaccucgggugcgggcggggcggguggagcuacuacugugccggccugaagaaagucacugaggugaagggguacaccaagggcggccccgggcacgaggagccgauccccauggcaacguacggcuggaaccuggugaagcuucacuccgggaaggacgucuucuucaugccgcccgagaaaugcgacacccugcuuugugacaucggagaaucguccccgaacccgaccauagaggaggggcggacccucagggugcuaaagaugguggagccauggcugcgcggaaaccaguucuguauuaagauccucaaccccuauaugccgagcgucguggagacgcuugagcagaugcagcggaagcacggcgggauguuagugcgcaacccccucucccggaacagcacccacgagauguacuggguguccuguggcaccgggaacaucgugagcgccgucaacaugaccucgaggaugcuacugaaccgguucacgauggcccaccgcaagcccaccuacgagcgggacgucgaucucggugcgggcacacgccacgucgccgucgagcccgaggucgcaaaccuggacauaauugggcagcgcaucgagaacauuaagaacgagcacaagagcaccuggcauuacgacgaggacaacccguacaagacgugggcauaccacggcuccuacgaggugaagcccagcggguccgcaagcuccauggugaacggggucgugcggcugcucacuaaacccugggacgucauucccauggugacccagaucgcaaugaccgauaccacgccguucgggcagcaacgcguguuuaaggagaaggucgacacccggacgccccgggccaagcggggcacggcccaaaucauggaggugaccgccaaguggcuguggggcuuccugagccgcaacaagaagccccggauuugcacccgagaggaguuuacccggaaggugcgcaguaacgccgcgauuggagccgucuuuguggaugaaaaccaguggaacuccgcuaaagaggccguagaggacgagagauucugggaccucguccaccgggagcgggaguugcacaagcagggcaaaugcgcgacgugcguguauaacaugauggggaagcgcgagaagaagcugggcgaguucgggaaggcgaagggcagccgggccauuugguacauguggcuuggggcacgcuuccuugaauucgaggcccugggguucaugaacgaggaccauugguucucccgagagaacagccucucuggcguggagggggagggccuucauaagcucggguacaucuuacgcgacaucagcaagaucccgggcggcaauauguacgcggacgacaccgccgggugggacacccggauaaccgaagacgaccugcagaacgaggccaaaaucaccgacauaauggagccggagcacgcacuucucgccacgucuaucuucaagcugaccuaccagaacaagguggugcgcgugcagcggcccgcgaagaacggcaccgucauggacgugaucagccgcagggaccagcggggaagcggccagguaggcacuuaugggcugaacacguuuaccaacauggagguccagcucauccgccagauggagagcgagggcaucuucuuccccuccgaguuggagagcccgaaccuggccgaaagagugcucgacuggcuggagaaacacggggccgaacgccucaagcgaauggccaucuccggcgacgacugcgucgucaagcccaucgacgaccgcuucgccaccgcucucaucgcucugaacgacauggggaaggugcggaaggacauaccccagugggagcccuccaagggcuggaacgauuggcagcaggucccguucuguucccaccauuuccaccagcugauaaugaaggacggacgcgagaucgucgugcccugccggaaccaggacgagcucguggggcgcgcccgggucagccagggcgccggguggucccugcgcgaaaccgccugccugggcaagagcuaugcgcaaauguggcagcugauguacuuccaccggcgcgaccugcgucuggccgccaacgccauaugcucugcggugcccguggacuggguccccaccucccgcaccacauggucgauccacgcccaccaccaguggaugaccacggaggacaugcucuccguguggaaccggguguggaucgaggagaacccuuggauggaggacaagacccacgucucuucaugggaggaggugcccuaccuggggaagcgcgaggaucaguggugcggcagccugaucggauuaaccgcccgggccaccugggccacgaacauccagguggcgaucaaccagguccggcgucugaucgggaacgagaacuaccuggacuacaugaccuccaugaagcgcuucaagaacgagagcgaccccgagggagcgcucugguga

SEQ ID NO: 23740 - RNA, 9879 nt, Artificial Sequence
  derived and/or modified CDS sequence (opt11) from DENV-1__JX669475__SS-prME
ucagugaccaugcugcucauguuacuaccuaccgcgcuugcguuccaccugaccacccggggcggggaaccacacaugauaguguccaagcaagaacggggaaagagccuccuguucaagacaucggcggggguuaacauguguacgcugaucgccauggaccugggcgaacuaugcgaggauacaaugaccuauaagugcccaagaaucaccgaggcagagcccgaugauguggauugcuggugcaacgcuacagacaccugggucaccuacgggaccugcagccagaccggcgagcaccggcgggacaagcgguccguggcccucgcgccucaugugggucuggguuuggaaacccgcacggagaccuggaugagcuccgagggggccuggaagcagauccagaaggucgagacuugggcgcuacgccauccaggguuuacggugaucgcccuuuuccucgcgcacgccauagguaccagcauuacccagaaggguaucaucuucauccuacugaugcuagucacccccagcauggcaaugcgcugugugggaauuggaaaccgagacuucguggaagggcucaguggagcuacgugggucgauguugugcuggagcacggcuccugugugaccaccauggccaagaauaagcccacgcucgacaucgaacugcugaagacggaggucacuaacccugcgguccuccgaaagcugugcauagaggcgaagaucagcaacaccacuacggauucccgaugcccgacccagggagaggccacucuggucgaggagcaggaugcgaauuucgucugccgccggaccuucguggaccgugguugggggaacggaugcggccucuucggcaaggggucguuacugacgugugccaaguucaagugcguaaccaaacucgagggcaagaucguccaauacgaaaaccugaaguacuccgugaucgugaccguccacaccggcgaccaacaccagguggguaacgagacgaccgagcacgggacaaucgcgaccaucacgccucaagcacccacgagcgaaauacagcugaccgacuacggcgcccucacccuggauugcagcccccggaccggccuugauuucaacgagauggucuuacugaccaugaaggagaagaguuggcuggugcacaagcaaugguuccucgacuugccgcugccuuggaccagcggggcgagcaccucgcaggagaccuggaaccgucaggaccuccuggugacauucaagacggcgcacgcgaagaaacaggaagucgugguucugggcucgcaagagggcgccaugcacacggcccucacaggcgccacggagauccagacgucagguaccaccacgaucuucgccgggcaccugaagugucggcugaaaauggauaagcucacccuuaagggcacaucauaugucaugugcacagggagcuuuaaacuugaaaaggaaguugccgagacgcagcacgggaccgugcugguccagguaaaguacgaaggcaccgaugcucccugcaagauccccuucucuacccaggacgaaaagggugugacucagaacggccggcucauaaccgcgaaccccaucguuaccgacaaggagaagccugucaacaucgaaacugagccgccguuuggggagucauauaucguagugggcgccggugagaaggcgcugaaacugucaugguucaaaaagggaagcucgauuggcaagauguucgaagccacggcccgcggugcccgccggauggcgauccucggugacacagcgugggacuucggcucuaucggcggaguguucaccaguguaggaaagcugguccaccagguguuuggcacggccuacggggugcuauucagcggaguaaguuggacgaugaagaucgggaucgggauccuccuuaccuggcugggccucaacagcagaucgaccagccugucgaugaccuguauagccguuggcauggugacgcuguaucucggcgugauggugcaagccgacagcgggugcgugaucaacuggaagggccgcgagcugaagugcggguccggcaucuucguuaccaaugagguacacaccuggaccgagcaguacaaauuucaggccgacucaccaaagcggcugagcgcggcaaucgggaaggccugggaggagggugugugcggcauccgcagugccacccgguuggagaauaucauguggaagcagaucaguaacgagcucaaccauauccugcucgaaaacgacaucaaguucacgguggucgucgggaacgccaauggcauccucgcgcaggggaagaagaugauccgcccccaacccauggaacacaaguacuccuggaaguccuggggaaaggcgaagaucaucggcgcggauauccagaauacuacauucaucaucgacggacccgacaccccggagugccccgacgagcagcgggccuggaacaucugggaggucgaggacuacggcuucgggauuuuuacgaccaacaucuggcugaaacuccgggacucuuauacccaaaugugugaccaccguuuaaugagugcagcaauuaaagauuccaaagccgugcaugccgacaugggcuacuggaucgagagcgagaagaaugagaccuggaagcuggcccgcgcaucauucaucgaggugaagacgugcauauggcccaagagccauaccuuguggucgaacggcguccuugagagcgaaaugaucauccccaaaauguauggggguccgaucucccagcacaacuaccggcccggguacuucacgcaaaccgccggccccuggcacuugggcaaacuugaauuggauuucgaccuaugcgagggcacgacagugguugucgacgaacacugugggucaagggguccaucccuccggaccacuacggugaccggaaagauuauucacgaguggugcugccgcagcugcaccuuaccgccguugcgguuccgcggggaggaugguuguugguacgggauggagauccggcccgugaaggagaaggaagagaacuugguccgcuccauggucagcgcggguagcggcgagguugacucauuuagcuuggggauccugugugucuccaucaugauagaggaggugaugcgaucaagauggucccggaaaaugcucaugaccggcacccuggcgguguuuuugcuguuaaucauggggcagcugaccuggaacgaccucauacgccuauguauuauggugggggccaacgcgagcgacaaaauggggaugggcacaaccuacuuggcccuaauggccacauuuaaaaugcgcccgauguucgccguggggcuauccuuccgccggcuuaccagucgugaggugcucuuacugacaauagggcucagccucgucgcaaguguugagcugccuaacagcuuggaggaguugggggauggguuagcuaugggcaucaugaugcuuaaacuguugaccgaguuccaaccccaccaacucuggaccacccugcugagccugaccuucaucaaaaccacacuaaguuuggacuacgcguggaagacgacagccaugguccucucaaucgugucacuguucccccugugccucagcacuacuucccagaagacgaccugguugccggugcugcugggcucuuuugggugcaaaccccuuaccauguuccugaucaccgagaacgagaucuggggucggaagaguuggccccuuaacgaggggauuauggccaucggcauugugagcauccuucugucgucccuccugaaaaacgaugucccgcuggcugguccgcucaucgccgggggaaugcuaauagccugcuaugugaucagcggaucuucggcugacuugucccuagagaaggcagcggaggucagcugggaggaggaggcagagcauuccggaacgagccacaauauccuaguggaagugcaggacgacgguacgaugaagaucaaggacgaggaacgggacgacacgcugaccauucuccugaaggccacgcugcucgccgucuccggcguguacccuaugagcauccccgccaccuuauuugugugguacuucuggcagaagaagaagcagcgcuccggaguccugugggacaccccaucgccuccagagguggagcgggcuguccuggacgauggcaucuaccggauacugcagcggggccuucuggggcgcagucagguuggcguggggguuuuccaagacggcgucuuucacacuauguggcaugugacgcgcggggcuguguuaauguaccagggcaagcgccuggagcccagcugggccagugucaagaaggaccuuauaagcuacggcggcggguggcgguuccaggguuccuggaacaccggcgaggagguccagguaauugccguggagcccgggaaaaacccgaaaaacgugcagaccacccccggcaccuuuaagacccccgaaggcgaggugggggccaucgcgcuagacuuuaagccaggcaccagcggcuccccaaucgucaauagagaagggaagauagucggacuguacgggaacggcgucgucaccacgagcgggaccuacgucagcgccaucgcccaggccaaggccucccaggaaggaccucugcccgagaucgaggacgagguauuccggaaaaggaaccucacuauaauggacuuacacccgggcagcggcaagaccaggagguaucucccugcgaucgugcgcgaggccaucaagcgcaagcuccggacgcucauccuggcccccacacgcgucguggcauccgagauggcggaggcccucaagggcaugcccauccgcuaccagaccaccgccgucaaauccgagcacaccgggagggagauuguugaucugaugugccacgccaccuucacaaugcgcuugcucucacccguccguguccccaacuacaauaugaucaucauggacgaggcucacuucacugaccccgcgagcaucgccgcccgcggauacaucuccaccagggucgggaugggcgaggccgcggcgaucuuuaugaccgcgacgccgccugggagcguagaggccuucccccaauccaacgcugugauccaggacgaggagcgcgacaucccugagcggucuuggaacucaggauacgacuggauuacugacuuccccggcaaaacggucugguucguuccuagcaucaaauccggcaacgauauugccaacugucuacgcaagaacgggaagcgggucauacagcugucacgcaagaccuucgacaccgaguaccaaaagacgaagaacaacgacugggauuacguagugacaaccgacaucucugagaugggcgcgaacuuccgggccgacagaguuaucgacccgaggcgcugccucaagcccgugauccugaaggacggaccugagcgggugauccuggccgggccgaugcccgucaccguagccagcgcggcccagcgucggggccgaaucggacggaaccagaacaaggagggggaccaguacgucuacauggggcagccccucaauaacgaugaagaccacgcgcacuggaccgaggcaaagaugcuucuggacaacaucaauacgccggaggggaucauaccagcccuuuucgagcccgaacgcgagaaauccgcggccaucgacggcgaauaccgccugcgcggggaggcucgcaagaccuuuguggagcugaugcggaggggcgaucuccccguguggcugagcuacaaggucgccuccgaggguuuccaguacucggaccgacgcuggugcuucgacggcgagcgaaauaaucaaguccuggaggagaacauggacguugagaucuggaccaaggagggggagaggaagaagcuccggccccgauggcuggacgcccggaccuauucggacccgcuugcacugcgcgaguucaaggaguucgccgccggccgacgcucaguaagcggcgaccugauucuggagaucggcaaacuuccccagcaccugacccuacgugcccaaaacgcccuugacaaccuugugaugcugcacaauuccgagcagggagggaaggcuuaccgccacgcuauggaggaacucccggacacgauugagacucugauguuguuggcgcucaucgccgugcugaccggaggcgucacccucuucuuccugagcggaaagggcuuaggcaagacgaguaucgggcugcugugcgugacugcauccuccgccuuacuuuggauggccagcguugagccacacuggauugccgcaagcaucauccuggaguucuuccugaugguccuccugauuccggaaccggacaggcagcgcacgccacaggacaaccaguuagcguauguugucauaggcuuacuguucaugauccugaccguagcggccaacgagauggggcuccucgagacgaccaaaaaggacuugggcaucggacacguggccgccgagaaucaccaacaugcuacgaugcucgacguggaccugcacccggcgagcgcguggacccuguacgccgucgccacgacugugaucacacccaugaugcgucacaccaucgagaacacgaccgcaaacaucucccugaccgccaucgcaaaccaggcggcaauccugaugggccuggacaagggcuggcccaucuccaagauggaccucgggguuccgcugcuugcgcucgggugcuauagucaagucaacccguugacccugacggccgccguucucaugcugguugcccacuacgcgaucaucggaccuggccugcaggcuaaggccaccagagaggcgcaaaagcggaccgccgcggggaucaugaaaaaccccaccgucgacggaauuguggcaauagaccucgaccccguaguguaugacgcgaaguuugagaagcaauugggccagaucaugcugcucauccugugcacgagccagaucuuacucaugcgcaccaccugggcccugugcgaguccaucacccuggcuacggggccgcucacgacccugugggagggcagccccgggaaguucuggaacacgacgauagcgguguccauggccaacaucuuccgcggcagcuaccuggccggggccgggcucgcauuuucccugaugaagucccugggcggagggagacgcggaacuggcgcacagggagaaacccuuggggaaaaguggaagcggcagcugaaucagcugagcaaguccgaguuuaacacauacaagcgcucggggaucauggagguagaccggucugaggccaaggagggacucaagcgcggugagacgaccaagcaugccguaagcagaggaaccgcgaagcugcggugguucguggagcggaaucuggugaagcccgagggcaaggucaucgaccugggcugcgggagagguggcugguccuauuacugcgccggccucaagaaggugaccgaggucaagggguauacgaaaggcggucccggccacgaagaaccgaucccgauggcuacguacggcuggaacuuggucaagcugcauucugguaaagauguguucuucaugccgccugagaagugugauacccugcuuugugacaucggagaguccucaccgaacccgacuaucgaggaagggcgaacauugcggguacuuaagauggucgaacccuggcugcgggggaaccaguucuguauuaagauccugaaccccuauaugcccuccgugguggagacgcucgagcaaaugcagcggaagcacggcgguaugcuggugcggaacccccuaagucgaaacuccacccacgagauguacugggugagcugcggcacagggaacaucguguccgccgucaacaugacaagccgcaugcuccugaaccgcuucacgauggcacaucggaaacccaccuacgaacgagacguggaucugggcgccgggacccgucacgucgcgguugagcccgagguggccaaccucgauaucaucggucagcggauugagaacaucaagaacgagcacaaguccaccuggcacuacgacgaggacaacccguauaagacgugggccuaucacggcagcuacgaaguuaagcccagugggagcgccucuagcauggucaacggcgucgugcgccuacugaccaagcccugggacguuaucccaauggucacccagaucgcgaugacggauacgaccccguucggacaacagcggguauucaaggaaaaagucgacacgcgcacgccucgggcuaagcgcggcacagcgcaaauaauggaggugacagccaaguggcuaugggguuuccugagccggaacaagaagccccgcaucugcacccgggaggaguucacccguaagguacguuccaacgccgccaucggggcaguguuuguggacgagaaccaguggaauagcgcgaaagaagccgucgaggacgagcgcuuuugggaccuggugcacagagaacgugaacuucacaagcagggcaagugcgcuacaugcguguacaacaugauggggaagcgggaaaagaagcugggagaguucgguaaggcgaagggcucccgcgccauaugguacauguggcucggcgcucguuuccuagaguuugaagcccugggauucaugaacgaggaccauugguucucccgcgagaacucccugagcggcgucgaaggggagggccuccacaagcuaggguacauccugcgggacaucaguaagaucccgggcggcaauauguacgcggacgacaccgcggggugggacacucgcauaaccgaggacgaccuccagaacgaggcgaagaucacggacauaauggagcccgagcacgcucugcuggcgacuagcaucuucaagcucaccuaccagaacaagguggugcguguucaacgcccggcaaagaauggaaccgugauggaugucaucucccgacgagaccagcgcgggucgggccaggucgguacguacggacugaauacuuucaccaacauggagguacaguuaauacggcagauggaguccgaaggcaucuucuuccccucugaauuagaguccccgaaccuugcggagcgugugcuggacuggcucgaaaaacacggcgccgagcgcuugaagcgcauggccaucagcggcgacgacugcgucgugaaacccauagaugaccguuucgccaccgcccugaucgcgcucaacgacauggggaaggugcggaaggacauuccccagugggagcccaguaagggcuggaacgauuggcagcaaguccccuucugcagccaccacuuucaccagcugaucaugaaggacggucgggagaucgugguccccugcagaaaucaggacgagcugguagggcgcgcucgcgugucccagggcgcgggguggagccuccgggagacggccugccuggguaagucuuacgcucagauguggcagcugauguacuuccaccgccgagaccuccgucuggccgccaacgcgauaugcuccgccgugccuguugacuggguaccuaccagccggaccaccugguccauccacgcgcaccaccaguggaugaccacggaagacauguuaagcguguggaaccgcgucuggauugaagagaaccccuggauggaggacaagacccacguguccagcugggaggaggugccuuaccucggcaagagggaggaccaguggugcggaucacugaucggacugaccgcaagggccaccugggccacgaacauccaagucgccauuaaccagguccggcgccucaucgguaaugagaacuaccucgacuacaugaccagcaugaaaagguucaagaaugaauccgaccccgagggugcgcuaugguga

SEQ ID NO: 23741 - RNA, 9879 nt, Artificial Sequence
  derived and/or modified CDS sequence (opt11) from DENV-1__JX669461__SS-prME
agcgugaccaugcugcucaugcugcugcccacggcccuugccuuccaccugaccacccggggcggggagccgcauaugaucgugagcaaacaggagcggggcaagagccuccuguucaagaccagcgugggggugaauauguguacccugaucgcgauggaccugggagaguugugugaagacaccaugacguacaagugcccccggauaaccgaagccgagccagacgacguggauugcuggugcaacgcaaccgacaccugggugaccuacgggaccugcagccagacuggcgagcaccgccgcgacaaacgguccguggccuuggccccccacgucggccuggggcuggagacgcggaccgagaccuggaugagcuccgagggugccuggaagcagauccagaagguagaaaccugggccuugcggcaccccggguucacggugaucgcccuguuucucgcccacgcgaucggcaccagcaucacacagaaagggaucauuuuuauccugcugaugcucgucacccccucgauggccaugcgcuguguggguauuggcaaccgggacuuugucgaggggcugucaggugccacguggguugauguggugcuggagcacgggucgugcgucaccaccauggccaagaauaaacccacccucgacaucgagcugcugaaaacggaggugaccaaccccgcggugcuccgcaaguugugcaucgaggcaaagaucagcaacacgaccacggacagccggugccccacccagggcgaggccacccuggucgaggagcaggacgcgaacuucguuuguaggcgaaccuucguggacaggggcugggggaacggcugcggccucuucggcaaggggagccugcugacgugcgccaaguuuaagugugucaccaagcucgagggcaagaucgugcaauacgaaaaccugaaguacagcguuaucgucaccgugcacaccggcgaccagcaucaagucgggaacgagacgaccgagcacggcacaaucgccaccaucacuccucaggcccccacgagcgagauccaacugaccgacuacggggcccucacccuggacugcagcccccggaccgggcuggacuuuaacgagauggugcuccugacgaugaaggagaagucauggcuggugcacaagcaaugguucuuagaucugccgcugccauggaccuccggggccagcaccagccaggagaccuggaaccgccaggaccuccuggucaccuucaaaaccgcccacgccaagaaacaggagguggugguccugggaucccaggaaggcgcgaugcacacugcccucacaggggccacggagauccagaccucgggcaccaccacgauauucgcugggcaucugaagugccggcugaagauggacaagcucacguugaaggguauguccuacgugauguguacagggagcuucaagcuugagaaggagguggccgagacgcaacacggcacggucuuaguucaggugaaguacgagggcaccgacgcgcccugcaagauccccuuccucacccaggacgagaagggggucacgcagaacggccgccuaauaacggccaacccgauuguaaccgauaaggagaagcccgugaacauugaaacugagccgcccuucggggaguccuacaucgucgucggcgccggcgagaaggcccugaaauuaagcugguucaagaagggguccuccaucggcaagauguuugaggcgacagcccgcggcgcgcgucggauggccauccugggcgacaccgccugggacuucggguccaucgguggccucuuuaccucgguggggaaacucauucaucagguuuucggcaccgcguacgggguccuguucucaggcgugagcuggaccaugaaaaucgggaucggcauccugcucacguggcugggccugaacucccgcagcaccucccuuucuaugacaugcauugcggucgggauggugacucuguaccugggcguaaugguccaggcggacuccgggugcguuaucaacuggaagggacgcgagcucaagugcgggucgggcaucuuugugacgaacgagguccacaccuggacggagcaauacaaguuccaggccgacuccccaaagcgacugagcgccgcgaucggaaaggccugggaggagggggugugcggcauacgcagcgccacccggcuggagaacaucauguggaagcagauuuccaacgagcugaacuacauccugcuagagaaugacaugaaguucaccguggucgugggugacgugaacggcauacucgcucaagggaaaaagaugauccgcccccaacccauggagcacaaguacucguggaaguccuggggaaaggccaagaucaucggcgccgacauucaaaacacgaccuucaucaucgacgggcccgacaccccggaaugccccgacgaccagcgggccuggaacaucugggaggucgaagacuacggcuucgggauuuucaccacgaacauuugguuaaagcugcgcgacagccacacgcaaaugugugaccaccggcuuauguccgccgccaucaaggacagcaaagcggugcaugcugacaugggcuacuggauugaguccgagaagaacgaaaccuggaagcuggcgcgcgccagcuucauugaggugaagaccugcauauggcccaaaucacacacgcuguggucaaacggcguacucgaguccgagauggugauccccaagaucuacgggggccccaucagccagcacaauuaccggcccggguacuucacccagaccgcuggccccuggcaccuggggaaguuggagcucgacuucgaccugugcgagggcaccacgguugucguggacgagcacugcggcuaccgaggcccgucacugcggaccaccaccgugacgggcaagaucauucacgagugguguugccgcucaugcaccuuaccgccccugcgguuucgcggggaagacggcugcugguacggcauggagauccggcccgucaaggagaaggaggagaaccuugugcgcaguauggugagcgcgggcuccggugagauggacagcuucagccucgggaucuugugcgucuccauccugaucgaggaggugaugcguagccgcuggucccggaagaugcucaugaccggcacccuggcuguguuucuguugcugaucaugggccagcugacguggaacgauuuaauccgccucugcaucauggucggcgcaaacgccagcgacaaaauggggaugggcaccacuuaccuggcuuugauggcuacccugaagaugcgcccgauguucgcaguggggcuccucuuccggcgcuugacuucccgggagguucugcuccugaccgucggccugagccucguggccuccgucgaacugcccaacucacuagaagagcucggcgacggguuagccaugggcaucaugaugcugaagcuccuuaccgacuuccagccacaccagcuauggacaacgcuccugucccugaccuucauccgcacuagccucagccuggacuacgccuggaagaccauggcgauggcccucagcaucgugucccucuucccgcugugccugagcacgaccucccagaagaccaccuggcucccagugcugcugggcagcuucggcugcaagcccuugacgauguuccugauaaccgaaaacaagaucuggggccggaaauccuggcccaucaacgaggggaucauggccgucggcaucgugagcauacugcucuccagccugcugaagaacgacgugccccucgccggaccgcugaucgcggguggcaugcugaucgccugcuacguaaucuccggguccucagccgaccuuucgcuggagaaggccgcagaagucagcugggaggaggaggcggagcauuccggcacuagccacaacauccuuguggaaguccaggacgacgggacuaugaagaucaaagacgaggagcgcgaugacacccucacgauccugcugaaggccacccucuuggccgugucaggcgucuaucccaugagcauccccgccacccuguucgucugguauuucuggcaaaagaagaagcagcgguccggcgugcuaugggacacccccagcccgcccgagguggagcgcgccgugcucgaugacggcaucuaccggaucuuacagcgcggucuacucgggcggucccaggucggcgucggcgucuuucaagacggcguguuccauacgauguggcacgugacccgcggggcgguccugauguaccagggcaagcgacuggagcccagcugggccuccgugaagaaggaccucaucagcuacggcgguggcuggcgcuuccagggcuccuggaacaccggcgaggaggugcaagucaucgccgucgagccugguaagaacccgaagaacguccagacuacccccggaaccuucaagaccccggagggggaggucggggccaucgcccuggacuucaagcccggcaccagcggguccccgauugucaaccgagagggcaagaucgugggucuguacgggaacggcguugugacgaccagcggcaccuacguguccgccaucgcccaggccaaggccacccaggagggaccccucccagagauugaggacgagguauucaagaagcgcaaucugaccaucauggaccugcacccggggucaggcaagaccagacgcuaccugcccgccaucgugcgggaggcgauaaagcgcaagcugcggacccugauccuagccccaacccggguggucgcuucagagauggccgaagcccugaagggcaugcccauccgcuaccaaacgaccgccgugaaguccgagcacacggggcgagagaucguggaucucaugugucacgccacauuuacgaugcgccuccugagcccagugcgggugcccaacuacaacaugaucaucauggacgaggcccacuucacugaccccgccuccaucgcggcccgcggcuauaucagcacccggguggggaugggcgaggccgccgccaucuuuaugaccgcgacacccccgggguccgucgaggcauucccccagagcaacgccgugauccaggaugaggagcgcgauaucccagagcggucuuggaacucuggcuacgauuggaucaccgacuuccccggcaagaccguaugguucgucccauccaucaagagcgggaacgacaucgccaacugccugcguaaaaacggaaaacgugugauccagcucucccgcaaaaccuucgauacggaguaucagaagaccaagaacaacgacugggacuacguggucaccacggauaucagcgagaugggugccaacuuccgggcggaccgcgugaucgacccgaggcgcugucugaaacccgugauccucaaggagggccccgagcgggucauccucgccgggccgaugcccgugacgguugcaucggccgcgcagcgccggggccgcauaggccggaaccaaaacaaggagggugaccaguacaucuacaugggccagccccugaauaacgacgaagaccacgcgcacuggacugaagcgaagaugcuguuggacaacaucaacaccccugaagggaucaucccggcacuguuugagcccgagcgcgagaaguccgcugcgaucgacggggaguaccgccugcgcggggaggccaggaaaaccuuugucgagcucaugcggcgcggcgaccuucccguuuggcuuuccuauaaggucgcuagcgagggcuuucaguauuccgaccggcgcuggugcuucgacggggagcggaauaaccagguucucgaagagaauauggauguggagaucuggacgaaagagggcgagcgcaagaagcugcggccccgauggcuggacgcgcggacauacagcgacccgcucgcccugcgagaauuuaaggaguucgccgcagggcggcgcagugucagcggcgaccugauccucgaaaucggcaaacugccacagcaccugacccuccgugcacagaacgcucuggacaacuuggugaugcuccauaauagcgaacagggcgggaaagccuaccgccacgccauggaggaacugcccgauacuaucgagacccuaaugcuccuggcccugaucgccguacucaccggcggggucacacuguuuuuucuguccgggaaggggcuuggcaagaccagcauugggcuacugugugugauggccuccagcgcuuuacuguggauggcgaguguggagccccacuggaucgcagccagcaucauccuggaguucuuccucaugguucugcugaucccggagcccgaccggcagagaacaccccaggauaaucagcucgccuacguggugauuggccuccuguucaugauccugacugucgcagcuaacgagauggggcugcuggagacuaccaaaaaggaccucggcaucgggcacguggcaguggagaaccaucaccacgcuaccaugcuggacgucgaucuucggcccgcuuccgcguggacgcucuacgccguggccaccaccgugaucacccccaugaugcgccacacgauugaaaacaccaccgccaacaucagccugaccgcuaucgcgaaucaggccgccauccugaugggucucgacaagggcuggcccauuuccaagauggacaucgggguccccuuacuggcgcuuggcugcuacagccaggugaacccgcuaacgcugaccgccgccguacucaugcuggucgcccacuacgccaucaucggacccggccuucaggccaaggcgacccgggaggcacagaagcgcacugccgcugggaucaugaagaacccuaccguggacggcaucguuaccauugaccuugacccagucguguacgacgccaaguucgagaagcagcucggccagaucaugcugcucauuuuguguaccucccaaauccugcucaugagaaccacuugggcccuaugcgaguccaucacacucgccaccgguccgcucaccacgcugugggaggggucccccggcaaauucuggaacacgaccaucgccguguccauggccaacaucuucaggggcuccuaccucgccggcgcggggcucgccuuuucacugaugaagucccugggcgggggccgccgugggacgggcgcccagggcgaaacgcucggugaaaaguggaagcgccagcuuaaccagcugucaaaguccgaguucaacaccuacaagaaguccgguauaauggaagucgaccgguccgaggcuaaggaaggccucaagaggggggaaaccaccaagcacgccgugucccgggggacggcuaagcuccgcugguucgucgagcggaaccugguaaagcccgaaggcaaggucauagaccugggcugcgggcgaggcggguggagcuacuacugugccggccucaagaaaguaacggaggucaaaggguauaccaagggcggccccggucaugaggagccgauccccauggccacauauggguggaaccuggugaagcugcauucggggaaggacguguucuucacgccgccggagaaaugcgacacccuccugugcgacaucggcgagagcuccccaaaccccacgauagaggagggccggaccuugcgcguccucaagaugguggagcccugguugcggggcaaccaguucugcaucaagauccuuaaccccuacaugccgagcguggucgagaccuuagagcagaugcaacgcaaacacggcgggauguuagugcggaacccccugucccgcaacagcacccacgagauguacuggguguccugcggcaccgguaauaucguuucagccguaaacaugacuucccggaugcuccugaaccgauucacaauggcgcaccggaagcccacguacgagcgugacguggaucugggcgccggcacgcgccacgucgcuguggagcccgaggucgccaaccucgacaucaucgggcagcgcauagagaacauuaagaacgagcacaaaagcaccuggcacuacgacgaagacaauccguauaagaccugggccuaucauggcuccuacgaggugaagcccagcggguccgccagcucgauggugaacggcgucgugcgucugcugacgaagcccugggacgugaucccgauggucacccaaaucgccaugacugacacgacgccguucggacagcaacgggucuucaaggaaaagguggacacccgcacaccacgggcuaagcgcggcacggcacagauaauggaggucacugccaaguggcuuuggggcuucuuaagccgaaacaagaagccccgcauuugcacucgggaagaguuuacccgcaaggugaggucgaacgcggccauuggggccguguucgucgaugaaaaccaguggaacagcgccaaggaggccguggaggacgagcgguucugggaucuggugcaccgggagcgugagcuccacaagcaggguaagugcgcaacgugcgucuacaacaugauggguaagcgggagaagaagcucggcgaauucgggaaagccaaggguagccgcgccaucugguauaugugguugggcgcccgguucuuagaguucgaggcgcuuggcuuuaugaacgaggaucauugguucucgcgcgagaacagccuauccggcguggagggggaaggccuccacaagcugggguacauccugcgggacaucagcaagaucccgggcggcaacauguacgccgacgacacggccgggugggacaccaggaucaccgaggacgaccuccagaacgaggccaaaaucaccgacaucauggagcccgagcacgcacugcuggcgacgucuaucuucaagcucaccuaccagaacaaggugguccgggugcagcgacccgcgaagagcgguacagugauggacgucaucucacgccgggaccagcgcgggagcggccaggugggcaccuacgggcugaacacguucacgaacauggaggugcagcugauccggcagauggaguccgagggcaucuuuagcccuuccgagcucgagaccccgaaucuggccaagaagguccuggacuggcucgagaagcacggggccgagcgccugaagcggauggccaucagcggggaugacugcgucgucaagccgauagacgaucgcuucgcgaccgcccugacggcccuuaacgauauggggaagguccggaaggacaucccacagugggagcccagcaaaggcuggaacgacuggcagcagguuccguucugcagccaccauuuccaccagcucaucaugaaggacggccgcgagaucgugguacccuguagaaaucaggacgaacugguggggagggcccggguuucccagggggccggcuggagccuccgcgagaccgcgugccugggaaaauccuacgcccagauguggcagcugauguauuuccaccggcgcgaccuacgacuugccgcgaacgccaucugcuccgcgguccccguggacugggugcccaccagcagaaccaccugguccauccacgcccaccaccaguggaugacgacagaagacaugcucaguguuuggaaccggguguggaucgaagagaacccguggauggaggacaagacccacguuuccuccugggaggaggugcccuaccucgggaagcgcgaggaccaguggugcggcucccugauaggacuuaccgcccgggcgacaugggcgacuaauauccagguggcaauuaaccaggugcggcgccucaucgggaacgagaacuacuuggacuacaugaccagcaugaagcgguucaaaaacgaguccgaccccgaaggcgcccugugguga

SEQ ID NO: 23742 - RNA, 9879 nt, Artificial Sequence
  derived and/or modified CDS sequence (opt11) from DENV-1__KF184975__SS-prME
agcgugaccaugcugcugauguuaaugcccaccgcacuggccuuucaccucaccacacgaggcggggaaccccacaugauagugaguaagcaggagcggggcaagagccuacucuucaagaccuccgcgggugugaacaugugcacccucauagccauggaccuuggcgagcugugcgaggacaccaugaccuauaagugcccccgcaucacggaggcggagcccgaugacguggacugcuggugcaacgccaccgacacaugggucaccuacgguacuugcagccagaccggcgagcaucgaagggacaagcgguccguggcccucgcgccccacguggggcuggggcuggagaccaggaccgagacguggaugagcuccgaaggcgccuggaagcagauacagcggguagagaccugggcccuccgccaucccggguuuacggugauagcccuguuuuuggcucacgccaucggcaccagcaucacccagaaggggauaauuuucauccucuugaugcugguaaccccuuccauggccaugcgcugcgucggaaucggcagcagggauuucgucgaagggcuguccggcgccacuuggguugacguuguacuggagcacgggagcugcgugacuacuauggcaaaggacaagcccacccuggauaucgagcuccugaagacggaggucacaaacccugcggugcuccggaagcucugcaucgaggccaaaaucagcaacaccacgacagacagccgcugcccgacccagggcgaggccacuuuaguggaagaacaggacgccaauuucgucugccgacgcaccuucguugaucggggcuggggaaacggcugcggucuguucggcaaagggucccuccugacgugcgccaaguucaagugugugaccaagcuggaggguaaaauaguccaguaugaaaaccugaaguacagcgugauaguuacuguccacacggaggaucagcaccaggucgggaacgagacaacagagcacggaaccauugcgaccauuaccccacaagccccuacguccgagauccagcugaccgacuacggcgccuuaacucucgacugcagcccccggaccggucuggacuuuaacgaaaugguccugcucacgaugaaggagaagucuuggcugguucacaaacagugguuccuggaccucccccugcccuggaccagcggagcuagcacuucccaggagaccuggaaccgacaggaccuccucgucacguucaagacggcccacgcgaagaagcaagaggucguggugcugggaagucaagagggcgcuaugcacaccgcccugacaggggccacggagauccagaccuccgggacgacuacgaucuucgccggccaccuuaagugccgccugaagauggauaaacugacccucaaggggaugucauacgugauguguaccggcuccuucaagcuggagaaagaaguggcggagacccagcacgggacggugcugguccagguaaaguacgagggcaccgacgcacccugcaagauccccuuuagcauccaggacgagaagggugugauccagaacgggcggcugaucaccgcgaacccgaucgucaccgacaaggagaagccagugaacaucgagacugagccgcccuucggcgaguccuacaucguugucggggcaggcgagaagacccugaagcugagcugguucaagaagggcuccagcauugggaagauguucgaggcuacagcccgcggugcuagacgcauggccauccugggcgauacagccugggacuucggauccaucgggggaguguuuacgagcgucggcaaacuuguccaccagguguucgggaccgcguauggcguguuauuuucuggggucagcuggacuaugaaaaucggcaucggcauccugcucaccuggcuuggucuaaauucccguaguacgucucucaguaugaccugcaucgccguaggcaugguaacccuguauuuaggggucauggugcaggccgacuccggcugcgugauuaacuggaaggggcgugaacugaagugcggcucaggcauauucgucaccaaugaagugcauacguggaccgagcaguacaaguuucaggccgauucgccgaagcgccuguccgccgcgaucggaaaagccugggaggaaggagugugcgggauacggagcgcgacccgccuggagaacgucauguggaaacagauauccaacgagcuuaaccauauccuacuggagaacgacaugaaguucacagugguagucggggacgugaaugggauacucgcccaagggaagaaaauggugcggccucagccuauggagcacaaguacaguuggaaguccuggggaaaggccaagaucaucggugcggacauccagaacaccaccuuuaucauagauggcccggacaccccggaaugcccggacgaccagcgcgccuggaacaucugggaggucgaggauuacggguucggcaucuucaccaccaacaucuggcugaagcugcgggacagcuacacgcagaugugcgaccaccgccucauguccgcugcgaucaaagacagcaaggcggugcaugccgacaugggguacuggauagaauccgagaagaacgagaccuggaagcuggcccgggcauccuucaucgaagugaagaccugcauuuggcccaaaagucacacccuguggagcaacggcguucuagagagcgagaugaucauccccaagauauacggaggcccgacgucccagcacaacuaccggcccggcuacuucacccaaaccgcuggcccauggcaccuggguaagcuggagcuggacuucgaccugugcgaggggaccacgguuguugucgacgaacacugcggcaaccggggcccgagucugcgcacgaccaccgugacagggaagaucauucacgaguggugcugccggaguugcacacugcccccacuucgcuucaagggcgaggacggguguugguauggcauggaaauccggcccgugaaggagaaggaagagaacuuaguacgcuccauggucagcgccgggagcggcgagguagacaauuucucccucggucugcugugcgucagcaucauggucgaggaggugaugcggucccgcuggucccggaagauguugaugacgggaacccucgccgucuuccugcuccugauaaugggccagcuaacguggaacgaccucauccgacugugcauuauggugggagccaaugccuccgaccgcaugggcaugggcacaaccuacuuagcccucauggcgacguucaaaaugcggccgauguuugcaguuggucuccuguuccgccgacugacgagccgggaggugcuucuccucaccaucggcuugucccugguagccagcguagaguuacccaacuccuuagaagaacucggggauggccucgccauggggauaaugaugcugaaguugcucaccgauuuucaaagccaccagcuguggaccacacugcucucccugacuuucgugaagaccacccugagccucgacuacgccuggaagacaauggcgaugguguuauccaucgugucacuguucccguuaugccuuagcaccaccagccagaagacgacguggcuccccgugcuccugggcuccuucggcugcaaaccgcugaccauguuucucaucaccgagaauaagaucugggggagaaaaagcuggccccugaaugaggguaucauggccguagggaucgccuccauccugcucagcucuuuacugaagaacgacguaccccuugccggcccccuuaucgccggugggaugcugauagcuugcuacgugauuagugggagcagcgccgacuugagccuagaaaaggccgcugagguguccugggaggaagaggcggagcacagcggggccucccacaacauccuggucgaaguacaggaugacggcaccaugaagaucaaggacgaggaacgcgaugacacccucacgauccugcuuaaggcuacacuccuggccgugucaggcguguacccuauguccauucccgcaacacucuucgugugguauuucuggcagaaaaagaagcagcgaagcggcguguugugggauacccccagcccgcccgaagcugaaaaagccguccuugacgacggcaucuaucgcauccugcaacggggguugcucggccgcagccaggucggggugggugucuuccaggacgggguguuccacacgauguggcacguaacccggggagccguucugauguaccaagggaagcgcguggaacccuccugggccagcguaaagaaggaccugaucuccuacggcggcggguggcgguuccaaggccuguggaauaccggggaggagguucaggugaucgccguugagcccggaaagaacccccgaaauguccagaccacgcccggaaccuucaagacccccgagggcgaagugggcgcgaucgcgcuggacuucaaacccggaaccagcggcucccccaucgugaaccgggaggggaagaucgucggccuguacgggaacgggguggugacgaccagcgguaccuaugucuccgccaucgcacaggcaaaggcaagccaggagggcccacucccugagaucgaggacgagguguuccgcaagcggaacuuaaccaucauggaccugcacccaggcucaggcaagacgcgacgguacuugccagccaucgugcgcgaggcuaucaaacggaagcugcgcacccucauccucgcccccaccagggugguggcauccgagauggccgaagcccugaaggggaugcccauucgguaccagaccaccgccgugaagaccgagcauaccggacgggagaucgucgaccugaugugccaugccaccuuuaccaugcgguuacugagccccguacgcgucccgaacuacaacaugaucaucauggaugaggcgcacuuuaccgaccccgccucuauagccgccaggggguacaucagcacacgcgucggaaugggggaggccgcagccaucuuuaugaccgccacgccgcccgguuccauggaggcuuucccgcagagcaacgccgucauccaggacgaggagcgggacauucccgagcgcuccuggaacagcggguacgacuggaucacagacuuccccggcaagaccguaugguucguccccucgaucaagagcggcaaugacaucgcgaacugucugcggaagaaugggaagcgcgucauccaacucucaagaaagaccuucgacacggaguaucagaagaccaagaacaacgacugggacuacguggucaccaccgauaucuccgagaugggcgccaacuuccgggccgaccgggucaucgauccgcgcagaugucugaagcccgugauacugaaggacgggcccgagcggguuauccucgccggccccaugccggugacggucgcgucagccgcccagagacgcgggcggauuggacgaaaucaaaacaaagagggggaccaguauguauacaugggccagccacugaauaaugacgaagaucacgcccacuggaccgaggccaagaugcuguuagacaacaucaacacgccugagggcauaauccccgcacuguucgagccggagcgcgaaaaguccgccgccaucgacggggaguaucggcuucggggcgaggcccggaagaccuucguggaacucaugcgccgcggcgaucugccuguauggcugucuuacaagguggccuccgagggcuuccaguauuccgaccgccgguggugcuucgacggcgagcgcaacaaccagguacuggaagagaauauggacgucgagaucuggacgaaagagggggagcgaaagaaacugcgcccccggugguuggacgccaggacauauagcgacccccucgcgcuacgggaguucaaagaguucgccgccggucgucgguccgucaguggggaccucauccucgagauaggucggcuuccgcagcaccuuacacucaaagcccagaacgcgcuggacaaccuggugauguugcacaacucugagcagggcgggaaggccuaccggcacgccauggaggagcugccugacaccaucgaaacccugaugcuccuggccuuaaucgcgguccucacgggcggggugacccuguucuuccuguccggcaaggggcugggcaagaccuccaucggccuguugugcgugauggccuccagcgugcuccuguggauggccuccguggaaccacauuggaucgcugccagcaucauucuggaguucuuccucauggugcugcugauccccgagcccgaccggcagcggacaccccaggacaaccagcucgccuacguggugaucgggcugcuguucaucauacucacgguagccgccaacgagaugggccugcuagagacaaccaagaaggaccuugggaucggccacgucgcugccgaggaccaccagcacgcuaccaugcuggacguggaccugagacccgccucggccuggacgcuauacgcgguggccaccacuaucaucaccccgaugaugcggcacacgauugagaacacgacagcgaacaucagccucaccgccauagccaaccaagccgccauccugauggggcuugacaagggcuggcccaucagcaaaauggacaucggcgucccgcuuuuggcgcucgguuguuacagccaggucaacccauuaacguuaaccgccgccgugcuuauguuagucgcccacuacgcaaucauuggcccggggcugcaggccaaggccacccgcgaggcccagaagcgaaccgcagcgggcaucaugaagaacccuacgguggacgggauuguggcuaucgaccucgauccagucguauaugauacaaaauuugagaagcagcuuggccaaaucaugcugcucauccugugcacaucgcagauccugcucaugcggaccacgugggcccugugcgagagcauuacccuggccaccggucccuugaccacucugugggaggggagcccgggcaaauucuggaacaccacgaucgcgguaagcauggccaacaucuuucgcgggagcuaccuggccggcgccggccucgccuucucuuugaugaagucacuagggggcgggcggcgcgggaccggcgcccagggcgagacgcucggugagaaguggaagcggcaacuaaaccagcuuagcaaaagcgaguucaacaccuacaagcgcagcgggauaacggaaguggaccggagcgaggcuaaggagggccucaagcggggugaaaccacgaagcaugccguguccagaggcgccgccaagcugaggugguucguugagcguaacuuggucaaaccggaggggaaggugaucgaccugggcuguggcagaggaggcuggucauauuacugcgcggggcucaagaaaguaacagaagucaaaggcuacaccaagggcgggccugggcacgaggagcccaucccgauggccaccuacggcuggaacuuaguuaagcugcacuccggcaaggacguguucuucaucccgccugagaagugcgacacucuccucugcgacaucggcgagagcagccccaauccgacuaucgaggaaggccggacccugcgcguccuaaagaugguggaacccuggcugagggggaaccaguucugcauuaagauccugaaccccuacaugcccucgguggucgagacguuggagcagaugcagcgcaaacacggcggcaugcuggugcggaacccccugucccgcaacaguacccacgagauguacuggguguccugcgggacgggcaauauaguuucugcagugaacaugaccagccggaugcuacugaaccgguucaccauggcccaccgcaagccuaccuacgagcgggacguagaccugggggccggcacgcgccacgucgcgguggagccugagguggccaaccucgacaucauuggccagcggauagaaaacaucaagaacgagcacaagaguacguggcacuacgaugaagacaaucccuacaagaccugggccuaccacggauccuacgaagugaagccgagcggcagcgccaguuccauggugaacgggguuguacgccuucugaccaagcccugggaugugauccccauggucacccagauugccaugacugacaccacucccuucggccagcagcgcguguucaaggagaagguagacacgcggaccccgcgggcuaagcgcgggaccgcccaaaucauggagguuaccgccaaauggcucuggggcuuccucucacggaacaagaagccccgcaucugcacgcgugaggaguucacacgcaagguacgguccaacgcugccaucggcgcggucuucgucgacgaaaaccaguggaauagcgccaaagaggcgguagaggacgagcgcuucugggaccugguucaucgggagcgcgagcugcacaagcaggggaagugcgcuacaugcguguauaacaugaugggcaagcgugagaaaaagcucggagaguucggaaaggcgaaggggagucgcgccauuugguacauguggcugggggcccgguuccucgaguucgaggcccugggauucaugaacgaggaucacugguucucucgcgaaaacagccuguccgggguggaaggcgaaggguugcacaagcugggcuacauccugcgggauaucagcaagauuccugggggcaacauguacgccgacgauaccgcaggcugggacacgcgcaucaccgaggacgaucuacagaacgaagcuaagauaacugacaucauggagccugaacacgcccugcuggccaccucgaucuucaagcucacauaccagaacaagguuguccgcguccagcggcccgcaaagagcgggaccguaauggacgucaucucccgucgagaccagcgcgguaguggccaggucgguaccuacggccugaacaccuucacaaauauggaggugcagcugauccgucagauggaauccgaggggaucuuccuccccagcgagcuggagacucccaaccuagcggagcgcgcgcucgacuggcuggagaagcacggcguagagcggcuaaaaagaauggcaauaaguggggacgacuguguggugaagccgaccgacgaccgguucgccacugcccucacggcacugaacgacaugggcaagguccgcaaggacaucccucaaugggagcccagcaagggguggaacgacuggcaacaggugcccuucugcucccaccacuuccaccaguugauaaugaaagacggccgggagaucguggucccgugccggaaucaagacgagcucgugggccgggcccgcgugucccagggggccggguggucccugcgggagaccgccugccugggcaagagcuacgcccagauguggcagcucauguacuuccaccgccgcgaccugcgccucgcggcuaacgccaucugcuccgccguccccguugacugggugcccaccucucggacuaccuggaguauccacgcccaccaccaguggaugacgacggaggacaugcuguccgucuggaacaggguguggaucgaagagaaccccuggauggaggacaagacccaugugagcucgugggaggacgucccguaucugggcaagcgggaggaccaauggugcgggucucuaaucggccucaccgcgcgggcuacgugggccacuaacauccagguggcgaucaaccaagugcgcagacugaucggcaacgagaacuaccuggacuacaugaccucuaugaagcgcuucaagaacgagucggaccccgaaggggcacucugguaa

SEQ ID NO: 23743 - RNA, 9879 nt, Artificial Sequence
  derived and/or modified CDS sequence (opt11) from DENV-1__KT831765__SS-prME
ucugucaccaugcuccucaugcugaugcccacggccuuggccuuucaccucaccacgagaggcggggagccccacaugaucgugagcaagcaggagcggggcaagagcuugcuguucaagacuagcgccggggugaacaugugcacccugauugcgauggaccuuggcgagcugugcgaggauacuaugacuuacaaguguccccggaucaccgaggccgagcccgacgacgucgacugcuggugcaaugccaccgacacguggguaaccuacgguaccugcagccaaaccggcgagcaccggcgcgacaaacgguccguggcccucgcgccccacgugggccugggccuggagacucggacggagaccuggaugucguccgagggcgcuuggaagcagauccagcgggucgagacgugggcacucagacaccccggguucacggugaucgccuuauuccuggcacaugccaucggcaccagcaucacccagaaggggaucaucuucauccuccugaugcuugugacgccaucaauggcaaugcggugcguuggcaucggaagcagagacuucguggaggggcugucgggugccacguggguggacgucgugcuugagcacgggagcugcgucaccaccauggccaaggacaagccaacccuagacauugagcuccuuaagacggaggucacuaaccccgcagugcugaggaaguugugcaucgaggccaagauuuccaacaccaccaccgacucucgcuguccaacccaaggugaggcaacccugguggaggagcaggacgccaacuuugucugccggcgcaccuucguggaccggggaugggggaacggaugcgggcuguuuggcaaggggucccucaucacgugcgccaaguucaagugcgugaccaagcuggagggcaagauaguucaguaugagaaccuaaaauauagcgugaucgugaccguccacaccggcgaccagcaccaaguggggaacgaguccacggagcacggcacgaccgcgaccauuacgccgcaagccccuaccaccgaaauacagcucaccgacuacggugcgcugacccuggacuguagcccccggacgggucucgauuuuaacgaaaugguacugcuaaccaugaaggagaaguccuggcucguucacaagcaaugguucuuagaccugccgcuacccuggaccagcggggcuagcaccucccaggaaacguggaaccggcaggaccugcuaguaacguucaagaccgcccacgcgaagaagcaggaggucguagugcugggcagccaggagggugccaugcauaccgcccugacgggggccacugagauccagaccuccggaacuacgaccaucuucgccgggcaccugaagugccgccuuaagauggacaagcuaacccugaaggggaugagcuacgugaugugcaccggguccuucaagcuggagaaggaaguggcggaaacgcagcauggcaccgugcugguccaaaucaaguacgaggggacagaugccccuuguaagaucccguucagcacacaggacgagaaaggggugacgcaaaacggccggcugaucaccgccaacccgauuguaaccgacaaggagaagccgguaaauaucgaggcagagccgcccuucggggaguccuacaucgugaucggagcgggcgaaaaggcccuuaagcucucgugguucaagaaggggucaagcauuggcaagauguuugaagccacugcccgcggggcccggcguauggcgauccugggcgacacggcgugggauuucggauccaucgguggcguguucaccagcgucgggaaacuggugcaccagaucuucggcaccgccuacgggguacuuuucucuggcguuagcuggacuaugaagaucggaaucggcguacugcugacguggcucggacugaacagccgcagcaccucccuaagcaugaccugcaucgccguugggcucguuacccuguacuuaggcgugauggugcaggcggacaguggaugcgucaucaacuggaaggggcgggagcucaagugugggagcgggaucuucgugacuaacgaaguacacaccuggaccgaacaauauaaguuccaggcggauagcccaaagcggcuguccgccgccauaggcaaggccugggaggaaggcgugugcgguauccggagcgccacccgguuggagaacaucauguggaagcagaucuccaaugagcucaaccacauccuacuggaaaacgauaugaaguucacgguggucguaggagacguggcgggcauccucgcccaggggaagaagaugauccggccacagccuauggagcacaaguacagcuggaaauccuggggcaaggccaagaucaucggcgccgacguccagaacacuaccuucauuaucgacgggcccaacaccccggagugccccgacgaccagcgcgcuuggaacauaugggagguggaggauuacggguuugggauuuucaccacgaacauuugguugaagcugcgggacucauacacccaggugugcgaccaccgccucaugucagccgccaucaaggacaguaaggccgugcacgccgauaugggcuacuggaucgagagugaaaagaaugagacuuggaaacuggcgagggccucguucaucgagguaaagaccugcaucuggcccaaaucccacacgcuguggagcaacggaguguuggaguccgagaugauaauccccaaaauauacgggggcccuaucagccagcacaaccaccgccccggguacuucacccagaccgccggacccuggcauuuggggaaacuggagcucgacuucgaucuaugugaagggaccacgguggucgucgacgaacauugcggcaaccgggggccgucccugcgcacgaccaccgugacuggcaagaucauccacgaauggugcugccggaguugcacacuuccgccccugcgcuaucgcggggaggacggcugcugguacgggauggagauccgccccgucaaggagaaggaggagaaccuggugaaaaguauggugagcgccggcagcggcgagguggacuccuuuagccucgggcugcugugcauuuccaucaugaucgaagagguaaugcggagccgcuggucccggaagauguuaaugaccggcacccuggcggucuucuuucugcucaucauggggcaguuaacguggaacgauuugauacgccucugcaucauggucggcgcgaacgccuccgaccgcaugggcaugggcacaacauaucuggccuuaauggcaaccuucaagaugcggccgauguuugccguggggcuccuguuccgccggcugacgagucgugaggugcuccuccugaccaucgggcucagcuugguugcuaguguugagcugccaaacagucucgaggaauuaggugacggucuggccauggggaucaugaucuugaaguuauuaacggauuuccaaucccaccagcuuugggcaacacugcugagccucacauucaucaagaccaccuucucucugcacuacgcauggaaaacuauggcgaugguccuaagcaucgugucccuuuuuccccugugccugagcacuaccucccagaagaccacguggcuccccgugcuauugggcagccucgguugcaagccgcugacgauguuccugaucgccgagaacaagaucuggggacggaaguccuggccccucaaugaggggauaauggccguuggcaucguguccauccugcugagcucccuccugaagaacgacgugccgcucgcagggccccucaucgccggcggcaugcugauugcuugcuacgucaucagcggguccagcgcagauuuaagccuagagaaggccgccgaggugagcugggaggaggaggccgagcacucgggcgcaagccacaacaucuuaguagagguccaggacgauggcaccaugaagaucaaggacgaggaaagagacgacacauuaaccauacuccugaaggccacguuacuugccguguccggcguguacccgcuuagcauccccgccacgcuuuucguaugguacuucuggcagaaaaagaagcagcgguccggcgugcucugggacacccccucgccgcccgagguggagcgcgccgugcuggaugacgggauauaccgaaucaugcagcgcggucugcuggggaggucccaggucggcgucggggucuuucaggaaaacguguuccacacgauguggcacgugacccgcggcgcgguccucauguaccaggggaaacgccuggagcccagcugggccuccgugaagaaggaccugaucagcuacggcggcggguggcgccuccagggcuccuggaacacgggcgaggaggugcaggucaucgcgguggagcccggcaaaaaucccaagaacgugcaaaccgcccccgggaccuucaagacaccugagggagaggucggcgcgaucgcucuagacuucaagcccgggacgagcggcuccccaauagugaaucgcgaggggaagauagugggccuauacgguaacggaguggugaccacgagcggcacguacgugagcgccaucgcccaggcgaaggcgucacaggaggggccgcuccccgaaaucgaggacgagguuuuccgcaagagaaaucucaccaucauggaccugcaccccggaagcgggaagacccgccguuaccucccggccauugugcgcgaagccaucaagcggaagcugcggacacugauccucgcccccacccgcguggucgccuccgaaauggcggaggcccugaaaggcaugccaauuagauaccagacaacagccgucaaaagcgagcacaccggcaaagagaucguugaccugaugugccaugccaccuucacgaugcgcuugcugucccccguccgcgugccgaacuacaacaugaucaucauggaugaggcccacuuuaccgaccccucauccaucgcggcccgcggguacauaagcacccgggugggcaugggagaagcggccgcgaucuucaugaccgccacgccgcccggaucggucgaggccuucccgcagagcaacgccgugauucaggacgaggaaagagacauccccgaacgcuccuggaacagcggguacgaguggaucaccgacuucccggguaagacugugugguucgucccaaguaucaaaagcggcaacgacaucgccaacugccugcggaagaacgggaagcgggugauccagcuaagucgaaaaaccuucgacacggaguaucagaagaccaagaacaacgacugggacuacguggucaccacagauaucagcgaaaugggcgcgaauuuucgugcggaccgggugaucgauccgcgucgcugucuuaagcccgugauacugaaggacgggcccgagcgcgugauucucgcgggacccaugccugugacggucgcguccgccgcgcagcgccgggggcgcaucggcagaaaccacaacaaagaaggcgaccaguacaucuacaugggucagccccuaaacaacgacgaggaccaugcccacuggacagaggccaagaugcuguuggauaacaucaacaccccagaggguaucauucccgcccucuucgaaccggaacgcgaaaaauccgccgcgaucgauggcgaguaccgcuugcggggagaagcccgaaagaccuuuguugaguuaaugcgucgcggggaccugcccguguggcuguccuacaaggucgccagcgagggcuuccaguauagcgaucggcgcuggugcuuugacggggagcggaauaaccaggugcucgaagagaacauggauguggagaucuggaccaaggagggcgagcguaagaaguuacggccccgcuggcuggacgcccggaccuacuccgacccccucgccuuacgcgaguucaaggaguucgcugccggccgucgcuccgucucuggggaccugauccucgagaucggcaagcugccgcaacacuugacccagcgggcccaaaaugcgcucgacaaccuggugauguuacauaauagcgagcagggcgggcgagcguaccggcacgccauggaggaauugcccgauaccaucgagacgcugaugcuguuagcccuaaucgccgugcugacgggcggggucacacucuucuuccuguccggcaagggccugggcaaaaccagcauuggccuucuaugcgugauggccagcagcgugcuacucuggauggcguccgucgagccccauuggaucgccgccaguaucauccuggaguucuuccuuaugguucugcugaucccugaaccagaucgccagcggacaccccaggacaaccagcuggccuacguggucauugggaugcuguucaugauccugacaguggccgcgaaugagaugggccugcucgagaccaccaaaaaggaccuggggauaggccacguggccgucgagaaccaccaccacgccgccaugcuugacguagaccuccacccggccuccgcguggaccuuguacgccguggccacaaccaucaucaccccgaugaugcgccacacgaucgagaacacgaccgccaacaucagcuugaccgccaucgcgaaccaggccgccauccucaugggacuggauaaaggguggccuauuuccaaaauggacaucggcguuccccuguuagcccuggggugcuacagccaagugaauccucugacccucaccgcggcaguacugaugcugguagcccacuacgccaucaucggcccggggcuccaggccaaggcgacccgggaagcccagaaacgcacagccgcgggcaucaugaaaaaccccacuguggaugggaucguggccauugaccuggaccccgucguauacgacgcgaaguuugaaaagcagcuuggccagaucaugcuccugauccugugcacgucgcagauccuccugaugcgaaccaccugggcccugugcgagagcaucacccucgccacgggcccccugacuacccucugggaaggguccccgggcaaguucuggaacaccacgauagccguuagcauggccaacauauuucgggggagcuaccucgcuggcgccggccuggccuuuagccucaugaagucccuugggggugggcgccgaggcaccggggcccaaggagagacccugggagagaaguggaaacgccaacugaaccaacucuccaagagcgaguucaacacauacaagcgguccgggaucauggaagucgacagguccgaggccaaggagggccugaagcgaggggagacgaccaaacaugccgugucccgcgggaccgccaagcuccggugguucguggagcguaaccucgucaaacccgaggggaaggugaucgaccugggcugcggccgcggcgguuggucuuauuacugugcuggguuaaagaaggugaccgaagucaagggguacacgaaagggggucccggccacgaggagccaaucccgauggcaaccuacggguggaaucuggugaagcuccacucaggcaaggacguguucuucgugccgcccgagaaaugcgacacccugcugugcgacaucggggagucaucccccaacccgaccaucgaggagggcaggacgcugcggguccugaagaugguggagcccuggcugcgcgguaaccaguucugcaucaagauccucaaccccuacaugcccucggucguagagacacuagagcagaugcagcgcaagcacggcggcauguuggugcgcaacccgcucucccggaauagcacccacgagauguacugggucuccugcgggacaggcaacaucgugagcgcgaucaacaugacauccagaauguuguugaaccgguuuacgauggcccaucgcaagcccacguaugaacgagacguggaccucggcgccggcacgcggcacgucaccguggagcccgagguugccaaccuagacaucaucggccagcgcaucgagaacaucaagugcgaacacaagagcacguggcacuacgacgaggacaaucccuacaagacaugggccuaccacgguuccuaugaggucaagccgagcggcuccgcgucgagcauggugaacgguguagugaaguuauuaaccaagcccugggacgugauacccauggucacccagaucgcgaugacggacaccacccccuuuggacagcaaaggguguucaaggagaagguggauacccgcacgccgaaagcaaagcgagggaccgcacagaucauggaagucaccgcccguuggcuuuggggcuuccugucccggaacaagaagccacgcauauguacccgagaggaguuuacucggaagguaagaagcaacgcggcuaucggggccguguuugucgacgagaaccaguggaacucagcgaaagaggcuguggaggacgagcgcuucugggaccucgugcaccgugagcgcgagcuucauaagcaagggaaaugcgcaacuugcgucuacaauaugauggggaagcgcgagaaaaagcugggggaguucggcaaggccaaagggucgcgcgcuaucugguacauguggcuuggugcucgguuucuugaguucgaggcauuagguuucaugaacgaggaccacugguucucccgcgagaacagccucagugggguggagggcgaggggcugcacaagcugggcuacauacucagagacaucagcaagauauccgggggcaacauguacgccgacgauaccgcugggugggauacccgcaucacggaggacgaccuacagaaugaagccaagaucacggaaaucauggagcccgaacaugcacagcuggcgaaggccaucuucaagcucaccuaccagaacaaagugguccgugugcagcgcccggcgaaaaacgggaccgugauggacgugaucagccgccgggaccagcgcggcuccggccaaguggggacguacggccugaauaccuucaccaacauggaggcccagcugauccggcagauggagagcgaggggaucuucucccccagcgagcucgagacccccaaucuggccgagcgcgugcucgacuggcucgaaaaguacggcgucgagcgucuaaaacguauggcgauauccggggacgacugcguggugaagccuaucgacgaucgguucgcuacggcccugaccgcccucaacgacauggggaagguccgcaaggacaucccgcagugggagcccagcaagggguggaacgacuggcaacaggugcccuuuugcucccaccacuuccaccaauuaaucaugaaggacggccgggagauagugguacccugucgcaaccaggaugagcuugugggcagggcccgcgugucgcaaggggcgggcuggagccuccgggaaaccgccugucugggaaagagcuacgcacagauguggcagcugauguauuuccacagaagggacuuacgccuugcggcgaacgcgaucugcagcgcuguccccguggacugggugcccaccucccgcaccaccuggagcauccacgcucaccaccaguggaugaccaccgaagacaugcuguccgucuggaaccgcgucuggaucgaggagaaccccuggauggaggacaagacucacaucagcuccugggaagacguacccuaccucggcaagagagaggaccaauggugugggagcuuaauaggcuuaacugcucgagcgacaugggccaccaacauccagguugccauuaaccagguccgccgccucaucgggaacgaaaauuaccuggauuauaugacauccaugaagagguuuaagaacgaaucagacccggagggggcucuuugguga

SEQ ID NO: 23744 - RNA, 9879 nt, Artificial Sequence
  derived and/or modified CDS sequence (opt11) from DENV-1__KP188567__SS-prME
agcgugacgauguuacuuauguugcugccgaccgcacucgccuuccaccugaccacgcgaggcggggagccccacaugauuguaagcaagcaggagcguggaaagagccucuuguucaagacgagcgugggggugaauauguguacccugaucgcgauggaccugggggagcucugcgaagacacgaugaccuacaagugcccucggaucaccgaagccgagccagacgacgucgacugcuggugcaaugccaccgauaccugggugaccuacgggacuugcagccaaaccggggagcaccggcgggauaaacgguccguggcucuggcgccucauguugggcugggauuggagacgaggaccgagaccuggaugucauccgaaggcgcuuggaaacagauccagaagguggagaccugggcccuucggcacccaggguucacagugaucgcccuauuccucgcccacgcgaucggaacuagcaucacccagaaggggaucauauuuauccucuuaaugcucgucacccccagcauggccaugcgcugcguggguauuggaaaccgggauuucguggagggacugagcggcgccacgugggucgacguggugcuggagcacggauccugcgucaccacuauggcgaagaacaagcccaccuuggacaucgaacugcuuaagacggaggucacuaaccccgccauucucagaaagcuguguaucgaggcuaagaucagcaacaccaccacggacucccguugccccacccagggugaggccacccugguggaggagcaggacgccaacuucgugugucgccggacguucguggaucgcggcugggguaauggcugcggccucuucggcaaaggcagccugcugacgugcgcgaaguucaaguguguaacuaagcucgagggaaagauuguccaguaugagaaccugaaauacuccguuauagugaccguccacacuggcgaccagcaccaagugggaaacgagaccaccgagcacggaacaaucgcaaccauaacgccucaagcaccaacgagcgagauccagcugacugacuauggggcccucacucuggacuguaguccccggaccggccuggacuucaacgagaugguccuccugacgaugaaggagaaguccuggcugguucauaagcagugguuucuagaccugcccuuacccuggaccuccggggccuccaccagccaggagacuuggaaucgccaagauuugcuggucacguucaagaccgcccacgccaagaagcaggaggucguggugcuaggcucccaagaaggcgcgaugcacaccgcccuuaccggggccacggagauccagacgagcgguaccaccacgauuuucgccgggcaucugaagugcaggcugaagauggacaagcucacccugaagggcaugagcuacguaaugugcaccgggagcuuuaaacuggagaaggaaguggccgagacccagcacggcacaguccugguccagguaaaauacgagggcaccgacgcacccugcaaaauccccuuccuuacccaggacgaaaagggugucacucagaacggucgccugaucacggccaacccgaucgucaccgacaaagagaagccggugaacaucgagaccgagccgcccuucggggagucguauaucguggucggcgccggcgagaaggccuuaaaacucaguugguucaagaagggauccagcaucggcaagauguucgaagcgaccgcccgcggggcucgccggauggccauccugggggauacggccugggauuucggguccaucgguggcuuguucaccagcguugggaagcucauccaccagguguucgggacagcguacggugucuuauucucugguguaagcuggaccaugaagauugggauagggaucuuauugacguggcuaggccuaaacucccgcagcacuucccucagcaugaccuguaucgccgugggcaugguuacccuguaucugggcgugaugguacaagccgacuccgggugcgucaucaacuggaagggacgggagcucaaaugcgggagcggcaucuucgugacgaacgagguccacacguggaccgagcaauacaaguuccaggccgacuccccgaagcggcugagcgccgcuaucgggaaggccugggaagaggggguaugcggcauacgcagcgcaacucgguuggagaacauuauguggaagcagauuuccaacgaguugaacuacauccugcuggagaacgacaugaaguuuaccgugguggucggagacgucaacgguauccuagcccagggcaaaaagaugaucaagccccagcccauggagcacaaauacagcuggaaaucaugggggaaggccaagaucaucggggcggacauccagaacacgaccuuuauaaucgacggucccgacacgccggagugccccgacgaccagcgcgcuuggaacaucugggagguugaggacuacgguuucggaauauuuaccacgaacaucuggcugaaacugcgugacagccacacacagaugugcgaccaccgccucaugucagcagcuaucaaagacagcaaggcaguccacgccgacaugggcuacuggaucgagucggagaagaacgagacauggaagcuggcacgggccagcuuuaucgaaguaaagacguguaucuggcccaagucgcacacgcuguggagcaacggcguguuagaauccgagauggucauccccaagaucuacgguggcccuaucagccaacacaacuaccgacccgguuacuucacacagaccgccgggcccuggcaucucgggaagcuggaacucgauuuugaccugugcgagggaaccacgguggugguagacgagcacuguggauaccggggaccgucccugcgaaccacaacagugacgggcaaaauaauccacgaguggugcugccggagcugcacccugccuccgcuucgcuuucgcggagaggacggcugcugguaugguauggaaauaaggcccgucaaggagaaggaggagaacuugguccgguccauggugagugcugggaguggcgagguggacagcuucagccuugggauccugugcgucuccaucuuaaucgaggaagugaugcgcaguagguggucccgaaaaaugcucaugaccggcaccuuggccguguuccuucucuuaaucauggggcagcugacguggaacgaccucauccggcugugcaucauggucggcgccaaugcccuggaccguauggggaugggcaccaccuaucucgccuuaauggcaacguucaagaugcgcccgauguucgccgugggccuccucuuccggcgcuuaacgucccgggagguccuccuacucacugucgggcugucccugguggccagcgucgagcugcccucaagccuggaagaacucggcgacggguuggccaugggcaucaugaugcugaagcuccugacagauuuccaaccacaccagcuguggaccacgcuccuaucccugaccuuuauccgcacgucuuuaucccuggacuacgccuggaagaccauggcgauggcccugucuaucgucucacuauucccccuuugucuguccacgaccucccagaaaacaaccuggcucccggugcugcugggcagcuuuggcugcaagccccucacaauguuucugaucacagagaacaagaucuggggcagaaagucuuggcccaucaacgagggaauuauggcuguggggauugugaguauacugcucuccagccugcucaagaaugacgugccucuagccgggccccugaucgcgggcgggaugcugauugcgugcuauguuauuucaggguccagcgccgaccucagccuggagaaagcggcagagguaagcugggaggaagaagccgagcacuccggcacgagccacaacauccugguggagguccaagacgacgggacaaugaagaucaaggaugaggaacgugacgacacccucacgauccugcugaaagccacccuccuggccgugagcggcguguaccccaugagcauuccagccacucuguucgucugguacuucuggcagaagaagaagcagcgguccggcguucugugggacacgccgucgccgccagagguggagcgcgccguacucgaugacggcaucuaccggauccuacagcgcggccuacucgggcggucccaaguggguguuggggucuuccaagacggcguuuuccacacgauguggcaugugacccgcggggccguucugauguaccaaggcaaaaggcucgagccaagcugggccuccgugaagaaggacuugauuucguacggcggaggguggcgauuccaggggagcuggaacaccggcgaagaggugcaggucaucgccguggagcccgggaagaaccccaaaaauguccagacuacacccggcacuuucaaaacuccggagggcgaggucggggccauagcacuggacuucaagcccggcaccagcgggucccccaucgugaaccgggaaggcaagauaguugggcuguaugggaacggcgucgugacgacgagcgggaccuauguauccgcaaucgcccaggccaaagccacccaggagggcaccuuacccgagaucgaagacgagguauucaagaagaggaaccugaccaucauggacuuacaccccgggucuggcaagaccaggcgguaucucccggccaucguccgggaggcgaucaaacgcaagcugcggacacugauacucgcccccacccgcguggucgccucugagauggccgaggcgcugaagggcaugcccaucagguaccagacgacugcugugaaguccgagcauaccgguagagagauuguggacuuaaugugccacgccacauuuaccaugagacuccugucucccguucgggugccgaacuauaauaugauuaucauggaugaggcucacuuuacagaccccgccuccaucgcagcgcgcggauauaucucuacgcggguagggaugggcgaggccgcugccaucuucaugacggcgacgccgccugggucggucgaggcuuucccacagagcaaugccguuauucaggacgaagaacgggacauccccgagcgaucguggaacuccggcuacgacuggaucaccgacuuccccggcaagaccguaugguuuguaccguccauaaagagcgguaacgacaucgccaacugcuugcgcaagaacgguaaaagagugauccagcucucaaggaaaacguucgauaccgaguaucagaagaccaagaauaacgacugggacuauguggucacgacggacaucucagagaugggggccaauuuccgggcggaccgcgugaucgauccgcggcggugccugaagcccgugauauuaaaggagggcccggagcgcgucauccuggccgggcccaugccgguaaccgucgccucggcagcgcagcgccggggccgcauuggacgaaaucagaauaaagagggggaucaguacaucuacaugggacaaccccugaacaaugaugaagaccaugcccacuggaccgaagccaagaugcugcuagacaacaucaacaccccagaaggaaucauucccgcccuguucgagccggagcgcgagaaauccgcugcaaucgacggcgaauaccgucugcgcggggaagcccgcaagacguucguggagcucaugcgcagaggcgaccugcccguguggcuguccuacaagguagcaagcgagggcuuccaauacuccgaccggcguuggugcuucgacggggaacgaaacaaccaagugcucgaggagaacauggacguagaaauuuggaccaaggagggcgagagaaagaagcugcggccucguuggcuggacgcccggaccuacagcgacccccucgcccugcgcgaguucaaggaguucgcugcagggcggcgcuccguaaguggcgaccugauccucgaaauagggaagcucccgcagcaccugacccuucgggcccaaaacgcccuggacaaccuggugauguugcauaacagcgaacagggugggaaggccuaccgccacgcgauggaggaguugccugacaccauagagacacuaaugcuccuggcgcugauugccguccucacaggaggcgucacccuguuuuuccuguccggcaaggggcucggcaagaccaguaucggcuugcuguguguuauggccucuagcgcacuacuauggauggcaucuguggaaccccacuggaucgccgccagcaucauacuggaguuuuuccucauggugcugcugauacccgagccagaccggcagcgcacgccucaggacaaccaacuggccuauguggugauaggccugcuguucaugaucuugaccgucgcagccaacgagaugggccugcuggagaccaccaagaaggaccucggcaucgggcacguggccgucgagaaccaucaccacgccaccaugcucgacguugaccugcggccagccucugcguggacccucuacgcaguggccaccaccgugaucacgccgaugaugaggcacacgaucgagaacacgaccgcaaacaucagccucacggccaucgcgaaucaggccgccauccugaugggccuggacaaaggcuggccgaucuccaagauggacauaggugucccacuacucgcccucgggugcuacagccaggugaacccccugacccugaccgcugcgguccucaugcuugucgcacacuacgccauaaucgguccggggcugcaggcgaaggcgaccagagaagcgcagaagaggacggcugcugggauaaugaagaaucccaccguggauggcauagugaccaucgaccucgaucccguaguauacgacgccaaguuugaaaagcagcuggggcagaucaugcuucugaucuuaugcacuucccaaauacugcuaaugcgaacgaccugggcucugugcgagaguauuacccuggccacgggcccgcuuacuacgcugugggagggauccccagggaaguucuggaacaccaccaucgccgucaguauggccaauauuuuucguggcuccuaccuugcaggggcgggucuugccuucucacugaugaagucccugggcgggggccggcggggcaccggugcacagggugagacccugggggagaaguggaagaggcagcugaaucagcucucaaaguccgaguucaauaccuacaagaaguccggcaucauggagguugaccgaagugaggccaaggaggggcugaagcgcggagagacuacgaagcaugccgucuccagggggacggcgaagcucaggugguucguggaacggaaccuggucaagccugagggcaaggucaucgaucuaggcugcggucgcgggggaugguccuacuacugugccggucucaagaaaguaaccgaggucaagggguauacgaagggcggcccgggacacgaggagccaaucccgauggcuacuuacggcuggaaccuugugaagcugcacucuggaaaagauguuuucuucacgccucccgagaagugcgacacguugcugugcgauaucggcgaaagcucccccaacccgaccauugaggagggacggacucugcgcgucuuaaagauggucgaacccuggcugcgggguaaccaguucugcaucaagauccugaaccccuacaugcccucuguggucgagacgcuagaacagaugcagcgcaagcacggcgggaugcuggucagaaauccgcugucccgcaacuccacccacgaaauguacuggguguccugcggaacagggaauauugucucggccgugaacaugacaucccgcaugcuccugaaccgcuuuacuauggcgcaccggaagcccaccuacgaacgcgauguggaccugggcgccggcaccaggcacguagccguggagcccgaggucgcaaaccucgauaucaucgggcagagaaucgagaauauaaagaacgagcacaagagcaccuggcauuacgaugaggauaaucccuauaagacgugggcguaccacggcuccuacgaggucaagccguccggguccgcaaguucuauggugaauggcguagugaggcuucuuacaaagcccugggacguaauucccauggugacgcagauugccaugaccgacacuacucccuucgggcagcagcggguauuuaaggaaaagguagacacccggacuccacgcgccaagcgcggaaccgcccagaucauggaagucaccgcuaaguggcucuggggcuuccucucacggaacaagaagccccgcaucugcacccgggaagaguucacccgcaaggugcgguccaacgcggccaucggggccguuuuugucgacgaaaaccaauggaacucagccaaggaggcaguggaagacgagcgcuucugggaccucgugcaccgggagcgcgaacuccacaagcagggcaagugcgcgacgugcgucuacaauaugauggggaagagagagaagaagcuaggcgaauuuggaaaggccaagggcucgcgggcaaucugguacauguggcugggcgcccgguuccucgaguucgaggcacugggcuucaugaacgaggaccauugguucucccgcgaaaacucucuuuccggagucgagggggaaggacuccacaagcuaggguacauucugcgggauauuuccaagauuccuggcggcaacauguacgcggacgacacagcagggugggacaccagaauuacggaggaugaucuacagaacgaggccaagauaacggacauuauggagccggagcacgcccugcuggcgacguccaucuuuaagcucaccuaccaaaacaaagugguccgggugcagcgccccgccaaaagcggcaccguaauggacguaaucucccgccgggaucagcgcggguccggucagguuggcacguacggccuuaacaccuucaccaacauggaggugcagcuaauacggcaaauggaguccgagggaaucuucagcccuuccgagcuggagacccccaaucuugcuaagaagguuuuggacuggcucgagaagcacggggcggaacgacuuaagcggauggccauuuccggugacgacugugugguaaagcccauugacgaccgcuucgccacggcccugacugcccuaaacgacauggggaagguccggaaggauaucccccagugggagcccuccaagggguggaacgacuggcagcaaguacccuuuuguucucaucacuuccaccagcugauuaugaaggacggccgcgagaucguggucccgugccggaaccaggacgagcucgugggucgcgcccgcgugucccagggcgccggguggagccuccgcgagacggcgugccugggcaagagcuacgcccagauguggcagcugauguauuuccaucgccgcgaccuccggcuggccgccaaugccauuugcagcgcugucccagccgacugggugcccaccagccgcaccacuugguccauccacgcccaccaccaauggaugaccaccgaggauaugcugucuguguggaaucgggucuggaucgaagagaaccccuggauggaggacaaaacacacgucagcagcugggaagaagugccguaccucgguaagcgcgaggaccaguggugcggcuccuugaucggucugacugcccgggcgaccugggccaccaacauccaggucgccaucaaccagguaagacgucuuaucggaaacgagaacuaccuggauuacaugacaucaaugaagcgguucaaaaacgaguccgaucccgagggggcucugugguga

SEQ ID NO: 23745 - RNA, 9879 nt, Artificial Sequence
  derived and/or modified CDS sequence (opt11) from DENV-1__KP188568__SS-prME
aguguuacaaugcuacuaaugcuacuuccaacagcacuggccuuccacuuaacgacgcggggcggagaaccacauaugauagucucaaaacaagagcggggcaaaagccuucuauucaaaaccuccguaggaguaaacauguguacacuaaucgcuauggaccugggcgaguuaugcgaggacacgaugacauacaagugcccgaggaucacagaagccgaaccggacgauguggacugcugguguaacgccaccgacaccuggguaacuuaugguaccugcagccaaaccggggaacacaggcgggacaaacgaagugucgcccuagcgccgcauguagggcucggacuugaaacgcgaacagaaacuuggaugaguucugagggagcuuggaagcaaauucaaaaaguagagaccugggcgcugaggcacccaggauuuaccgugauagcacuuuuucuagcgcacgcaauaggaacgaguaucacgcaaaaaggcauuauauuuauccuacuaaugcucguuacccccucaauggcgaugaggugugucggcaucggaaaccgggauuucguggagggccugucaggagcaaccuggguagacguaguacuugagcacggcagcugcgucacaaccauggccaaaaacaagcccacccucgacaucgagcugcuaaagacagaggucacgaacccagccguacucagaaaacuauguaucgaggccaaaaucagcaacacuacgacagacagccggugcccgacccaaggagaagccacucuagucgaggaacaagacgccaacuucgugugcagacggacauucguggacagaggauggggcaacggcugcgggcuauuuggcaagggaucgcugcucacaugcgcgaaauucaaguguguaacaaagcucgaggguaagaucguucaauacgaaaaccugaaguacucggucauagugaccguccacacgggagaccaacaccaaguggggaacgagacaacggagcacggcacgauagcuacaaucaccccgcaagcaccuaccuccgaaauccaacuaaccgacuacggcgcgcuaacacuagacugcucaccuagaaccgggcuugacuuuaacgagaugguacuuuuaacaaugaaagagaaaagcuggcuuguccacaaacaaugguuccuagaccucccccuacccuggacaagcggcgcaaguaccucucaagagaccuggaaccggcaggaccuccuagucaccuuuaaaacggcgcaugcgaagaaacaggaagugguuguccuaggaucucaagagggagcgaugcacacggcgcuaacaggagcgaccgaaauccaaacgucgggcacaacaaccaucuuugcgggacaccucaaaugucgacugaaaauggacaaacucacacugaaagggaugagcuacguaaugugcacgggcucauucaaacuugaaaaagagguagcggagacacagcacggcacaguacugguccaaguuaaauacgagggaacggaugcuccgugcaaaauaccauuccugacccaggaugaaaagggugugacacaaaacgggcgucucauuaccgcuaaccccauagucacugacaaagaaaaaccugucaauaucgaaacggagccgccuuucggcgagucuuacauaguagucggcgcaggagagaaagcacuuaaacuguccugguucaagaaaggcuccuccauaggcaaaauguucgaggcaacagcaagaggggcaagacguauggcgauacucggggauacagcgugggacuucggaagcaucggcgggcuauucaccagcguggguaaauuaauucaccagguguucgggacugccuaugguguauuguuuuccggcgucuccuggacaaugaaaaucgggaucggcaucuuacuuacuuggcuaggccugaacucaaggucgaccucauugucaaugacgugcauugccguggguaugguaacuuuauaccuaggaguaaugguccaggcggacucuggaugcguuauuaacuggaagggaagggaacucaaauguggcucggggauauucgugacaaaugaaguacacacauggacagaacaauacaaauuccaagcagauucgcccaaacgccuauccgccgccauugggaaggcgugggaggaagguguaugcgguauacgaucagcaacgcgccuagaaaacauuauguggaaacagauuagcaaugaacugaaccauauccuauuggaaaacgacaugaaauucacgguaguagucggugacgucaauggaauacuggcccaggggaagaaaaugauaagaccacagcccauggagcacaaauacucauggaagucgugggguaaagcgaaaaucaucggcgccgacauacaaaacaccacguucauuauugacggaccggacaccccagagugucccgacgaccagagagccuggaauaucugggaaguggaagauuacggcuucgggauuuucacuacaaacaucuggcucaagcucagggacucccacacacaaaugugugaccacagacugauguccgcagcuauaaaagacucgaaagcggugcaugcagacaugggguacuggauugaaagcgagaaaaacgaaaccuggaaacuggcccgugccucauucauugaaguaaaaacgugcauauggcccaagagccacacucuguggagcaacggaguacucgaauccgagaugguaauuccaaaaauauacgggggcccaauaagccagcacaacuaccgcccuggauacuucacacagaccgcgggacccuggcacuuagguaaacuugaacucgacuucgauuugugcgaagggacgacgguaguagucgacgagcacuguggguaccgugggccuagccugcgaacaacaacugugacagggaaaauuauacacgaguggugcugcagaucguguacauuaccgccccuaagguucagaggggaagauggaugcugguauggcauggaaauucggccaguuaaagagaaggaagagaaccuagugaggagcaugguaagugccggaagcggagagauggacagcuucuccuuaggcaucuugugcgugucaauccugauagaagaaguuaugcggucacgguggucgcgcaaaauguuaaugacaggcacccucgccguauucuuccuccugaucaugggccagcucacuuggaacgaccugaucagauuauguauaauggucggcgccaaugcaucagaccguaugggcauggggaccacauauuuggcauugauggcaaccuucaagaugagaccgauguucgcaguagggcuucuauucaggcgacuaaccuccagagaaguacuacucuugacaguagggcuauccuugguggcaagcguagaguuaccaaacucccuagaagaacucggagacgggcuggccauggggauaaugaugcugaaacuucuaacagacuuucagccccaccaacuguggacaacacuacugagccuaacguucauacgcacgucgcucucgcuggacuacgcauggaagaccauggccauggcacuaagcauagucagucuauucccccugugucuaaguacgacaucacagaaaacgacauggcugccuguccugcucggcagcuucgggugcaagccccucaccauguuccuaauaaccgagaacaaaauuugggggcgaaaaagcuggccgaucaaugaaggaauaauggcagugggcauuguaagcauccuccuuaguagccugcugaaaaacgauguaccgcuugccggacccuuaaucgcaggaggaaugcugauagcguguuacguaaucucaggcagcagcgccgacuugagccuagaaaaggccgccgaaguuucaugggaagaagaagcagaacauagcgggacaagucacaacauccucguugagguacaggacgacggcacgaugaagaucaaagacgaggaaagggacgacacucuaacaaucuuacuuaaggcaacucugcucgcuguaucaggggucuaccccaugucaaucccggcaacacuauuuguaugguauuuuuggcagaaaaagaaacaacgcucaggugucuugugggacacaccaagcccgcccgaaguggagagagccguacucgaugacggaaucuaccgcauacuacaacgcggauuacucggaaggagccaaguaggcgugggcguuuuccaggauggaguuuuccauaccauguggcacguaacccgaggagcgguacuuauguaccaaggcaaacgccuggaacccuccugggcaucagugaagaaagaccuaauaagcuacggcggaggcuggcguuuccaagggagcuggaauaccggggaagaaguccagguaaucgccgucgaaccuggcaagaauccgaaaaacguacaaacuacgcccgggaccuucaaaacaccagaaggagaaguaggagcgauugcacuggauuucaaaccgggcacgagcggcuccccaaucgugaaccgcgaagggaagauuguagggcucuacggcaacggaguggucaccaccucugguacguacgucagcgcuaucgcccaagccaaggcuacacaggaaggcccccuucccgaaaucgaggacgaagucuucaaaaagcgcaaccuuacgauaauggaucugcacccgggcuccggaaagaccagacguuaccucccaagcauaguccgagaagcgauaaaaagaaaacucagaacacucauccuagccccgacccguguaguugcaucugaaauggccgaagcacuaaaagggaugccgauacgauaccaaaccacggccgucaagagcgaacacaccggacgggaaauagucgaccucaugugccaugccaccuuuacuaugcgccuccuaagcccaguacgggucccuaacuacaauaugauaauaauggacgaggcacacuucacagacccggccucuaucgccgcaagaggcuacauauccacacgggucgggaugggagaagcagcugcgaucuucaugacagcuacucccccaggaucaguagaggccuucccccaaucaaacgcagcgauucaagacgaagaaagggacauaccggagcguucauggaacacaggguacgacuggauaacggacuucccaggaaaaacagucugguuuguaccuucgauuaaaagcggaaacgauauagcgaacugucugaggaaaaacggcaagcgagucauccaacucucacguaaaacauucgacaccgaguaccagaaaacaaagaacaaugacugggacuauguagucaccaccgauaucucagaaaugggagcaaacuucagagcagacaggguaaucgacccacgacggugucuaaagcccguaauacuuaaagaaggcccggaaagaguuaucuuggcuggacccaugccagucacgguggcaucagcagcgcaacgucguggcaggauugggagaaaucaaaacaaagaaggcgaccaguacauauacaugggacaaccgcugaacaaugacgaggaccacgcgcacuggacggaagccaagaugcuccuggauaacauaaauacccccgaaggaaucauccccgcccucuucgaacccgagcgggagaaaagcgcagcuaucgacggcgaguaccgguuacgcggagaggcccggaaaacauucguagagcuaaugcggcggggcgaccuaccaguaugguuaagcuacaaggucgcuucugagggcuuucaauacucggaucgcagauggugcuucgacggagaacguaacaaccaagugcuagaagagaauauggacguugagauauggaccaaagagggagaaaggaagaaacuucgcccaagauggcuagaugcacggaccuacuccgacccacuagcacuuagagaguucaaagaauuugcugcaggaagacgaucugucuccggagaccucauacuggaaauagggaaacucccccaacaucugacgcugcgcgcgcaaaacgcacuugacaaccuagugauguuacacaacagcgaacaaggaggaaaggcuuaccgucacgcgauggaggaacuaccagacaccaucgaaacgcuaaugcuucucgcauuaaucgccguccuaaccggaggaguaacacuguucuuucuuagcgggaaaggacucgguaaaacuagcauagggcuccugugcguaauggcuagcagugcccuauugugggucgcgagcguagaaccgcacuggaucgcagcuucgauuauacuagaguucuuccuaauggucuuacugauuccagaacccgaccgucagcgcacgccacaagacaaccagcuggcauacguagucaucggccuacuguucaugauacucaccgucgcggcuaaugaaaugggccugcucgaaacaacgaagaaagaccucggaaucggacacguggcggucgagaaucaccaucaugcgaccauguuagacgucgaucuaagaccagcgagcgcauggaccuuauacgccgucgcaaccacugugaucacgcccaugaugcggcacacgauagaaaacacgacggcuaacauaucgcucacagcaauagccaaccaagcggcaauacuuauggggcuggacaaaggcuggccaauuuccaagauggacauaggcgugccucuacuagcacuuggcugcuacucgcaaguaaacccgcugacccugacggccgccguccuuauguugguugcccacuaugcaauaauugggccaggucuccaagcaaaggcuacccgggaagcccagaaacgcaccgcugcggggauaaugaagaaccccaccguggauggaauaguaacaaucgaucucgaccccguaguauacgacgcgaaauucgaaaagcaguuaggccagaucaugcugcucauccuaugcacaucucagaucuuacuaaugaggacaaccugggcacugugugagaguaucacccucgcgacaggaccgcucacgacucugugggaggggaguccuggcaaauucuggaacaccacgaucgccguaagcauggccaacauauuuaggggauccuaccuagcuggagccggccuugcguucagcguaaugaagucgcugggaggaggccggcgugggacgggggcccagggagagacgcuaggagaaaaguggaaacgccagcuaaaccaacucucaaaaucugaguucaacacguacaaaaagagcgggauaauggagguggaccggagugaagccaaggagggcuugaaacgaggagaaacaaccaagcacgcaguuucacguggcacggcgaaacuacggugguucguugaacgcaaucucgugaaacccgaggguaagguaauagaccucgggugcggucgcggaggcuggaguuacuacugugcgggccucaaaaaggugaccgaaguaaagggauacaccaagggcggcccgggccacgaagaaccaauaccuauggccaccuacggcuggaacuuggucaaacuccacagcgggaaggauguauucuucaccccaccugagaagugcgacacucuauuaugcgacauaggcgaaucgagcccgaauccgaccaucgaagagggcagaacacugaggguacuaaagauggucgaacccugguugcgcggaaaccaguucugcauaaaaauacuaaacccuuacaugccaucggucguggagacgcuagaacagaugcaacgcaagcacggugggaugcugguacgaaacccacucagucguaacagcacucacgaaauguauugggucuccuguggaaccggaaauauuguuagcgccguaaacaugacaagccgaaugcuacucaaccgauucacaauggcccacagaaagccgacauaugagcgagacguugacuugggagcggguacccgccacguagcuguagaacccgagguugcgaauuuagacauaaucggacagcgcaucgaaaauaucaaaaacgaacacaaaagcacauggcauuacgacgaagacaaccccuauaagacaugggcuuaccacggaaguuaugaggucaaaccaucgggaagcgccucgucuauggucaacggugucgugcgacuguuaacaaaaccaugggauguaaucccgaugguuacucaaauagcuaugacagacacgaccccauuuggacaacaacgggucuuuaaagaaaaaguggacacacgcaccccgcgcgcaaaacgcggcaccgcccaaauuauggaaguaacagccaaguggcuaugggguuuccuaucccgcaacaagaagccgcgaauuugcaccagagaagaauuuacacgaaagguaagaucaaacgcagcgauuggugcaguauucguugacgaaaaucaguggaacagcgcaaaggaagccgucgaggaugaacgcuucugggaucucguucaucgcgaaagggaacuacacaagcagggcaagugcgcaacaugugucuacaacaugaugggaaagagggaaaagaaacucggagaguucggaaaagcaaaagggaguagggcaauuugguauauguggcucggggcccgauuccuagaauuugaggcacuuggcuuuaugaacgaagaccacugguuuagucgugagaacucccuaucgggcgucgagggagaaggacuacauaaacucggcuauaucuugagggacauaucaaagauacccggaggaaauauguacgccgaugauacggccggaugggacacccggauaaccgaagacgaccuucagaacgaggccaaaaucaccgauauaauggagccugaacacgcacuccuagcuaccagcaucuucaaacuaacauaucaaaacaaaguaguccgugugcagcgccccgcaaaauccgggacgguaauggacgugauuagccgaagggaccagcgggguucaggccaaguagggacauacggcuugaacacauuuacaaacauggagguacagcuaauccgccaaauggagucagaaggaauauucucacccagcgaacuggagacgccgaaucuggcgaagaaaguccucgauuggcuagaaaaacauggagcggaaaggcugaagcgaauggcaauaaguggcgacgacugcgucguuaagccgauugacgaccgauucgccacggcucucaccgcccugaacgauaugggcaaaguucgaaaagauauuccacagugggaaccaagcaaaggguggaaugacuggcaacaagucccauuuugcucccaccauuuccaccaacucauaaugaaggacgggagagaaauaguaguuccaugccgaaaccaagacgaguuagugggccgugccagagugucgcaaggggcaggauggagccugagggagacagcuugucuagguaaguccuacgcccaaauguggcagcucauguauuuccacagacgagaccuaagacuggccgccaacgcgauaugcucagcggugcccguggauugggugccuaccagccggacgacaugguccauccacgcacaucaucaauggaugacaacagaggauaugcucuccguguggaaccguguuuggauagaggagaacccauggauggaagauaagacccacguaagcagcugggaggaagugccauaccuaggaaagcgagaggaucaauggugcgggucccucauaggacugaccgcacgggccacuugggcaaccaacauucaggucgcgaucaaucaaguacggcgguuaauaggaaacgagaacuaccuagauuacaugaccaguaugaaacgcuuuaagaacgaaagcgaccccgagggagcgcuaugguga

SEQ ID NO: 23746 - RNA, 9879 nt, Artificial Sequence
  derived and/or modified CDS sequence (opt11) from DENV-1__KF971870__SS-prME
agcgugaccauguuacucaugcuaaugcccacagcgcuggcuuuccaucucaccacccggggcggggaaccacauaugaugguguccaagcaggagaggggcaaaagccugcuguucaaaaccuccgcaggggugaacauguguacgcucaucgccauggaccuaggcgagcucugcgaggacacgaugaccuacaagugcccacggaucaccgaggcggaacccgacgacguggacugcugguguaacgccaccgacaccugggugaccuacggcaccugcucccaaacaggcgagcaucggcgcgacaagcgguccguggcccucgcaccccacgugggacuggggcucgaaacgcgcacggagaccuggaugagcagcgaaggcgccuggaagcagauccaacggguagagacaugggccuuacgccaccccggguuuaccgugaucgcacuguuccuggcgcacgccaucggcaccucaaucacccaaaaggggaucaucuucauccucuuaaugcuggugacgcccuccauggccaugcggugcgucggaauaggcagccgcgacuuuguggaggggcuuucuggcgccacguggguggacgucguacuagagcacggaagcugcguuaccaccauggccaaggacaagccgacccucgacaucgagcucuuaaagacggaggucacuaaccccgcggucuugcggaagcucuguaucgaagccaaaaucuccaacaccaccacggacagccgcuguccgacccagggugaagccacacugguggaggagcaggacgccaacuucgucugccgucgcaccuucguugaccggggcugggggaacgguugcggccuguucggcaaggggucucucaucacgugcgccaaguucaagugcguaacaaagcuggagggaaagaucguccaguaugaaaaccugaaguacagcgugauugugaccguccacaccggugaccagcaccaggugggaaacgaguccacggagcacgguacuacagcgaccaucacgccccaagcgcccacgacggaaauccagcucacggacuauggggcucuuacccuggauugcagcccccggacgggccucgacuucaacgagaugguccugcugaccaugaaggagaagagcuggcucguacacaagcaaugguucuuggaucugccccuccccuggaccagcggggcuagcacgucccaagagacguggaaccggcaagaccuacuggucaccuucaagacagcccacgcuaagaaacaggaggucguagugcucggcucgcaagagggggccaugcauacggcacugacgggggccaccgagauccagaccuccgguaccacuaccauauuugcugggcaccugaaaugcaggcucaagauggacaagcugacccuaaagggcaugucuuaugucaugugcaccggguccuuuaagcucgaaaaggaaguagcggagacgcagcaugguacggugcugguccaaaucaaauacgagggcacagacgcccccugcaagauccccuuuagcacccaggaugagaaggggguuacccaaaacggccggcugauuaccgccaacccuaucgugaccgacaaggagaagccagucaauaucgaggccgagccgcccuucggggaguccuacaucgucaucggggcgggcgagaaggcccugaagcugagcugguucaagaagggcuccaguaucggaaagauguuugaagccacggccaggggugcccggcgcauggcgaucuugggcgacacggccugggacuucggguccaucggcggaguuuucacguccgugggaaagcuggugcaccagaucuucggcaccgcauacggcguccucuucucaggcgucagcuggaccaugaaaaucggcauuggugugcugcucacguggcucgggcugaauagcaggagcaccucacugaguaugaccugcauagcagugggacucguaacacuguaccugggcgugauggugcaagccgacucggggugugucaucaacuggaagggccgagagcuaaagugugggucugguauuuuugugacgaacgaagugcacacauggaccgagcaauacaaguuucaggcggacagcccaaagcgccugucugcugccaucggcaaggcgugggaggaaggugucugcggcauacgguccgccacacgccucgaaaacauaauguggaagcagaucuccaacgagcucaaccacauccugcuggaaaacgacaugaaguucaccguuguggucggugacguggcgggaauuuuagcccagggaaaaaaaaugauccggccgcaacccauggaguacaaguacucuuggaaguccuggggcaaggcgaaaauuaucggcgcugacgugcagaacacgacuuucaucauagacgggccaaacaccccggagugccccgacgaccagcgagcguggaacauuugggaggucgaggacuauggcuucgguaucuucaccacaaacaucuggcugaagcugcgagacuccuacacucaggugugcgaccaucgccucauguccagcgccauaaaggacuccaaggccguccacgccgacaugggcuacuggauugagagcgagaaaaacgacacguggaaacuggcccgggcuucguucauagaagucaagaccugcauuuggcccaagucacacacgcugugguccaacggcgucuuagagagcgagaugaucauccccaagaucuaugggggcccgauuucccagcauaacuacagacccggguacuucacccagacugccggccccuggcaucuaggaaaguuagagcucgauuucgaccugugcgaggggaccacuguggucguggaugagcacugcggcaaccggggcccgagccugcgaaccaccaccgugacaggcaagauaauacacgaguggugcugcagaucgugcacccugccaccacuacgcuuccgcggggaggauggcugcugguacgguauggagauucgucccguuaaagaaaaggaggagaaucuggugaagagcauggugagcgcgggcuccggcgaaguugacuccuucucccucgggcugcugugcaucucgaucaugauugaggagguaaugaggucccgcuggagccgcaagaugcugaugaucgguacccuggccguguucuuccuccugaucaugggucagcugaccuggaacgaccugauccguuuaugcauaauggugggcgccaacgcgucugacaggauggggaugggcacgaccuaccuggcacugauggccacuuuuaaaaugaggccuauguucgccgugggauuacuguuccgcagacugaccagccgcgaggugcuccugcugacgauaggacucucgcuagucgcuagcgcggagcuccccaacucccucgaggaguugggcgacgggcuggccaugggcaucaugauccucaagcuucugaccgauuuccagagccaccagcuuugggccacccuccugagccucaccuuuaucaaaacaacuuucucacugcauuaugcuuggaagaccauggcuaugguccuguccauagucagucucuuuccccugugccugucaaccaccagccagaagacaacuuggcuccccgugcuacuuggcuccuuggggugcaagccucugaccauguucuuaaucgcagagaacaagaucuggggccgcaaaaguuggccucucaacgagggcauuauggccguuggcaucgucagcauccugcuuuccucgcuccugaagaacgacguuccccucgccgggcccuuaaucgcgggcggcaugcugaucgcguguuacgugaucucgggaucauccgcugaccugagccuugagaaagcagccgaggucuccugggaagaagaggcagagcacagcggcgcgucccacaacaucuugguggaagugcaggacgaugguacgaugaaaauuaaggacgaggaacgggacgacacucucacuauccuucugaaggccacacugcucgccguuagcggcguuuucccacugucuauacccgcgacccuguucgugugguacuuuuggcagaagaaaaagcagcggagcgggguccucugggacacgcccagcccucccgaaguggaacgcgccguucuggaugauggcaucuaucggaucaugcagcgcggccuacuggggcguagccaggucggcgucgggguuuuccaggaaaacgucuuccauaccauguggcaugugacccgcggcgcgguacucauguaucaagguaagcggcuggaaccaagcugggccagcgugaagaaggaccugaucuccuacggcggcgguuggagacuccagggcagcuggaauaccggagaggagguccaggugauugcggucgagccaggcaagaaccccaagaauguucagaccgcccccgggacuuucaagacccccgagggugaggugggcgccaucgcgcuggacuucaagccggggaccucggguuccccuauugucaaccgggaggggaagaucgugggccuguacggcaacgggguggugaccaccagcggcaccuacgugucggccaucgcacaggcgaaggcgucacaagaggggccgcucccugagaucgaggacgaggucuuucgcaagcggaaccuaacuauuauggaccugcaccccggguccgguaagacgcgacgguaucugccggccaucguccgcgaagccauuaagcggaagcugcgcacccuuauccucgcccccacgcgcgugguugccucggagauggcggaggcccugaagggcaugcccauccgguaccaaaccacggccgucaaguccgagcacaccgggaaggagaucguggacuuaaugugccacgcuaccuucaccaugcgcuuacugagcccgguccgggucccaaauuauaacaugaucaucauggacgaggcccacuucacagaccccucauccaucgcggcccgcggguacaucagcacccguguugggaugggcgaggcagccgccaucuuuaugaccgcuaccccgcccggcagcgucgaggcauuuccccaguccaacgccgucauccaggaugaagagcgcgauauuccugaacggagcuggaacucgggguaugaguggaucacggacuuccccggcaagaccgugugguucguuccgagcaucaaauccggcaacgacaucgcgaauugccuccgcaagaacgggaagagagucauucaguugagccgcaagacguucgauacggaguaccagaagacgaagaauaacgacugggacuacgucgugaccaccgacaucuccgagaugggagcgaauuuccgcgccgaccgugucaucgauccgcgacgaugccucaagcccgugauacuaaaagaugggcccgagaggguuauacucgccggccccaugcccguaacuguggccagcgcugcccaacgccgggggcgcauuggacggaaccacaacaaagagggcgaucaguacaucuacauggggcagccacugaacaacgacgaggaccacgcucacuggaccgaagcuaagaugcugcuugauaacauuaauacgccggaggguaucauccccgcccuuuucgagccggagcgcgagaaguccgccgcaauugacggugaauaucgccuccggggcgaggcgcgcaagaccuucgucgaacugaugcggagaggugaccucccagucuggcucagcuacaagguggccagcgaaggauuccaguacuccgacaggcgcuggugcuucgacggcgagcggaacaaccaggugcucgaagagaacauggauguggagaucuggacuaaggagggagagagagagaagcugcgcccccgauggcugggcgcacggacguacagcgauccccuggcacugcgcgauuuuaaggaguucgccgccgggcggcgcuccgugucaggagaccugauccucgagaucgggaagcucccgcaacaccugacccagcgggcucagaacgcgcucgacaaccuagucauguuacacaacagucagcaagguggucgagcguacacccacgccauggaagagcuccccgacacuaucgagacgcugaugcugcucgcccugaucgccgugcugaccgggggcgugacacuguucuuucucagcgggcgcggcuuaggcaagacaucgaucggguugcucugcgucauggcaagcucagugcuucucuggauggcgucuguggagccccacuggaucgcagccuccaucauccuggaguuuuuccugauggucuugcugauccccgaacccgaccgccagcggacgccccaggacaaucagcuggcguacguggugaucgggcucuuguucaugauucugacggucgccgcgaacgagauggggcuccuugaaacuaccaagaaagaucugggcaucgggcauguggccguggagaaccaccaccacgccgccaugcucgaugucgaccuacaccccgccucggcauggacccuguaugccguggccacgaccaucaucacuccgaugaugcgacacaccaucgagaacacgacagccaacauaucucuuaccgccaucgcgaaccaggccgcuauucugaugggucuggauaagggguggccgaucagcaagauggacauuggggugcccuugcucgcccucggcugcuacucccaggucaauccauuaaccuuaacggcggccguccucaugcucguggcccacuacgcgaucaucgggccgggcuuacaggcuaaagccacucgggaagcccagaagcgcaccgccgccgggaucaugaagaaucccacugucgauggaauugucgcaaucgaccuugaccccguggucuacgacgcuaaauucgagaaacagcucggccagauuauguugcuuaucuuaugcacgucgcagauucugcugaugcgcaccaccugggcccucugcgaaucaaucacccucgccacggggccacuuacuaccuuaugggaaggaagcccggggaaguuuuggaacaccacgauagccguguccauggcuaauaucuuucggggcagcuaccuggcgggagcuggucucgcguuuucgcucaugaaguccuuaggagggggccgacgggggaccggugcucagggcgaaacccuaggggagaaguggaagcgccggcucaaucagcugagcaagagcgaguucaauaccuauaagcgcuccggaaucauggagguugaccgguccgaagcaaaggaggggcuuaagcgaggcgaaacuacgaagcacgcugucagccggggcacugcgaagcugcgcugguucguggagcggaacuuagugaagcccgagggcaaggucaucgaccugggcugcggccgcgguggguggucguauuacugcgcuggacucaagaaggugaccgagguaaagggguacacgaaggggggacccgggcaugaggaacccaucccgauggccaccuacggcuggaaccuugucaaacugcacucagggaaggacguuuucuuuauaccgcccgagaagugcgacacguuacucugcgauaucggcgaguccagcccgaacccgaccaucgaagaggggcgcacgcuacgggugcugaagauggucgagcccuggcuacggggcaaccaguucugcaucaaaauccugaaccccuacaugcccuccgugguagagacccuggagcaaaugcagcguaaacacggcgggaugcugguccggaauccgcucagcaggaauuccacccacgagauguacugggucagcugcggcacgggcaacaucgucuccgcggugaacaugaccagccggauguugcucaaccgcuucaccauggcucacagaaagcccaccuacgagcgggauguggaccugggcgcaggcacccggcacguggccguagagcccgagguggccaaccuggacaucaucgggcaacggaucgagaauaucaagcacgagcacaaguccacauggcauuacgacgaggacaacccauacaaaacgugggcguaucacggcuccuacgagguaaagccguccgggagcgcuagcagcaugguaaacgggguugucaaacuccuaacgaagccuugggacgugaucccgauggugacccagauugccaugacugacacaacacccuucgggcagcagcgcgucuucaaggagaagguggacacccggacgccgaaggccaagcgcgggacggcgcagaucauggaggugacugccagaugguuauggggcuuccucucacgcaauaagaagccccggaucugcacccgcgaggaauucacccggaaggugcgcagcaacgccgccaucggagcuguguucaucgacgagaaccaguggaacagcgcgaaggaggccguggaggaugaaagauucugggacuugguacaccgagagcgcgagcugcacaagcaggggaagugcgccacgugcguguacaacaugauggggaaacgcgagaagaagcucggagaguuugggaaggccaagggcucccgggcaaucugguacauguggcugggugcgcgcuuuuuagaguucgaggcccucggguucaugaacgaggaucacugguucagccgcgagaacucccuaagcggaguugagggggaggggcugcacaagcucggguacauccugcgcgacauuuccaaaaucccuggaggcaacauguacgccgaugauaccgccgguugggauacccgaaucaccgaagacgaccugcagaaugaggccaagauaacugauaucauggagccggagcacgcgcuccuagcgaaggccaucuucaagcugaccuaccaaaauaaagucgugaggguucagcgcccugccaagaaugguaccgucauggacgugaucagccggcgcgaccagcggggcuccggccaggugggaacauacgggcucaacacuuuuacuaacauggaggcgcagcugauccgccagauggaaagcgagggcaucuucagucccucagaauuagagacucccaaccucgcggagcggguccuggacuggcuggggaaguacggcguagagcgccuuaagcggauggccaucucgggagacgacuguguggucaagccuauugaugaccgcuucgccaccgcccuuaccgcccugaacgacaugggcaaaguccggaaagacaucccccaaugggagcccagcaagggcuggaacgacuggcagcagguacccuucugcucccaccacuuccaccagcucaucaugaaggaugggagggagaucgugguaccgugcagaaaucaggaugaacugguuggccgagcacgggucagccagggcgccggcuggagccugcgcgagacagcgugccucgggaaguccuacgcccagauguggcagcugauguacuuccaucgacgcgaccuacgccucgcggccaacgccauauguagcgcugugcccguggacuggguuccgaccucucgcacuacguggagcauccacgcccaccaccaauggaugacaaccgaggacaugcugaguguuuggaaucggguguggaucgaggagaaucccuggauggaggacaagacccauauuucgaauugggaggacgucccguaccuugguaagcgcgaagaccaguggugcggcucucugaucgggcuuacggcgcgagccaccugggcuaccaacauccagguggcuauaaaccaaguccggcgccugauuggcaaugagaacuaccucgacuauaugacgagcaugaaacgguucaagaaugaguccgaccccgagggggcuuuaugguga

SEQ ID NO: 23747 - RNA, 9879 nt, Artificial Sequence
  derived and/or modified CDS sequence (opt11) from DENV-1__KF971871__SS-prME
ucaguaacuauguuguuaaugcucaugcccaccgcgcucgccuuccacuugacgaccagaggcggagaaccccacaugauggugagcaagcaggagcggggcaaaagccuccuguucaaaacuagcgcuggugugaauauguguacccuuaucgcaauggacuuaggcgaacugugcgaagacaccaugaccuacaaguguccacgcaucacugaggcugagccagacgacguggacugcuggugcaacgccaccgacacuugggugaccuaugggaccuguagccagaccggagagcaccgacgggacaagcguaguguagcgcuugcgccucaugugggccuggggcuggagacgcgaacggagacguggaugaguuccgagggagccuggaagcagauccagcggguggagaccugggcccucagacacccgggauucacggucauugcccucuuuuuggcgcacgcuaucggaaccagcaucacccagaaagggauaaucuucauucuccugaugcuugugaccccuagcauggccaugcgaugcguuggaaucggcucgagagacuucguggagggccucuccggagcgacguggguggacguagugcuagagcaugggagcugcguaaccaccauggcgaaagauaagcccacccuggacaucgagcuccugaagacggaggucacaaacccugccgugcugaggaaacucugcaucgaggccaaaauaucgaauacuacuaccgacucucgcugcccgacucagggcgaggccacccugguggaggagcaagacgcuaacuucgucugccggagaacguucguggacagaggcugggggaacggaugcggccuguucgggaaaggaagccuaaucacgugcgccaaauucaagugcguaaccaagcucgaaggcaaaaucguccaguacgagaacuuaaaauacuccguaaucguuaccguccacaccggcgaccagcaccaaguugggaaugaguccacagagcauggcaccacggcgaccaucacgccacaggcgccuacgacugagauccaacucaccgacuauggggcacuaacacuggauugcucuccccgcaccggcuuagacuuuaacgagaugguccugcugacgaugaaagagaaguccuggcucgugcacaagcagugguuucuggaccugccacucccuuggacgucaggggcaagcacuucccaggagacguggaacagacaagaccugcuugugacguucaagaccgcccacgcgaaaaagcaggaaguggugguauuaggcagccaggagggcgcgaugcacaccgcucugacuggagcaaccgagauucaaaccucaggcaccacgacgaucuuugccgggcaccugaaaugccgccucaagauggacaaacuuacccugaaaggcaugagcuacguaaugugcacugggaguuucaaguuagagaaggagguggcagagacgcagcacggcacgguuuuaguccaaauuaaguacgagggcacagacgcuccaugcaaaauccccuucagcacccaagacgaaaagggugugacgcagaacggccggcugauaaccgcuaauccgaucgugacagacaaggagaagcccgucaacaucgaggccgagccgccguucggggaauccuacaucgugaucggugcuggcgaaaaggcccugaagcucagcugguucaagaaggguuccagcauaggcaagauguucgaggccaccgcucggggugcucggcgcauggcgauccugggcgacacggccugggacuucggguccaucgggggagucuucacgagcgucggcaagcuggugcaccagaucuucggcaccgccuacgguguccucuucuccggcgucagcuggacuaugaaaaucggcauaggcgugcuguuaaccuggcuaggccucaauucccggagcaccagucugagcaugacgugcauagccguaggguuagucacguuguaucucggggugaugguccaagccgacuccgggugugucaucaacuggaagggaagggaguuaaagugcgggagcggaaucuucgucaccaacgaggugcacaccuggaccgagcaguauaaguuucaagcugacagcccgaagcggcuguccgccgccauaggcaaggcaugggaagaaggggucugcggcauccggagcgccacaagacuggagaacaucauguggaagcagaucuccaaugagcuuaaucacauccugcuggagaaugacaugaaguucaccguggucgucggggauguggcgggcauccucgcccagggcaagaagaugauccgcccccagcccauggaguacaaguacagcuggaaguccuggggcaaggccaaaaucaucggagccgacgugcagaacaccaccuucaucauagacgggcccaacacaccggaaugccccgaugaucaacgcgcuuggaacauuugggaagucgaagacuauggcuucgggauauuuaccacaaauaucuggcuaaagcugcgggacucguacacacaggucugcgaccacaggcucaugucggccgcaauaaaggacagcaaggccgugcacgccgauaugggcuacuggauugaauccgaaaagaacgacaccuggaagcuggccagagccuccuucaucgaggucaagacauguaucuggccuaaaagccacacgcuguggagcaacgguguacuugaguccgagaugaucauucccaagaucuacggaggcccgaucagccagcauaacuaccggcccggguacuucacccagaccgcagggcccuggcaccugggcaaguuagagcuagauuuugaccugugcgaagguaccacgguggugguggacgagcacuguggcaaucggggcccgucgcuaaggaccaccaccgugacgggcaaaaucauccacgaguggugcugccggucaugcacucugccgccccucagauuccgcggcgaggauggaugcugguacggaauggagaucaggcccgugaaggagaaggaagagaaucuugugaaaagcauggugagcgccgguucgggcgaggucgacuccuucucucucggguuacugugcauauccauuaugaucgaggaggugaugagaagccgaugguccaggaagaugcugaugauuggcacccuugcgguguucuucuuguuaaucauggggcagcugaccuggaacgaucugauccgccuuugcaucaugguaggcgcgaacgccucugaucguaugggaauggguacgaccuaccuggcccuaauggccaccuucaaaaugagaccgauguucgcugucggccuccuauuucgccggcugaccucccgcgaggugcuccugcugacuauaggacucagccugguggcuuccgccgagcugccaaacucccucgaggagcuuggagacgguuuggccaugggaaucaugauacucaagcugcugaccgacuuccagucccaccagcuaugggcaacccugcugagucucacauucaucaagacgaccuucucccugcacuacgccuggaagaccauggccauggugcugagcaucguuucccucuuuccucugugccuuuccaccacgucccagaagaccacuuggcuuccggugcugcuuggcagcuugggaugcaaaccgcugacgauguuccugaucgcggagaacaagaucuggggccggaagucauggccccucaacgaggggauuauggccguggggaucgucucuauacuccuuucaaguuuacugaagaacgacgugccgcuggcggggccccucauagcgggcggaauguugaucgccuguuauguuauuucugguuccucagcugaccugucgcuugagaaagccgcugaggucagcugggaggaggaggcggagcacuccggcgcuagccacaauauacugguugaagugcaggacgauggcacgaugaagauuaaggacgaggagagagaugauacacugacgauccuacugaaggcuacccucuuggccgucuccggcguguucccgcuaagcaucccugccacccuguucgugugguacuucuggcagaagaagaagcagcgguccgggguacucugggacacgccgagcccgccggagguggagagagccguacuggacgacggcauauaucguaucaugcaacgcggccugcugggcagaucccaggucgggguugggguguuucaggagaacgucuuccauacaauguggcacgugaccagaggugccguacucauguaucaggggaagagacuagaacccucgugggccagugucaagaaggaccugaucagcuacggcgggggcuggagauugcaggguuccuggaacaccggggaagagguccaggugauugccguggagcccggcaagaaccccaagaacgugcagacagccccugggaccuucaaaacccccgagggugaggucggcgcgauagcucucgauuucaagcccggcacuuccggcucccccauaguuaaccgcgaggggaaaaucgugggcuuguauggcaacggugucgucacgaccagugggaccuauguguccgccaucgcccaggcgaaagccucgcaagaggggccauuaccugaaaucgaggacgagguuuuuaggaagagaaaccugaccaucauggaccugcaucccgggagcgguaagacucgccgguaccuccccgcuaucguucgagaggccaucaagcggaagcugcgcacccuuauccucgcccccacccgcgugguggcguccgagauggccgaggcucugaagggaaugccgauucgguaccaaacaacggccguuaagagcgagcacacuggcaaggagaucguggaccugaugugucaugccaccuucaccaugcgccucuuaagucccgugcguguaccuaacuauaacaugaucauaauggacgaggcacacuucacggaucccucguccaucgccgcccgcggcuacaucagcacccguguaggcaugggugaggccgccgcgaucuuuaugacugcaacgccgcccggcuccgucgaggcuuucccgcaaagcaacgccguaauccaggacgaggaacgggacauccccgagcguuccuggaacucgggguacgaguggaucacggauuuccccggcaagaccgugugguucgugccauccaucaagagcgguaaugacaucgcuaacugcuuacgcaagaacgggaagcgggucauucagcucagucgcaagaccuucgauaccgaguaccaaaagacaaagaacaacgauugggauuacguggugaccaccgacaucucagagaugggcgcaaacuuccgggcagaccgcgucauugacccgaggagaugccugaaaccgguuauccugaaggacggaccagagcggguaauucucgccggacccaugccggugacagucgccagugcggcacagcgccgggggcggauuggacguaaccauaauaaggaaggcgaccaguacaucuauauggggcaaccacugaacaacgaugaggaccacgcccacuggacggaggccaaaaugcuacucgacaacaucaacacuccggaggguaucauccccgcccuguuugagccggagcgcgagaaaagugcggcgauugacggugaguaccgucugcgcggugaggcccgcaagaccuucguggagcucaugcggcgaggcgacuuaccaguguggcuauccuauaagguugccagcgagggcuuucaguacagcgaucggcgcuggugcuucgacggcgaacggaacaaccaggugcuggaggagaauauggauguggaaauauggacaaaagagggggaacgcaaaaagcugcguccccgcuggcuaggugcccgaacguacuccgacccacucgcacugagggaauuuaaggaguucgccgcugggcggcgcagcgugucuggcgacuuaauccucgagauaggaaaauuaccgcagcaccuaacucagcgagcccagaacgcucucgacaaccugguaaugcuucacaacagcgagcagggggggcgcgccuaccgucacgccauggaggagcucccagacaccaucgagacacugaugcugcucgcccugaucgccgugcugaccggcggggugacccuguucuuccuguccgggcgcggccugggcaagaccaguauagggcuacugugugucauggcgucgagcgugcugcucuggauggcgaguguggagccccauuggaucgccgcgagcauuauacuggaguuuuuccuuaugguccuccugauucccgagccggaccggcagcgcacgccccaagacaaccagcuggccuacguugugaucggacuccuguucaugauccugacgguugcggcaaacgagaugggccuccucgagacaaccaagaaggaccuggguauuggacacguggccguggagaaccaucaccaugcagccaugcucgacgucgaccugcaccccgcguccgccuggacccuguacgccguggccacaacgaucaucaccccaaugaugcggcacacuaucgagaacacgacggccaacaucagccucaccgcuauugcaaaccaggccgccauccuaaugggccuggacaagggguggccuaucuccaaaauggacaucgggguaccucuccuugcguuggguugcuauucccaggucaauccgcugacucugacagccgccgugcucauguuaguggcccauuacgccaucauagggcccggccugcaggcgaaggccacacgcgaggcccagaagcgcacggcugccgggaucaugaagaaucccacuguagacggcauuguggccauagacuuggaccccguggucuaugacgccaaauucgaaaagcaacucggucagaucaugcugcuuauacucugcaccucccaaauccuguuaaugcggacgacgugggcccucugcgagucgaucacccuggccaccgggccgcugacuacgcucugggagggcucgccggggaaguucuggaacaccacgauugcagugucuauggcgaauaucuuccgcgggucuuaccuggccggggcuggucuggcauuuagccucaugaagucccugggcgggggccggcgcgggacgggcgcccaaggagagacccugggagagaaauggaagcgacgccucaaccaauuguccaagucggaauucaacaccuacaagcggucgggcauaauggagguggaccgcagcgaggccaaggaggggcucaagcguggggagaccacaaagcaugcagugucccgcggcaccgccaagcucagaugguuuguggagcgcaaccuggugaagccagaggguaagguaaucgaccuugguugcgggagaggagguuggagcuauuacugcgccggcuuaaagaaggucaccgaagugaagggcuacaccaaggggggccccgggcacgaagaaccgaucccaauggcgacguacggcuggaaccuggucaaacuacacuccggaaaggacguguucuucaucccgccggaaaagugcgacacccugcucugcgacaucggcgagagcucccccaacccgaccaucgaagaggggaggacguugcgggugcugaagauggucgagcccuggcuccggggcaaucaguuuugcaucaagauucugaauccuuacaugccuucuguaguggagaccuuggaacagaugcagaggaaacacggaggaauguuggugcgcaaccccuugucgcggaacagcacccaugagauguacugggucuccugcgguaccgggaauauugugagugccgucaauaugacaucccguaugcugcucaaucgauucaccauggcccaucggaaacccacguacgagcgcgacguggaccucggcgcuggcacccggcacgucgccguggagcccgagguggcgaacuuggacaucauugggcagcgcauagaaaacaucaaacacgagcacaaaucuaccuggcacuacgacgaggauaaccccuacaagaccugggccuaccaugguucguacgaggugaagccgagcggaagcgcgucaagcauggucaauggcguggucaagcuccucaccaaaccuugggacgucaucccaauggugacccagauagcuaugaccgacacgacgcccuucgggcagcagcgggucuuuaaggaaaagguugauacccgcaccccgaaagccaagcgggguacagcucagauuauggaagugacggcacgcugguuauggggcuuccuaagccggaacaagaagccacgcaucugcacccgugaggaguucaccagaaagguacguaguaacgccgcaauuggagcuguuuuuaucgacgagaaucaguggaauuccgccaaggaagcaguggaggaugagcgcuucugggaucuuguucauagagagcgcgaacugcacaaacagggcaagugcgcuaccuguguguacaacaugauggggaagcgcgagaagaaguugggugaguucggcaaggccaaggggucgcgcgcuaucugguacauguggcugggcgcccgguuccuggaguucgaggcccuuggauucaugaacgaagaucauugguucucacgcgaaaauagccuguccggcguggagggggagggucugcacaagcucgguuacauccugagggauaucuccaagauccccggcggcaauauguacgcugacgacaccgccggcugggacacucgaaucaccgaggacgaccugcaaaacgaggcgaagauaaccgauauaauggagccggagcaugcccuucuggcuaaagcgaucuucaagcugacguaccagaauaaggucgugcgcguacaacgccccgccaaaaacggaaccgugauggacgugauuuccaggcgggaucaacgcggcagcggccaggucggcaccuacggccucaacacauucaccaacauggaggcgcagcugauucgccagauggaguccgaaggcaucuuuucacccuccgagcuggagaccccaaaccucgccgagcgcguccuugacuggcuggggaaguacggcguggagcgccucaaacgcauggccauauccggggacgacugcguggugaaaccgaucgacgaccgauucgccacagcgcugaccgcgcucaacgauaugggcaaaguacgaaaggauaucccacagugggaacccuccaaaggcuggaaugacuggcagcaagucccguucuguucgcaccacuuccaccaguuaaucaugaaagacgggagggagaucgucgucccaugucguaaccaggacgagcugguggguagggcgcgcgucucccagggggccggguggagccugcgggagaccgccugucucgggaagagcuacgcgcagauguggcagcugauguacuuccaccgccgggauuugcgccucgccgccaacgccaucugcuccgccgugccagucgacugggucccuaccagcaggacaaccuggaguauccacgcucaccaccaguggaugaccaccgaggacaugcugagcguauggaaucgcguuuggauagaggaaaacccauggauggaggacaaaacccacaucagcaacugggaggacgugccuuaccugggaaaacgugaggaccagugguguggcagccucaucgggcugaccgcccgggcgacgugggcuacgaacauacagguggcgaucaaccagguacgccggcugauaggcaaugagaacuaccucgauuacaugaccuccaugaagcgcuucaagaaugagucagaucccgaaggagcgcugugguga

SEQ ID NO: 23748 - RNA, 9879 nt, Artificial Sequence
  derived and/or modified CDS sequence (opt11) from DENV-1__KF971869__SS-prME
agcgugaccaugcugcucaugcucaugcccaccgcacuggccuuccaccucaccacccguggcggggaaccacacaugauggugagcaagcaagagcgaggcaagagccuucuguucaagaccagcgccggggugaacauguguacucucauagccauggaccugggcgagcugugugaggacacgaugaccuacaagugcccccgaaucacugaggccgagcccgacgacguagacugcuggugcaacgccacggacaccugggugaccuacggcaccuguucacagaccggcgaacaccggcgcgacaagcgguccguggcccucgcgccacacgugggccugggucuggagacgcggaccgagacuuggaugaguuccgagggagccuggaagcaaauccagagagucgagacaugggcccuucgccaccccggcuuuacggugaucgcccuguuccuggcucacgccauaggaacaagcaucacacaaaaggggaucaucuucauccuccugaugcuggugacccccucuauggccaugcggugcgucggcaucggcucgcgcgacuucguggaggggcucuccggcgccacguggguggacgucguccuagaacacgggagcugugugaccaccauggccaaggacaagccaacccucgacaucgaacuccugaaaacggaggucaccaaccccgcggugcugcggaaguugugcauugaagccaagaucuccaacaccaccacggacagccgcuguccuacccagggcgaggcuaccuuaguggaggagcaggacgcuaacuucgucugccggcguaccuucguugaccggggcugggggaacggcugcgggcuguucggcaaggggucccuaaucacgugcgccaaauucaagugcgugacuaagcuggaaggcaagaucguccaguaugagaaccugaaguacagcgugaucgugaccguccacaccggcgaccagcaccaaguagggaacgaguccacggaacacggaaccaccgcgacgaucacgccucaagcucccacgaccgagauccaacuaaccgacuacggggcccugaccuuagacugcagcccccgaacgggccucgacuucaacgaaaugguccuguuaaccaugaaggagaagucuuggcucgugcacaagcagugguuccuugaccugccccuccccuggacuagcggggccagcaccagccaggagacguggaauaggcaggauuuacuugugaccuucaagacugcccacgcgaagaagcaggaggucgucgugcucggcagccaggagggcgccaugcacacugcccugacgggggcaacggagauccagaccagcggcaccaccacgaucuucgccgggcaccucaaguguagacucaagauggacaagcugacccugaagggcaugagcuaugucaugugcaccggguccuuuaagcucgagaaggagguagcggagacgcaacacggcaccguguuagugcagauuaaguacgagggcacggacgcccccugcaagaucccuuucagcacucaggacgagaagggggugacgcagaacgggcggcugaucaccgcgaacccgaucguaaccgacaaggagaaacccgucaacaucgaggccgagccgccauucggggagucauacaucgugaucggcgcgggcgaaaaggcccugaagcucagcugguucaaaaaaggguccucuaucggcaagauguucgaggcaaccgcucgcggggcccggcgcauggccaucuugggcgacacggccugggacuucggaucaauuggcggcguguucaccagcgucgggaagcuugugcaccaaaucuucggcacagccuacggggugcuguucuccggcgucagcuggaccaugaagauuggaauuggcgugcugcugacguggcucggccugaacuccagaagcaccucccugagcaugaccuguaucgccguggggcucgucacccuguaccugggcgugauggugcaggcggacagcgggugcguaaucaacuggaagggccgagagcucaaaugcggcagcggcaucuuugugacgaacgagguucacacauggaccgagcaguacaaguuccaggcggacagcccaaagcgccuguccgccgccaucggcaaggccugggaggagggggucugcggcaucagaagcgccacccgacuagagaacauaauguggaagcagaucuccaacgagcucaaucacauacugcuugagaacgauaugaaguuuaccgugguggucggagacguggcgggcauccucgcccaggguaaaaagaugauaaggccccaacccauggaauacaaguacagcuggaaguccugggggaaggccaagaucaucggcgccgacgugcagaacacgaccuucaucaucgacgggcccaacaccccggagugccccgaugaccagcgcgcguggaauauaugggaggucgaggacuauggcuucgggaucuucaccacgaacauuuggcugaagcugcgggauagcuacacccaggugugcgaccaccgucucauguccgccgccaucaaggacucaaaggccgugcacgccgacaugggcuacuggauagaauccgaaaagaacgacaccuggaagcuggcccgggccagcuucaucgaggucaaaaccuguaucuggcccaagucccacacgcuguggagcaacggcgugcucgaguccgagaugaucauacccaaaaucuacggcggcccuaucucucaacacaacuaccgccccggguacuucacccagaccgccggccccuggcaccugggaaagcuggaguuggacuucgaccugugcgagggcacuacgguggucguagacgagcacugcggcaaucgggggccgucccugcgcaccaccaccgugaccggcaagaucauccacgaguggugcugccggaguugcacccuaccgcccuugcgcuuccgcggggaggauggcugcugguacgggauggagauccgccccgucaaggagaaggaggagaaucuggugaaguccauggugagcgccggcagcggcgaggucgacuccuucucguuggggcugcugugcauuuccauuaugaucgaggaggugaugcggagccgcuggucccggaagaugcuuaugauuggcacccuggccguguuuuucuugcugaucaugggucaacuaacuuggaacgauuuaauccgccucugcaucauggucggugcgaacgccuccgaccgcauggggaugggcacaaccuaccuggcccuuauggccaccuucaagaugcggccgauguucgccgugggccuccuguuccgccgccugacuucccgcgagguacuccugcugaccaucgggcucagccuggucgcguccgcugagcugcccaacagccucgaggaauugggcgaugggcuggccaugggcaucaugauacucaagcugcugaccgacuuccagucccaccagcucugggccacgcugcugagccucaccuucaucaagacgaccuuuucgcugcacuacgcguggaagacuauggccauggugcuuagcaucguuucccucuucccccugugccugagcaccacgucccaaaagaccaccuggcugccugugcugcuuggcucgcucggguguaagccccugacuauguuccugaucgcugagaacaagaucuggggccggaaaaguuggccccucaacgagggcauaauggcaguggguaucgucagcauccugcugagcucccuccugaagaacgacgugccccuggcaggaccucucaucgcgggcggcaugcugaucgcauguuacgugaucucagggucgagcgccgaccugucccucgagaaagccgccgaggucagcugggaggaggaagcggagcacuccggagcuagccacaauauccugguggaggugcaggacgacgggacgaugaagaucaaggacgaggaacgcgacgacacccugacuauccuucugaaagccacccuguuagccguauccgggguguucccacugagcauccccgccaccuuauucgugugguauuucuggcagaagaagaagcagcgguccgggguuuugugggacacgcccagcccgcccgagguggagcgcgcggugcuagaugacggcaucuaccggauaaugcagcgcggccugcuggggcggucccaggucgguguggggguguuccaggagaacgucuuccacaccauguggcacgugacccgcggcgccgugcucauguaccaggggaagcgguuagaacccaguugggccuccgucaagaaggauuuaaucagcuacgggggcggguggcgccuccagggcuccuggaacaccggugaggagguucagguuaucgcagucgaacccggcaagaaccccaagaacguccagacugcccccgggaccuuuaagacccccgagggcgaagugggcgcuaucgcacuggacuucaagccaggcaccagcggcucccccaucgucaaccgagaggggaagauugugggccuguacggcaacggcgugguuacgaccagcggcacguacgugagcgccaucgcccaggcgaaggccucccaggagggaccgcuaccggagaucgaggacgagguguuccgcaagcggaaccugacaauaauggaccugcaccccggcucggggaaaacgcgccgguaccucccugcuaucguccgcgaggccauuaagcggaagcugcggacccugauucucgcgcccacccgcgugguggcgagcgagauggccgaggcccucaagggcaugcccauccgguaccagaccacggccguuaagagcgagcacaccgguaaggagaucguggaccugaugugccacgccaccuuuacaaugcgacuccuaucccccguacgggucccgaacuacaauaugaucaucauggacgaggcucacuucacggaucccagcuccaucgcggcccgcggguacaucagcacccgugugggcaugggggaggccgccgcgaucuuuaugacugccacaccgccuggcuccguggaggcauucccgcagagcaacgccguaauucaggacgaggagcgggauaucccggagcggucauggaacagcggguacgaguggaucacggacuuccccggcaagaccgugugguucgugcccuccauuaagagcggcaacgacauugcgaacugucugcgcaagaaugggaagcgggucauccaauuaucccgcaaaacauucgacaccgaguaccagaaaacgaagaacaacgacugggauuauguugugaccaccgacauuagcgagaugggggccaacuuucgggccgaccgcgucaucgacccgcggcgcugccugaagccggugauccugaaggacgggcccgagcgugugauccuagccggccccaugccugugacgguggcuuccgcggcccagcgucggggacgcaucggacggaaccauaauaaggagggagaccaauacaucuacauggggcagccccuaaauaacgacgaagaccacgcccauuggacggaggccaagaugcuguuggauaacaucaacacgcccgagggcauuauccccgcccuguucgaaccggagcgugagaaguccgcugcgaucgauggggaguaccggcugcggggcgaggcgcgcaagaccuucgucgagcuuaugcggcguggggaccugccuguguggcuguccuacaagguugccagcgagggcuuccaauacucugaucggcgcuggugcuucgacggugagcggaacaaccagguccucgaggagaacauggacgucgagaucuggaccaaggagggggagcgcaagaaacuuagaccccgcuggcuagacgcacggacguacuccgacccccucgcgcugagggaauucaaggaauucgccgccggccggcgcagcguguccggggaccugauccucgagaucggcaagcugccgcaacaccugacccagcgggcccaaaacgcgcucgacaauuuggucaugcugcauaacucggagcagggcgggcgugccuaccggcacgccauggaggaacuccccgacacuaucgagacgcuuaugcugcucgcccugauugcggugcuaacgggcggcgugaccuuguucuuccugucuggccgcggacugggaaagacuagcaucggccuccugugcgugauggcguccucggugcugcucuggauggccuccguggaaccccacuggaucgcugccagcaucauccuggaguucuuccugaugguccucuuaauccccgagccggaccggcagcgcacgccucaggacaaccaacuggcuuacguggugaucggguugcuguuuaugauccuaaccgucgcggcaaacgagaugggccugcuugagacgaccaagaaagaccuggggaucggccacguggccguugagaaccaccaccacgccgccaugcucgacguugauuuacaccccgcguccgccuggacccuguacgcuguggccaccacgauuaucaccccgaugaugcggcacaccaucgaaaacaccacggccaacaucagccucacagcgaucgccaaccaggccgccauccugaugggccuggacaagggcuggccuaucucaaagauggacaucggcgugccccuccuggcacugggauguuacucacaggucaauccccucacccugaccgccgccgugcugaugcucguggcucacuacgccaucaucgguccgggucugcaagcgaaggccacgcgcgaggcccagaagagaaccgcugccggcaucaugaagaacccgaccguggacgggaucguggccaucgaccuggacccugugguauacgacgccaaauucgagaagcagcucggccagaucaugcugcugauccuuugcacaucccagauccugcugaugcggacgaccugggcccuuugcgagagcaucacccuggccaccggcccccugaccaccuugugggaaggauccccgggcaaguucuggaacaccaccaucgccgugagcauggcgaacaucuucaggggguccuaccuggccggcgccggccuggcauucagccucaugaagucccuagggggcggucggcgcgggacgggggcgcagggcgagacguugggcgaaaaguggaagagacgcuugaaccaacuguccaagagcgaguucaacaccuauaagcggagcgguauaauggagguggaccgcagcgaggccaaggagggccugaagcgcggggagaccacgaaacaugccgucucccgcgggaccgccaagcuccggugguucguugagaggaaccuggugaagccggaggggaaagucaucgaccugggcugcggacgcggggguuggucauacuauugcgcggggcugaagaaggugacugaggugaaaggcuacacuaaaggcggccccggccaugaggagcccaucccgauggcgacauacggguggaaccucgucaagcugcacuccggcaaagacgucuucuucauaccccccgaaaagugcgacacgcugcuaugugacauaggggagagcagccccaacccgacgaucgaggagggccgcacccuucgcgugcugaagaugguugagcccuggcuccgcgggaaccaauucugcaucaagauccugaacccauacaugcccagcguggucgaaacgcuggagcagaugcagcggaagcauggcggcaugcucguccgcaacccgcugucacggaauagcacgcacgagauguauuggguguccugcggcaccggcaauaucguuagcgcggucaauaugaccucccguaugcuguugaacagauucacaauggcccaccgaaagccaacguaugaacgcgacguagaccugggcgccgguacucgacacguggccgucgagccagagguggcgaaccuugacaucauaggccagcguaucgagaacaucaagcacgagcacaagagcaccuggcacuacgacgaggacaaccccuacaaaacgugggccuaccacggauccuacgaagugaagccgagcggcucagcgagcagcauggucaacgggguugucaagcuccugaccaagccgugggacgugauccccauggugacccagaucgccaugaccgacaccacgccguuugggcagcagcgggucuucaaggagaagguggacacgcgcaccccuaaagccaagcgggggaccgcgcagaucauggaggugacagcccgcuggcugugggguuuucuuucgcggaacaaaaagccccgcauaugcacccgggaggaauucacccggaagguccggagcaacgccgccaucggcgcggucuucaucgaugagaaucaguggaacuccgccaaggaggccguugaggaugagagauucugggaccugguccacagggagcgugaauuacacaagcaagggaagugcgcgaccugcguuuauaacaugaugggcaagcgggagaagaaauuaggggaguuugggaaggccaaagggucacgcgcgaucugguacauguggcugggcgcccgguuccuggaguucgaagcacugggcuucaugaacgaggaccacugguucucccgggagaacagccuguccggggucgagggcgaggggcugcacaagcucggcuacauccugcgggauaucagcaagauccccggggggaacauguacgccgacgacacugcggguugggacacccgcaucacugaggacgaccugcaaaaugaggcgaagaucaccgacaucauggagcccgagcacgcccuccuggcgaaggccaucuuuaaacugacauaucagaacaaggucgugcggguucagagaccggcuaagaacgggacugucauggacgugaucagucgucgggaccagcgcggcagcggccagguggggaccuacggccucaauaccuucacgaauauggaggcgcagcugauacggcagauggaguccgaggggaucuucagccccagcgagcuugagaccccuaaccucgccgagcgcguccuggacuggcuggggaaguacgggguggagagacucaagcgcauggcgaucucuggggacgacugcguggucaagccgauagacgaccgguucgccacggcccugaccgcgcuuaacgacaugggaaaagugcguaaggauaucccucagugggagcccuccaagggcuggaacgacuggcagcagguccccuucuguagccaccacuuccaccaacucaucaugaaagacggccgggagauagucguaccgugccgcaaucaggacgagcugguggggcgggcccgcgucagccagggcgcaggguggagccugcgggaaacggcaugcuugggcaagagcuaugcgcagauguggcaauugauguacuuccaccgccgggaccugcgccuugccgccaacgcuaucuguuccgccguuccggucgacugggugcccacaucuagaaccacuugguccauccacgcgcaccaccaguggaugacgaccgaggauaugcugagcguguggaaccgcguauggaucgaggagaaccccuggauggaggacaagacccauaucuccaauugggaagacgugccguaccuggggaaacgcgaggaccaguggugcggaagcuuaaucggccugacggccagagccacgugggcaacaaacauccagguggcaaucaaccagguucgccggcuaauagggaacgagaauuaccuggacuacaugaccagcaugaagcgcuucaagaacgagagcgaccccgagggcgcguugugguga

SEQ ID NO: 23749 - RNA, 9879 nt, Artificial Sequence
  derived and/or modified CDS sequence (opt11) from DENV-1__JN903578__SS-prME
uccgugaccaugcuguugaugcugcugcccaccgccuuagccuuccaccugaccacccguggcggggagccccacaugaucgugagcaaacaggagagaggcaagagccuacuguucaagaccuccgugggggugaauaugugcacucugaucgcgauggaccugggcgagcucugcgaggacacuaugaccuauaaguguccacgcaucacugaggccgagcccgacgacguggacugcuggugcaacgccaccgacacuugggugaccuacgggaccugcagccagaccggcgaacaccggcgcgacaagagaucaguugcacuggcgccccacgucggccuggggcucgagacgcgcacugagaccuggaugagcuccgagggggccuggaaacagauucagcgcguagagaccugggcacugcgccaccccggguucacggugaucgcccuguuccucgcucacgcgaucgguacaucgaucacccaaaaagggaucaucuuuauccugcugaugcucgucacccccucuauggccaugcgguguguggguaucggcaaccgcgacuucguggaggggcugagcggcgccacgugggucgacguggugcuggagcacggguccugcgucaccaccauggccaagaacaagcccacccucgacaucgaguugcugaagacugagguaacaaaccccgccgugcuccguaagcugugcaucgaagcgaagaucagcaauaccaccacggacuccaggugcccgacccagggcgaggccacucuggucgaggagcaggacgccaacuucgugugccgucgcaccuucguagaccggggcugggggaacggaugcggccucuucggcaagggaagccuucugacgugcgccaaguucaaaugcgucacaaaauuggagggcaagguggugcaguaugagaaccugaaguacuccgucaucgugaccguccacaccggcgaucagcaccaggugggcaacgagacgaccgaacacggcaccaucgccaccaucacgccacaggcgcccacgagugagauccagcuaacagacuacggggcccucacccuggacugcagcccccggaccgggcuggacuucaacgagaugguacuccucacaaugaaagagaaguccuggcugguccacaagcagugguuccucgaccuuccccugccauggaccuccggggccagcacgagccaggagacuuggaaccggcaggaccucuuagugacguucaagaccgcccaugccaagaagcaagaaguaguggugcuaggcucacaggagggcgcgaugcacaccgcccucaccggggccacggagauccagaccagcggcaccaccacgaucuuugcugggcacuuaaagugucgacugaagauggacaagcuuacccugaagggcaugaguuauguuaugugcaccggaagcuucaagcuggagaaggaggucgccgagacgcagcacgguacggugcucguacaggucaaguaugagggcaccgacgcaccgugcaagauccccuuccucauccaggacgagaagggggugacccagaacggccggcugaucaccgccaacccgaucgugacugacaaggagaagccggucaacaucgagaccgagccgcccuucggugaguccuacaucguggugggcgcaggcgagaaagcccugaagcucucccgcuucaagaagggauccagcaucggcaagauguucgaggcgaccgcccgcggcgcccgccgcauggccauccugggcgacaccgccugggacuuugguuccaucggcggagucuucacgucgguggggaagcugauccaucagguguucggcacagccuaugggguccuauucuccggaguguccuggacuaugaagaucgggaucggcauccuguugaccuggcucgggcucaacagccggagcacgucccuuagcaugaccugcaucaccgugggaaugguaacccuauaccugggcgugauggugcaggccgauuccgggugcgucaucaacuggaagggucgcgagcugaaaugcggguccggcaucuucguaacgaacgaggugcacaccuggaccgagcaguacaaguuucaggcugacuccccgaaacggcucagcgccgccaucggcaaggcgugggaggagggggucugcggcauccgcagcgccacucggcuggagaacauaauguggaagcaaaucuccaacgagcugaaccauauccuccuggagaacgacaugaaguucaccgugguggucggagacgcgaacggcauccuggcccaggggaagaaaaugauccgcccccagcccauggagcacaaguacagcuggaaguccuggggcaaggccaagaucaucggcgcugacauccagaacacgaccuuuaucaucgacgggccggacaccccggagugccccgacgaucagcgggcauggaacaucugggagguggaggauuacggcuucgggauauucaccaccaacauauggcucaagcugcgcgacagcuacacccagaugugcgaccacagacugauguccgccgccauaaaggacagcaaggcgguacacgccgacaugggcuacuggauagaguccgaaaagaacgagaccuggaagcucgcccgcgccagcuucaucgaaaucaagacuugcaucuggcccaagucccacacacuguggagcaacggcguccuggagucggagaugaucauccccaagaucuacgggggcccgauuagccagcacaaucaccggcccggcuacuucacccaaacagccggccccuggcaccucgggaagcuggaguuggacuucgacguaugcgaggguaccacgguggucguggacgagcacugcggcaaccggggaccgucccuccggaccacaaccgucacgggaaagaucauccacgaguggugcugccgcaguuguacacugccuccccugcgguuccgcggggaggacggaugcugguaugggauggagauccggccagucaaggagaaggaggagaaccucguucgcuccauggugucugcgggcuccggcgaggucgacagcuucagccugggccuguuaugcguguccauuaugaucgaggaggugaugcguucucgcuggucccgcaagaugcugaugaccggcacacuugcagucuucuuccuccugaucaugggccagcugacguggaacgaccucauaaggcugugcaucaugguaggcgcuaacgugagugaccgcauggggaugggcacgaccuaucuggcccucauggcuaccuucaagaugcggccgauguucgcggucggccuguuguuccgccggcucaccucccgcgaggugcugcugcucaccaucgggcuaagccuggucgcauccgccgagcuccccaacucucuggaggagcugggagacgggcuagcgaugggcaucaugaugcugaagcugcucacggacuuccagucccaccagcuguggaccacgcugcuuagccugaccuucaucaagaccacccuguccuuggacuacgccuggaaaacgaucaccaugauccugagcaucguaucccuguucccacucugccugucgacgacgagucagaagacaaccuggcugcccguucuccugggcagcuucgggugcaagccgcugacuauguuccucaucacugaaaacaagauauggggcagaaagucuuggccccugaacgaggggaucauggcgguugguaucgugagcauccugcuauccagccugcugaagaacgaugugcccuuggccgggccccugaucgccggcggcaugcugaucgccugcuacgucauaaguggguccagcgccgaucucuccuuggagaaggcugccgaggucagcugggaggaggaggccgaacacuccgguaccagccacaacaucuuaguggaggugcaggacgacggcacgaugaagaucaaggacgaggagcgcgacgacaccuugacuauccugcugaaggccacccuccuugcggugucaggcgucuacccgaugagcauccccgccacccuguucgucugguacuucuggcagaagaagaagcagcgguccggggugcucugggacacccccagcccgccggagguggagcgcgccguccuggacgauggcaucuaccggauucugcagcgcggccugcucgggcggucccagguuggcgugggggucuuccaggacggcguauuccacacaauguggcacgugacccggggcgccguccugauguaccagggcaagcggcuggagcccagcugggcgucaguuaagaaggaccucaucucuuacggagggggcuggagguuccaaggauccuggaacacgggcgaggaggugcaggucaucgcgguggagcccgggaagaaccccaagaacguccagacuaccccaggcaccuucaagacgcccgagggcgaggucggggcuaucgcccuggacuucaagcccggcaccagcgggucccccaucguaaacagggagggcaagauugugggccuguacgggaacggcgucgugacaaccagcgggacguacgugagcgcuaucgcccaggcgaaggccagccaggaaggcccgcuccccgagaucgaagacgaggucuucaagaagcgcaaccugaccaucauggaucuucauccugggagcggcaagacccggcgcuaccucccggccaucgugcgggaggccaucaagcgcaaacugcgcacccugauccucgccccaacgcggguggucgccuccgagauggcugaagccuuaaagggcaugcccaucagguaccagaccaccgccgucaagagcgagcacaccggucgggagauaguggaccugaugugucacgcgacguucacgaugcgccuccuguccccggugcgggugccgaacuacaacaugaucauaauggaugaggcccauuucaccgaccccgccagcaucgccgcccgcggcuacaucuccacccggguggggaugggcgaggcggccgccaucuucaugacggccacgccucccggcuccgucgaggcuuucccgcaguccaaugcggucauccaggacgaagagaaggacauccccgagcgcucauggaacuccggcuaugacuggaucaccgacuuccccgggaagaccgugugguucguccccucuaucaaauccgggaacgacaucgcgaacugccugcggaagaacggcaagcgcgugauccagcucagccggaaaacguucgacacugaguaccagaagaccaagaacaaugacugggacuacguggucaccacugauaucuccgagaugggggccaacuuccgcgccgaccgcgugaucgauccgcgccggugccugaagcccgugaucuuaaaggacggccccgagcgcguuauccucgccgggcccaugccgguaacagucgcgagcgccgcccagcggcgcggacggaucggccgcaaccagaacaaggagggggaccaauacguuuacaugggccagccucugaacaacgacggggaccaugcccacuggaccgaagcgaagaugcugcucgauaacaucaacaccccugagggcaucauaccggcccucuucgagccggagcgcgaaaaguccgcagccaucgacggggaguaccggcugcgcggcgaggcccggaagacguucguggagcucaugcgccggggcgacuugccagucuggcugagcuacaagguugcauccgagggguuccaguacagcgaccgccgguggugcuucgauggcgagcgcaacaaccaggugcucgaggagaauauggacgucgagaucuggacuaaggagggggagcggaaaaagcugcgcccccgguggcuggacgcccgcaccuacuccgacccucuggcacugcgggaguucaaggaguucgccgccggcagacggagugugagcggcgaucuuauacucgagaucgggaaacugccgcagcaccuaacccuccgcgcgcaaaacgcccucgauaaccuggugaugcuacacaacuccgagcaaggugggaaagccuaccggcacgccauggaggaacugcccgacaccaucgagacgcugaugcuccuggcccugaucgccguccucacaggaggggugacgcuguucuuccugagcggcaaggggcucgggaagaccuccaucggccugcugugcgugauggccuccuccgccuugcuguggauggcgagcgucgagccccacuggauugccgccuccaucauucuggaguucuuccucauggugcugcuuauccccgaaccggacaggcagcggacgccccaggacaaccagcucgcguacguggugaucgggcuacuuuucaugauacucaccguggccgccaaugagaugggccugcuggagaccaccaagaaggaccucgggaucggccauguggcggccgagaaccaccaccacgccacgaugcuugacgucgaccugcgccccgccuccgcguggacccucuaugcgguggccaccacugugaucacgccgaugaugcggcacaccaucgagaacaccaccgcuaacaucucccugacagccaucgccaaucaggcggccauccugaugggccucgacaagggguggcccaucagcaagauggacaucggcgucccccugcuagcccucgggugcuauucccaagugaacccccugacccugacugccgcgguccucauguuggucgcgcacuacgcgaucaucggaccggggcugcaggccaaggcaaccagagaggcacagaagcgcacggcugccgggaucaugaagaauccgaccguggacggcaucguggccauugaccucgaccccgucguuuacgacgccaaguucgagaagcagcugggucagaucaugcugcugauccugugcaccagccaaauccugcucaugcgcacaacgugggcgcuuugcgaguccaucacgcuggccaccggccccuuaaccacauuaugggagggcagccccggcaaguucuggaacaccaccauugccgucuccauggcgaacaucuuccgcggcagcuaccuggcgggggcgggccucgccuucucccugaugaagucccuaggcgggucgcggcgcgggacgggggcccagggcgaaacguugggggagaaguggaagaggcaacugaaccagcugagcaagagcgaguucaacaccuacaagcgcuccggcaucauggaggucgaccggagcgaggcuaaggaggggcucaagcgcggcgagaccaccaagcacgccgugucccgggggacagcgaaguugcguugguucguagagcggaaccuggucaagcccgagggcaaggugaucgaccuggggugcgggcgcggcggguggucuuacuacugcgccggcuugaagaaagugaccgaggucaagggguauaccaaggggggccccgggcacgaggagcccaucccgauggccaccuacggcuggaaccuagugaagcugcacuccggcaaggacguguucuucaucccgcccgagaagugcgacacccuccugugcgacauaggcgagagcucccccaaccccacgaucgaggaggggcggacccugcgcguccucaagaugguggagcccuggcugcggggaaaccaguucugcauaaagaucuugaaccccuacaugcccagcguggucgagacccucgagcagaugcagcgaaaacauggcgggaugcuggugcggaauccgcucucccgcaacucaacccacgagauguauuggguauccugcggcacgggaaauaucgucagcgccguaaacaugaccucccgaaugcuccugaaucgcuucacuauggcgcaccgaaagcccaccuacgagcgggacguggaccugggcgccggcacgcgccaugucgccguggagcccgagguggcaaacuuggauauaaucgggcagcggaucgagaacaucaagaaugagcacaagucuaccuggcacuacgacgaggacaaccccuacaagaccugggccuaccacggcuccuacgaggucaaacccaguggguccgcgagcuccauggugaacggcgucgugagacugcugaccaagccuugggacgugaucccgauggucacgcagaucgccaugaccgacaccacgcccuucgggcagcagcggguguucaaggagaagguggacacgcgcaccccgcgggccaagcguggcaccgcccagaucauggaggucaccgcuaaauggcucuggggcuuccugagccggaacaagaagccgcgcaucugcacgcgggaggaguucacacgcaagguccggucgaaugcggccaucggggccguuuucguugacgagaaucaauggaauuccgccaaagaggccgucgaggacgagcguuucugggaccuggugcacagagagcgagagcuccacaagcagggcaagugugcgaccugcgucuauaacaugauggggaagcgggagaagaagcugggcgaauucgggaaagccaaaggcagccgcgcgaucugguacaugugguugggcgcccgguuccucgaguuugaggcgcugggguucaugaacgaggaccacugguucucccgggagaacagccucuccgggguggaaggggagggacuccacaagcugggguacauccugcgggauaucagcaagauccccggcggcaauauguacgccgaugacaccgccgggugggacacgcgcaucaccgaggacgaucuccaaaacgaggccaagauaaccgacauaauggagccggagcacgcccugcuggcgaccaguaucuuuaagcucacguaccagaacaaggugguccgggugcagcgucccgccaagagcggcaccgugauggaugucaucucacgccgagaccagcgcgggagcggccaggugggcaccuacgggcugaacaccuucacaaacauggaggugcagcugauacggcagauggagucagagggcaucuuccuccccagcgagcuggaaacccccaauuuagccaagcggguccucgacuggcuggaaaaacacggggccgagcggcugaagcgcauggcaaucuccggugacgacugcgugguaaagccgaucgacgaccgauucgcgaccgcccucaccgcccugaacgauauggggaagguccguaaagauaucccccagugggagcccagcaagggcuggaacgacuggcagcagguccccuucugcucccaccacuuucaccagcugaucaugaaggacggccgggagaucgugguuccgugccgcaaccaggacgagcucguggggcgggcccgcgugagccagggcgccggguggucccugagggagacggcgugccugggcaagagcuacgcccagauguggcagcucauguacuuccaccgccgggaccuccgccucgccgccaacgccauaugcucugcgguuccaguggacuggguucccaccucccggacuaccuggucgauccacgcccaccaucaguggaugacuacggaagacaugcucuccgucuggaaccgcguguggaucgaagagaaccccuggauggaggacaagacccacguguccucaugggaggaagucccguaccuggggaagagggaggaccagugguguggcagccugaucggccucaccgcccgggccaccugggcuacgaacauacagguggccaucaaccaggugcgccggcucaucgggaacgagaacuaccuggacuacaugaccaccaugaaacgcuucaaaaacgaguccgaucccgaaggcgcccucugguag

SEQ ID NO: 23750 - RNA, 9879 nt, Artificial Sequence
  derived and/or modified CDS sequence (opt11) from DENV-1__JN903579__SS-prME
agcgugaccaugcugcugaugcugcugcccaccgcccucgccuuccaccugaccacccggggcggggaaccccacaugaucgugggcaagcaggagcggggcaagagucugcuguucaagaccucggccgggguaaacauguguacacuuaucgccauggacuugggggagcucugcgaagacaccaugaccuacaagugcccacggaucaccgaggccgaacccgaugacguggacugcuggugcaacgccaccgauaccugggugaccuacgggaccugcucucagaccggggagcaccggcgugacaaaagaucaguggcccuggcgccccacguggggcugggucucgagacgcgcaccgagaccuggauguccucggagggggccuggcggcagauccagaagguggaaaccugggcucugcgccacccuggcuucaccguaaucgcccuguuccucgcgcacgccauugggaccuccaucacccagaagggaaucaucuucauccugcugaugcucguuacccccagcauggccaugcguugcguaggcaucgggaaccgcgacuucguggaaggccuguccggggccacguggguggaugucguacuggaacacgguuccugcgugaccaccauggccaagaacaagccaacacucgacaucgagcugcugaagacggaggucaccaacccagcggugcucaggaaacuuugcaucgaggccaagaucucaaauacaaccacggacagcagaugcccgacgcagggcgaagccacccugguagaggagcaagaugcgaauuucgucugcaggcgcacauuuguggaccgaggguggggcaauggcugcggccucuucgggaaggguucuuuacugacgugcgcuaaguuuaagugcgugacaaagcucgagggcaagauagugcaguaugagaaccugaaguacagcgugauugucacaguccauaccggugaccagcaccaggugggcaacgagacgaccgagcacgggaccaucgcgacgauaacgccccaggccccuacguccgagauccaguugaccgacuacggcgcccucacacuggacugcagcccgagaacagggcuggacuucaacgagauggugcuccugacgaugaaggagaaguccuggcuggugcacaagcaaugguuccucgaucugccgcuccccuggaccagcggcgcguccaccucacaggagacguggaaccggcaggaccuuuuagugacguucaagacggcucacgcaaagaagcaggaggucgucgugcugggcagucaggagggugcaaugcacaccgcccucacaggcgccacugagauccagaccuccgggacuaccaccaucuucgcggggcaucugaagugcaggcugaagauggacaagcucacccugaagggggugagcuacgugaugugcaccggcuccuucaagcuggagaaggagguggccgagacccagcacggcacgguccuaguccaggugaaguacgaggguaccgaugcgccgugcaagauccccuucucaacccaggaugagaaaggggucacacagaacggccgucuuauaacugccaacccgaucguuacagacaaagaaaagcccgugaacaucgagaccgagccgccuuucggcgaguccuacaucguuaucggcgccggggaaaaggcgcucaaguugagcugguuuaagaagggguccagcaucgggaagauguucgaggccaccgcccgcggagcucggcgcauggcaauccucggggacacggcuugggacuuuggcuccauuggcgggguguuuaccagcguuggcaaacugguccaucaaguguuugggaccgccuacggcgugcuguucucugggguuagcuggacuaugaagaucggcaucggcauccuccugacguggcuggggcuaaauucccguucuacaucucugagcaugacgugcaucgcaguaggcauggugacccuguaccuuggggucauggugcaagccgacacgggcugcgugaucaacuggaaaggccgcgagcugaagugcggcagcggcaucuucgucaccaacgagguccacaccuggaccgagcaauacaaguuccaagccgacaguccaaagcgccugucggcggcuauagggaaagcaugggaggagggagugugcgggauacggagcgccacacgucuagagaacaucauguggaagcagaucucuaacgaacucaaucacauccuccucgagaacgacaugaaauucacggucgugguaggcgaugccaacgggauccugacacagggcaagaagaugauccguccccagcccauggagcacaaguacuccuggaaguccuggggcaaggcgaaaaucaucggggccgacacacagaauaccacguucauaaucgacggccccgacacgccggagugccccgacgaccagcgcgcauggaacaucugggaagucgaggacuacggauucggcaucuuuaccaccaacaucuggcuuaagcuccgggacuccuauacgcagaugugcgaucaccgcuugaugagcgccgcgaucaaagacuccaaggccgugcacgccgacaugggguacuggauagaaagcgagaagaacgaaaccuggaagcuagcccgggccucauuuauugaggugaagaccugcaucuggcccaggucccauacccucuggucuaacgguguccucgagagcgaaaugaucauccccaagauauauggcgggccgaucucccaacacaacuaccgccccggcuacuucacgcagaccgcagggcccuggcaccugggcaagcucgagcuggacuuuaaccugugcgagggcaccaccguaguagucgaugagcauuguggcaaccgcgguccgagccuccggacgaccaccgugaccgguaagaucauccacgagugguguugccgcuccugcacgcugccaccccugcgguuucguggcgaggacggcugcugguacggcauggagauucggcccgugaaagagaaggaggagaaccuaguccgcucaaugguauccgcgggaucuggggagguagacuccuucagcuugggacugcuaugugucucaaucaugaucgaggaagugaugagaucgcgcuggagccgcaagaugcugaugaccggcacacuggccguauucuuccuccugaucaugggccagcugacguggaacgaccuaauacgucuauguaucauggucggggccaacgugucagaccgcaugggcaugggaacgacauaucuggcauuaauggcgaccuucaagaugcggccgauguucgccguggggcuacucuuccgcaggcucaccucgcgggagguccugcuuuuaacuaucggccugucccugguggccagcgccgagcucccuaacucccucgaggaacugggagacggccucgccauggguaucaugaugcugaagcugcuuaccgacuuccagucccaccagcucuggacaaccuugcucucccugacguucauaaagaccaccuugagccucgacuacgcguggaagaccaucgcgaugaucuuguccaucguuucucuguucccucucugccuguccacuacgagccagaagaccaccuggcugcccgugcuccugggguccuucggcugcaagccgcugaccauguuccucaucacggagaacaagaucugggggcggaaaagcuggccccugaaugagggcaucauggccguggggaucgucuccauccuucuaagcucccugcugaagaacgacgugccccucgccggcccccugaucgcgggcgggaugcugaucgccugcuacguuaucaguggaagcuccgccgaccuuagccuagagcgcgccgcagagguaucgugggaggaggaggcugagcacagcggggccucccacaacauccugguggagguacaggacgauggcaccaugaaaauuaaggacgaagaacgggaugacacguuaaccauauugcucaaggccacccuccuggccgucagcgggguguaucccauguccauccccgcaacccuguucgugugguacuucuggcagaagaagaaacagagaagcggcguccugugggacaccccgucgccgccugagguggaacgggcgguucuggaugacggcaucuaccgcauccuacagcgaggccuccucggccgcucucaagucggggugggcguguuucaggacggugucuuccacaccauguggcacgugacccguggcgcaguguugauguaccagggcaaacgccuggagcccuccugggcuagcgucaagaaggaccucauauccuacggugguggguggcgguuucaagggagcuggaacaccggggaggagguccaggugauagcggucgagcccggcaagaaccccaagaacgugcaaaccacccccgguaccuucaagacccccgaaggggaggugggcgcuauugcccuggacuucaagccggggaccuccggcagccccaucgucaacagagagggcaaaaucguugggcuuuacggcaacgggguggucaccacguccggcaccuaugugagcgccaucgcccaggcaaaggccucgcaggaggggccgcuccccgagaucgaggacgagguguucaagaaacggaaccucaccaucauggacuuacacccagggagcggcaaaacacgucgguaccucccggcgaucguacgcgaggccaucaagaggaagcugcggacgcugauacuggccccgacccgcgugguggccagugaaauggccgaggcccuaaaggguaugcccauccgguaucagacgaccgccgugaaaagcgagcauacgggccgcgagaucguggaccugaugugccaugcgaccuuuacgaugaggcuccuuagcccuguccgcgucccuaacuacaacaugaucauuauggacgaggcucacuucacugaccccgcaaguauagccgcccggggguacaucuccacgcgcguuggaaugggagaggccgccgcgaucuucaugaccgcaacgccgcccggcucgguugaggccuucccgcagagcaacgccguuauccaggacgaggaacgggauauccccgagcgcagcuggaacagcggguacgacuggauaaccgacuuccccgguaagacggugugguucgugcccaguaucaaaagcggcaacgacaucgcaaauugccugcggaagaacgguaaaagagugauucagcucucccgaaagacaaucgauaccgaguaucagaagacaaagaauaacgacugggacuauguggugacgaccgacaucagugagaugggugcgaauuucagggccgaccgggucaucgacccaagacggugucugaagccagugauccugaaggacgggcccgagcgcguaauccucgccggccccaugcccgucaccgccgcaucagccgcccagcgacgcggccggaucggacggaaccagaacaaggaaggcgaccaguauaucuacauggggcagccccugaacaacgaugaagaucacgcgcacuggacagaagccaagaugcugcucgacaacaucaacacaccugaagguaucaucccagcucuguuugaaccggagagagagaaauccgcggcuaucgacggggaguaucggcugcguggagaggcccgaaagaccuucguagagcucaugcgccgaggggaccugcccgucugguugagcuacaagguggccagcgagggcuuucaguacucagaccgccggugguguuucgacggcgagcgcaacaaucaggugcucgaggagaacauggacguagagaucuggaccaaggagggggagcggaagaagcugcgcccccggugguuagacgccaggaccuacagcgacccccuagcccugcgggaguucaaggaguucgccgcgggccgccgguccgugagcggggaucucauucucgagauagggaaguugccacagcacuugaccuugcgcgcacagaacgcguuggacaaccuggugaugcuccacaacagcgagcagggcgggaaggccuaccggcaugccauggaggagcugcccgacacgaucgagacgcugaugcuccuggccuuaaucgcgguccucacaggaggggugaccuuguucuuccuaucaggcaaaggccucgggaaaaccagcaucggccuguugugugugauggccuccucgguccuccuguggauggccuccguggagccccauuggauugcugccagcaucauccuggaguucuuucucauggugcugcugauccccgagccggauagacagcggacuccccaggacaaucaacuugcguacgucgugaucgguucacuguucaugauccugacuguggccgccaacgagaugggccuacuggagaccacgaagaaagaucucgggaucgggcacgucguagccgagaaccaccaucacgccacuacccucgacaucgacuugcaccccgcgagcgccuggacccuguacgccguggccacgaccauuaucacuccgaugaugcgccauacaaucgagaacaccaccgccaacauaucccucacggcgaucgccaaccaggcggcuaucuugaugggucucgacaagggguggcccaucagcaagauggacauagggguuccccuccuagcucuggggugcuacucccaggugaacccccucacacugacggccgcagugcucaugcucgucgcccacuacgccaucauuggcccggggcugcaggcgaaggccaccagagaggcgcagaaacggaccgccgcggggauuaugaagaaccccacgguugacgggaucguggccaucgaccuggaccccgucguguacgaugccaaguuugagaagcagcucgggcagaucaugcugcugauccucuguacgucgcagauccugcugaugcgcaccaccugggcccucugcgaauccaucacuuuggccacggguccucuaaccacccucugggaggggagcccggggaaguuuuggaacaccaccauugcaguguccauggcgaacaucuuccggggcagcuaccuggccggagccggacuggccuuuuccuuaaugaagucccucggcggcgggcgccggggcacaggugcccagggagagacccugggcgagaaguggaaacgccagcuuaaucagcuguccaagagcgaguucaacaccuacaaacguagcgggaucauggagguugaccgcagugaggcgaaggagggccugaagcgcggggagaccacaaaacacgccgugagccgcgguaccgccaagcucaggugguucguggagcgcaauuuagucaagccagaggggaaggugaucgaccuuggguguggccgcggcgguugguccuacuacugcgccggucugaaaaaggugaccgaaguuaaaggcuacaccaaaggagguccaggucacgaggaacccaucccgauggcgaccuacggguggaacaucguaaagcuccacagugguaaagauguguucuucaccccgcccgaaaagugcgacaccuuacugugcgauaucggggagucuucucccaacccgaccaucgaggagggccgcacccucaggguccucaaaaugguugaacccuggcuacguggcaaccaauucugcauuaagauucucaaucccuacaugcccuccgugguggagacccuggagcagaugcagcggaagcacgggggcauguuaguacguaacccgcucagccggaacuccacacacgagauguauugggucagcugcgggaccggcaacaucguuucugccgugaacaugacgucgcggaugcugcugaaucgcuucaccauggcccaccgaaagccuaccuacgagcgcgauguggauuugggcgccggcacccggcacgucgccguggagccagagauagcgaaccuggacaucaucggccaacgcaucgagaauaucaagaacgagcacaaguccacguggcacuacgacgaggacaaccccuacaaaacgugggcauaccacgggagcuacgaagugaagccguccggcagcgcuuccagcauggucaacgggguggugcgucugcucacuaagcccugggauguaauucccauggugacccagaucgccaugacagacaccacccccuuuggucagcagcgcgucuucaaagagaaggucgacacaagaacgccgcgcccuaagcgagguacagcacagauaauggaaguuacggccaaguggcuauggggguucuuaucccgcaacaagaaaccccggaucugcacccgcgaggaguucacgaggaaaguccgcagcaacgccgcaaucggcgccguauucguggacgagaaucaguggaacagugccaaggaggcgguagaggaugaacgguucugggacuuggugcaccgggagcgggagcuucacaagcaggggaagugcgcuacgugcguuuacaacaugaugggcaagcgagagaagaaacugggagaguucggcaaggcaaaaggcucccgggccauuugguacauguggcugggggcucgcuuccuggaguucgaggcccuaggcuucaugaacgaggaccacugguucagccgggagaacucccucagcggggucgaaggcgagggucuguacaaacuuggcuacauccuacgcgacaucucgaagaucccgggagggaacauguacgcugacgacaccgccggcugggacacccggaucacagaggaugaccugcagaacgaggccaaaauaaccgacaucauggaacccgagcaugcgcugcuugcgacaagcaucuucaaacugaccuaccagaacaagguugugcggguccaaaggcccgccaaguccgggacggugauggacguuaucucgcggcgcgaccagcggggcucgggucaggucgggacguacggucugaacacauucaccaacauggaggugcagcucauccgccaaauggaaagcgaggggaucuucucccccagcgagcuggagaacucuaaccuggcagaaagggugcuugacuggcuggagaagcauggggucgagcgccugaagcgcauggccaucagcggagaugacugcguggugaagccgaccgaugaccgcuucgcgaccgcccuuaccgcgcugaacgacaugggaaaggucaggaaggacauuccacagugggagccgucuaagggauggaacgacuggcagcagguccccuucugcagccaccacuuucaccagcugauuaugaaggaugggcgcgagauuguugucccgugccggaaccaggacgagcucgucggccgcgcgcgugucucccagggggccggcuggagccugcgcgagaccgcgugucuggguaagagcuacgcccagauguggcagcucauguauuuccaccggcgcgaccugcgcuuggccgccaaugcuaucugcucagcgguucccgugaacugggugccuacaagccgcacgaccuggaguauacacgcccaccaccaguggaugaccaccgaagacaugcuuagcgucuggaaucgcguguggaucgaggaaaaccccuggauggaggauaagacgcacgucucaaguugggaggacgugccguacuugggcaaacgggaggaccaguggugcggcagccugaucgggcucaccgcccgcgccaccugggccaccaauauccaggucgccaucaaccaggugcggagguuaauuggcaacgagaacuacagcgacuacacgaccuccaugaagagauucaaaaaugagagcgaucccgagggugcccugugguag

SEQ ID NO: 23751 - RNA, 9879 nt, Artificial Sequence
  derived and/or modified CDS sequence (opt11) from DENV-1__JN903580__SS-prME
agugugacaaugcuuuuaauguugcuaccaacggcacuagcguuccaccucaccacccgcggaggggaaccgcacaugauagugagcaaacaggaacggggcaagagcuuguuauucaaaaccagcgccggggugaauaugugcacacuaauagcuauggaucuaggggagcuaugcgaagacacaaugaccuacaaaugcccgcgcaucacggaagccgaaccagacgacgucgacugcugguguaaugccaccgacaccuggguaacguacgggacuugcucacagaccggggagcacagaagagauaaacggagcguagcacucgcaccucacgugggguuaggccucgagacucgcacggagacauggauguccuccgagggagcauggcggcagauacaaaaaguagaaacaugggcacuacgucacccagguuucacugucaucgcccuguuucucgcccacgccauaggcacaucaauaacacagaaaggcauaaucuucauacuacuaauguugguaacgccuagcauggcaaugcggugugucgggaucggcaacagagacuuugucgaaggccuuagcggagcaaccuggguggacgucguccuggagcacggcucgugcguaaccacaauggcgaaaaacaaaccgacucucgauauugagcuccugaaaacagaaguaacgaacccagccguccucagaaaauugugcauagaagcaaaaaucucgaacaccacuacggacagccgaugucccacucaaggggaggccaccuugguggaggaacaggacgcaaauuucguaugccgcagaaccuuugucgacagaggcuggggcaacggaugcggacucuucggcaaaggcucgcuacuaaccugcgcgaaauuuaaauguguaacaaaacuggagggcaaaauaguucaguacgaaaaccuaaaauacucagugaucgucacaguacacacaggcgaccaacaccagguagguaaugaaacaacagagcaugguaccauugccacgauaacaccgcaagccccuaccucugagauucagcuuacugauuacggcgcacucaccuuagacuguucgccgagaacggguuuagacuuuaaugagaugguauugcugacaaugaaagaaaaaucauggcuaguccacaaacaaugguuccucgaucucccgcuacccuggacgagcggagcaagcacaucacaagaaacguggaaucggcaagaccuauuagucacauucaaaaccgcccacgcgaaaaagcaggaaguagugguccucggcucccaagaaggcgcgaugcauacagcacugacaggagcaacagaaauacaaacaagcgguaccacaaccauauucgcaggacauuuaaaaugccgccugaaaauggacaaacucacccucaagggaguaucguacguaaugugcaccgggucauucaaacucgagaaagaaguggcggagacccaacacgguaccguauugguacaggugaaauacgaagguaccgaugcgcccugcaaaauaccuuuuucaacccaagacgaaaagggcguaacacaaaacggccgucuaaucacugcuaacccuauuguaacagacaaggagaagcccguuaacauugagaccgaaccaccauucggagaaaguuauaucgugauuggagcuggggagaaagcacucaaauugucaugguucaaaaaggguucaucuauaggaaagauguucgaggcaacugcucgaggcgcacgacgaauggcaauacuaggcgauacagccugggacuuugguaguaucggaggcguauucaccucuguaggcaaguuaguucaccagguauucgggacugcuuacggaguccucuuuucaggagucucguggacaaugaagauagggauaggcauucuauuaacguggcuaggguuaaacaguaggaacacgucacuauccaugaccugcauagccgugggaauggugacuuuauaccucggagucauggugcaagcggacacgggaugcgugaucaacuggaaagggagggaauuaaaaugugguuccgggaucuucgucaccaacgaaguucacacuuggacggaacaguauaaauuccaagcugauagcccaaaacgccuaagcgccgccauagguaaagcaugggaggaaggggugugcgguauucgaagcgcaacccgacuagaaaacaucauguggaaacagaucagcaacgaguugaaccacauccuccuggaaaaugacaugaaauucacggucgucgucggggacgcaaacggaauacucacacaaggcaagaaaaugauucgaccgcaacccauggagcacaaauacucauggaaaucauggggaaaagcgaagaucaucggagccgacacucaaaacacaaccuucaucauugacggaccagauaccccugagugcccagacgaccagagggccuggaauaucugggagguagaagacuacggcuucggcauauucacaacgaacauuuggcuaaagcuaagagacaguuacacgcaaaugugugaccaucgacuaaugucagccgccaucaaggacaguaaggcaguccacgcggacaugggauacuggauugagucggaaaagaacgagacguggaaacuugcccgagccucuuucaucgaagucaagaccugcauauggccccgcucccacacccucuggucgaacggaguguuagagagcgaaaugaucauuccuaaaauauacggagggccaauaucgcaacauaacuaccgcccaggguacuucacccaaacagcaggacccuggcaccuaggcaaauuggaacuagacuucaaccucugcgaaggaaccacgguaguagucgacgagcacugcggaaacagagggccgagccuacgaaccacaacuguaaccggaaagaucauucaugaauggugcugucgaagcugcacacuucccccuuuacgcuuccgcggggaagauggaugcugguacgggauggaaauaagacccgucaaagaaaaagaagaaaaccucguccgaucaauggucucggcagggucgggagaggucgauuccuucucgcuuggacuacuaugcgucagcaucaugauagaggaggugaugaagagucgaugguccaggaagauguugaugacgggaacucucgccguauuuuuccugcuaauaauggggcaacuaacuuggaaugaccugauacggcuaugcaucaugguuggcgcaaacguaagcgaccgcaugggcaugggaacaacguaccucgcgcugauggcaaccuucaaaaugcgaccaauguuugcgguagggcugcuauuucgaagacugaccagucgagagguauuacugcuaaccauuggcuugucucuaguagcauccgcagaacuaccaaacagucucgaggaacuuggggacggacuagcaaugggcaucaugauguuaaaacugcugacugacuuccaaucacaccagcuauggacaacacuacuaucgcugaccuucauuaaaacuacccuaagccuagacuacgcauggaagaccauagcaaugauacugucgauaguaagccuauuuccccuaugucucucgacaacaagucaaaagaccaccuggcuuccaguacuguuagguagcuucggcugcaaaccccugacuauguuccuaaucacggaaaacaagaucuggggacgcaaaagcuggccacuuaaugagggaaucauggccgucggaauagucagcauucuacugaguagccuacuuaaaaacgacgugccgcuagcggguccgcuaauugcgggaggcauguugaucgccuguuacguaauaaguggcagcagcgcagaccugucccuggaacgagcugcagaggugucaugggaagaagaagccgaacauuccggcgcuucacauaacauccucguggagguacaggacgacggaacuaugaagaucaaggaugaggagagagacgauacacucaccauccuacugaaagcaacgcuccuagcaauauccggaguauaccccaugucgauaccggcgacguuguucgugugguacuucuggcaaaagaagaaacaacggucaggcguacugugggacacgccaucgccaccggagguggaacgagcaguccucgacgauggaauauaucgaauacuacaaagaggccuacugggccgaucacagguaggggucggcguauuccaagauggcgucuucaggacgauguggcacguaaccagaggggccguacucauguaccagggaaaacggcuagaaccgagcugggccucaguaaagaaggaccucaucagcuacgguggaggguggagauuccagggaucauggaacacgggagaagagguccaggugaucgccguugagccgggcaaaaaucccaaaaaugugcagacaacacccggaacauucaaaacuccugagggggaagugggagcaauagccuuagacuucaagcccgguaccucuggaaguccaauuguaaacagggagggcaaaauagugggacucuacgggaacggaguagucacaaccagugguacauauguaucagcaauugcccaagcaaaagcaucccaggaagguccgcuacccgaaaucgaggacgaaguuuuuaagaaacggaacuuaaccauaauggaccuucacccgggaagcggcaaaacacgacgguauuuaccagcaauaguacgugaggcgauuaagcgaaaacuccgcacucugauacuagcacccacgcguguaguagcguccgaaauggccgaggcccuaaaaggaaugccgauuagguaccaaaccacggccgucaagagcgagcauacggggcgagaaaucguagaccuuaugugccacgcgacauucaccaugcgguugcuaucuccaguacgcgugccaaacuacaacaugaucaucauggacgaagcgcauuucacggauccagcauccauagcugcccgcggcuauaucagcacaagaguuggaaugggcgaagccgcugcaauauucaugacugcgaccccgccggggucuguagaagcguucccccaaagcaacgccgugauccaggaugaagaaagagacauacccgagcgaagcuggaacucgggauaugacuggauaacggacuucccugggaagaccgugugguucgucccgucaauaaagucaggaaaugauaucgcaaacugucugcgaaagaacggcaaacggguaauccaacuaucaaggaagacuuuugacacggaauaccagaaaaccaagaacaaugacugggacuacguaguaacaacagauaucagcgaaaugggugccaacuuccgggcagaucgcgucauagauccaagaaggugccugaagccagucauucuuaaagacggaccugagagggucaucuuagcagggccgaugcccguaacggcagcgagcgcagcacaaagacgggggcggauuggucgcaaucaaaauaaggagggcgaccaguacauauacauggggcagccacucaauaacgacgaagaucacgcucacuggacagaagccaaaaugcuguuagacaacaucaacacgccagaagguaucauaccugcgcucuuugaacccgagcgagagaaaagcgccgccaucgacggagaauauagacugagaggugaagccagaaagaccuucgucgaauugaugcgacgaggggaccuaccaguguggcucucguauaaggucgcaucagaaggguuucaauacagcgaccggagauggugcuucgauggggaaaggaauaaccagguacuagaggaaaauauggacguagagaucuggaccaaggagggcgaaaggaagaaacuacgaccgcgcuggcuagacgcaaggacauauucagacccguuggcacugcgggaguucaaagaauuugcugccggacgccgcagcguaucaggggaucuaaucuuggaaaucggcaaacucccucaacacuuaacguuacgagcgcagaacgcacuggacaaccucgugauguuacauaacagcgaacaaggcggaaaggcuuaccgccacgcaauggaggagcugccagacacaaucgaaacccucaugcuccucgcccucauugcaguacuaacagggggcgucacacucuucuuccucagcggcaaggguuugggaaagacuuccauuggccuauuaugcgucauggccucgucgguacuacuauggauggcaagcgucgagccacauuggauagcagcgaguauuauccucgaguucuuccuaaugguacuccucauacccgaacccgaccgacagaggacaccccaagauaaccagcucgccuaugucguuauagggcuguuguucaugauccugaccguagcggcaaacgagaugggucuccucgagaccacuaagaaggaccucgguauugggcacgucgucgccgaaaaccaucaccacgcaacuaugcuagacauagacuugcacccggcgucugcauggacacuauaugcaguugcaacaacaauaaucacuccaaugaugcgacacaccauagagaacacaaccgcaaacaucucucucacagccaucgcgaaucaagccgcaauucuaaugggucuagauaagggauggccuauaagcaaaauggacauuggaguuccccugcuggcgcucgggugcuacucacaaguuaauccccugacucucaccgccgccgugcugauguuagucgcacacuacgcgauuaucggaccgggacuacaagcaaaagcaaccagggaagcgcagaagcgcacagcggcggguauuaugaaaaacccgacgguggauggcaucguggcaaucgaccuagacccaguaguauaugacgccaaauucgagaaacaacuugggcaaauuaugcuccuuauucucugcacaucccagauucugcucaugcggacaaccugggcccuaugcgaaaguaucacacuagcaacaggcccacucacaacccuaugggagggaucccccgggaaguucuggaacaccacaaucgccgucucgauggcaaacaucuuccgaggaucguaccucgcaggagcgggcuuagccuucagucucaugaaauccuuaggagguggaagacgggacacaggagcacagggggaaacacuaggcgagaaauggaaacgacagcuaaaucagcucagcaagccggaguucaacacguacaagaggagcgggauuauggagguggacagaucagaagccaaagaaggucucaagaggggagagacaacaaaacaugcaguaagccgugguacggcgaaauugcgcugguucgucgaacgcaaccucgucaaaccagagggcaaagucaucgaccuagggugcgggcgaggaggguggagcuacuacugcgcaggacuuaagaaagugaccgaggucaagggauacaccaaaggcggaccaggccaugaagaaccuauccccauggcuaccuacgguuggaacaucgucaaacuccauagcgggaaagaugucuucuucacaccgccagaaaaaugcgauacacuacuaugcgacauuggcgaauccucgccaaauccuaccauagaggaggggcgcacccuccggguucuaaaaaugguugagccauggcugcgaggaaaccaauucugcaucaaaauacugaauccuuacaugccaucuguugucgaaacccuagaacaaaugcaacggaaacacggaggaaugcuaguuaggaacccguuaucaaggaacagcacacacgagauguauugggucagcugcggcacggggaacaucgucucggccguuaacaugacaucgcgcauguuacuaaacagauucacgauggcgcaucgaaagcccacauacgagcgugacguggaccuuggggcuggaacaagacacgucgcaguagagccagagaucgcaaacuuagacauaauuggacagcggauggagaacauaaagaacgagcacaaaaguacauggcauuacgacgaggacaaccccuauaagacgugggcuuaccacggcucguacgaaguuaaaccgagcgggucggccagcagcaugguaaacggugugguacgacuacugaccaagccaugggacguaaucccaaugguaacccaaauagcuaugacggacacaaccccuuuuggccagcaaagagucuuuaaggaaaagguagacacccgaacgcccaggccaaaacguggaaccgcgcagauaauggaaguaacggcuaaguggcuauggggcuuccuaucaagaaacaagaaaccgcggaucugcacucgagaggaauuuaccagaaaagugagauccaacgcagcgaucggagcagucuucguugacgagaaccaguggaacucggcaaaagaagccgucgaggacgagcgauucugggaccugguacaccgcgagagggagcugcacaagcagggaaaaugcgcgaccuguguguauaacaugaugggaaagagagagaagaaacugggagaguucggaaaggcgaagggaucacgagccaucugguacaugugguuaggggccagauuccucgaguucgaggcccuaggguuuaugaacgaagaccacugguucucucgcgaaaacucccucagugggguugaaggagaaggccuauacaaacugggguacaucuugcgagacauaagcaaaaucccagggggaaacauguacgcggacgacacggcggguugggacacccgaaucacagaagacgaucuccagaacgaggcgaaaauuacugauauuauggagccagagcaugcccuacuagcgaccagcaucuucaaacugacauaccaaaacaagguuguccgcguccagcgaccagcgaaaagcggaaccgugauggacguaauaagccggagagaccagagaggaucggggcaggucggaacuuacggccuaaacacuuucacaaacauggagguucaauugauaaggcaaauggaaagcgaaggcaucuuuucgccaucagaacuugagaacucaaaucuagccgaaagagugcuugacuggcuggagaaacacggagucgaacgacucaaacggauggcaauuagcggagacgacugcgucgugaaaccaaccgacgaccgcuucgccacugcccuaacggccuuaaacgacaugggcaaggucagaaaggacauaccccagugggaacccagcaagggauggaacgauuggcaacaagucccauuuugcucccaccacuuucaccaguuaaucaugaaagauggccgggaaauagucgucccaugucguaaccaggacgagcucguaggucgagcccgcgucucccagggagccggcuggucucuccgggagacagcgugccucgggaaauccuacgcccaaauguggcaacugauguacuuucaucggcgagaucuuagacuugccgcgaacgcaaucugcucagcggucccagugaacuggguaccaacaucacguacaacguggucuauacacgcccaccaucaauggaugacgaccgaggacaugcuauccguguggaacagggucuggauagaagaaaacccauggauggaggacaagacgcacguuucaucgugggaggacguaccauacuuggguaagcgagaagaucaauggugugggagccucaucggccucaccgcccgcgcgaccugggcuaccaacauccagguggccauuaaccaagucagaaggcuaaucggcaaugaaaacuauucggacuacaugaccucgaugaaacgauucaagaacgagucugaccccgaaggggcccuaugguga

SEQ ID NO: 23752 - RNA, 9879 nt, Artificial Sequence
  derived and/or modified CDS sequence (opt11) from DENV-1__JN903581__SS-prME
ucagucaccaugcuguuaauguuacuucccacagcacuugccuuccaccuaacaacccgcggcggggagccccacaugaucguguccaagcaggaacggggcaagagccuccuguucaagaccuccgccggggucaacaugugcacccugauagcuauggaccugggcgaacucugcgaggacacgaugaccuacaagugcccccgcaucaccgaggccgagcccgaugacguggacuguugguguaacgccaccgauaccuggguaaccuacgggaccugcagccaaaccggcgagcaucggcgcgauaagagguccguagcccuggcgccacacgugggccugggguuggaaacccguaccgaaaccuggaugucuuccgagggcgccuggcgacagauccaaaagguggagaccugggcacugcgucaucccggguucacggugaucgcccuauuccucgcgcacgcuauuggcacauccaucacccagaaggggaucaucuuuauccugcugaugcucgugacccccuccauggccaugaggugugucggcaucggcaaccgcgauuucguagagggguuaagcggcgcuacguggguagacgucgugcuugagcacgggucuugcgugaccaccauggccaaaaacaagccaacccucgacaucgaacugcuaaagacggaggucaccaaccccgcgguguuacgcaagcuguguaucgaggccaagauuagcaacaccaccacggauucgcgcuguccaacccagggagaggccaccuugguggaagaacaggacgccaauuucguaugccggcgcaccuuuguggaccggggcuggggcaacggcugcgggcucuuuggaaaggggucgcugcugacaugcgccaaguuuaagugugugaccaaguuagaggggaagaucguacaauacgagaaccugaaguacuccgugaucgugaccguccacacaggcgaucagcaccagguugggaacgaaacgacugaacacgguaccauagcgacuaucacgccccaggcgcccacgagcgagauccagcugaccgacuacggugcgcucacccuggauuguagcccccggaccggccuggacuucaaugagauggucuuacugacgaugaaggaaaaguccuggcucgugcacaagcagugguuccuggacuuaccuuugcccuggacguccggggcuagcaccagccaggagacauggaaccggcaggacuuacugguaacguucaagaccgcccacgccaagaagcaggaggucgugguacuuggcucgcaggagggcgccaugcacaccgcccucaccggggccaccgaaauccaaaccucuggcacaaccacgaucuuugcagggcaccugaagugccgccugaaaauggacaaacuuacccuaaagggagucuccuaugugauguguaccgggagcuucaaacuugagaaggagguggcggagacccagcacgggacaguccuuguccaggugaaguacgagggaacggacgcccccugcaaaaucccuuucuccacccaggaugagaagggagucacccagaacggccgccucaucaccgccaaucccaucgugaccgacaaggagaaacccgugaacauugagaccgagccgcccuucggugaguccuacaucgucauuggcgccggcgagaaagcgcugaaacuguccugguucaagaaggggaguuccaucggaaagauguucgaggccacggcccgcggggcacggcgcauggcgauacuuggcgacacagcgugggauuucgggaguauaggcggcguguucacauccguggguaagcugguucaccaaguguucgggacugcguacgggguucuguucagcggcgucuccuggacgaugaagaucgggaucggaauccuccugacuuggcugggccucaacagccggaacaccucccuguccaugacgugcaucgccgucgguauggugacccuguaccugggugucaugguacaggccgacacagggugcguaaucaacuggaagggccgagaguuaaagugcggguccggcaucuucgugaccaaugagguacauacauggacggagcaguacaaauuccaggcugacucgccaaagcggcucuccgcggccauaggcaaagccugggaggagggggugugcggcauccguagcgccacgaggcucgagaacauuauguggaagcagaucagcaacgagcugaaccacauccugcucgagaacgacaugaaguucacugugguaguaggggacgcaaacggcaucuuaacccaggggaaaaagaugauccgaccacagccgauggagcauaaguacuccuggaagucauggggcaaagcgaagaucaucggcgccgacacacagaauacgacguucaucaucgacgggccugacaccccggaaugccccgacgaccaacgcgccuggaauaucugggaggucgaagacuauggcuucgggauuuucacgaccaacauauggcugaagcucagggacucguacacccagaugugcgaucaucggcugaugagcgccgugaucaaggacuccaaggcggugcacgccgacaugggauacuggaucgagagcgagaagaacgagaccuggaagcuggcccgcgccuccuucaucgaggucaagacaugcaucuggccccgcagucacacccucugguccaacggcgugcuggagagcgagaugaucaucccuaagaucuacggcggccccaucagucagcacaacuaucggcccggcuacuucacgcagaccgccgggcccuggcacuuggggaagcucgagcuggacuucaaccugugcgagggcaccacugugguaguggacgaacacuguggcaaccgcgggccgagccucagaacaaccaccgugaccggcaagauaauccacgagugguguugccguuccugcacccugccgccccugcgguuccgcggggaggaugggugcugguacgggauggagauccggccugucaaggaagaggaggaaaaucucgugcgcucaauggugucugcgggcucgggcgaagucgauaguuucagccuggggcuguugugcguguccaucaugauagaggaggugaugaaaucccguuggagcaggaagaugcugaugacgggcaccuuggccgucuucuuccucuuaaucauggggcagcugaccuggaacgaccucauucgccuguguaucaugguuggcgcuaacguguccgaccgcauggggauggggacgacguauuuagcccucauggccacguuuaagaugcgcccgauguucgcggucgggcugcuguuccggcgacucacaagccgggagguucugcugcucacaaucgggcugucccuggucgccagcgccgagcuccccaacagucuggaggaacuuggcgacggucucgccaugggcaucaugaugcugaagcugcucgccgauuuccagagccaccagcuauggaccacccuguuaucccuuaccuucaucaagacgacccugucccucgacuacgcguggaagaccaucgcuaugauccuguccaucgugagucucuucccccucugccuguccacgacaagccagaagaccaccuggcuccccguucuccugggcucauucggcugcaagccgcugaccauguuccuuaucaccgagaacaagaucuggggccgcaaaucguggccccugaaugaagggaucauggccgucggcauaguguccauucugcucagcuccuuauuaaagaacgacgugccccucgccgguccccugaucgcuggcggaaugcugaucgccugcuacgucaucagcgggagcuccgccgauuuaucgcuagagcgggcugccgaggucuccugggaggaggaggcggagcacagcggcgccucacacaacauccuaguggaaguccaggacgacgggacgaugaagauaaaggacgaggagcgcgaugacacgcucaccauccugcuuaaagcuacccuccuagccauuucuggcguguacccaauguccauccccgccacgcuguucgugugguacuucuggcagaagaaaaagcagagguccgggguccuuugggacacccccagcccgcccgagguagagcgcgcggugcuggacgauggcaucuaccggauccugcagcgcggcuugcucgggcggagucaggucgggguggggguguuucaggacggggucuuccacaccauguggcacgugacccgcggggcugugcuuauguaccaggggaagcggcuggagccuuccugggccagcgucaagaaggaccucaucuccuauggcggcggguggagauuccaagggagcuggaacacgggcgaggagguucaggugauagccgucgagcccgggaagaaccccaagaacgugcagaccacccccggaaccuucaaaacuccagagggcgaggugggggccauugcgcuggauuucaagcccgguaccucugggucacccaucgucaaccgggaaggcaagaucguaggccuguacggugauggcgucgucaccacauccgggacguauguuagugccaucgcccaggcuaaggccagccaggaggguccgcucccggagauugaggacgagguguucaaaaagcgaaaccugaccaucauggaucuucacccuggguccgguaagacccggcgcuaccucccggcuaucgugcgggaggcgaucaagcgcaaacugcguaccuuaauacucgcacccacaagagugguagcuagcgagauggcggaggcccugaaaggaaugcccauccgguaccagaccacagccgucaaguccgagcacacugggcgggaaaucgucgaccugaugugucacgccacguucaccaugcggcuccugagccccguacgggucccgaauuacaacaugauuauuauggacgaggcccauuucaccgaccccgcgagcauagccgcccgaggcuacauaagcacucgggucgggaugggcgaggcagcagcgaucuucaugacggccacgccgcccggauccguggaggcuuucccgcagagcaacgccgucauccaggacgaggagcgcgacauccccgagcgguccuggaacagcggcuacgacuggauuaccgacuuccccggcaagaccgucugguucguccccuccaucaagagcgggaacgacaucgccaacugccugagaaagaacgguaagcggguuauccagcucagccguaagacauucgacaccgaguaccagaagacgaagaacaaugacugggauuacguuguaaccacggacaucagcgagaugggggccaacuuccgggccgaucgcgugaucgauccgcggcgcugccuggagcccgugauucuaaaggacggccccgaaagaguaaucuuagccgggcccaugccggucaccgcugcgagugccgcccaacgccggggcaggaucgggaggaaccaaaacaaggagggcgaccaguacaucuacaugggucagccccugaacaacgaugaagaucacgcccacuggaccgaggcaaagaugcugcucgacaacaucaacaccccugaagggaucauccccgcgcuguucgagccggagcgagagaaguccgcagccaucgacggcgaguacaggcuucgcggggaggcgcgcaaaacguuuguugaguugaugagacgcggcgaucugccagucuggcuguccuacaagguugcgagugagggcuuccaguacagcgaucggcgcuggugcuucgacggagagcggaauaaccaagugcucgaggagaauauggacgucgaaaucuggacgaaggagggcgagcgcaaaaagcugcggccccgcuggcucgacgcccgaaccuacagugaucccuuggcguugcgcgaguucaaggaguucgccgccgggcggcgcuccguuagcggagaucugaucuuagagaucgguaagcucccgcagcaccugacccucagggcccagaacgccuuggacaaccuaguuaugcugcacaauucggagcagggcggcaaagccuaccgccacgccauggaggaacugcccgacaccauugagacauuaaugcuccuagcccugaucgcgguacuuaccgggggcgugacccuguucuuucuuuccgggaagggccucggcaaaaccagcaucggguuacuaugcgugauggcuagcucaguccuccuguggauggccucgguggaaccgcacuggauugcggccagcaucauccuggaguucuuccugaugguguugcugauccccgagccggaucgccagagaacgccacaggacaaccaguuagcguacguagugauaggccugcuguucaugauccucaccguggccgccaacgagauggggcugcuggagacgaccaagcgggacuuaggaaucggucaugucguagccgaaaaccaccaccaugccacgaugcucgauaucgaccugcacccugcauccgcuuggacccucuacgccguggccaccaccaucauaacaccgaugaugcgccacaccauugagaacacuacagccaacauuagccuaaccgcgauagccaaccaggcagccauccugaugggccuugacaagggguggcccauauccaagauggacaucggggucccccugcuggcacucggcugcuacagccaggugaacccccugacccuuaccgcggcgguguugaugcuggucgcacacuacgcaauuaucgggcccggcuuacaggcgaaggcgacgcgcgaagcccagaagcgaacagccgcggggauaaugaagaaccccaccguggacggcauuguggccauagacuuagacccgguuguguaugacgccaaguucgagaagcaacugggccagauaauguuacugauccuaugcacgucccagauauuacucaugagaaccacgugggcccugugugagagcaucacccuggccacugguccccucaccacacugugggaggguucgccagggaaguucuggaauaccaccaucgccgugagcauggcgaacauauuccguggcucauaccuggccggagccgggcucgccuucucgcuaaugaaauccuugggagggggcagacgggggaccggagcccagggcgagacgcucggggagaaauggaagcgccagcugaaccagcugagcaaguccgaguucaacacuuauaagcggagcggcauuauggaaguggaucgcagcgaggcgaaggaggggcucaagagaggggaaacuaccaagcacgcggugucccgugggaccgugaagcugcgaugguucgucgagcggaaccuggugaagccugaaggcaagguuaucgaccugggcugcgggcggggcggguggagcuacuacugcgcaggccucaagaaggucaccgaagugaagggauauacaaaggguggccccgggcaugaggagcccauccccauggccaccuacggguggaacaucguaaagcugcauucugggaaggacgucuucuucacgccgcccgagaagugcgauacgcuucucugugacauuggagagagcucccccaacccgaccaucgaggaggggcgcacucugcgggugcugaaaauggucgagcccuggcuccgcggcaaucaguucuguaucaagauccugaaucccuacaugcccagcguaguggagacucuggagcagaugcagcguaagcacgguggcaugcucguccgcaacccgcugucccggaacagcacgcacgagauguacuggguuagcuguggcaccgggaauauuguuagugcggugaacaugacgucccgcaugcugcucaaucgcuuuacgauggcccaccggaagcccacguacgagcgcgauguggaccugggcgcuggcacucggcacguagcaguagagccugagaucgcuaaccuagacaucaucggccagcgcaucgagaacauaaagaacgagcauaagagcaccuggcacuaugacgaagacaaccccuacaagacaugggcguaccauggcuccuacgaggugaagcccucggggucagccagcuccauggugaacggcgugguacggcuucuaacgaagcccugggacgugauccccauggucacucagaucgcuaugaccgacaccacgcccuucgggcagcagagaguguuuaaggagaagguggauacccggaccccgcgucccaagagaggcaccgcccagauaauggagguaacugcgaaguggcuuuggggcuuccucagccguaacaaaaagccacggauaugcacccgagaggaguucacccggaaggugagaucuaacgcggccauaggggcgguguucgucgacgagaaccaguggaacuccgccaaagaggcgguggaggacgagcgguucugggacuugguacaccgcgagcgcgagcugcacaagcagggcaaaugcgcgaccugcguguacaacaugauggggaaacgggaaaagaagcucggcgaguucgggaaggccaagggcagccgggccaucugguacauguggcugggcgcacgcuuccuggaguucgaggcgcucgguuucaugaacgaggaccacugguucuccagggagaacagccuguccggcguggaaggggagggacuguacaagcucggguacauccugagggacaucucaaagaucccgggcgggaauauguacgccgacgacacggcugggugggauacccgcauuaccgaggacgacuugcagaacgaggccaagauaacggacaucauggagcccgagcacgcccuccuggcgacauccaucuucaaacugaccuaccagaacaaggugguccgggugcagcgcccggccaagagcggcaccgugauggaugucaucucccggcgggaccagcgggggucuggccaggucgguaccuaugggcucaauacguucaccaacauggagguccaguuaauccgccagauggagucggagggcaucuuuucgcccuccgagcuggagaacucuaaccucgccgagaggguccuggacuggcuggagaagcaugggguggagaggcucaaacgaauggccaucuccggcgacgacugcgucgucaaaccgaccgacgaccgcuucgccaccgcgcuaacggcccugaacgacauggggaaggugcgcaaggacauuccccaaugggaacccagcaagggauggaaugacuggcaacaggucccguucugcucccaucacuuccaccaacucaucaugaaggacggccgcgagaucguagugccgugccggaaucaagacgagcugguggggcgcgcccgggucucucaaggcgccggguggucucuaagagagaccgccugccucggcaaaagcuacgcacaaauguggcaacucauguacuuccaccgccgcgaccugcggcucgccgccaacgcaaucugcagcgccgugccaguuaacugggucccaacguccaggaccaccuggagcauucacgcgcaccaccaguggaugaccaccgaggacaugcuguccgucuggaacagggucuggaucgaggaaaaccccuggauggaggacaaaacccaugucagcuccugggaggacgucccuuaccuggguaagcgugaggaccaguggugcggcagccuuaucggccugaccgcccgugcuacgugggccacaaacauccagguggcgaucaaucagguccggcgccugaucgggaacgaaaacuauuccgacuacaugaccagcaugaagcgguucaagaacgaguccgacccggagggcgcccucugguga

SEQ ID NO: 23753 - RNA, 9879 nt, Artificial Sequence
  derived and/or modified CDS sequence (opt11) from DENV-1__KX380796__SS-prME
agcgugaccaugcugcucauguuguuacccaccgcguuagcauuccaccucaccacccgggguggggagccucacaugaucgugaguaagcaagaacgggguaagagccuccuguucaagacauccgcggggguaaacaugugcacccuuaucgccauggaccugggcgaguuaugcgaggacaccaugaccuacaagugcccccgcauaacggaagccgagcccgacgacguggacugcuggugcaaugccacugacacgugggugaccuaugggaccugcagccaaacuggugaacaucggcgcgacaagcgguccguggcacuggcgccccacguggggcuggggcucgaaacgcgcaccgagaccuggaugagcucagagggcgcauggcgccagaugcagaagguggagaccugggcccugcgccacccaggguucacgguuaucgcacuguuccuagcacacgcaaucggcaccagcaucacccagaaggggaucaucuucauccuacugaugcucgugacgccauccauggccaugcgcugcgucggcaucggcaaucgugauuucguggaggggcugagcggcgccacguggguggaugucgugcuggagcacggguccuguguaaccaccauggccaagaacaagcccacccucgacaucgagcuccugaagacagaggucaccaaccccgcgguacuccggaagcuguguaucgaggccaagaucagcaacaccaccacggacucacgcugcccgacucaaggggaggccacccuaguggaggagcaggacgcgaacuucgucugccggcgcaccuuuguggaucggggcugggggaacggcuguggccucuuuggcaaggggagucugcuuacgugcgccaaguucaagugugugaccaagcucgaaggcaaaaccguacaguacgagaaccugaaguacucgguuaucgugaccguccauacgggcgaucagcaccaggugggcaacgaaacaacggagcacgggaccaucgcaacuaucacaccccaggccccaaccagcgaaauccaguuaaccgacuauggggcccucacccuggacuguagcccccggacuggccuggacuucaacgagauggugcuccuuacaaugaaggagaagaguuggcuggugcacaagcagugguuucucgauuugccgcuaccguggacgucaggagcaagcacaucccaggagacguggaaccggcaggaucuccuugugacauucaagaccgcgcaugcaaagaagcaagagguggucguuuugggcucccaagagggcgcuaugcacacggcccucacgggcgccacggagauccagaccagcggcacaacuacgauuuucgccgggcaccuaaagugcaggcuuaagauggacaagcugaccuugaagggcgugucauacgucaugugcaccgggagcuuuaaguuggagaaagagguugcagaaacgcagcacggcaccguccugguccaggucaaguacgagggcaccgacgcccccugcaagauucccuucuccacucaggaugagaagggagugacgcagaacggacggcucauaaccgccaauccgaucgugaccgacaaagagaagcccgugaacaucgaaacggaaccgcccuucggcgagagcuacaucgucauaggcgccggggagaaggcacugaagcuguccugguucaaaaaggguagcucgaucgguaaaauguucgaagcaacugcgcgcggggcccggcgcauggccauacugggagauacagcgugggacuucgggagcauaggagggguuuucacgucuguggggaagcugguccaccaggucuucggcacggccuacggaguccuguucaauggagucucuuggacgaugaagauagguaucggcauccucuuaaccugguuaggcuugaacucccgauccacaucccugagcaugaccugcaucgccgugggcauggugacacuguaucugggcgucaugguucaggccgauaguggaugcgugaucaacuggaagggucgggagcugaagugcgggagcggcauauucgucacgaaugagguacauaccuggacagagcaauacaaguuccaggccgacagcccgaagcgacucagcgcggcgaucggcaaggccugggaggaggggguguguggcauccggagcgcaacccgcuuagaaaacauuauguggaaacaaaucuccaacgaacugaaccacauccugcucgagaacgacaugaaguucacggucguagugggagacgcuaacggcauccugacccaagggaagaagaugauccggccucagcccauggagcacaaguacagcuggaaguccugggggaaggcgaagaucauuggcgccgacacacagaacaccacguucaucaucgacgguccugacacccccgaaugccccgacgaucaacgcgcguggaacauaugggaagucgaggacuacggcuucgggguguucaccaccaacauauggcucaagcuccgggacagcuacacacagaugugugaccaccgacugauguccgcagcgauuaaggacagcaaggcaguccacgccgacaugggcuacuggaucgaguccgagaaaaacgagaccuggaaacuggccagagccagcuucauagaagucaaaaccugcaucuggccccgcucucacacccucuggucuaauggcgugcuagaguccgagaugaucauccccaaaaucuauggagguccaauuagccagcauaacuaccggccaggauacuucacacagaccgcgggcccguggcaucuggggaaacucgagcuugacuuugacuuaugcgaaggcacuaccgucguaguggaugagcauuguggcaaccguggaccgucccuccggaccacgaccgugaccggaaaaaucauccacgaguggugcugucgcagcugcacguuaccuccccugcgguuccgcggggaggauggcugcugguacgguauggagauaaggcccgucaaggagaaggaggagaaccuuguccgcucgaugguguccgcagggaguggcgaggucgacucauuuagucuggggcugcucugcguguccauaaugaucgaggagguaaugcggagccgcuggucccgcaagaugcugaugacagguacgcuggcugucuuuuuccuccugaucauggggcaguuaaccuggaacgauuuaauccggcucugcaucauggugggcgcgaaugugagcgaccgcauggggauggguacgaccuaccucgcccucauggcuaccuucaaaaugcggccgauguucgccgucgggcugcuguuccgccggcucaccucgcgcgaggugcugcugcucacgaucgggcucagccuggucgccucggucgagcuccccaacagucuggaggagcugggggacgggcucgccaugggcaucaugaugcugaaauugcucacagacuuucagccccaccagcuguggacaacacugcuuagucugacguucaucaaaaccacacugucacucgacuacgccuggaagaccauggcuauggugcuguccaucgugagccuguucccguuaugucuauccaccaccagccagaaaacaaccuggcugccagugcucuuagggagcuuuggguguaagccgcugaccauguucuugaucacagaaaauaagaucuggggacgcaagagcuggccccugaacgaaggcaucauggcugugggcaucgucucgaucuugcuuagcagccugcugaaaaaugacgugccucucgccgggccgcugaucgccggaggcaugcucauagcgugcuaugugaucucagguagcuccgccgacuugagccuggaacgcgccgcggagguguccugggaagaagaggcagagcacagcggcgcuagucacaacauauuaguggagguacaggacgacgggacaaugaagaucaaagacgaggaacgggacgacacacucaccauccugcugaaggcuacgcuccuggcagucagcggagucuacccuauguccaucccagccacccuuuucgugugguacuucuggcaaaagaagaagcagcgcagcgggguucucugggacaccccauccccaccagagguggagagggccguccuggacgauggcaucuaccgcauccuucagcggggccugcucggucggucgcaggucggcguggguguuuuccaagauggggucuuucauaccauguggcaugugacgagaggggcgguccugauguaccagggaaagcgccucgaacccuccugggccagcgucaagaaggaccucaucuccuacggcggggguuggcgguuccaggggucuuggaauaccggcgaggagguccaggugaucgccguagaaccagggaaaaacccuaagaacgugcagaccacccccggcaccuucaagacccccgaaggugaggugggggccaucgcccuggacuucaaaccaggcaccagugggagccccaucgucaaccgggagggcaagaucgucggucuguacgggaacggcguggucaccacgucugggaccuacgucagcgcgaucgcccaggccaaagccucccaggaggguccacuccccgagaucgaggacgagguguucaagaaacggaaucugaccaucauggaccugcacccggggagcgguaaaacccgccgguaccugcccgccaucguccgcgaggcgauuaaaaggaagcuccggacgcuaauccucgccccuacgcgcgucguggcaagcgagauggccgaggcgcugaagggcaugcccauccgcuaucaaacaaccgcugucaaauccgagcacacggggaaggaaaucguggaccugaugugccaugccaccuucaccaugcgccuccugucaccgguuagaguaccgaauuauaacaugaucaucauggacgaggcccacuucacggauccugccucuaucgccgcccggggcuacauuagcacgcgagucggaaugggcgaggccgccgccauauucaugaccgcgacgccgccaggguccguggaggccuuuccacagucuaacgcagucauccaggaugaggagcgcgacauaccggagcgguccuggaacaguggauacgacuggauuaccgacuucccuggcaagacgguuugguucgugcccuccauaaagagcgggaacgauaucgccaacugccugcgcaagaacggcaaaagggucauccaacucucccgaaagaccuuugacaccgaguaccagaaaaccaagaacaacgacugggacuauguggugacgaccgauaucagcgagaugggcgcgaacuuucgggcagaucgcgucauagauccacggcguugccuuaagccggugauccugaaggauggccccgagcggguuauacucgccgguccuaugcccgugaccgcugccuccgcggcccagcgaagaggacgcaucggacgcaaccaaaacaaggagggagaccaauacaucuacaugggccagccccugaacaaugacgaagaccacgcccauuggaccgaggccaagaugcugcucgacaauaucaacacgcccgaagggaucaucccagcucuguucgagccagagcgggagaaaucagcggccaucgacggcgaguaucgacugcguggggaggcgcgcaagacuuucguggagcucaugcgacgcggcgaucugcccgucuggcugagcuacaagguggccuccgagggcuuucaguacuccgaccgacgcuggugcuucgauggggagcggaacaaucaggugcucgaggagaauauggacgucgagaucuggacuaaggagggcgagcgcaaaaagcuccggccccgcuggcuggacgccagaaccuacucggacccauuggcgcugcgcgaguucaaagaguucgccgccggucggcgguccguauccggcgacuuaauccucgaaaucggcaaacugccccagcacuugacccuccgugcgcagaacgcccuggacaaccuggugaugcuccacaacagcgagcaaggagggaaggcguaccgccaugccauggaggagcucccggacacgaucgagacccugaugcucuuagcccugaucgccguccucacagguggcguuacucuguucuuccuguccgggaagggcuuggguaagacgaguaucgggcucuugugcgucauggcgaguagcgugcuccuguggauggccuccguggagccgcacuggauugcagcuucaaucauccuggaguuuuuccucauggugcugcugaucccugagcccgaccgccagcgcacgccucaggacaaccagcuugcauacgucgugaucggcuugcuauucaugauccugaccguggcggccaacgagaugggacugcuggagaccacuaagaaggaccucggcauagggcacgucguggcagagaaccaucaucacgccacuaugcuggacaucgaccugcauccggccuccgccuggacccucuacgccguggccaccacaaucauaacccccaugaugcggcacacaaucgaaaauaccacagcuaacauuagccugacagcaaucgcgaaucaggccgccaucuugaugggccucgacaaaggcuggcccauuucaaaaauggacaucgggguccccuugcuagcccucgggugcuauagucaaguuaacccgcugaccuugaccgccgcgguacuaaugcuagucgcccacuacgccaucauagggcccggucugcaggccaaggcgacccgagaggcccagaagcggaccgcagcugggaucaugaagaacccuaccguggacggcaucgucgccaucgaccuggaccccgucguguacgacgccaaguucgaaaagcagcugggccagaucaugcugcuaauacugugcacgucccaaauucugcucaugcguacgaccugggcucuuugcgaaucuaucacccuggccaccgggccacuaacgaccuuaugggaggggucccccgggcguuuuuggaacacaacuaucgcagugagcauggcgaauauauuccgcggcuccuacuuagcgggcgcgggacucgccuucagccugaugaagucacucggcgggggccgccggggaacgggugcccagggcgaaacccuaggugagaaguggaagcgucagcugaaccagcugucgaagucugaguuuaacaccuauaaaaggagcggcaucauggaggucgaccgcagcgaagccaaagagggccucaagcggggcgagacaaccaaacaugccgugucgagagggacggcuaaacugcggugguucguggagcguaaucucgucaagcccgagggcaaggugaucgaccucgguugcgggagaggcggguggagcuacuacugcgccggccugaagaaagugaccgaggugaaaggcuauacgaaaggcggccccgggcacgaggagccgauccccauggcaaccuacggcuggaauauagugaagcugcacuccgggcgcgacguguucuucacucccccagagaaaugcgauacccugcucugcgacaucggcgaaagcucgccaaaucccacgaucgaggaggggcgcacccugcguguccugaagaugguggagcccuggcucagaggcaaucaguucugcauuaagauccuuaaccccuacaugccguccguggucgaaacgcuugagcagaugcagcguaaacacgguggaaugcucgugcgaaacccccugucccgcaauagcacccacgagauguacuggguguccugcggcaccgguaauaucguaagugccguaaacaugacgucccguaugcugcugaacagguucacgauggcacaucguaaacccaccuacgagagggacguagaccugggcgcuggcacacgccacgucgccguggagcccgagaucgccaaccuggacaucauagggcagcgaaucgagaacaucaagaaugagcacaaaagcaccuggcauuacgacgaagacaauccguacaagaccugggcguaccacgggagcuacgaggugaagcccagcgggucugccagcucuauggucaacggcguggugcgccuccugaccaaacccugggacgugauccccauggugacccagaucgcaaugaccgacacgaccccguuugggcaacagcgugucuucaaggaaaagguggacacccgcacgccccgaccuaagcgcggcacggcacagaucauggaggugaccgccaaguggcuguggggguucuuaucaaggaacaaaaagccacgcaucugcacucgggaggaguuuacccgcaaaguccgguccaacgcggccauuggggcuguguucguugacgagaaccaguggaacagcgccaaggaggccgucgaggacgaacgauucugggaccuggugcacagagaacgcgagcugcacaagcagggcaaaugcgcgacgugcguuuacaacaugauggggaagcgggaaaagaagcucggugaguucgggaaggccaagggcagccgggccaucugguacauguggcugggcgcccgguuccuggaguucgaggcucucggguucaugaaugaggaccauugguucuccagagagaacagccugagcggcguggagggggagggccugcacaaauuaggguauaucuuacgcgacaucagcaagauccccgggggcaacauguacgcagacgacaccgcggguugggauacccggaucaccgaggacgaccugcagaacgaggccaagaucacagacauaauggagcccgaacacgcccuucuagcgacuuccauauucaagcugaccuaccagaacaagguggugcguguccagcggcccgccaagaguggcacggucauggaugugauaucccgccgggaucagagggggagugggcaagugggcacguacgggcucaacaccuuuaccaacauggagguucagcugauucggcagauggaauccgagggcauuuucucaccguccgagcuggagaacagcaaccucgccgagcgcgugcuggacuggcuggagaaacacggggucgagcggcucaaacggauggcaaucaguggcgacgacugcguggugaagccgacugaugaccgguucgccacggcgcugaccgcacuuaacgacauggggaagguccgcaaggauaucccacagugggagcccaguaaaggcuggaacgacuggcagcaagucccguucugcucccaccacuuccaccagcuaauaaugaaggacggcagggagauuguggugcccugccgcaaccaggacgagcugguggggcgggcccgggugucgcagggcgccggcuggagccugagggagaccgccugccuggggaaaagcuacgcccagauguggcagcucauguacuuucaucgccgggacuugcgccucgccgccaaugccauuugcagcgcuguacccguaaacugggugcccaccucccguaccacuugguccauccacgcccaccaccaguggaugacgaccgaggacaugcuguccgucuggaacaggguguggauugaggagaacccguggauggaggauaagacccacgugagcuccugggaggacguacccuaccuggggaagcgcgaggaccaguggugcggcagccucaucggccugacugcccgggccaccugggccaccaacauccaaguggcgauuaaccaggugcgccggcuaaucggaaaugagaacuaucucgauuacaugacuuccaugaagcgcuucaagaacgagagcgaccccgagggcgcccugugguga

SEQ ID NO: 23754 - RNA, 9879 nt, Artificial Sequence
  derived and/or modified CDS sequence (opt11) from DENV-1__KX380799__SS-prME
uccgugaccaugcuguugaugcugcugcccaccgcccucgccuuucaucuaaccacccggggcggggagccccauaugaucgugagcaagcaggagcgggguaagagccuuuuguucaaaaccuccgcgggggugaacaugugcacccugaucgccauggaccugggcgaacucugcgaggacacgaugacguacaagugucccagaaucacagaggcggaacccgacgacguggauugcuggugcaaugccacagacacauggguaaccuacgggaccugcagccaaaccggcgaacauagacgcgacaagcgguccguggcccuggcgccccacgugggccuggggcucgagacccgcaccgagacguggaugucgagcgaaggggccuggcggcagauccagaagguggagaccugggcgcuacgccaccccggguucacggucaucgcguuauucuuagcacacgccauuggcaccagcauaacccaaaaggggaucauuuucauccugcugaugcucguuacccccucaauggcgaugaggugcgucggcaucgguaaccgcgacuucguagaggggcugagcggcgcgacgugggucgacgucguacuggaacacggguccugcguuaccacuauggcaaagaacaagcccacccucgacaucgagcugcucaagacggaagugaccaaccccgcuguucuccggaaguugugcaucgaggcgaagaucucaaacaccaccacggacucccgcugccccacucagggcgaggccacccugguggaggaacaggacgcgaacuucgucugcagacgcaccuucguggaccgggguugggguaauggcugcggccuguucggcaaggggagccuacucacgugcgccaaguucaagugcguaaccaaacuugaaggcaagauaguucaauacgagaaccugaaguacuccgugaucgugacgguccacaccggcgaccagcaccaggucgggaacgagacgacagagcacgguaccauugcgaccaucacgccccaggcacccacaagcgagauacagcugaccgacuacggggcccucacccuugacugcagcccccgaaccggccuagacuuuaacgagaugguacuccucacuaugaaggagaaguccuggcugguucacaagcagugguuccucgaccugccgcugccuuggaccucgggggccagcaccagccaagagaccuggaaucggcaggaccuccuggugaccuucaagaccgcacacgcgaaaaagcaggaggucgugguacuaggcucccaggagggcgccaugcauacggcccuaaccggugccaccgaaauucaaaccuccggcaccaccacgauauucgcuggacacuuaaagugccgccugaagauggacaaguugacccugaaggggguuuccuacgucaugugcaccgguucguucaagcuugagaaggagguggcagaaacccagcauggcacuguccuggugcaaguaaaguacgagggcaccgacgcgcccuguaagauucccaucuccacccaggacgagaagggggucacucagaauggccggcucaucaccgccaacccgauagucaccgacaaggagaagcccgugaacaucgagaccgagccgcccuucggcgaaagcuauaucgucauaggggcuggcgagaaggcgcugaaacuguccugguuuaaaaaagggucgucuauaggaaaaauguucgaggccacggcccgcggggcacgacgcauggccaucuugggcgacacggcgugggauuucggguccaucgguggcguguucaccuccguggggaagcugguccaccagguguucggcaccgccuacggggugcucuucaguggcgucucauggacgaugaagauaggcaucggcauccugcuaacguggcuggggcucaacucccgcuccaccagccuguccaugaccugcaucgccgugggaauggugacccuguacuuaggcguaaugguacaggccgacagcgggugcgugaucaacuggaaaggcagggagcucaagugcggguccggcauuuucgucacgaacgaagugcacaccuggaccgagcaguacaaguuccaggccgacagcccgaaacgccugagcgcggcgauugggaaggcaugggaggagggcgugugcggcauccgguccgccaccagacuagagaacaucauguggaagcagaucagcaacgaacugaaccacauccuguuggagaacgacaugaaguucaccgucguggugggggacgccaacgggauccugacgcaggggaagaagaugauccggccccagcccauggaacacaaguacaguuggaaguccugggggaaggcaaaaaucaucggcgcggacacccaaaacaccaccuucaucaucgacgggcccgacacaccggagugccccgacgaccagcgcgccuggaacaucugggaggucgaggacuacggcuucggcguguuuacgaccaauauaugguuaaagcucagagacuccuacacccagaugugcgaccaccgacugaugagcgcagcgaucaaggacuccaaggcuguucaugcagauaugggcuacuggaucgagagcgagaagaaugagacauggaagcuggcccgcgccucuuucaucgagguuaagaccugcaucuggccccgaagccauacccucugguccaacggcguccuggagagcgagaugaucauucccaaaaucuacgggggaccgaucagucaacacaacuaccggcccggguauuucacccagacggcgggucccuggcaccuggguaagcuugagcucgacuucaaccugugugagggcaccaccguuguuguggacgagcauugcgggaaccgagggccgucgcuccguaccacgaccgugaccggcaagaucauccacgaguggugcugccgcagcugcacccugccgccccugcgguuccguggggaggauggcuguugguacgggauggagauccggcccgucaaggagaaggaggagaaucugguacguagcauggugagugccggcagcggggaagucgacagcuuuucccuggggcucuugugcgugucgauuaugaucgaggagguaaugcgguccagauggagccgcaagaugcugaugacggggacccuggccgucuucuuccuccugaucauggggcagcugaccuggaacgaccucauccggcugugcaucauggugggagcgaacguguccgaccgcauggggaugggcacaacguaucuggcccucauggcgaccuucaagaugcggccaauguucgccgucgggcugcuuuuccgccgacuaaccagccgcgaaguguuacugcucaccauaggacugucccuggucgccagcguggagcucccuaauagccuggaggagcugggcgacgggcucgcuaugggaaucaugaugcucaaacuccucacggauuuucagucgcaucagcuguggaccaccuugcuaucucugacuuucaucaaaacgacucugagucucgacuacgccuggaagaccauggcaaugguucuguccaucgucagccuguuuccccucugcuuguccaccacgagccagaaaacaaccuggcugcccgugcuccugggcucuuucggcugcaagccgcugaccauguucuugaucaccgagaauaagaucuggggccgcaagagcuggccccugaaugaggggauaauggccgucggcaucgucuccauccugcucaguagccuguuaaagaacgacgugccgcuugcggggcccuugaucgccggcgguaugcugauagcgugcuacgugaucucugggagcuccgccgaccugagccuggaacgcgcggcugaaguuagcugggaggaggaggcggagcacagcggcgcgucucacaacauccugguagagguccaggaugacgggacgaugaagaucaaggacgaggagcgggacgacaccuugaccauccugcugaaagccacccuguuggccgucagcggcguauacccgauguccauuccugccacauuauucgugugguauuuuuggcagaagaaaaagcagaggagugggguucucugggacacccccaguccgcccgagguggaacgggccgugcuggacgacggcaucuaccguauccugcagcgcggccugcucggucgcagccaagucggcguggguguguuccaggauggcguguuccacaccauguggcacgucacccgcggggcggugcugauguaccagggcaagcgccuagagcccuccugggccagcgucaagaaagaccucaucagcuacggcgggggcuggcgguuccaagguagcuggaauacgggcgaggagguccaagugaucgcagucgagccugguaaaaaccccaagaaugugcagaccacccccggcaccuucaagaccccugagggcgaagucggggccaucgcucuagacuuuaagcccggcaccuccgggagccccaucguaaaccgcgaagguaaaaucgugggccuauaugggaacggcguugugaccaccagcgggacguacgugagcgcgaucgcccaagccaaggcaagccaggagggcccgcuccccgagaucgaggaugagguauucaagaagcggaaccugaccaucauggaucugcaccccgggucaggcaagacccggcgguaccucccggccaucguucgcgaggcaaucaagcguaaacugcggacccugauccuugcccccacgcgugugguggccagcgagauggcggaggcacugaagggcaugcccauccguuaccagaccaccgccgucaagucagaacacaccgggaaggagaucguggauuugaugugucacgccacuuucaccaugcgccuucugucccccguccgugucccgaacuacaacaugaucaucauggaugaagcacacuucaccgaccccgccuccaucgcggcacggggauauauuagcacccgaguggggaugggcgaggccgcggccaucuuuaugacggcgacgccgccaggguccguggaggcuuucccucagagcaacgccgucauucaggacgaggagcgcgacauacccgagcgauccuggaacucaggcuacgacuggaucaccgacuuccccgguaagaccgugugguucgugcccuccaucaagucgggcaacgacauagcgaauugccuccgaaagaacggcaagcggguuauccagcucucccgcaagacguucgacacugaguaccagaagacgaagaacaacgacugggauuacguggugaccacggacauaagcgagaugggugcuaauuucagagcggaccgcgucaucgacccgcggaggugccugaagccggucauccugaaggacggccccgagcgcgucaucuuagccggucccaugccggugaccgccgccuccgcggcccagcgccggggccgcaucggccgcaaccagaacaaggagggggaccaguacaucuacaugggccagccccugaacaaugacgaggaccaugcccacuggaccgaagcaaaaaugcugcucgauaacaucaacaccccagaggggaucauacccgcccuguucgagccugagcgggagaagucugcggcaaucgauggcgaauaucgccugcggggcgaggcgcgcaagaccuuuguggagcucaugcgcaggggggaccugcccgucuggcuguccuacaaggucgccagcgagggcuuccaguacagugaccggagaugguguuucgacggugagagaaauaaccaggugcucgaggagaacauggacgucgagauauggaccaaagaaggcgagcgcaagaaacugcggccccguuggcuggaugcccggaccuacagcgacccccucgcucugcgugaauucaaggaguucgcagccgggcggagaagcguaucgggagaucucauccucgagauuggaaaacugccgcagcauuuaacccuccgggcccagaacgcccuggacaaucuggugaugcuccacaacucagagcagggcgggaaagcguaccgccaugcgauggaggagcugccagacaccaucgagacgcugaugcuucuagcauuaaucgcaguccucaccggaggagugacccuguucuuccuauccggcaaaggccucggcaagaccucaaucgggcuacuaugcgugauggcuuccagcguacuccucuggauggcauccguggagccucacuggaucgccgcuagcaucauccuggaauuuuuccucauggugcugcugauccccgagcccgaccggcagcgcacgccccaggauaaccagcuugccuauguuguaaucggccugcuguucaugauccucaccguggcggccaacgagaugggucugcuggagaccaccaagaaggauuugggcaucggucacgucguggccgagaaucaccaccacgccacaauguuagauauugaccugcaccccgcuuccgcguggacccucuacgccguugccacaaccauaaucacgccgaugaugcggcacaccaucgagaauaccacugcuaacauaagcuugacggccauagcgaaccaggccgccauccugaugggccucgacaaaggcuggccgaucuccaaaauggacauagggguuccucuucuggcccucgggugcuacucacagguaaacccucugacacuuaccgcagcugugcucaugcuggucgcccacuacgccaucaucgggccgggacuccaagccaaggcaacccgcgaagcacagaagcggacggcugccgggaucaugaagaaccccaccguggacggcaucguggccauugaccucgaccccgucguguacgaugcgaaguucgaaaagcagcugggccagaucaugcugcucauccugugcaccucgcagauccugcucaugcgaaccacgugggcccuaugcgaaucgaucaccuuggccaccgggccccucacaacgcugugggagggcucgccggggagguucuggaacacuaccaucgccgugucuauggccaacaucuuccgggguucguaccuggcgggugccggguuggccuucagccugaugaagucccuggggggaggccgccgggggaccggcgcacaaggcgagacucucggggagaaguggaaaagacagcugaaccagcuuagcaagagcgaguucaacacauacaagcgcuccggcaucauggaggucgaccgcagcgaggccaaggaggggcucaagagaggagaaaccaccaagcacgcggugucccgcggcacggccaagcuacggugguucguggagcgcaaccuggucaaaccggaaggcaaagugaucgaccugggcugcggucggggcgguuggagcuacuacugcgccggccuuaaaaaggugaccgaggucaagggauacacaaagggcggccccgggcaugaagagcccaucccaauggcgaccuacggcuggaacaucgugaaacugcacuccgggcgcgauguauucuucacgccgcccgaaaaaugugacacucugcucugcgauaucggcgagucaucccccaacccgacaaucgaggaggggcggacccugcgcguccugaaaaugguggaacccuggcucagaggcaaucaguucugcaucaagauccugaaccccuacaugccuagcguggucgagacccuggagcagaugcaacgcaaacauggcgguaugcuagugcgaaacccgcugucccgcaacagcacgcacgaaauguacugggugucgugcggcacagggaacaucgucagcgcggugaacaugacuagucgcaugcuguuaaaccgguucaccauggcccaccgaaagccgacguacgagcgggacguggacuuaggcgccgggacucgccacgucgccguggagcccgagaucgccaaccucgacaucauagggcagcgaaucgagaacaucaagaacgaacauaagucuaccuggcacuacgacgaggacaaucccuacaaaacuugggcguaccacggguccuacgaggugaagcccagcggaucagccagcuccauggucaacggcgugguccgccuccugacgaagcccugggacguaauaccuauggugacccagaucgccaugaccgacaccacgcccuuugggcaacaacgggucuucaaggagaagguggacacccgcaccccgcggccgaaacgcgggaccgcccagaucauggaagugacugcgaaguggcuguggggcuucuuaagccguaacaagaagccgcgcauaugcacccgugaggaguucacccgcaagguccgcagcaacgcggcuaucggagcgguguucguggacgaaaaccaauggaauuccgcaaaggaggccgucgaggacgagcgcuucugggacuuggugcaccgggagcgcgagcugcacaagcagggcaagugcgcgaccugcgucuacaacaugauggggaagcgggaaaagaaacucggcgaguucggcaaggccaagggcagccgagccaucugguacaugugguugggcgcccgauuccuggaguuugaggcgcugggguucaugaacgaggaccacugguucucccgcgaaaauucgcugaguggcgucgaaggggaaggccugcacaagcuuggguauauccugagagacaucagcaagauuccgggcggcaauauguaugccgacgacaccgccgggugggacacccggaucaccgaggacgaccugcagaacgaggcaaagauuaccgacaucauggagcccgaacacgcccuucuggccaccuccaucuuuaaacugacuuaccagaacaaggugguucgcguucagcggccggcgaagagcggcaccgugauggacgugaucucccgccgggaccaacgcgggagcggucagguugggaccuacgggcucaauacguucacgaacauggaagugcaguugauacggcaaauggaauccgagggcaucuucucucccuccgagcuggagaacagcaaccucgccgagcgcgugcuggacuggcuggagaagcauggcguggagcggcuaaaacgcauggcaaucuccggcgaugauugcguggugaagcccacggacgacagguucgccaccgcgcugaccgcccugaacgacauggggaagguccgcaaggauaucccccagugggagcccucuaagggcuggaacgauuggcagcagguccccuucugcucccaccacuuccaucagcuuauuaugaaggacggccgggagaucguagugccuugccggaaccaagaugagcucgugggucgagcacgcguuagccagggcgccggguggagucugagagagacugccugccucggcaaguccuacgcgcaaauguggcaacugauguauuuucaccgccgggaucugcgcuuagccgccaacgccauaugcagcgccgugccggucaauuggguccccaccagccgcacgacguggaguauacacgcgcaccaccaguggaugaccacugaggacaugcuguccgucuggaacagaguauggaucgaggaaaaccccuggauggaggauaagacccacgugagcuccugggaggacgucccguacuuagggaagcgcgaggaccaguggugcggcagccucaucggccugacagcccgggccacgugggcuaccaacauacaagucgcgaucaaccaaguccgccggcuuaucggcaacgagaacuaucucgacuacaugaccuccaugaagcgcuucaaaaacgagagcgaccccgaaggcgcccugugguag

SEQ ID NO: 23755 - RNA, 9879 nt, Artificial Sequence
  derived and/or modified CDS sequence (opt11) from DENV-1__KX380800__SS-prME
agugugaccaugcuucucaugcugcugcccacggcccucgcauuucaucugacaacccggggcggggagccgcacaugauagugagcaagcaggagcggggcaagagccuucuguuuaagacguccgcgggggugaauaugugcacccucaucgccauggaccugggugagcucugcgaagacaccaugacguauaaguguccccgcauuacagaggccgaaccugaugacguggacugcuggugcaacgccacggacacuuggguuaccuacgggaccuguagccagaccggugagcaccggcgcgacaagagguccguggcacuggcgccacacgugggccuggggcucgagacccgcaccgagaccuggauguccucagagggagccuggcggcaaauccagaaggucgaaaccugggcccuaaggcaccccggguucaccgucauugccuuauuucuagcgcacgccauaggcaccagcauuacccagaagggaauuaucuucauccuccugaugcuugugacucccuccauggccaugcggugcgucgguaucggcaaucgcgacuucgucgagggguuaagcggcgcaacguggguagacguuguccuggagcacggguccuguguaaccacaauggccaagaacaagcccacacuugacaucgagcugcugaagacagaagucaccaaccccgcggugcugaggaagcucugcaucgaagcuaagaucagcaauaccaccacggacucccgcugccccacccagggcgaagccacccucguggaggagcaggacgccaauuuugucugucggcguacuuucgucgaccggggcuggggcaacgggugcggguuguucggcaaggggaguuuauuaacuugcgcuaaauucaagugcgugaccaagcuugagggcaaaaucguucaguacgagaaccugaaauacuccgugaucgucaccguacacaccggggaccagcaccagguggggaaugaaacuacagagcacggcacuaucgcgaccaucacgccucaggcccccacaagcgagauccagcugaccgauuacggggcacucacccuggacugcucaccgcggaccggccucgacuucaacgagaugguccuccuuacgaugaaagagaaauccuggcugguacauaagcagugguuccucgaccugccccugcccuggacuuccggggccaguaccagccaggagacguggaaccgacaagaucugcucguuacguucaagacugcccacgcuaagaaacaagaggucguggugcuuggcucacaggagggugccaugcacacagcucuaacgggcgccacggagauccaaaccagcggcaccaccacaaucuucgccgggcaccuaaagugccggcugaagauggacaaauugacccugaagggcgucuccuacguuaugugcaccgguagcuucaagcuggaaaaggagguggccgagacucagcacgggacaguacugguucaaguuaaauacgagggcacggacgcucccugcaaaauucccaucuccacccaggaugaaaaaggugucacucagaacggccggcucaucacggcgaauccgauagugacagacaaagaaaagcccgugaacaucgagaccgagccgcccuucggggagagcuacauugucaucggcgccggcgaaaaggcgcugaagcuguccugguucaaaaaggggagcuccaucggcaagauguucgaggccacggccaggggggcccggcgcauggcuauccugggcgacacggcgugggauuucgggagcaucgguggcguguuuaccaguguagggaagcugguucaccagguguuuggcaccgcuuacggggugcuguucucggguguaagcuggaccaugaagaucgggauaggcauccuccugacguggcugggccucaacucgcgcaguaccuccuuaagcaugaccugcaucgccguggguauggugacccucuaccucggggucauggugcaggcggacucgggcugcgugauuaauuggaaaggccgggaacugaagugcgggucgggcaucuucguuacaaacgagguacauaccuggacugagcaguacaaguuccaggccgauucaccgaagcgccugucagcggccaucgggaaggccugggaggaaggagugugugguauucgguccgcuacccgccuggagaacaucauguggaagcagaucagcaacgaguugaaccauauccugcucgaaaacgacaugaaguuuaccgucguggucggggacgcgaacgggauccugacccagggaaagaagaugauccguccccaacccauggaacacaaauacuccuggaagucauggggcaaggcgaaaaucauaggcgccgauacacagaacaccaccuucaucaucgacgggcccgacacuccggagugucccgacgaccagcgcgccuggaacauaugggaagucgaggacuauggguucggaguauuuaccaccaacaucuggcugaaauuacgggauuccuacacccagaugugugaccaccggcugaugagcgcagcgaucaaagacucaaaggccguucaugccgacaugggcuauuggaucgagagcgagaagaacgaaacauggaagcuggcccgggccuccuucaucgaggucaaaacaugcaucuggccucggagccacacccucuggagcaacggcgugcuggagagugaaaugaucauccccaagaucuaugggggacccauuucccagcacaacuaccggccuggguauuucacucagacggcgggaccauggcaucuggggaaacucgagcuagacuucaaccuuugcgagggcacuaccguggucguggaugagcauuguggcaaucgcgguccgagccuccggaccaccacagugaccggcaagaucauccacgaguggugcugccgcucgugcacccuuccgccccugcgauuccgcggggaggacggcugcugguacggcauggagauuagacccgugaaggagaaagaggagaaccuagugcgcucaaugguguccgccgggucgggcgagguugacagcuucucccuggggcuucucugcgugucuaucaugaucgaggaggucaugcggucucgcuggucucggaagaugcugaugacuggcacccucgccaucuucuuccuccugaucaugggacagcugacauggaacgaccucauuagacuaugcaucaugguuggcgccaauguguccgaccgcauggguaugggaaccacauaccuggcacucauggcgaccuucaagaugcgccccauguucgcugugggguugcuguuucgccggcuaaccucgagagaaguccugcuucucacgauagguuuaucccuaguugccucuguagaacugcccaacucccuggaggaacugggcgacgguuuggccaugggcauaaugaugcugaagcugcugacggacuuccagagccaccagcuguggaccacccuucucagcuugaccuucaucaagacaacccugagccucgacuacgccuggaagaccauggcgaugguacugaguaucgugagccuguucccgcugugccuguccacaaccagucagaaaaccacauggcugcccguccuccugggcucuuucgggugcaaaccgcuaaccauguuccucaucaccgagaacaagauaugggggcgcaagagcuggccucugaacgaggggaucauggcuguuggcauuguguccauacuguugucuucucuccugaaaaacgacgucccccucgcgggaccccugaucgccgggggcaugcugaucgcgugcuacgugauuucggggagcuccgcggaccucagccuggagcgagcggccgaaguguccugggaggaggaggccgagcacagcggcgcgucccacaauaucuuggucgaggugcaggaugacgggacgaugaaaauuaaggacgaggaacgagacgacacguugaccauccuauuaaaggccacgcucuuagcugucagcggggucuacccgauguccauccccgccacgcuguucgugugguacuucuggcagaagaaaaaacagcgcucggggguacucugggacacuccgagcccgcccgaggucgagcgggccgugcuggacgauggcaucuaccggauccugcaacggggccugcucgggcgaucacaagugggcgucggagucuuccaggauggcguguuucacaccauguggcacgucacccgcggggccguacuaauguaccaggggaagcgccuggagccauccugggccucuguuaaaaaggaccucaucucguauggugggggcuggcguuuccagggaaguuggaacacuggcgaggagguccaggugaucgccguggagcccgggaagaaccccaagaacguucagaccacgcccggcaccuuuaagacacccgagggcgaggugggggccaucgccuuagacuucaaaccagggaccucugggagccccaucgucaaccgcgaaggaaagauaguaggccucuacggaaacgguguugugacgaccaguggaacguacguuagugcgauugcgcaggccaaggcaagccaggagggcccgcugcccgaaaucgaggacgagguguucaagaagcggaaccugaccaucauggaccuacacccgggguccggcaagacccgucgguaucugccggccaucguccgcgaggcgaucaaacguaaguuacgaacccuaauucucgccccgacucgcgucguagccuccgagauggccgaagcguuaaagggaaugcccaucagauaccaaacuaccgccgugaaguccgagcauacagggaaggagaucguggaccugaugugccacgcuaccuucaccaugcgccuccugagucccgugcgggugccgaacuacaacaugauaauaauggacgaggcgcacuucacagauccagccuccauagcggcccgcggcuacauuagcacccggguugggaugggcgaggccgccgccaucuucaugacggcgacgccgccaggguccguggaggcguucccacagagcaacgcuguaauccaagacgaggagcgcgacauuccugagcgguccuggaacagcggcuacgacuggauuaccgacuucccugggaaaaccgucugguucguacccucaaucaagagcggcaacgacaucgccaacugccugcgcaagaacggcaaacggguuauacagcuuucccgaaagacguuugacacggaauaccagaagaccaagaauaaugacugggacuaugucgugaccacggauaucagcgagaugggugccaacuuccgggcggaccgcgugauugacccgcggcgcugucugaagccagucauccucaaggacggaccggagcggguuaucuuagcagggcccaugccggugaccgccgcgucagcggcccagcgccggggccgcauagggcgcaaccagaacaaggagggugaccaguacaucuacaugggccagcccuuaaacaacgacgaagaccacgcccacuggacagaggcuaagaugcugcucgacaauauuaauacacccgaggggauuauccccgcgcuguucgagccggagcgggagaaguccgcggccaucgacggcgaguaccgcuugcgcggggaagcccgcaaaacguucguggagcugaugcguaggggcgaucugccaguguggcugucauauaagguugccagcgagggcuuucaauauuccgaccgccgcuggugcuucgauggggagcggaacaaccaaguguuagaggagaauauggacguagagauauggaccaaagagggagagcgcaaaaagcuacggccccgcuggcuggacgcccgcacguauagcgacccacucgcgcuacgcgaguucaaggaauuugccgccgggcgacgcuccgugucaggcgaucuaauccucgaaaucggaaagcugccucagcaccucacacucagagcccagaacgcgcuugacaaccuggugaugcuccacaacucggagcagggcgggaaggcguaccgacacgcuauggaagagcuccccgacaccaucgaaacacugaugcuccuggcgcugaucgccguguuaaccgggggcguaacacuguuuuuccugucaggaaagggcuugggcaaaaccagcauuggccuucuguguguuauggcgaguagcguucuccuguggauggcguccguggagccacacuggauagccgcgagcaucauccuggaguucuuccucauggugcuguugaucccagaaccggaucggcagagaacgccccaggacaaccagcucgccuacguggucaucggccuguuauucaugauacucacuguugcagcuaacgagaugggacuucuggagacgaccaagaaagaccucggcaucggucacguagucgccgagaaccaccaccacgccacgaugcuggacaucgaucuacacccagccuccgcguggacccuauacgcaguagccacaaccaucaucacgccuaugaugcgacauaccauugagaauaccacugccaacaucucgcucacggccaucgcaaaucaagccgcuauccugaugggcuuggacaaaggauggcccauauccaaaauggacaucggggugccccuguuagcccucggcugcuacagccaggucaacccccugacccugaccgcagcggugcuuaugcuggucgcccacuacgccaucauagggccggggcugcaggccaaggccacacgcgaggcccagaaaaggacggccgcggggauaaugaagaauccaaccgucgacggcaucguggcuauagaccucgacccggugguguaugacgcgaaauuugagaagcagcugggccaaaucaugcugcucauccugugcaccucccagauccugcucaugcggaccacgugggcccugugcgagagcauaacgcuggccacugguccccucaccacgcugugggagggcuccccggguaaguucuggaacaccaccauugcagugucaauggcaaacauauuccguggcucauaccuggccggggccgggcucgccuuuagucugaugaaaucccugggcgggggccggcgaggaacaggcgcccagggagaaacuuugggagaaaaguggaaacgucagcugaaccagcugaguaagagcgaguuuaacacuuauaagcgcuccggcauaauggagguagaccggagugaggcgaaggaggggcucaagcgcggcgagaccaccaagcaugcggucucccggggcacugccaagcugcgcugguucgucgagcggaaccugguuaagcccgagggcaaagucaucgaccugggcugcgggcgcggcggguggagcuacuacugcgccggccucaagaaaguaaccgaggugaagggguauaccaaggggggccccgggcacgaagagccgauaccgauggccaccuacggcuggaacaucgucaagcugcacuccgggcgggacguuuucuucacgccgccggaaaagugugacacgcugcucugcgauauuggcgaaaguucccccaauccgacaauugaggaagggcgcacccugagggugcugaagaugguugaaccguggcuccgcggaaaccaguucugcauaaagauccugaacccuuacaugcccucagugguggagacgcuggagcagaugcaacggaaacacggcgguaugcugguccguaacccgcugucgcggaacucgacgcacgagauguacugggugagcugcggcaccggcaauaucgugucagcgguaaacaugaccagucgcauguuacucaacagguucacuauggcccaccggaagcccacauacgagcgcgacguggaccucggagccggcacccggcacguggccgucgagccggaaaucgccaaccuggauaucaucggccagcguaucgagaacaucaagaacgagcacaaaucgacauggcauuacgaugaggacaaccccuacaagaccugggcguaccacgggucguaugaggucaaaccgagcggauccgccagcaguaugguaaacggcgucguccgguuacuaacgaagcccugggauguaaucccgauggugacucagaucgccaugacugacacaacgcccuucggccagcaacgcguguucaaggagaaaguugacaccagaacgccgagacccaagcggggcaccgcucagauaauggaggugacggccaaguggcuguggggcuuccuaagcaggaacaaaaagccccggaucugcacccgcgaggaauuuacccggaagguacgcagcaacgcugccaucggagcuguguucguggacgagaaccaguggaacuccgccaaagaggcugucgaggacgaaagguucugggaccugguccaccgcgagcgggagcuucacaagcagggcaagugcgcgaccugcguguacaacaugauggggaagcgggagaagaagcucggcgaauucgggaaggccaagggcagccgggccauuugguacauguggcugggcgcccgcuuccucgaauucgaggcgcucggguucaugaaugaagaccacugguucucgcgcgaaaauagccuaaguggcguggagggugagggccugcacaaguuagguuacauccuccgggacaucuccaagaucccgggcgguaacauguacgccgacgacacggccggaugggacacccgcaucaccgaggaugaccugcaaaacgaggcaaagaucaccgacaucauggagccugagcacgcccugcuggcgacguccaucuucaaacuuaccuaccagaacaagguugugcgggugcagcgccccgccaagagcggcaccgucauggacgucaucucccggagggaccaacggggaagcggacaggugggcaccuauggguugaacacuuucacaaauauggagguccagcugauccgacagauggaaucggaaggcauuuucuccccaucagagcuggagaacagcaaccuggccgagcgggugcuggacuggcuugaaaaacacggaguugagcgccucaagaggauggccaucuccggggacgacugugucgugaaaccgaccgaugaccgcuucgccacugcucugacggcccugaacgauaugggaaaagugcggaaagacauaccccaaugggaacccagcaagggcuggaaugauuggcagcaggucccuuucugcucccaccacuuccaccagcucauuaugaaggacggucgcgaaauaguggugcccugccggaaccaagaugaacuugucggucgcgccagggugagccagggugccggguggagccugcgcgaaacggccugccuuggcaaauccuaugcacagauguggcagcugauguacuuccaccgaagagaccugaggcucgccgccaacgcaauaugcagcgcagugcccguuaacugggucccuaccucccgaacgacauggagcauccacgcgcaucaccaguggaugacuaccgaggacaugcuguccguguggaacagagucuggaucgaggagaaccccuggauggaggacaaaacccacguuagcucgugggaagacgugcccuaccuggguaagcgggaggaccaauggugcggcagccucaucgggcugaccgcaagggccacgugggccaccaacauccaggucgcuaucaaccaggugcggcgacuaaucgggaacgaaaauuacuuggacuacaugaccuccaugaagcgauucaagaacgagagcgaccccgaaggggcucugugguga

SEQ ID NO: 23756 - RNA, 9879 nt, Artificial Sequence
  derived and/or modified CDS sequence (opt11) from DENV-1__KX380802__SS-prME
ucuguaaccaugcuacucaugcucuuacccacggcucucgccuuccaccugaccacccgcggcggggaaccccacaugaucgugucuaagcaggagcggggcaagagccugcuguucaagaccuccgcgggggugaacaugugcacccugaucgcaauggaccugggggagcucugcgaggacacaaugaccuauaaguguccccgaaucacggaggccgaacccgaugacguggacugcugguguaacgccaccgacaccugggugacuuaugggaccuguagccagacuggcgagcaccgucgcgacaaaaggucuguggcccuggcaccccaugugggccuaggucucgaaacccgcacagaaaccuggaugucguccgagggcgcguggcggcagauacagaagguggagaccugggcacugcggcacccgggguucacagucaucgcccucuuucuagcgcacgccaucggcaccagcaucacccagaaggggaucauuuucauccugcucaugcucgugacccccuccauggccaugcgguguguuggcauaggcaaucgcgacuucguagaagggcugucuggcgcuaccuggguggacgucguacuggagcacggguccugcguuaccaccauggccaagaacaagcccacgcuugacauugagcuucugaagacggaggucacuaacccggcggugcuccggaagcugugcaucgaagccaaaaucaguaacaccaccacagacuccagaugccccacccagggcgaggcaaccuugguugaggagcaggacgcgaacuucgucugcagacgcaccuucgucgaccggggcugggggaacggcugcggauuauucgggaaggggagccugcugacgugcgccaaguucaagugcgugaccaaacuugagggcaagaucguucaguacgagaaccugaaauacuccgugaucgugaccguccacaccggcgaccagcaccaggugggcaaugagacgaccgaacacggcaccaucgcgaccaucacgccccaagcgcccacgagcgaaauccagcuaaccgacuacggggcccucacccucgacugcaguccccggacuggccucgacuucaacgagaugguccuacugacgaugaaggagaaguccuggcuggugcauaaacagugguuccucgaccugccgcuacccuggacuuccggugccagcaccagccaggaaacauggaaccgucaggaccuccuggugacauucaagaccgcgcacgcgaaaaagcaagaggucgucguucuggguucccaggagggugcuaugcacaccgcccucaccggggccacugagauacagaccaguggcacuaccacgaucuucgcagggcauuuaaagugccgcuugaagaugggcaagcucacccugaagggggucuccuacgugaugugcaccggcucguuuaagcuggagaaggagguggcggaaacucagcacggcacgguacugguccaaguuaaguacgaagggacugacgcccccugcaagauuccgauauccacucaggacgagaagggagucacccagaacgggcggcucaucacggccaacccgauugugaccgacaaggaaaagccgguaaacaucgagaccgagccacccuuuggcgagagcuauaucgucaucggcgccggugagaaggcuuugaagcuguccugguuuaagaaaggaagcuccaucgggaagauguucgaggccaccgcucgcggcgcccggcgcauggccauucucggggacaccgcgugggacuucggcagcaucggagggguguucaccuccguaggcaaguuagugcaccaaguguuugguaccgccuauggcgugcuguucagcggcguuuccuggaccaugaagaucggcaucggcauccuccugaccuggcuuggguugaacagccgcuccacuagccugucaaugaccugcaucgcggugggcauggugacacuguaccucggggucauggugcaggccgauagcggaugugucauuaacuggaaggggcgagagcucaaaugcggcuccggcaucuuugucacgaacgaggugcacaccuggacugagcaguacaaguuccaggccgacagcccgaagcgccucuccgcggcuaucgggaaggcuugggaggagggcgugugcgggauccgguccgcaacccgucucgagaacaucauguggaagcaaaucagcaaugaguuaaaccacaucuugcucgagaacgacaugaaauucacggucguggucggcgacgcuaacgguauucugacccaaggcaagaagaugauucguccccaaccuauggagcacaaguacuccuggaaguccuggggcaaggcgaagaucaucggggccgacacccagaacacgaccuucaucauagacggcccggacacgcccgaaugucccgaugaccagcgggccuggaacaucugggaagucgaggacuacggguucggcguguuuaccaccaacaucuggcugaagcugcgggacuccuacacccagaugugcgaccaccgccuuaugagcgcggcgaucaaggacucuaaggccguucacgcagacaugggauacuggaucgagagcgagaagaacgaaacguggaaacucgccagagccagcuucauagaagucaagaccugcaucuggccccgcucgcacaccuugugguccaacgggguacuggagagcgaaaugauuauccccaagaucuauggcggaccgaucucccagcacaauuaccggcccggcuacuucacccagacggcggggcccuggcaccuagggaagcucgagcuggacuucaaccugugcgagggcaccacuguggucgucgacgagcacuguggcaaccgcggcccgucccucagaaccacgaccgugaccgguaagaucauccacgaguggugcugccgcuccuguacucugccgccauuacgguucaggggagaggacggauguugguauggcauggagauccggcccguaaaggagaaggaggaaaaccucgugcgcuccaugguguccgccggcucgggggaggucgacagcuucucccugggacugcugugcgugucaaucaugaucgaggaggugaugagaagucguuggagccgcaaaaugcugaugacgggcacccuggccguuuucuuccuccugauaauggggcaacugaccuggaacgaccucauucggcuguguaucauggugggggccaacguguccgaucgcaugggcaugggaaccaccuaccuggcucucauggcgaccuuuaagaugcggccgauguucgcggucggucuacuguuccgccggcucaccagccgcgaggugcugcugcucaccauuggccugucccuagucgccagcguggagcucccgaacuccuuggaggagcugggcgacggccucgccaugggcauuaugaugcuuaagcugcucacugacuuccaaagccaccaacuguggaccaccuuacuaagccugaccuucaucaaaacgaccuugucucucgacuacgcguggaagacuauggccaugguucuguccauagucagccuguucccccuuugcuuauccacaacgucccagaagaccaccuggcugcccguccuccugggguccuucggcugcaagccgcugacgauguucuugauuacggagaauaagaucugggggcgcaagagcuggccccugaacgagggcaucauggcuguagggaucguaaguauccuguugagcucacugcugaaaaacgaugucccgcucgccgguccacucaucgccgguggaaugcugaucgcgugcuacgugaucagcggaucuuccgcagaccucagccuggagcgcgccgccgaggucaguugggaggaggaggccgagcacucaggggcuucccacaacauccugguagaggugcaggacgacgguacaaugaagauuaaagacgaggagcgggacgacaccuuaacgauccugcugaaggccacccuccuggcaguuagcggaguguacccgauguccauccccgccacucuguucgugugguacuuuuggcagaagaagaaacagagaagcgggguccucugggauacccccaguccgcccgaggucgagcgggccguauuagaugacggcaucuaccgcauccugcagcgggggcugcucggcagaagccaggucgggguaggcguguuccaagacggggucuuccacaccauguggcacgugaccaggggcgcagugcugauguaccagggcaagcggcuggaacccuccugggcgagcgucaagaaagaccucaucucguaugggggcggguggcgguuccaggggagcuggaacacgggcgaggagguucaggugaucgccguggagcccggcaagaaccccaaaaacgugcagaccacuccuggcacguucaagacgccugagggugaggucggagcaaucgcccuggacuucaagcccgggaccucuggcagccccaucgucaaccgcgaggggaagaucguaggauuauacggcaacgggguuguuaccacaucuggaacguaugucagcgcgaucgcccaggccaaagccagccaggagggcccguugcccgagaucgaggacgaggucuuuaaaaagcggaaccugaccaucauggaccugcacccuggguccggcaaaacccgccgauacuuaccugcaauuguccgcgaggcgaucaaacgcaagcugaggacccugauccucgccccgacgcgcgugguggccagcgagauggccgaggcguuaaaaggaaugccaauccguuaccagaccaccgccgucaaauccgagcacaccggcaaggagaucguugacuuaaugugccacgccacguucaccaugcgccuacugucaccagugcggguuccgaacuacaacaugaucauuauggacgaggcacacuuuacugaucccgccuccaucgcggcccggggguacaucagcacccgcguaggcaugggggaggccgccgccaucuucaugacggccacgccgcccggcuccguggaggcuuuuccgcagagcaacgccgucauccaggaugaggagcgggacauucccgagcgguccuggaacagcggcuacgacuggaucacagacuucccagggaagaccgugugguucguucccuccauuaagucuggcaacgacaucgccaacugccugcggaagaacgguaaacgggugauccagcucagccgcaagacguuugacaccgaguaucagaaaaccaagaacaaugacugggacuacgugguaaccacggauauuagcgagaugggcgccaacuuccgggccgaccgcgucaucgacccgagacgcugccugaagcccgugauccuuaaggacgggcccgaacggguuauucuagccggcccaaugccggugaccgcggccagcgcggcccaacgcagaggcagaaucgggcgcaaccaaaauaaagaaggcgaucaguacaucuacaugggacaaccccugaacaaugacgaggaccaugcccacuggaccgaggcuaaaaugcugcucgacaacaucaauacccccgagggaauaauucccgcgcuuuucgaacccgagcgggagaaguccgccgccaucgacggggaguaccgccuacggggcgaggcgagaaagacuuucguggagcucaugaggcgcggcgaccuccccgucuggcuuuccuacaagguggcaagcgagggguuccaguacuccgaccggcgcuggugcuucgacggugagcggaacaaucagguguuagaggagaacauggacgucgagauuuggaccaaggagggggagcgcaagaagcugcggccccgcuggcuggaugcccggaccuacagcgacccccucgcgcugcgcgaauuuaaggaguucgcggcaggccggcguucugugagcggcgaccugauauuggagaucgggaagcugccucagcaucuuacccuccgagcucagaacgcccuggacaaccuggugaugcuccacaacagcgagcaaggagggaaggcguacagacacgcuauggaggagcugcccgacaccaucgagacucugaugcuccuugcccugaucgccguccucaccgguggggugacccuguucuucuuaucgggcaagggacucgggaaaacuagcaucggucugcugugugugauggcguccagcguccuccucuggauggccuccguggagccccauuggauagccgcgagcaucauccuggaguucuuucucauggugcugcuaauccccgaaccggaccggcagagaacgccucaagacaaccagcuugcuuacgucgugauugggcuccuguucaugauucucacuguugcagccaacgagaugggccuguuagaaacaaccaaaaaggaccucgggaucggucacgucguggccgagaaucaccaccaugcuacgaugcuggacaucgaucuccaccccgccucagcauggacgcucuaugccguggccacuacaaucauuaccccgaugaugcggcacaccaucgagaacaccacggccaacaucagccugacggcaauagcgaaucaggccgcaaucuugaugggucucgacaaaggauggccaaucuccaagauggacaucggcguaccccugcuggcccucgggugcuacagccaggugaacccccugacucugaccgcagcaguacuaauguuaguagcccacuaugccaucauuggccccgggcugcaggccaaggcgacucgcgaggcgcagaaacgaacggccgccggcauuaugaagaaccccaccguggacgguauaguugccaucgaccuugaccccguaguauacgacgcuaaguuugagaagcagcuggggcagauaaugcugcucauacugugcaccucccaaauccugcucaugcggaccaccugggcccucugcgaaucuaucacccuggccaccggcccccucaccacgcuuugggagggguccccgggcaaguucuggaauaccaccaucgccgucagcauggccaacaucuuccggggcucuuaucuggcgggggccggcuuggccuuuagccugaugaagucccucgggggcggccgacgcggcaccggcgcccagggugagacgcucggcgagaaguggaagcggcaacugaaccagcugagcaagagcgaguucaacacuuauaagcgcucugggaucauggagguggaccggagcgaggccaaggagggccuuaagcgcggggagacaacgaagcacgcggugucccggggcacagccaagcugcgcugguucguggagagaaaccugguuaagccggagggcaaggugaucgaccuagggugcggcagagggggcuggaguuacuacugcgccggguuaaagaaggugacggaagucaaggguuacacgaaaggcggacccggccacgaggaacccaucccgauggccaccuauggguggaacauagugaaacugcacucggggagagacguguucuucacgccgcccgagaagugcgacacgcugcucugcgacaucggugaguccucccccaacccgaccauagaggagggcaggacccugcggguacuuaagaugguggagcccugguugagaggcaaccaguucugcaucaagauacugaaccccuacaugcccagcgugguagaaacccuggagcagaugcagaggaagcacgggggcaugcucgugcgcaacccgcucagucggaacagcacgcacgaaauguacuggguauccugcggaaccggcaauauagucagcgcgguaaacaugaccucccgaaugcugcucaaccgauucaccauggcucaccggaagcccacguacgagagagauguggaccuuggcgccgggacccggcacgucgccguggagcccgagaucgccaaucuggauaucaucggccagcgcaucgaaaacaucaagaacgagcauaagucaaccuggcauuacgacgaagacaaccccuacaagaccugggcuuaccacggguccuacgaggugaagccgucaggcuccgccagcuccauggucaacggggucguccggcuccugacgaagcccugggacgugauacccauggugacccagaucgcuaugacugacaccacgcccuucggccaacagcgcguauucaaggagaaggucgacacccggaccccgagacccaagagaggaacagcccaaauaauggaggucacggccaaguggcuguggggguuccucagccguaacaaaaagcccaggaucugcacccgcgaggaauuuacccggaagguacgcagcaacgcggccaucggcgccguguucguggacgagaaccaguggaacagugccaaagaggccgucgaggacgaacgcuucugggaccuggugcaccgcgagcgggagcugcacaagcagggaaaaugcgcuaccugcguguacaacaugaugggcaaacgagagaagaagcucggagaguucggcaaggccaagggcagcagagccaucugguacauguggcugggggcccgcuuucuggaguucgaagcgcuaggcuucaugaacgaggaccacugguucucucgggagaacagccucuccggugucgagggcgaggggcugcacaagcucggcuacaucuuacgagauaucagcaagauaccgggcggcaauauguacgcugacgacacggccggcugggacacccguaucaccgaggacgaccuacagaacgaagccaaaauaacugacauaauggagcccgagcacgcccuccuggcgacauccaucuuuaagcugaccuaccagaacaaggugguacggguccagaggcccgccaaaagugggacugucauggaugugaucucccggcgcgaccaacggggcagcggacaagucggaaccuacggccucaauacguucaccaacauggaggugcagcugauucgccagauggaguccgaagggauuuucucucccuccgagcuggagaacagcaaccucgcugagcgggugcuggacugguuggagaagcauggcgucgaaaggcucaagaggauggcuaucagcggggaugacugcguugucaagccaaccgacgaucgcuucgcgaccgcgcugaccgcccugaaugauaugggcaagguccggaaggacauaccccaaugggagcccagcaaaggcuggaacgauuggcagcagguacccuuuugcucccaccacuuccaccagcucaucaugaaggacgggcgcgagauaguggucccgugccggaaccaggacgagcuagugggacgcgcccgcgugagucagggggcgggcuggagccugcgcgagacggccugccucgggaaauccuacgcucagauguggcaguugauguacuuccacagacgcgaccugcggcucgccgccaacgccaucugcagcgccguacccgugaacugggugccgaccucgcgcacgacguggaguauucacgcucaucaucaguggaugacgaccgaagauaugcugagcgucuggaaccgcguguggauugaggagaacccauggauggaggacaagacccaugugagcuccugggaggacgucccuuaccugggaaaacgggaggaucaguggugcggcagccugauugggcugaccgcgcgcgccacgugggccaccaacauccagguggcgaucaaccagguacggcgccugaucggcaacgaaaacuaucucgauuacaugaccuccaugaagagauucaagaaugagagcgaccccgaaggggcccugugguga

SEQ ID NO: 23757 - RNA, 9879 nt, Artificial Sequence
  derived and/or modified CDS sequence (opt11) from DENV-1__KX380797__SS-prME
agcgugacgguucugcucaugcugcugcccaccgcccuugccuuucaccugacuacccgcggcggcgagccccacaugaucgugagcaagcaggagagaggcaagucucugcuguucaagacuuccaccggggugaacaugugcacucugauugcgauggaccugggugaguuaugcgaagacaccaugaccuacaaaugcccccggaucaccgagaccgagcccgacgacgucgacugcugguguaaugccacugagacaugggugaccuaugggacuugcagccagaccggcgagcaucggcgcgacaaacgguccguggccuuagcgccccacguuggccuggggcucgagacccgcaccgagaccuggaugagcuccgaaggcgcguggagacagauccagaagguggagaccugggcccugcgccaucccggcuucaccgugaucgcacuguuccuagcccacgccauaggcaccagcaucacacagaaagggaucaucuuuauacugcuuaugcucguuacccccuccauggcgaugcggugcgugggcaucggaaaccgcgacuucguggaggggcugagcggggcaaccugggucgauguggugcuggagcacggguccugcgugacgacgauggccaaggacaagccgacccucgacaucgagcugcugaagacugaggugaccaaccccgccgugcugcggaagcugugcaucgaggcgaagaucagcaacacgaccaccgauucgcgcugccccacccagggagaggcgacgcuggucgaggaacaagauaccaacuucgugugcagacgcacccucguggaucggggcugggggaauggaugugggcuguucggcaaggggagccugaucacgugugccaaguucaagugcgugacgaaacucgagggcaagauagugcaguacgagaaccugaaguauagugugaucgucaccgugcacaccggcgaccaacaccaggucggaaacgagaccaccgagcacggcacgaccgccaccauaacuccccaggcccccacguccgagauacagcugaccgacuacggagcccucacccuggauugcagcccccggaccggccuggacuucaaugaaauggugcuccugacgaugaaggagaaguccuggcuggugcacaagcagugguuccucgaccugccacugcccuggaccucgggggcgagcaccagccaggagaccuggaaccgucaggaucugcuggucacguucaagaccgcccacgcgaagaagcaggaggugguuguccugggcucccaggagggagccaugcacaccgccuugaccggggcgacggagauccagaccagcggcaccaccacgaucuuugcggggcaucuaaaaugccgucugaagauggacaaacucacccugaagggcguguccuacgucaugugcaccgggagcuucaagcuggagaaagaggucgcugagacccaacauggcacggugcugguucaggugaaguacgagggcaccgacgcccccugcaagaucccuuucacgucccaagacgaaaaaggggugacacagaacggucgucucaucacggccaacccgaucgucaccgacaaggagaagcccgucaacaucgaggcggaaccgccguucggggagagcuaccugguggugggcgccggcgagaaggcccuuaagcucuccugguucaagaaggggucauccaucggcaagauguucgaggccaccgcgcgcggggcccggcgcauggccauucugggcgacaccgccugggauuucgggagcaucggcggcguauucaccuccguggggaagcugauccaccagaucuucggcaccgccuacggggugcucuuuagcggcgucaguuggaccaugaaaauugggaucgguauccuguugaccuggcucggauuaaacucaagguccacgagccuguccaugacgugcaucgcggugggcauggugacccucuaccugggugucauggugcaggccgacagcgggugugugaucaacuggaagggacgggagcugaagugcggguccgggaucuuugugaccaacgaaguacacacuuggacggaacaguacaaguuucaggcugacaguccgaagagacucagcgccgccaucggaaaggcgugggaggagggagugugcggcauccgguccgccacccgauuggagaacaucauguggaagcagaucagcaacgagcuaaaucacauccugcuggagaaugauaugaaauuuacagucgugguuggggacgucaauggcauacuggcgcaggggaagaaaaugauccggccccagcccauggaacauaaguacuccuggaaguccuggggcaaggcgaaggugaucggugccgacgugcagaacaguaccuucaucaucgacgggcccaacaccccggagugccccgaugaccagcgcgcguggaacauuugggaagucgaggacuacggcuucgggaucuucaccacgaacauuuggcucaaguugcgggauagcuacacccaggugugcgaccaccgccugaugagugccgccauaaaagacagcaaagcagugcacgcugacaugggcuacuggaucgagucggagaagaacgagacguggaaguugaccagggccagcuucaucgaagugaaaaccuguguguggccaaagucccacacccuguggagcaauggggugcuggagucugagaugaucauccccaagaucuauggggguccgaucagccagcacaauuaucgacccgguuauuucacgcagacggccggucccuggcaccuagggaagcuggagcuggacuucggccuuugugagggcacaaccguggugguggacgagcacugcgggaaccggggcccgucacugcgcacgaccaccgugaccgggaagaucauccacgaguggugcugcagaagcugcacguuaccgccccucagauucaagggcgaggacgggugcugguacggcauggagauccggcccgugaaggaaaaggaggaaaaccuugugaaguccauggucagcgcugggagcggugagguggacaguuucagccugggccuccucugcaucuccaucaugaucgaggaggugaugcgcagccgguggagccgaaagaugcuuaugaccggcacccucgccgucuuccuguugcucauaaugggccagcugaccuggaaugaccugauccggcucugcaucauggugggagcuaacgccagcgacaagaugggcauggguacaaccuaccuggcccuaauggccaccuuucgcaugcgccccauguucgcagucgggcuccuguuucgacgccuaaccuccagagaggugcuccugagaucugugggccucucucucguugcgagcguggagcugccgaacucgcuggaggaacucggggacggacuggccaugggcaucaugaugcugaagcuccugacggacuuccagagccaccagcucugggccgcacuauuaucccugaccuucgugaagacaaccuucagccuccacuacgccuggaagacaauggccaugauccuuuccaucgucagccuguucccccucugccucuccaccaccucccagaaaacgacguggcugcccgugcuccugggguccuugggaugcaagccgcucaccauguuccugaucaccgagaauaagaucugggggcgcaagucauggccccugaacgaaggcaucauggcuguggggaucgucaguauccuccuguccagccugcucaagaacgacgugccccucgccggcccccugaucgccggcgggaugcucaucgcgugcuacguuaucucuggaagcucugccgaucugagcuuggagaaggcugccgagguauccugggaggaggaggccgagcacucuggagcgucucacaacauccucguggaggugcaggacgacgggaccaugaagaucaaggaugaggagcgcgacgacacccugacgauccugcucaaggccaccuuacuagcgaucagcggcguuuacccgaugaguauccccgccacccucuucguaugguacuucuggcagaagaagaaacagcggagcggcguacugugggacacccccuccccgcccgaggucgagcgcgccguccuggaugacgguaucuaccggaucuuacagcgagggcuccugggcaagagucagguagguguagguguguuccaagaagguguguuccacacgauguggcaugucacccggggcgccgugcucauguaccagggcaagcgccucgagcccuccugggcuuccguaaagaaggaccucaucuccuacgggggcggguggcgguuccagggcagcuggaacaccggggaagaaguccaggugaucgccguggagcccggcaagaaccccaagaacguccagaccgcccccggcacuuucaagacccccgagggggaggugggggccaucgcgcuugacuucaagcccggaacauccggaagcccaaucgugaaccgcgagggcaaaaucgugggccucuacggcaacggggucgugacuacgagcggcaccuacguaucggccaucgcccaggcuaaggccagccaagaggggccgcugcccgagaucgaagacgagguguuccguaagcgcaaccugaccaucauggaccuccaccccggcuccggcaagacccgccgcuaucugccggccaucgugagagaggccaucaaacggaagcugcggacacucguccuggcacccacccgcgugguggcaagcgagauggcggaggcccugaagggcaugcccauucgguaccagaccaccgccgucaaguccgagcacacgggcaaggagaucguggaccucaugugccacgccaccuucaccaugcggcugcugagccccguucgcgucccgaauuauaacaugauaaucauggaugaggcccacuucaccgacccugcuuccaucgccgcccggggguacaucagcacccgcguaggcaugggggaggccgccgccaucuucaugaccgccacgccgcccggguccauggaggccuucccgcaaaguaacgccgccauccaggaugaggagcgggacauccccgagagaagcuggaacagcggcuacgacuggaucaccgacuuuccugggaagacaguuugguucguuccaucgaucaagagcggcaacgacauagcgaauugcuugcggaagaacgggaagcgcguggugcaguugucccggaagaccuucgacaccgaguaccagaaaacgaagaacaacgacugggauuacgucgugacgacugacaucucugagaugggcgccaacuuucgcgcugaccgagugaucgacccgcgccggugccugaaacccgugaucuugaaggacgggcccgagcgcgugauccuggccggcccuaugccggucaccguggcguccgcggcccagcggcgcggccguaucgggaggaaccagaacaaggagggcgaccaguacaucuacaugggccaaccccugaacaacgacgaggaccaugcccacuggacggaggcuaagaugcuccuugacaauaucaacacgcccgagggcauaauccccgcgcuguuugagccggaacgugagaagagcgccgcgauagauggcgaguaccgccuccgcggcgaagcccggaagaccuucguggaacugaugcgccggggcgaccugcccguauggcuguccuacaagguggccagcgagggguuccaguacagcgaccgacgguggugcuucgacggugagcgcaacaaccaggugcuggaggagaauauggacgucgagaucuggaccaaagagggggagcggaagaagcugcgccccaggugguuggacgcaagaaccuacuccgacccccuggcccugagggaauuuaaggaguuugcggccggccgccggagcguuuccggcgaccucauacuggagaucgggaaacugccucagcaucucacacagcgcgcucagaacgcgcuggauaaccugguuaugcuccacaacuccgagcagggcgggaaggccuaccggcaugccauggaagagcuccccgacacgaucgagacccuuaugcugcuagcccugaucgcgguccucaccggcggagugacguuguucuuccucucaggccgcggccucggaaagacguccaucggccugcugugcguaauggccucgagcgcccuccucuggauggccuccgucgagccccacuggaucgccgcgagcaucauccuggaguucuuccucauggugcuguugauccccgaaccugaccggcagcgcacgccucaggacaaccagcucgccuacguagucauaggacuguuguucaugauacucacuguggccgcgaacgagaugggccugcuggagaccacgaagaaagaccucgggauaggccauguggccgcggagucccaccaucacgcggcuaugcuggacguggaccugcacccggccucagccuggaccuuguacgccguggccaccaccaucauaacgccgaugaugcggcacaccaucgaaaacaccacugcgaacaucagccugacggccaucgccaaccaggcagccauccugaugggucucgacaagggguggccgaucagcaagauggauaucgggguuccccugcuggcccucggguguuauucccaggucaacccccugacccugaccgccgcagugcucaugcuggucgcccacuacgcaaucaucgggccgggucugcaggcgaaggcgacccgcgaggcgcagaagcggacggccgccggcaucaugaagaacccuaccgucgacgggaucgucgccaucgaccucgaccccgugguuuacgacgccaaguucgagaagcagcuagggcagaucaugcuguuaauccugugcacgagccagauccugcucaugcgcaccacgugggcgcugugcgagaguaucacccuggccaccggcccccucaccacgcugugggaaggcagcccgggcaaguuuuggaacacuaccaucgcggugucaauggccaacauauuccgcggcagcuaccuggccggagcgggccucgcuuuuagccuaaugaagagccucgggggcggacggagggggacuggcgcccagggggagacgcucggugagaaauggaaaaggcagcugaaccagcugaccaaaucugaguucaacacauauaagcgguccgggaucaucgaaguggaccggagcgaggccaaggaaggccuaaagcgcggggaaaccaccaagcaugcggucuccaggggaaccgccaagcugcgaugguucguggagcggaaccuggugaagcccgagggcaagguaaucgaccuggggugcggccgcgggggguggagcuacuacugcgccggucuaaagaaggugaccgaggugaagggguacaccaagggcgggcccgggcacgaggagccuauccccauggccacguacggguggaaccucgucaagcuguacuccggcaaggauguguucuucacgccgcccgagaagugcgacacccuccugugcgacauaggggaguccucccccaacccgaccauugaggagggccgaacccuacgcgugcuaaagauggucgagcccuggcugaggggcaaccaguucugcaucaaggugcugaacccuuacaugccgagcguggucgaaacgcucgagcagaugcaacgcaagcacgggggaaugcuggugcggaauccacugucccgcaauaguacccacgagauguacuggguguccugcgguaccggaaacaucgucagcgcggugaauaugacaucccggaugcuccugaaccgcuucacgauggcgcaccggaagcccaccuacgaacgcgauguggaccugggcgccgggacccgucacgucgccguugagccagaggucgccaaccuggacaucaucggccaacggauugaaaacaucaagaacgagcacaagucgacguggcacuacgaugaggauaaccccuacaagacgugggccuaccacggguccuacgaggugaagccgucugggagugcgagcagcauggugaacggggucgugcgccugcugaccaagcccugggacgugaucccgauggugacccagauugccaugaccgacaccacccccuucggccagcagcguguauucaaggagaaggucgacacccgcacuccgaaggccaaacggggcacggcccagaucauggaggucaccgcccgcuggcucuggggguuuuuaucccguaacaagaaaccgcgaaucugcacccgggaggaauucacccgcaaagugcguucuaacgcggccaucggcgccguguucgucgaugagaaccaauggaacucugccaaagaggcgguggaggacgagcgcuucugggaucuugugcaccgggagcgggagcuccacaagcaggggaaaugcgccaccugugucuacaacaugaugggcaagcgggagaagaagcugggggaguucggcaaggccaagggcagccgcgcaaucugguacauguggcugggggcucguuuccucgaguuugaggcgcugggauucaugaacgaggaccacugguucucacgcgagaacagccuguccggggucgagggggaagggcuccacaaguugggcuacauacuaagagacaucagcaaaauccccggcgggaacauguacgccgacgacaccgccggcugggacacccgcaucaccgaggacgaccuccagaacgaggccaagauuacggacaucauggagccggagcacgcccugcuggcgaccuccaucuucaaacucaccuaucagaauaaagugguccgcgugcaacgcccagccaagaacgggaccgugauggacguuauaagccgccgggaccagcgcggcuccggccagguggggacguacggccugaacaccuucacgaacauggaggcccagcuuauccggcagauggagucagaggggauauuccuucccuccgagcuggagaccccgaaccuggccgagcgggugcuggacuggcuggaaaaguacggcauugagcggcugaaacgaauggcaauaagcggggacgacugcgucgugaagccgguggacgaccgguucgccacggcccucacggccuugaacgacaugggcaagguccggaaggauaucccccagugggaacccagcaagggcuggaacgacuggcagcagguccccuucugcagccaccacuuccaccagcugauuaugaaggacggacgggagaucguggugccaugucgcaaccaagacgagcucgucggccgggcccgcguuucccagggugccggcuggagccugcgugaaacugcgugccugggcaagagcuaugcccaaauguggcagcugauguacuuucauaggcgggaccugcgucucgccgcaaacgcgaucugcuccgccguuccuguggacuggguucccaccagcagaacgaccugguccauccaugcccaccaucaguggaugaccaccgaggacaugcucucagucuggaaccgcguguggauagaggagaaccccuggauggaggacaagacucacguuuccagcugggaagacgucccguaccugggcaaacgugaggaccaguggugcggaucccucauugggcugacggcccgcgccaccugggcgaccaacauccagguggccaucaaccaaguucgccggcugaucggcaacgagaacuacuuagacuacaugaccagcaugaagcgcuucaagaacgaguccgaccccgagggggcccucugguag

SEQ ID NO: 23758 - RNA, 9879 nt, Artificial Sequence
  derived and/or modified CDS sequence (opt11) from DENV-1__KX380805__SS-prME
agcgugacgaugcuucugaugcuacuacccacagcgcuggcguuccaccucaccacccggggaggggaaccgcacaugaucgucagcaagcaagaacgagguaagucgcuacucuucaaaacguccgcagggguaaacauguguacacucaucgcaauggacuugggcgagcuaugugaagauacaaugaccuauaagugcccccgaauaaccgaagcggagcccgacgaugucgauugcugguguaacgcaaccgacacguggguaacauacggcacgugcagucaaacaggagaacacagacgagauaagcgaagcguggcacucgcaccgcaugucggacuaggacuagaaaccagaacggaaacguggaugucauccgaaggggcauggcgacagauccaaaaagucgagacgugggcgcuacgccacccuggcuucacuguaauagcccuauuucuugcgcacgcgaucggcaccagcauuacgcaaaaaggaaucaucuucauacucuugaugcucgugacccccagcauggccaugaggugcgugggcauaggcaaccgagauuucguugaagggcuaucgggcgcaacauggguagaugucgucuuggagcauggcucgugugugaccaccauggcuaagaacaagcccacucuugacauagaauuacucaaaacggagguuacgaaucccgcgguacuacgaaagcuuugcauagaagccaaaaucaguaacacgaccaccgacucacguugcccaacacagggagaagcaacauuaguagaggagcaagacgcgaacuucgugugcagacggacguucgucgaucgaggaugggggaauggaugcgggcuuuucggaaaaggcagucuucuaacaugcgccaaguucaagugugucacgaaacuagaaggaaaaaucguucaauacgagaacuugaaauacucagugauuguaacagugcauacgggggaccaacaccaagucggcaaugagacgacagaacacggcacaauagccacaauaacaccacaagccccgacaucggagauucaacugacggauuacggggcuuugacucucgacugcagcccaaggaccgggcuagauuuuaaugaaaugguguuacuaacaaugaaagagaaaagcuggcuugugcacaagcaaugguuccucgaccuaccacuuccuuggacaucgggcgcgucaacaagucaagagaccuggaaucgacaggaucuucucguaacauuuaaaaccgcccacgcgaaaaagcaagaggucguuguccucggcagccaggagggugcgaugcacacagcacuaacgggugcaacggagauacaaacaagcggaacgacaacaaucuucgccggccaccucaagugccgccucaaaauggacaaacuaacccuuaaaggaguaagcuacguaaugugcaccggaucguucaaacuagaaaaagaggucgccgaaacacaacauggcaccguccucguacaggugaaguacgaaggaaccgaugcgccgugcaaaauucccaucucgacacaagacgaaaaaggcgucacgcaaaacggaaggcugauaacggccaacccaaucgugacggauaaggaaaaaccuguaaacaucgagacagaaccgccauucggggagucauacaucgugauaggggcaggugaaaaggccuuaaaauuauccugguucaaaaaggguucgagcaucgggaagauguucgaggcaaccgcccggggggcgcgacguauggcaauccuuggagacacggcgugggacuucggcucgauugggggugucuucaccucgguuggcaaacucgugcaccaggucuucggcacagcauacggcguccucuucucggggguauccuggacaaugaagauaggaauaggcauucuccucacauggcucggacuuaacucucggucuacaagcuuaucgaugacuugcauagccguagggauggugacauuauaccucgggguaauggugcaagcagacuccggauguguaaucaacuggaaggggagagagcuaaagugcggguccgggauauuuguaacaaaugaaguacauacauggacagaacaguacaaguuccaggcagacagcccaaaacgacuguccgcugcaauaggcaaagcuugggaggagggggucugcggcauaagaagugcgacucgccuggagaauaucauguggaaacagauaagcaacgagcuaaaccacauacuucuugaaaaugacaugaaguuuacugucgucguaggcgacgcuaacggcauucugacgcagggcaaaaaaaugauucgaccucaaccuauggaacauaaauacucguggaagagcuggggcaaagcgaaaauaauaggcgcagauacccaaaacacaacguucauaaucgacggaccagacaccccggaaugccccgacgaccagcgggccuggaacaucugggaaguagaggacuauggauucggcguauuuacaaccaacauauggcuuaagcuucgggacagcuacacacaaaugugcgaucacagacuuauguccgcagcaaucaaggauucgaaagcaguccacgcagacaugggcuacuggauagaaucggaaaagaacgaaacauggaaguuagcccgcgccuccuucaucgaggugaaaaccugcauauggcccagaucccacacucuguggucaaauggaguccucgagucagaaaugauaaucccaaaaauuuacggcggcccgauaagccagcacaauuacaggccuggcuacuucacccaaaccgcuggcccauggcaccuaggcaagcucgagcuagacuucaaccuaugugaagggacgaccguggucguugaugagcacugcggaaaccgaggaccaucgcuaagaacaaccacggucaccgggaaaaucauacaugaaugguguugccgcagcugcacccuaccaccccuacgcuuucggggcgaagacggcugcugguauggcauggaaauacgaccagucaaagaaaaggaagaaaaccuaguacgcucgauggucucagcugguuccggagaggucgauuccuucucacucggccuacuaucuguguccaucaugaucgaagagguaaugagaagcagguggagucgaaaaaugcucaugacgggaaccuuagcgguuuucuucuuacuuaucauggggcaacucaccuggaaugaccuaauaaggcuguguauaaugguaggcgcuaaugugucggaccgaauggguaugggaacaaccuaccuugcgcuaauggcgacguucaaaaugaggccaauguuugccgugggccuauuauucagacggcugacgucucgagaagugcugcuacucaccauagggcuaucauuggucgcuaguguugaacucccaaauucacucgaagaauuaggagauggccuagccauggguauaaugaugcuaaaguuacuuaccgacuuucaaagccaccagcuauggacgacccuucuaagccugaccuuuauuaaaacaacacuaagccucgacuacgccuggaagacaauggcgauggugcucagcauuguaucacucuuucccuugugucucuccaccacaucgcagaaaacaacuuggcuccccguccuacugggguccuucgggugcaagccccucaccauguuucucauaaccgagaacaaaaucuggggacgcaagaguuggccgcuaaacgagggcauaauggcagucggcauugucucaauauugcugagcagcuuguuaaagaacgauguaccccucgcaggaccguugaucgccggaggaauguugaucgcauguuaugucauaaguggaaguagcgccgaccuaagccuagaacgcgcugccgaggucucgugggaggaagaagcagaacacucaggggcgucccauaacauacucguggaaguacaggaugacggaaccaugaagauaaaggacgaagaacgggacgacacucugacaauacuacugaaagccacacuguuagccgugagcgguguauaccccaugagcauaccugcuacccuuuuugucugguauuuuuggcaaaaaaagaagcaacguaguggcguacugugggacaccccauccccgccagaagucgaacgcgccguuuuagacgauggaauauauagaauacugcagagagggcuucuuggacgaagccaaguuggcgucgguguauuccaagacggaguguuccacacuauguggcacgucacacgaggugcgguacucauguaccaggggaaacggcucgaacccagcugggccagcgugaaaaaggaucuaauuaguuacgguggaggauggcgcuuccagggaagcuggaacacgggugaagaagugcaagugauagcaguagagcccggaaaaaaccccaagaacguucagacaaccccagggacauucaagacaccugaaggagagguaggagcaauugcuuuagacuucaagccagggacaagcgggucacccauuguuaaucgggaaggaaagauaguaggccuauacgggaauggaguaguaacaacgagcggaacauacgucagugcgauagcucaagcaaaggcgucucaggaggggcccuugccagagaucgaagacgaaguauucaagaaacguaacuuaaccaucauggaccugcacccaggaucagggaaaacacgucgcuaucuaccagcgaucguccgugaagcaauaaaaaggaaacuaaggacacuaauacuagcaccaacgcgagucgucgcgucagagauggcagaagcccuaaaaggcaugccgauccgcuaccaaaccacagcggucaaguccgaacauaccgggaaggagauaguugaucugaugugucacgcaacauuuaccaugagacuacuaagccccguucgaguccccaauuacaacaugaucaucauggacgaagcacacuucacagacccagcaagcauagccgcacgcggguacauaucgacacgcguuggcaugggcgaggccgcggcaaucuucaugacagcaacgcccccgggaaguguggaggcauucccgcaguccaacgccgugauccaagacgaagaaagagacaucccggagagaagcuggaacagcggauacgacuggauuacggacuuuccgggcaaaaccguuugguucguccccucuauaaagucggguaacgauauagcaaacugccuucgaaagaacggaaagcgggugauucaauuguccagaaaaaccuucgauacugaguaccaaaaaaccaagaacaacgacugggauuacguaguaaccacggacaucuccgaaaugggggccaacuucagagccgacagagugauagauccacgucgaugccuuaaaccagugauacuaaaagacggacccgagcgcguaauauuggcuggacccaugcccgucacagcggcuuccgcagcccaacgccgcggcagaauaggcagaaaucaaaacaaagaaggcgaccaauauauuuauaugggccaacccuuaaauaacgacgaggaccacgcacacuggacggaggcaaagaugcuguuagauaacauuaacacacccgaagggauaaucccagcccuguucgaaccugagagagaaaagagcgcggcaaucgauggagaauaccgucuacggggcgaggcgagaaaaaccuucgucgagcuuaugcggcgcggcgaccuucccguauggcugucauacaaaguggcgucggaaggauuccaauacucggauaggagaugguguuucgacggagaaagaaacaaccaagugcuagaagagaacauggacguagaaaucuggacgaaagagggagagcgaaagaagcuccggccaagguggcucgacgcaaggacauacucagauccucuggcgcuucgugaauucaaggaauuugcagcuggacgccgcucaguaaguggggaccugauacuggaaaucggaaaguugccacaacaccuuacauugagagcacagaacgcccuagacaaccuaguaaugcuacauaacagcgagcaaggagguaaggcauaccgacaugcaauggaagaacucccggacaccauagaaacacucaugcuacuugcguugauagcagugcuaaccggggggguaacucuuuucuuccuaucaggcaagggacuggguaagacuuccaucggacuauuaugcguaauggcauccucgguccugcucuggauggccuccguugaaccacacuggauagcagcaucgaucauauuggaguucuucuugauggugcugcuaauaccagagccagaccgacaacgcaccccccaagacaaucaacucgcguaugugguaauaggacuccucuucaugauacucacggucgccgcuaaugagaugggacuguuggagacgacaaagaaagauuuaggcauagggcacgugguagcggaaaaccaccaccaugcaaccaugcuugacauagaccuccacccugccagcgccuggacccuguacgcgguagcgacuaccauuauuaccccgaugaugcgacacacaauugaaaacacgacagcgaacauaagccugacugccaucgccaaccaggccgccauacuaauggggcuagacaaaggguggccaauaagcaagauggacaucggggucccgcugcuagcuuugggcugcuauucccaggucaauccucugacccuaaccgccgccgucuugaugcucguggcccacuacgcaauaauuggcccagggcuacaagccaaagccacgcgagaggcgcaaaaaaggacagcggcuggcaucaugaaaaacccgacaguagacgggauaguagcgauagaccucgacccagucgucuaugacgcgaaauucgagaagcaauugggacagauaaugcuccugauacuauguacgucucaaaucuuacuuaugcgcaccacaugggcucuaugugaaucgauuacacucgcgacaggaccucuuacaacgcucugggagggguccccaggcaaguucuggaacacgaccaucgcaguaucgauggcaaacauauuccgaggaucauaccuggcgggagcaggccuagccuuuucccucaugaaaagccuaggaggcggacgacggggcaccggagcgcagggggaaacccuaggagagaaguggaaaaggcaacuaaaucagcuaucaaaaagcgaguucaacacguauaaacgguccggcauaauggaaguagacagguccgaggcuaaagagggacucaaacgcggggaaaccaccaagcaugcugugucccgcggaacggcuaaguuacggugguucguggaacgcaaccuggucaaaccugaaggcaaaguaauagauuuaggcugugggcgcggcgguuggucguacuacugugcaggacucaaaaaggugacagaaguaaaaggcuacaccaaagggggcccugggcacgaggaaccgauaccgauggcaaccuacggcuggaacaucgugaagcugcauucaggacgcgauguauucuucaccccgccagagaagugcgacaccuugcuaugcgauauaggagaguccucgcccaacccuaccaucgaggaggggagaacacugagaguacuaaaaaugguugaaccaugguugaggggaaaccaauucuguauuaagaucuuaaaccccuacaugcccucagucgucgaaacgcucgaacagaugcaaaggaagcauggcggcauguuaguucguaacccacucagucggaauagcacccacgaaauguacugggucucuugcgggacggguaacauuguaucagcaguaaacaugacaucccgaaugcuucuaaaccgcuucacgauggcucaccgaaaaccaacauacgagcgagacgucgaccugggggcaggcacacgacauguggccguagaaccugaaaucgcgaaccuugacauuaucggacagcgaaucgaaaacaucaaaaacgagcacaagucgacauggcacuacgacgaggacaacccuuacaagacgugggcguaccacggguccuacgaagucaagccgaguggaagcgcuucaagcauggucaauggaguuguucgccuccucacuaaaccgugggacgucaucccgauggugacgcaaaucgcgaugacagacaccacaccauuuggccaacagaggguguuuaaggagaaaguagacacgagaaccccucggccgaagcgcggaaccgcacagaucauggaagucaccgcaaaguggcucuggggcuuccuaucucggaauaaaaagccgagaauuugcaccagagaagaauucaccaggaaggucaggaguaacgcagcgauaggggccgucuucgucgaugaaaaccaguggaacagcgccaaagaagcaguggaagacgagcgauucugggauuuagugcaccgggaaagagaauuacacaagcaaggcaagugcgcaacaugcguuuacaacaugaugggaaaaagggagaaaaaacuaggugaauucggcaaggcaaaaggaagcagagcgauaugguacauguggcugggugcacgcuucuuggaauuugaggcccucgguuucaugaacgaagaccacugguucagcagggaaaacucacugucaggaguagagggcgaggggcuucacaaacuaggauacauacuacgagacauaucaaagauccccggcgggaacauguacgcugaugacacugcuggcugggacacccgcauaaccgaggacgaccugcaaaacgaggcaaaaauaacggacaucauggaaccagaacacgcucuacuagccacgagcaucuucaagcuaacauaccaaaacaaaguaguuagggugcaacguccugcgaaaagcgguaccguuauggacguuaucucccgcagggaucaaaggggaagcggccaaguggggacguauggucuuaacacauucaccaacauggagguacagcuuaucaggcaaauggaaucggaaggcaucuucagcccgagcgaacuggagaacagcaaucuggcggaacgcguccuagacuggcuggaaaaacacggggucgaacggcucaaacggauggccauaagcggugacgacuguguagucaaacccaccgacgaccgcuucgcaaccgcauugacggcucugaacgauauggggaaggugagaaaggauaucccacaaugggagcccaguaaaggguggaacgacuggcagcaagucccuuuuugcucccaccacuuccaccaacugauaaugaaggacgggcgagagaucgucguccccugccguaaccaggacgaacucgugggccgggcacggguaagccaaggcgcaggauggucuuugcgcgaaaccgccugcuugggaaaaucauaugcccaaauguggcaacucauguacuuccauagaagggaccuccggcucgcagcaaaugccaucugcuccgccguuccagucaacuggguuccuaccuccaggacaacauggagcauacacgcccaccaccaauggaugacgacugaggauaugcucuccguauggaacagagucuggaucgaagaaaacccauggauggaagacaaaacccacguaagcucaugggaagaugugccguaucuaggaaaaagggaagaccaauggugcgggagccucauaggccuaaccgcaagggccacgugggcgacuaacauacaggucgcaauaaaccagguuaggagacugaucggcaacgaaaauuaucuagauuauaugacuucaaugaaacgauuuaagaacgaaagugauccggagggcgcccugugguga

SEQ ID NO: 23759 - RNA, 9879 nt, Artificial Sequence
  derived and/or modified CDS sequence (opt11) from DENV-1__KX380798__SS-prME
ucaguuacuaugcuucucaugcuaaugcccaccgcacuggcauuccaccucaccacccgcggcggggaaccgcauaugaucguaagcaaacaggagcgcggcaagagccugcuuuuuaagacuagcgcaggggugaacaugugcacccuuaucgcgauggacuugggggaacugugugaggauacgaugaccuacaaaugccccagaaucacagaggccgagccugacgacguggauugcuggugcaaugcgaccgacacguggguaacuuacgggaccugcagccagaccggcgagcaccggcgcgacaagcgcuccgucgcccucgcuccccacguaggcuuaggacuggagacgcguaccgaaacuuggaugagcagcgagggcgccuggaagcagauccagcgggucgagaccugggcguugcgccaucccggguucacggugaucgcgcuguuccucgcgcacgccaucggcaccagcaucacccaaaaggggaucauuuuuauccuccugaugcuggugacgcccuccauggccaugcggugcgucgguaucggcagccgcgauuucguggagggguuauccggcgccacguggguggauguuguguuagagcacgggaguugcgugaccaccauggcaaaagauaagcccacacuggacauugagcuacugaaaacggaggucacuaaccccgcgauccuacggaagcucugcauagaggccaagauauccaauaccacaacggacaguagguguccgacccagggcgaggcgacacugguagaagaacaagacgccaacuucgugugccggcgcaccuucguugaccguggcugggggaacggcugcggguuguuuggcaaggggucacucaucacgugcgccaaguucaagugcgugaccaaacuggaggggaagauagugcaguaugagaaucugaaguacagcgucaucgugacagugcacacgggcgaccagcaccaagugggcaacgaguccacagagcacggcacgaccgcaacuaucacuccccaggcucccacgacugagauucagcucacugauuacggugcacugacuuuggacugcucgccccgcacgggccucgacuuuaacgagaugguacuccugaccaugaaagagaaaagcuggcucguucacaaacagugguuccuggaccuaccccugcccuggaccucgggggccagcacaucccaggaaacguggaaccggcaggaucuguuagugacguucaaaaccgcccacgcaaagaagcaggagguggucgugcucgggagccaggagggagcaaugcacacggcccucaccggggcgacugagauacagacuuccggcaccacgaccauauucgcggggcacuuaaagugucgacucaagauggacaagcuaacuuugaaaggaaugagcuaugugauguguacuggcuccuucaagcucgagaaggaagucgccgagacgcagcacggcacggugcugguacagauaaaguaugagggaaccgacgcccccugcaagauccccuucagcacccaggaugaaaagggggucacgcagaaugggcggcugaucaccgccaauccgaucgucaccgauaaggagaagcccgugaacaucgaagccgagccgccauucggagaauccuacauagugaucggugcgggcgagaaggccuuaaaauugagcugguucaagaaggguuccaguaucggcaagauguucgaggcgacagcccgcggugccaggcgcauggcuaucuugggggacacagccugggacuucggguccauuggcggcguuuuuaccucuguggggaaguuaguacaucaaaucuucggcacagcguacggcguccuguuuuccggcgugagcuggacgaugaagaucgggauaggaguccuucugacauggcucggccugaacucccgcagcaccucccugagcaugaccuguaucgccguggggcucgugacccuauaccugggcgucaugguucaggccgacagcgggugcguuaucaacuggaaggggcgggaguuaaagugcgggagcggcaucuuugucacgaacgaagugcauaccuggaccgagcaguacaaguuccaagcugacuccccaaaacgccugucugccgcgauuggcaaggccugggaggagggaguuugcggcauccggagcgccacucgacuggagaauaucauguggaagcaaaucaguaacgagcucaaccacauacugcuggagaaugacaugaaguuuacagucguggugggugacgucgccggcauccuugcccaggggaagaagaugauccggccccagccuauggaauacaaguacagcuggaaguccuggggcaaggccaagaucaucggcgccgacguucagaauacgacauucaucaucgacgggccuaacaccccugaaugucccgacgaccagcgggccuggaacaucugggagguggaggacuacggcuuuggcaucuuuaccacgaacaucuggcuuaagcugcgggacagcuacacccaggucugcgaccaccgccuaauguccgccgccauaaaggacucaaaagcgguacacgcggacaugggcuacuggaucgaguccgagaagaacgagaccuggaaacuggcgcgggccagcuucaucgaagucaagaccugcaucuggccuaagucccacacguuguggagcaacggcguucucgagucugagaugauuauccccaagaucuacgggggcccuaucagccagcauaacuaucggcccggguauuucacccaaaccgccgggcccuggcaccuugggaaguuagaauuggacuuugaucugugugaggguaccacaguuguggucgaugagcacugcggcaaucgggggcccucccugcgcacaaccacaguaaccgguaaaaucauccaugaguggugcugucggagcuguacccucccgccccuucgcuuccgcggagaagauggcugcugguacgggauggagauacgccccgugaaggagaaagaagagaaucuggucaaguccauggugagcgccggcucuggcgaaguggacuccuuuucacucgggcuucugugcaucuccaucaugaucgaggaggucaugcggagccgcuggucccggaagaugcucaugaccggcaccuuagccgucuucuugcuacugaucaugggacagcugacguggaacgaucuaaucagacugugcauaauggucggcgcgaacgccagcgaccgcauggggaugggcaccacguaucuagcacucauggccaccuucaagaugcggccaauguucgccgucggacuacucuuucgccgccucacgucccgcgaagugcuguugcucacaauuggucuuagccugguggcgucggucgaauugcccaauagccucgaggaacugggcgacgggcucgccaugggcaucaugauucugaaguuauuaacggacuuccagucccaccagcucugggcgacucugcucagccugacguucaucaagacgaccuuuagccugcacuacgcguggaagaccauggcgaugguccuaagcauugucucccuguucccccugugcuuauccacgaccucccaaaagaccaccugguugcccguguuguuagguagccuggggugcaagccgcugacaauguuccuaaucgcugagaauaaaaucuggggcagacgguccuggccccugaacgaggggaucauggccguggggaucguuagcauccugcuaagcucccuuuuaaagaacgacgugccgcucgcagggccccugauugccggcgguaugcugaucgcaugcuauguaauaucuggcuccucugccgaccugucccuggagaaggccgccgaggucagcugggaggaggaagccgagcacucuggcgcaagccacaacauccugguggagguacaggaugaugggacuaugaagauuaaggacgaggaacgggacgacacccugaccauccugcugaaggccaccuuacuugccgucagcgggguguacccgcuuagcauucccgcaacccucuucguuugguacuucuggcagaagaagaagcaacgcuccgggguccugugggacacccccagcccgcccgagguggaacgcgcggugcuggaugauggcauuuaccgcaucaugcagcgcggccugcucgggcgcucgcaggucggaguggggguguuccaagagaacguuuuccauaccauguggcacgugacccggggcgcgguucuaauguaccagggaaagcgucuggagcccagcugggcauccgucaagaaagauuuaauaucuuaugggggcgguuggcguuugcagggguccuggaacacgggagaggagguccaggugauagccgucgaacccgggaaaaaccccaaaaauguacagaccgcacccggaaccuucaaaacacccgaaggcgaagugggugccaucgcgcuggacuucaagccggggacgagcggcucccccaucgucaacagagagggcaagaucgugggacucuacggcaacggggugguuaccaccucagguacguaugugagcgccaucgcucaggccaaggcgucccaggaggggccgcugcccgagauugaggacgagguguuccggaagagaaaucuuacgaucauggaccuccacccaggcagcgggaagacccggcguuaucugccugccauaguccgggaagccauuaagcgcaagcugcgcacucucaucuuggccccaacccggguaguggccucggaaauggcggaagcccugaaaggcaugcccauccgcuaucagaccaccgcgguaaaguccgagcacaccggcaaggagaucguugaccucaugugucacgcuaccuuuacgaugcggcugcuaucgccugugcgggucccuaacuacaacaugaucaucauggacgaagcccauuucacugaccccagcuccaucgccgcccggggauauaucagcaccagggugggcaugggugaggccgcagccauauuuaugaccgccaccccgcccggcuccguggaggccuuuccgcagagcaacgccguaauccaagacgaggagcgagacauucccgaaaggucguggaacucgggguaugaauggaucaccgacuucccgggcaaaacagugugguucguccccagcaucaagucaggcaaugacaucgccaacugccuccggaagaacgggaaacgcgucauacagcuuuccagaaagaccuucgacacagaguaccaaaagacaaagaacaacgauugggauuacguggugaccaccgauaucagcgagaugggagcgaauuucagagcagaccgggucaucgacccgagaaggugccuaaaacccgugauccucaaggaugggccggaacgcgugauccuggccggccccaugccggucacgguggccucagccgcgcaacgcagggggcgcauaggccgaaaccacaacaaagagggggaccaguacauuuacauggggcaaccccugaacaaugaugaggaccacgcccacuggaccgaggccaagaugcugcuggacaacaucaacacccccgagggcauaauccccgcucuauucgagccggagcgcgagaagucugccgcgaucgacggggaauaucgguuacgcggcgaggcccggaagacauucgucgagcugaugcgcagaggagaucugcccguaugguuauccuauaagguugccucagagggcuuucaguacagugaucgccgguggugcuucgauggugaacgcaacaaccagguccuggaggagaacauggacguggagaucuggacgaaggagggagagcggaagaaacuucgcccacgguggcucgaugccagaaccuauuccgaucccuuggcguugcgggaguucaaggaguuugcggccggacgccggagcguauccggugacuuaauccuggagauaggcaagcuaccgcagcaucucacccaacgcgcccagaacgcgcuggauaaccugguuaugcuccacaacagcgagcaaggcgggcgggcguaccgccaugccauggaggagcugcccgacaccaucgagacgcugaugcuccucgcacugaucgccgugcucacuggaggggugaccuuguucuuccuguccggccgcgggcucgggaaaaccuccaucggccuucugugcgucauggccuccagcgugcuccuguggauggccuccguggagccacacuggaucgcagccagcaucaucuuggaguucuuccucaugguccugcugauacccgagccggaccggcagcguacgccgcaggacaaccagcuugccuauguggugaucgggcugcuguucaugauccucaccgucgccgcaaacgagaugggccugcuggagaccaccaagaaagacuuaggaaucggccacguggcuguagguaaccaccaccacgcagcgauguuagacgucgauuuacaccccgccucggcguggacccuguacgccguugcuacgacaaucaucacgcccaugaugcgccacaccaucgagaacacgaccgccaacaucagcuuaaccgcgaucgcgaaccaggcugcaauccuuaugggccucgauaagggcuggccaaucagcaaaauggacauuggcgugccccugcuggcccucggcugcuacagccaggucaacccccugacgcugacggcggccguccucaugcugguggcccacuacgccauaaucgggccgggccugcaggccaaggcgacccgcgaggcccaaaaacgcacggccgccgggaucaugaaaaacccgaccgucgauggcauuguugccaucgaccucgaucccguagucuacgacgcgaaauuugagaagcagcugggucaaauuaugcugcucaucuugugcacgagccagauccuccucaugcgcaccacgugggcacugugcgaaagcaucaccuuagccacggggccgcucaccacccugugggagggcaguccggggaaguucuggaacaccacuaucgccgugagcauggcuaacauuuuucggggguccuaucuggcgggugccgggcucgccuucagccugaugaagucccugggugguggcagaagaggaacgggcgcccagggcgagacccuuggggagaaguggaagcgccaguuaaaccagcuguccaagagcgaguucaacacauacaagcgcucugguaucauggaggucgacagauccgaggcaaaagaggggcucaagcggggcgagacgaccaagcacgcagugucccgcgggaccgccaaacugcggugguucguagagagaaaccuggugaagccggaaggcaaggucaucgaccuaggguguggacggggcggguggagcuacuacugugcuggccuaaagaaagugaccgaagugaagggcuacacgaaggguggucccggccaugaggaacccauccccauggccaccuacggcuggaaucuggucaagcugcacucugguaaggacguguucuucaucccacccgagaagugcgacacacuccugugcgacaucggcgagaguucccccaauccuacaaucgaagaggggcgcacucugagaguguugaagauggucgaacccugguuacgcggcaaccaguucugcaucaagauccugaaccccuacaugcccagcgugguggaaacccucgagcaaaugcaacggaagcacggcgggaugcugguccgaaacccgcugucacggaacagcacccacgagauguauugggucuccugcggcaccgggaacaucgugagcgcuguuaacaugaccucccgcauguuacugaaccguuuuaccauggcccaccggaagcccaccuacgagcgggacguagaccugggggcggggacccggcacguggccgucgagcccgagguagcuaaccuugauauuauagggcaacgcaucgaaaacauaaagcacgagcacaaaagcaccuggcacuaugacgaggacaaccccuacaagacgugggcguaucacggauccuacgaggugaagccgagcggguccgccagcucaauggucaacgggguggucaaacuucugacgaagcccugggacgucaucccaauggugacucagaucgccaugacggauacgaccccguuugggcagcagagaguauucaaggaaaagguggacacgcgcacaccgaaggccaagcggggcacggcccagauaauggaggugaccgcaaaauggcucuggggcuuucuuucccgcaauaaaaagccacgcauaugcacccgcgaagaguuuacccguaagguucgcagcaaugccgccaucggagccguauucguagacgaaaaccaguggaacucagcaaaggaggccguggaggacgaaagguucugggaccucguccacaaggagcgcgaacuccacaagcaggguaagugcgccacgugcguguauaacaugauggggaagcgggagaagaagcugggcgaguucgggaaggccaaggguagccgcgccauaugguacauguggcuuggugcacguuuccucgaguucgaagcccugggguucaugaacgaggaucacugguucucccgcgagaacagccugaguggugucgagggugagggccuccacaagcuaggcuacauccuccgggacaucucaaagauccccggcggcaacauguacgccgaugacacagcggggugggacacccgcaucaccgaagacgaccuccagaaugaggcucggaucacugauauuauggagccggagcacgcguugcuugccaaguccaucuuuaagcucaccuaccagaacaaagugguccgcguccagcguccggccaagaacggcaccgugauggacgugaucucucggagagaccagcggggaagcggccaggucgggaccuacgggcuuaacaccuucaccaacauggaggcgcagcugauacgccagauggagagcgagggcaucuucucccccagcgaacucgagacgcccaaccuggccgagcggguucuggacugguuagaaaaguacgggguugagcgccugaagaggauggcgauuuccggcgacgacugcgugguaaaaccgaucgacgacagguuugccaccgcccugacggcgcucaaugacauggggaaggugcggaaggacaucccgcagugggaaccgagcaagggcuggaaugacuggcagcagguaccguucugcagccaccacuuccaccaacugauuaugaaggacggccgcgaaaucguugugccuugccggaaccaggacgaguuggucgggcgcgcccgcguaagccagggggcgggguggagccuccgcgagacagcgugccugggcaaauccuacgcccagauguggcagcugauguacuuucaccggagggaucugcggcuggccgcgaacgccauaugcucagccguacccgucgacuggauacccacgucgcgaaccacguggucgauccaugcgcaccaccaauggaugaccacagaagacaugcucuccguguggaaccggguguggaucgaggaaaacccguggauggaggauaagacacacaucagcuccuggggcgacgucccguaccucggaaagcgcgaagaccaguggugcggcucgcuaaucgggcugaccgcccgcgcgaccugggcuaccaacauucagguggccaucaaucaggugcggcgccucaucggcaacgagaacuaucuggacuacaugaccuccaugaagcgauucaaaaacgaaagugaucccgagggcgcacugugguga

SEQ ID NO: 23760 - RNA, 9879 nt, Artificial Sequence
  derived and/or modified CDS sequence (opt11) from DENV-1__KJ649286__SS-prME
ucagugaccaugcuacuaaugcugcugccuaccguguuggcuuuccaucugacaacgagaggcggggaaccccacaugauugugaccaagcaggagcgggguaagagcuugcuauucaagaccucuaccggggugaacaugugcacccuaaucgccauggaucugggagagcucugugaggacaccaugaccuauaaaugcccccgcauaaccgaggcggagcccgaugacaucgacugcugguguaacgcaaccgacaccugggugaccuacgggaccugcucccagaccggggagcaccggcgcgacaagcgcagcguggcacuggcgccccacgugggccuuggccucgagacucgcaccgagacguggaugucaagcgagggugcguggaagcagauccagcgggucgagacgugggcacugcgccaucccggguucaccgucaccgcccuguuccucgcgcacgcaaucggcacguccauaacccaaaaggggaucaucuuuauccugcugaugcucgucacccccagcauggcgaugcggugcgucggcaucggcaaccgcgacuucguggaggggcuguccggcgccacauggguugacgucgugcuggaacacgggagcugcgugaccacaauggccaaggacaagcccacccucgacaucgagcugcuaaagaccgaagucacgaaccccgccgugcuacgcaagcuguguaucgaggccaagaucuccaacaccaccacggacagccgcugccccacucagggcgaagcgacgcugguagaggagcaggacgcuaauuucgucugccggcgcaccuucguugaucggggcugggggaacggcuguggccuguucggcaaggggucucugaucacuugcgcgaaguuuaagugcgugacgaaacuggagggcaagaucguccaguacgagaaccucaaguauagcgugaucgugacuguccacaccggcgaucaacaucagguggggaaugaauccaccgagcacggcaccacggcuacaauuacgccccaagcccccaccucagagauacagcugacggacuacggggcauuaaccuuggacugcucuccccggaccggccuggacuuuaacgaaauggucuuauugacaaugaaggagaaguccuggcuggugcacaaacagugguuccuggaccuaccguugcccuggacguccggggccaccaccagccaggagaccuggaaccggcaggacuuauuggugacguucaagaccgcccacgccaagaagcaggaggucgucgugcugggcagccaggagggggcuaugcauacugcgcugaccggggccacagagauccagacauccggcaccaccacgaucuucgccggccaucucaagugccgccugaagauggauaagcugacacucaagggcaugagcuacgucaugugcacuggaagcuucaagcuggagaaggagguaguggagacgcagcacggcacggugcugguccaagugaaguacgagggcaccgacgcccccuguaagauccccuuccugacccaggacgagaaaggcgucacccagaacggccgggugaucacggcaaacccgaucguuaccgacaaagagaagccagucaacaucgaggcggagccgcccuucggggagagcuacauugugguaggcgccggcgagaaggcccucaagcuguccugguucaagaaggggagcaccaucggcaagauguuugaggcgaccgcgcgcggggcacggcguauggccauccuuggcgacacggccugggacuucggguccaucggcggcgucuucacgagcgugggaaaacuuguccaccagauauucggcaccgcuuacggggucuuauucuccggcgugaguuggaccaugaagaucggaaucggagugcugcucacguggcuggggcuuaacuccaggagcacgucacucagcaugaccugcauagcugucgggcuggugacacuguaucuaggugugaugguccaggccgacuccgggugcguaaucaacuggaagggucgggagcugaagugugggagcggcaucuuugugaccaacgagguccacacguggaccgagcaguacaaguuccaggccgauaguccgaagcgccuguccgcagccaucggcaaggcgugggaggagggcgucugcggcauccgguccgccacccgccucgagaacaucauguggaagcagaucagcaacgagcucaaccacauauugcucgagaacgacaugaaguucaccguggucgugggggacgugagcggcauacuggcccaagggaagaagaugauccggccccaacccauggagcacaaguacuccuggaaguccuggggcaaagcgaagauaaucggggccgacguccagaacuccacuuuuaucaucgacgggcccaauaccccggagugcccugaugaccaacgcgcauggaacaucugggagguggaggacuauggcuucgggaucuucaccacgaauaucuggcugaagcuccgggacuccuacacccaggugugcgaccaucgccugauguccgccgccaucaaggauucaaaggcuguccacgccgacaugggauacuggaucgaauccgagaagaaugaaaccuggaagcuggcccgcgccagcuucaucgaggugaaaacgugcguguggcccaagagucacacccucuggagcaacgggguccuggagagcgagaugauaaucccgaagaucuacgggggcccgaucagccaacacaacuacagacccggguacuucacgcaaaccgccggccccuggcaccuggggaagcucgagcuggacuucgaccucugcgagggcacuaccguaguggucgaugagcauugcggcaaccgggggccgucccuccguaccaccaccgugaccggcaagaucauacacgaguggugcugccggagcugcacgcugccaccccugcgcuucaagggggaggacggcuguugguacggcauggagauacgacccgugaaggagaaggaggagaaccucgucaaauccauggugagcgccggcuccggggagguggacagcuucagccugggccugcuuugcaucuccaucaugauagaggaggucaugcgcagccgguggagccgcaagaugcugaugaccggcacccuggcgguguuucugcuguuaaucauggggcaacucaccuggaacgaccugauccggcugugcaucauggucggcgccaacgccucugacagaaugggaaugggcacgacguaccucgcucugauggccacguucaagaugcgcccgauguucgccgugggguuacuauuucggcgcuuaacuucccgggagguccugcuccugacgaucgggcugucccucguagccuccguggagcugcccaacucuuuggaggagcucggcgacggacuggccaugggcaucaugauccugaagcuccugaccgacuuccagucccaucaacugugggcagcacuccugagccugaccuucaucaagacuacgugcucccuccauuacgccuggaagaccauggccaugguccuguccaucgucagccuguucccccucugcaugagcaccaccagucagaaaacgaccuggcugcccgugcugcucggcagccuagggugcaagccacugaccauguuucucaucgcggaaaacaagaucuggggcaggaaguccuggccccucaacgaggguaucauggccgugggaauagucucuauccugcucuccagccugcugaagaacgacgugccccucgcggggccccuggucgccggcggcaugcugaucgccugcuacgucauaagcggauccagcgccgaccucuccuuagagaaggcagcagaggucagcugggaggaggaggccgagcacuccggcgccagccacaacauccugguggagguccaagacgacggcacgaugaagauuaaggacgaagagcgggacgacaccuugacgauccugcugaaggccacucuccuggccguguccggcguguacccacugagcauccccgcgacccucuucgugugguacuucuggcaaaagaagaagcagcgcuccggggugcugugggacaccccgagcccgcccgagguggagagagcuguccuggacgacggcaucuaccgcaucaugcagagggggcugcucgggagaagccaagucggcguuggggucuuucaggagaacguguuucacaccauguggcacgugaccaggggcgcuguccugauguacaaggggaagcgcuuagaacccaccugggcaagcgugaagaaggacuuaaucuccuacgguggcggcuggcguuuacagggcagcuggaacaccggggaggaggugcaagucauagccguggaaccugguaagaaccccaagaacguccagacggcgccggggacauucaagacccccgagggcgaggugggagccaucgcacuggacuucaagccaggaaccuccggcagccccaucgugaacagagaggggaagaucgugggccucuacggcaacggggucgugaccaccuccggcaccuacgugagugccaucgcacaggcgaaggccucacaagaaggaccgcugcccgagaucgaggacgaggucuuccggaagcgcaaccugacaaucauggaccuccaccccggcucggggaagacgcggcguuaccugccggccaucguccgggaggccaucaagcggaagcugcggacccucauccucgcgcccacccgcguagucgccagugagauggccgaagcccugaagggcaugcccauccgcuaccagaccacggccgugaaguccgagcacaccgguaaggagaucguggaccucaugugccacgccaccuuuaccaugcggcugcugagccccguccgcgugccaaacuacaacaugaucaucauggacgaggcccauuucacggaccccagcucaaucgccgcccggggcuacaucuccacccgaguggguaugggggaggccgcggccaucuucaugacggccacgccgcccggcagcguagaggccuucccgcaguccaacgccgugauccaggacgaggagcgggacauccccgagcgcagcuggaacuccggauacgacuggaucaccgacuuucccggcaagaccgugugguucguccccagcaucaagaguggcaacgacaucgcgaacugccuccggaagaacgggaagcgcgugauccagcugagccggaagaccuuugauaccgaguaccagaagacgaaaaauaacgauugggacuacgucgugaccaccgacauauccgagaugggcgcuaacuuccgcgcagaccgagugaucgacccgcgaagaugccugaagcccgucauccucaaggacgggccugagcgcgugauccuggcuggcccgaugccggugaccgucgcguccgccgcccagcggcgcgggcggaucggacgcaaccagaacaaggagggcgaccaguacauauacauggggcaaccccugaacaacgacgaggaccacgcccacuggacggaggccaagaugcuccuugacaacaucaacaccccugagggcaucauccccgcgcuguucgagccggaaagagagaaguccgccgcuaucgacggggaguaucgccuccgcggcgaggcacggaagacuuuuguggagcugaugcgucgcggggaccuuccugucuggcugagcuacaaggucgcguccgagggcuuccaguacagcgacagacgguggugcuucgauggcgagcgaaauaaccaggugcuggaagagaacauggacguugagauauggaccaaggagggggagcggaagaaguugcgaccccgguggcuugacgcgcgcacuuauucagacccccuggcccuccgagaguucaaggaguucgccgccgggcggcggucgguaagcggggaccucauccucgagaucggcaaguugccccagcaccuuacccagagggcccaauccgcgcuggacaaccugguuauguugcacaacucagagcaaggcggccgggcuuaccgccaugccauggaggaacugccggacacgaucgaaacccugaugcugcuggcccugaucgcgguuuugaccggcgggguuacgcuguuuuuccugagcggcaaggggcuuggcaagaccagcaucggauuacugugcguuauggccucguccaugcuccuguggauggccuccguggagccucacuggaucgccgccuccaucauccucgaguuuuuccucaugguccugcugauccccgagccugaccggcagcgcacgccccaggacaaccagcucgcguacgugguaaucgggcugcuguucaugauucucaccgucgccgccaacgaaaugggccuccucgagacgaccaagaaggaccucgggauaggccauguagccguggagaaccaccaccacgcgaccaugcuggacgucgaccugcaucccgcguccgccuggacccucuacgccguggccacgaccaucauuaccccgaugaugcgccacaccaucgaaaacacgaccgccaauaucucacugaccgcuaucgcaaaccaggccgccauccugauggggcuagacaagggcuggcccaucuccaagauggacaucggcgucccucugcucgcccuuggcugcuacagccaaguuaaccccaugaccuuaacggcggccguacugaugcucguggcgcacuacacgaucaucggcccggggcugcaggccaaggcgacccgcgaagcucaaaaacggaccgccgcugguaucaugaagaaccccacggucgaugggauuguggccaucgaucuagaccccgugguauacgaugcgaaguucgagaagcagcucggucagaucauguugcugauacucugcaccucccagauucuucugaugcgcaccaccugggcccuuugcgagagcaucacgcuggccaccggcccccugaccacccucugggaaggcuccccaggcaaguucuggaacacuaccauugccgugagcauggccaacaucuuccgcgggaguuaucuggcgggcgccggcuuggccuucagccucaugaagucgcucgggggagggaggcgcgggaccggggcccagggcgagacacugggcgagaaguggaaacggcagcucaaccaacugagcaagagcgaguucaauacguauaaacgcuccggcaucaucgagguggaccggagcgaggccaaggaaggucugaagcgcggcgagacgacuaagcacgcugucagccggggcacagcuaaacucaggugguucgucgagcggaacuugguuaaacccgaggggaaggucauugaccuggguuguggccgcgggggguggagcuacuacugcgccgggcugaagaaggucacggaggugaagggcuacaccaagggcggggccggccacgaagagccgaucccgauggcgaccuacggguggaaucucgucaaauuacacagcggcaaggacguguucuucaucccgcccgagaagugcgacacccugcugugcgacaucggugagucuuccccuaauccaacaaucgaggagggccggacgcugcgcgugcuuaaaaugguagagccguggcuccgggggaaccaguucugcauuaagauccuuaaccccuacaugcccagcguuguggagaccuuagagcagaugcaacggaagcacgggggcaugcuuguccggaauccccuuucccgcaacagcacccacgagauguacugggugucguguggaaccggaaacaucgugagcgccgucaauaugacuuccaggaugcugcucaaccgauucaccauggcccaccggaagcccaccuacgagcgugacguggaucuaggggcuggcacccgccacgucgccguggagcccgagguggcgaaccuggacaucaucggccagcgcaucgagaacauaaagcacgagcacaagagcacguggcacuacgacgaggacaaucccuacaagaccugggcuuaccacggguccuacgaggucaagcccuccggguccgccagcuccaugguaaacggggugguacgucuccugaccaagccgugggacgugaucccuaugguaacccagaucgccaugacggauaccacgcccuucggacagcagcgggucuucaaggagaagguagacacucgcacgccgaaagccaagcgggggacugcccaggugauggaagucaccgcccgguggcuguggggcuucuugagcaggaacaagaagccgcgaauuugcacccgggaggaguucacgaggaaggugcggagcaacgccgccaucggcgccguguuugucgacgagaaccaguggaacucggcgaaagaggcagucgaagacgagcgauuuugggaucuagugcaccgggagcgcgaacugcacaaacaggggaagugcgcgaccugcguauacaauaugaugggcaagcgggagaagaagcucggggaauucggcaaggcaaaggggagccgcgcaaucugguacauguggcugggcgcccguuuccuggaguucgaagcccucggcuuuaugaacgaggaccacugguucucccgcgagaacucucugagugggguggagggcgaggggcugcaccggcucggcuacauccugcgcgacaucucuaagauccccgggggcaacauguaugccgacgacaccgccggcugggacacccguaucacggaggacgaccuccaaaacgaggcgaaaaucacggacaucauggagcccgaacacgcccuccuggccaccucuaucuucaagcugaccuaucaaaauaaagugguccgcguccagcgcccagccaagaauggaacagugauggacguuaucucccggcgcgaccaacgggggagcggccaggugggcaccuacggauugaacaccuuuaccaacauggaggcccagcugauucgacagauggaguccgaggggcuguucucccccagcgagcucgaaaccccaaaccucgcagagcgggugcugaacuggcucgggaaguacgggguggagcgucugaagcggauggcgaucucgggggacgauugcguggugaagcccaucgacgaccgcuucgccacugcccuuaccgcccucaacgacauggggaaagucagaaaggacaucccgcagugggagccgagcaagggcuggaacgacuggcagcaagucccuuucugcucccaccacuuccaccagcugaucaugaaggacggccgugaaauagugguacccugcagaaaccaggacgagcucguggggcgagcgcggguaagccagggcgccggguggucccuccgcgagaccgccugccuaggcaagagcuacgcgcagauguggcagcuaauguacuuccaccggcgggaucuccggcuagcggcgaacgccaucugcagcgccgucccgguggacugggugcccacguccagaacgaccugguccauccaugcccaccaucaauggaugaccacggagaauaugcugucugucuggaacaggguguggauugaggagaacccauggauggaggacaagacgcacgugagcuccugggaggauguacccuaccucgggaagagagaggaccaguggugcggcagccugaucggccugacggcgcgcgccacuugggccaccaacauccaaguggccaucaaccaggugcggaagcuaaucgggaacgagaacuaucucgacuacaugacgucaaugaaacgcuucaagaacgacagcgacccugagggcgcccugugguga

SEQ ID NO: 23761 - RNA, 9879 nt, Artificial Sequence
  derived and/or modified CDS sequence (opt11) from DENV-1__KF887994__SS-prME
agcgucacgaugcuguuaaugcuuaugcccacggcccuggcuuuccacuuaaccacccgcggcggcgaaccccacaugaucgucucgaagcaggagcgggggaagucacugcuguuuaagaccucggcuggggugaacauguguacccucauugcaauggaccucggugagcugugcgaggacacuaugacguacaagugcccccggauaaccgaggccgaaccugacgacguugauugcuggugcaacgccaccgauacguggguuaccuacgggaccugcagccagacgggugaacaccggagagacaagcgcuccguggcccuugcgccccacgugggucugggucuggagacgcgaacugagacguggaugagcuccgagggcgccuggaagcagauacagcgcguagagaccugggcuuuacgccaucccggcuucacggugaucgcgcuguuccuggcacaugccauugguacuagcaucacccagaagggaaucaucuucauccugcuuaugcuggugacccccucgauggcgaugcggugcgucggcauuggcagccgagacuucguggaggggcucagcggcgcuacauggguggacguuguacuggagcaugggucgugcgugacgaccauggccaaggacaagccgacacuggacaucgaguuguugaagacggaggucaccaaccccgcgauccugcggaagcucugcaucgaggcaaagaucuccaacaccaccacugacagccggugcccgacgcagggcgaggccacccugguggaagaacaggacgcgaauuucgugugccgccguaccuucguggaucggggcugggguaacggcugcgggcucuuuggcaaggggagucucauaacuugugcaaaguucaagugcgucaccaaacuugagggcaagauugugcaguacgagaaccugaaguacagcgucaucgucacggugcacaccggagaccagcaucaggucggaaacgagucgacggagcacggcacgacggcgacuaucacaccgcaagcaccgaccacggaaauccagcucacugauuauggggccuuaaccuuggauugcagcccccgaacaggacuggacuuuaacgagaugguguuacuuacaaugaaggagaagucuuggcucguccauaagcagugguuccuugaccugccacuccccuggacaucaggggccucgaccucccaggagacguggaaccgacaggaccuguuggugaccuucaagaccgcccacgcaaagaagcaggagguagucgugcugggcucgcaggaaggcgccaugcacaccgcacucacgggcgccaccgagauccaaacguccggcacuacgaccaucuucgcaggccaccugaagugccgccuuaagauggauaagcugacccugaagggcaugagcuacgugauguguacagguaguuucaagcucgagaaggaggucgcggagacucagcauggcaccgugcuggugcagaucaaguacgagggcaccgacgcuccuuguaagaucccuuuuagcacacaggacgagaagggggugacgcagaacggccggcugauaaccgccaauccaaucguaaccgacaaggagaagccugugaauaucgaggcugagccgccuuucggggaaagcuacaucgucaucggcgcgggcgagaaggcccugaaguuaaguugguucaagaaggggucuaguauugguaagaugcuugaagccaccgcccgaggggcccggagaauggcgaucuugggugacacggccugggacuucgggucuaucggcggagucuuuaccuccguaggcaaguugguccaucagaucuuuggcacggccuacggggucuuguuuuccggcgugagcuggaccaugaaaaucgggauaggcguccuguuaacguggcugggucuaaauucucgcaguaccucgcucagcaugacauguaucgcuguggggcuaguaacccuguaccuuggcgucauggugcaggccgacucaggaugcgugaucaacuggaagggacgggagcugaagugcgggagugguaucuucguaacuaacgagguacacaccuggaccgagcaauacaaguuccaagcugacagcccgaagcgccugagugccgccaucggcaaggccugggaggaggggguuuguggcauacgaagcgccacccgcuuagagaacaucauguggaaacagaucuccaacgagcugaaucacauccugcuggagaacgacaugaaguucaccguggugguaggcgaugucgcgggaauccuggcccaaggaaagaagaugauccgcccccagccuauggaguacaaauacagcuggaagucuuggggcaaggcgaagaucauuggcgccgacguucagaacacaaccuucauuaucgacgggccuaacacuccggaaugccccgaugaccagcgcgcauggaacaucugggaaguugaggacuacggcuucggaauauuuaccacgaacauauggcugaaacuucgggauuccuacacccaggugugcgaccaccgucuuauguccgccgccaucaaagacucaaaggccgugcaugcagacaugggcuauuggaucgagagugagaagaaugagaccuggaaacucgcacgggcgagcuucaucgaggugaaaacaugcauuuggccuaagagccacacgcucuggucuaacggaguccuugaguccgaaaugauaauaccgaaaaucuacgguggccccaucucgcagcacaacuaccgacccgguuacuucacucagaccgccggccccuggcaccucgggaaguuggagcuggacuucgaccugugcgaggguaccacggucgugguggacgagcacugcggcaaccgcggcccgagucuccgcacaacaaccgugacgggcaagaucauccacgagugguguugccguuccuguacccuuccaccccuucgcuuucgcggggaagacggcuguugguacgggauggagauccgccccgugaaggagaaagaagaaaaucucgucaagucaauggugagcgcaggcagcggugagguagacucguuuucccucggguuacucugcauuagcaucaugauugaggaaguuaugcggagccgcuggucccgaaagaugcugaugaccggcacucucgccguguuccuucuacugaucaucgggcaauugacguggaacgaccuuauuagacuguguaucauggugggugcgaaugccucugaccgaauggggaugggcaccaccuacuuagcccugauggcaacauucaagaugcguccgauguucgcggucgggcuccuguuuaggcgguugacgaguagggagguguuacuccugaccaucgggcugagcuuaauggcguccguggagcugcccaauagccuggaggaauuaggcgaugggcuggccauggguaucaugauacugaaacuccuaacggacuuccaaagccaucagcugugggcuacucuccuaagccugacauucauaaagacaaccuucagcuugcacuacgcuuggaaaacgauggcgaugguccucuccaucguaucccuguucccccucugucuuucuacgaccucccagaaaaccacauggcugccugugcuccugggcucguuagggugcaagcccuuaacuauguuccugaucgcagagaacaagauuuggggucggcgcucguggccucugaaugaggggaucauggccguagguauaguuagcauccuguuaagcucucugcucaagaaugacgugccccuggccgggccccugaucgccggcgggauguuaaucgcguguuacgucauuagugggaguucagcggaucucucccuagagaaggcagccgaagugagcugggaggaggaagccgaacacuccggcgcgucccacaacauccucguugaggugcaggaugacggaaccaugaaaaucaaggaugaagaacgggaugacacacugaccauccuguugaaggcuacucugcuggcuguguccggcguauacccgcugaguauccccgccacauuguucgugugguacuuuuggcagaagaaaaagcagcggaguggggugcuuugggauacuccaucaccgccagagguugagcgggccgugcuggacgacgguauauacagaaucaugcagcggggccuauuaggucgcagccaggugggcgucgggguguuucaggagaacguguuccacaccauguggcaugucacacgaggcgcagugcugauguaucaagggaaacgccucgagcccaguugggccuccgugaagaaggaccuuauauccuacggcggcggguggcgacugcaagggagcuggaacacaggggaggagguucaggugaucgccguagagcccggaaagaaccccaaaaauguucagaccgcuccgggaaccuucaagacacccgaaggugaggugggcgccaucgcccuagauuuuaagccggggacaucugguagccccaucguaaaccgggaggguaagauagucggccuguacgggaacgggguggugaccaccagcggcaccuacgucagcgccauagcucaggccaaagccucccaggaggguccguugcccgagauugaggacgagguauuccguaaacggaaucucacuauuauggaucugcaccccggcagcgggaaaacccgucgcuaccugccggcaauaguccgggaggccaucaagcgcaagcuacgcacccugauacuagcccccacccgaguagucgcuuccgagauggcggaggcccuuaaaggcaugccgauccgcuaccagacgacggcugucaagagugagcacaccggcaaggagauagucgaccugaugugccaugcgaccuuuaccaugcgccuccucuccccugugcgcgugccaaacuacaauaugaucauuauggacgaggcccacuucacugacccgaguuccaucgcggcgcgcggauacauaagcacucgagucggcaugggggaggccgcagccaucuuuaugacggcuacuccgcccggcuccgucgaagcauucccgcagagcaacgccgugauacaggacgaggagcgugacauaccggagcgcucguggaacagugguuacgaguggaucacggacuucccggguaagacuguuugguucguccccucaaucaagagcggcaacgacaucgccaacugccugcggaagaaugguaagcgcguuauucagcuuucccgaaaaaccuucgacacggaguaccagaagaccaagaacaacgacugggacuacgucgugaccacugacaucucggagaugggcgcuaacuucagagccgacagagucaucgacccgcgacggugccucaaaccggucauacugaaggaugggccggagcgcguuaucuuagccggccccaugccgguuacggucgccucagccgcgcagcggaggggacggaucggccguaaccauaacaaggagggcgaucaguacaucuauauggggcagccccucaauaaugacgaagaccaugcccacuggacagaggccaaaaugcuuuuggacaacauaaacacccccgaagguaucauucccgcccucuucgagccggagagggaaaaguccgccgccaucgacggugaauaccgucuucggggcgaagcgcggaagaccuuuguggagcugaugcgccggggugaccuucccgucuggcugucuuacaagguggcgagcgagggcuuccaauauuccgaccgccguugguguuucgacggggagcgcaacaaccagguccuggaggagaacauggacguugagaucuggaccaaggaaggagagcgcaaaaagcucaggccaagauggcuggacgcccggacuuacuccgaccccuuggcgcugcgggaguucaaggaguucgcggccgggcgccggagcguguccggcgacuuaauacuagagaucggaaagcucccgcaacauuuaacccagcgggcccagaaugcacuggacaaccucguaaugcugcacaauagcgagcaaggagggagagcguacaggcaugccauggaagaacugcccgacacaaucgaaacccuuaugcugcuggcccucauagccgugcugaccggaggagugacccuguucuuccucucaggaaggggacuggguaagaccagcaucgggcuccucugcguaauggcgucaagcguacugcuguggauggcgaguguggagccacacuggauagccgcgagcaucauucuggaguuuuuccugauggugcuucucauccccgaaccggaccgucagcggacgccccaggacaaucagcuugcauacgucgugauagggcuacucuucaugauccuaacgguagcugcuaacgagaugggucugcucgaaaccacuaagaaggacuugggcauaggccacguggccguugggaaccaccaccacgcugcgaugcuggaugucgacuugcacccggcuuccgcuuggacccuguacgccgucgcaaccacuaucauuacccccaugaugcgacacaccaucgaaaacacgacagcaaacauaagucugacggccaucgcgaaccaagccgcuauccucauggggcuggacaagggcuggcccaucuccaagauggacaucggcguaccccuauuagcccuaggcugcuacagccagguuaacccccugaccuugacggcggccguccugauguugguggcccauuacgccaucaucggaccggguuuacaagcgaaggcuacccgcgaggcccagaagagaaccgcugccggcaucaugaagaaccccaccguggauggcaucguggcuauugacuuagaccccguuguauacgaugcgaaguucgagaagcagcucggccaaaucaugcuccugaucuuaugcaccucccagauacugcuaaugcguacgacgugggcgcucugcgagucaaucacccucgcaacugggccccuuaccaccuugugggagggcagcccggguaaguucuggaacacgacgaucgcuguuagcauggccaacaucuuccggggauccuaccucgcgggcgcugggcuggccuucagcuuaaugaaguccuuaggcgggggccgacgcggcaccggcgcccagggagagacacugggggagaaguggaagcgccagcugaaccaguugagcaaaagcgaguucaacacauacaagcgcaguggaauaauggagguggaucgaagcgaagcgaaagaggggcuuaagcgcggcgaaacgaccaagcacgcuguguccagagggaccgcaaaacugcgaugguuugucgaacguaaccuggugaagcccgaaggcaaggugaucgaucucgggugcggaaggggcggcuggagcuauuauugcgcaggacugaagaaagucaccgaggugaagggcuacacgaaaggcggccccggccacgaggaaccaauaccgauggcgacuuacggcuggaaccucgugaagcuccacagcgggaaggacguguucuucauuccgcccgagaagugcgauacucugcuuugcgacauaggcgaauccaguccaaacccaaccaucgaagaggggcgcacucucagagugcugaagaugguggaacccuggcugcguggcaaccaguucugcaucaagauuuuaaacccuuauaugcccucgguuguagagacccuggaacagaugcagcguaaacacgguggcaugcugguuaggaacccgcucuccaggaacagcacacacgagauguauuggguguccuguggcaccgguaacaucguaucagcugucaacaugacgucccgcaugcuauuaaaucgcuucacgauggcccaccgcaagcccaccuacgagagagacgucgaccuaggcgcgggcacccggcauguggccguggaacccgaggucgccaaccuggacaucaucgggcaacggaucgagaacauuaagcacgaacacaaguccaccugguacuaugaugaggacaacccauacaagacgugggcguaucacgggagcuacgagguaaagccgagcgggagugccagcagcaugguaaacggcguuguaaaacuucugaccaagccgugggacgugaucccuauggugacccagaucgccaugacagacacuaccccguucggccagcaacgugucuucaaggagaaggucgacacccgaacaccaaaggccaaaagagguacagcacagaucauggaggugaccgcgaaguggcuguggggcuuccugucucgcaauaagaagccuagaaucuguacccgggaggaguucacaagaaaggugaggaguaacgcggccaucggggccguguucguggacgagaaucaauggaacucugcgaaagaagcgguagaggacgagagguucugggaccucguccacaaggagcgagaguuacacaaacagggcaaaugcgcgacgugcgucuauaacaugaugggaaagcgggaaaagaagcugggcgaguucgguaaagccaaaggcagcagagcgaucugguacauguggcucggugcuagauuucuggaguuugaggcgcuggguuucaugaacgaggaucacugguucucgcgagaaaacagcuucagcggcguugaaggggaaggacuccauaagcugggguauauacuacgggauaucagcaagaucccagggggcaacauguacgccgacgacaccgccggcugggauacccgcauuaccgaggaugaccuccagaacgaggcccggauaacugacaucauggagccggaacacgcgcugcuggccaagucaaucuuuaaacuuacguaccagaacaagguggucaggguucaacggccugccaagaaugggacaguuauggauguggugagccguagggaccagcggggcucggggcaggucggcaccuacggucuaaacacauucacuaauauggaggcccagcuaauucgccagauggaguccgagggcaucuucagucccagcgagcucgagacgcccaaucuggccgagcgaguacucgcauggcucgagaaguauggcguggaaaggcugaagcggauggccauauccggcgacgacugcgucgugaagccgaucgacgaccguuuugccacagcccugacggcauuaaacgacauggggaaggugcguaaggauaucccccagugggagccaagcaagggcuggaacgacuggcaacaggucccauucugcucccaccacuuccaccagcugaucaugaaggacggcagggagauagugguaccgugccggaaccaggacgagcugguugggcgcgcucggguaagccaaggcgcuggguggagccuccgcgagaccgccugccuaggcaaguccuacgcccagauguggcagcugauguacuuccacagacgcgaucuucggcuggcagcaaacgcgaucugcucugcaguucccgucaacuggaucccaacaucccgcaccacauggucaauacacgcucaccaccaguggaugacaacagaagacaugcuaaguguguggaacagaguguggauugaggagaaccccuggauggaggauaaaacccacaucucgucauggggcgacgugccguaccugggcaaacgcgaggaccaguggugcggcagccugauuggucuaacugcccgcgcgaccugggccacgaacauccaggucgccaucaaucaggugcggaagcuaaucggcaacgagaacuaccucgauuauaugaccuccaugaagcgcuucaagaacgagucugaucccgagggggcgcugugguga

SEQ ID NO: 23762 - RNA, 9879 nt, Artificial Sequence
  derived and/or modified CDS sequence (opt11) from DENV-1__JQ675358__SS-prME
ucagugaccaugcugcugauguuacugcccaccgcccucgccuuccaccugaccacccggggaggcgagccccacaugaucgugagcaagcaggagcggggcaagagccuccuguuuaagaccuccgccggggucaauaugugcacucugaucgccauggaccugggcgagcucugcgaggacaccaugaccuacaagugcccccagaucaccgaggccgagcccgacgacguggacugcugguguaacgccaccgacacgugggugaccuacgggaccugcagccagaccggcgagcaccggcgggacaaacgcuccguggcccuggcuccccacgugggccuggggcucgagacgcggacggagaccuggaugagcuccgagggagccuggaagcagauccagcgugucgagaccugggcgcugcggcaucccggcuucacgguaaucgcccuguuucucgcgcacgccaucgggaccagcaucacccagaaagggaucauuuuuauuuuacugaugcuugugacccccagcauggccaugcggugcgucggcaucgggaaccgggacuucguagaggggcugagcggcgccacuuggguggacgucgugcuggagcacggaucaugcgugacuaccauggccaagaacaaacccacccucgauaucgagcugcugaagacggaggucacuaaccccgcgauccuccgcaagcugugcauagaggccaaaaucucgaacaccaccacggacagccggugcccgacccagggcgaggccacccugguugaggagcaagacgccaacuucgugugucgucggacauucgucgaccgcggcugggggaacggcugcggccucuucgguaaggggagccugcucacgugcgccaaguucaagugcguuacuaagcucgagggcaaaaucguccaauacgagaaccugaaguacuccgucaucgugaccgugcacacuggcgaccagcaccagguggggaaugaaacuacagagcacgggacgaucgcuaccaucacaccccaggcccccacgagcgagauccaacugaccgacuauggggcucuaacccuggacugcagcccccggaccggccuggacuucaacgagauggugcuccugacgaugaaggaacgcagcuggcugguacacaagcagugguuccucgaucugccauugcccuggaccuccggggccagcacgagccaggagaccuggaaccggcaggaccuccuggugacuuuuaagacagcccacgcgaaaaagcaggaagucgucgugcuuggcucucaggagggggccaugcacaccgcucucaccggggccacggagauccagaccagcggcacaaccacaaucuucgcgggucaucugaagugccgccugaagauggacaaacucacccugaagggcaccuccuaugugauguguaccgggagcuucaaacuggagaaagaggucgcggagacgcagcacggaaccgugcugguccaagucaaauacgagggaaccgacgcacccugcaagaucccauucuccacccaggacgagaaaggggugacgcagaacggccggcucaucacggcuaacccgaucgugaccgacaaggagaagccggucaacaucgagaccgagccgcccuucggggaaagcuacaucgugguaggcgccggagagaaggcgcugaaacugucaugguucaagaaggggucaucaaucggcaagauguucgaggcaacggcccgcggggcccggcggauggcgauccucggcgacaccgcgugggacuucgggagcaucggcggcguguucacaaguguggggaagcuggugcaucaaguauucgggacggccuacggggugcuguucagcgggguguccuggacgaugaagaucggaaucggcauccuccugaccuggcugggcuuaaacagccgcuccaccagccugucaaugaccugcaucgcggucgggaugguuacgcuguaccucggcgugaugguccaggccgacucagggugcgugauaaacuggaagggccgggagcuuaagugcggguccgguaucuucgugaccaacgagguccacaccuggaccgagcaguacaaguuccaggccgacagcccgaagcgccugagcgcggccaucggcaaggccugggaggaaggggugugcggcauccgguccgcuacccgccucgagaacaucauguggaagcagaucagcaacgagcugaaccacauccugcuagagaacgacaugaaauucaccguugucgugggggacgccaacggaaucuuggcucagggaaagaagaugauucggccccaacccauggagcacaaguacuccuggaaguccuggggcaaggccaagaucauuggggccgauauccaaaacacgaccuucaucaucgacgggcccgacaccccggagugcccggacaaccaacgcgccuggaacauuugggagguggaggacuacggcuucgggaucuucacgaccaacaucuggcugaagcuccgggacuccuauacgcagaugugcgaccaccgccugaugagcgcggccaucaaggacuccaaggccguccaugcggacaugggcuacuggauugaaagcgagaagaacgagaccuggaagcucgcccgcgcguccuucauugaggugaagacgugcaccuggccuaagagccacacccucuggucuaacggugugcuggagagcgagaugaucauacccaagaccuacgggggaccgaucucccagcacaacuaccgacccggguauuucacgcagaccgccggccccuggcaccuggggaagcucgaauuagacuucgaccugugcgagggcaccaccgucgugguggacgaacacugcggcaaucgggggccgagccuccgcacgaccaccgucaccggcaagaucauccacgaauggugcugccggucaugcacgcugccgccucugcgcuuucgcggggaggacggcugcugguacgguauggagauccgccccgugaaggagaaggaggagaaccucgugcggagcaugguuuccgccggcagcggcgaaguggacagcuuuucccuggggauccugugcgcaagcaucaugauagaggagguaaugcgcucccgguggagccgcaagaugcugaugacuggcacucuggccgucuuccugcucuuaaucauggggcagcugaccuggaaugaccucauucgccugugcaucauggugggcgcgaacgccagcgaccggauggggaugggcacaaccuaccuggcccucauggccaccuucaagaugcgcccgauguucgccgugggccugcuguuccggcgccucaccagccgggagguccugcuauugacgaucgggcugucccugguggcgagcguggagcuccccaacucccuggaggaauugggcgacggucuagccaugggcaucaugaugcugaagcugcucaccgaguuccagccccaccagcuguggaccacccugcucagccugacguucaucaagaccacccugucccucgacuacgccuggaaaaccacggccauggcgcugagcauugucucccuguuuccccucugccuuagcaccaccucccaaaagaccaccuggcugccggugcuacugggcagcuucggguguaagccccugacaauguucuuaaucaccgagaacaagaucuggggccgaaaguccuggccccugaacgaagggaucauggccaucgguaucgucucccugcucuuauccagccugcucaagaacgacgugccccucgccgggccgcugaucgcuggcggcaugcucaucgccuguuacguuauuuccgguuccucugcggacuugucacuggagaaggccgccgaggucagcugggagcaggaggccgagcacuccgguaccagucauaacauccucguggaggugcaggaugacgggacaaugaaaauuaaggacgaggagcgggacgacacgcugaccauccugguaaaggcaacccucuuggcgguguccgggguguaccccaugucaauaccugccacccuguucgucugguacuucuggcagaagaagaagcagcgcuccggggugcuuugggacacgcccaguccacccgaggucgagcgggccguccuggaugacggcaucuaccgcauccugcaacggggccugcucgggcgcucccaagugggcgugggggucuuccaggacggcguguuccacaccauguggcacguaacccgcggggccguccugauguaccagggcaaacgacuugagcccagcugggccuccgugaaaaaggaccucaucagcuacggagggggcuggcgguuccaaggguccuggaauaccggcgaggaagugcaggucaucgccguggagccccgcaagaacccgaaaaacgugcagacgacccccgggaccuucaagacccccgagggcgagguaggcgccaucgcccuggacuucaagccagggacuucaggcuccccgauugucaaccgggaggggaagauugucgguuuguacggcaacggggucgugaccaccagcggcacguacguguccgcaaucgcccaggcgaaggccagccaggaggggccccucccggagaucgaggacgaggucuucaagaagcgaaaccugacgaucauggaccugcacccgggcagcgggaaaacacggcgcuaccucccugccaucgugcgggaggccaucaagcgcaaguugcgcacgcugauccucgcgcccacccggguggucgccuccgagauggccgaggcccugaaagggaugcccauccgcuaccagacgaccgccguaaaaagcgagcacaccggccgggagaucguggaccugaugugccacgcgacguucacgaugcgacuccuguccccgguccgggugcccaacuacaacaugaucaucauggacgaggcucacuucaccgauccagccagcaucgcggcccggggguacaucucaacccgggugggcaugggggaagcggccgccaucuucaugaccgcuacgcccccgggcagcgucgaggcguuuccccaguccaacgcggugauccaggacgaggagcgggacauccccgagcggagcuggaacaguggguacgacuggaucacggacuucccuggcaagaccguaugguucguaccaucgaucaaguccggcaaugacaucgccaacugccugcgcaagaacgggaagcgggucauccagcucagccgcaagaccuucgacacggaguaccagaagaccaagaacaacgacugggauuacguggucaccaccgacauauccgagaugggcgccaauuuccgggcagaccgcgugaucgauccgcggcgcugccugaagcccgugauucuaaaggacgggcccgagcggguuauccucgcuggcccgaugcccgugacgguugccagcgccgcccagcgccgggggcgcaucggccgcaaccagaacaaggagggagaccaguacgucuacauggggcagccccugaacaacgacgaggaccacgcccacuggaccgaggcgaagaugcugcucgacaacaucaacacccccgagggcaucaucccggcgcuguucgagcccgagagagaaaagagcgccgccaucgacggggaguaccggcugagaggggaggcccgcaagaccuucguggagcucaugcggcgcggggaccugcccgucuggcugagcuacaagguggcguccgagggcuuccaguauagcgaccggcgauggugcuucgacggcgagcggaacaaucaggugcucgaggaaaacauggacgucgagauauggaccaaggagggggagcgcaagaagcugcggccccgauggcuggacgcccggacguauuccgacccgcucgcccugcgcgaguucaaggaguucgccgcggggcggcgcagcgugagcggggaccugauccucgagaucggcaagcuaccgcagcaccugacacuccgagcgcagaacgcccuggacaaccuggugaugcuccacaacuccgagcaaggcgggaaggcguaucgucacgccauggaggaacugcccgacaccaucgagacgcugaugcucuuggcgcucaucgccguccucacgggcggggugacccuuuucuuccugagcggcaaggggcuaggaaagaccucaauaggccuguuaugcgugaccgccagcucagcccuccuuuggauggccagcgucgagccccauuggauugcggccuccauaaucuuagaguucuuucucauggugcugcugaucccggagcccgaccggcaacgcacgccccaggacaaccaacucgccuacguggucauagggcuacuguucaugauccucaccgucgccgccaacgagaugggccugcuggagaccaccaagaaggaccucggcaucggccacguggcggccgagaaccaccaacacgccacuaugcuggacgucgaccugcggccggccagcgccuggacccucuacgcgguggccaccaccgugaucacacccaugaugcgccacacuaucgagaacaccacggccaacauaagccugacggccaucgccaaccaggcggcgauccugaugggccucgacaagggcuggcccaucagcaagauggacaucggcgucccccugcuggcccucggguguuacucccaggugaacccgcugacccuaaccgccgcggugcucaugcuggucgcccacuacgccauaauuggccccggguuacaagccaaggccacccgcgaagcgcagaagagaacggccgccggcaucaugaagaaccccacgguggauggaaucguggccaucgaccucgaccccguuguguacgacaccaaguucgagaagcagcugggccagauuaugcuacucauccugugcacgagccagauccugcuaaugcgcacgaccugggcccugugcgagucgaucacccuggcgaccggaccgcucacgacccugugggaggggagccccggcaaguucuggaauaccacuaucgccguaucuauggccaacauauuccgggggagcuaucuggccggcgccggcuuagcguucucgcugaugaaauccgucggaggcgggcgccggggcaugggggcccagggcgagacgcuaggcgagaaguggaagcggcagcucaaucagcuguccaagagcgaguucaacaccuauaagcggagcgggaucauggaaguggaccgcuccgaggccaaagagggucugaagcguggggagaccaccaagcacgccgugagcaggggcaccgcgaaguugcggugguuugucgaacgcaaccuggugaagcccgaggggaaggugaucgaccugggcugcggcaggggcgggugguccuacuauugcgcaggccugaagaaggucacugaggugaagggguacacgaagggcgggcccggccacgaggagccaauccccauggcaacguacggguggaaccucgugaagcugcacagcggcaaggacgucuucuucaugccgccugagaagugcgauacacugcucugcgacaucggggaguccagccccaacccaacuaucgaggaagggcgcacccuacgggugcugaagaugguggagcccuggcuccgcgggaaccaguucugcaucaagauccugaaucccuacaugccauccguaguagaaacccuagagcagaugcagcggaagcacggcggcaugcucgugcgcaacccccugagccggaacuccacucacgagauguacugggucagcugcgggacgggcaacaucguguccgccguaaacaugaccagccgcauguuguugaaucgcuucaccauggcgcaccgcaagccuaccuacgagcgcgaugucgaccugggagcggguacgcggcacguggcuguggagcccgaggucgccaaccuggauaucaucggccagcgcauagagaacaucaagaacgagcacaaguccaccuggcacuacgacgaggacaacccguacaagaccugggccuaccacgggucuuacgaggugaagcccucuggcucagccuccagcauggugaacggggucgugcggcuccugacaaagcccugggacgucauacccaugguaacgcagaucgcgaugaccgacaccaccccguucggccagcagcgcguguucaaggagaaagucgacacgcggacgccucgcgccaaacgggggaccacccagaucauggaaguaacggccaaguggcuguggggcuuucucucacgcaacaagaagcccagaaucugcaccagggaggaguucacccggaaagugcgcagcaacgccgccauaggcgcggucuuuguggacgagaaccaguggaacagcgccaaggaggccguggaggaugagcgguucugggauuugguccaccgagaacgggaacugcacaagcagggaaagugcgcgaccuguguauacaacaugaugggcaagcgcgagaaaaagcucggggaguucggcaaggcgaagggcagccgggcuaucugguacauguggcugggcgccagguuccuggaguucgaggcccucggcuucaugaacgaggaccacugguucagccgggaaaauucccugagcggggucgaaggggaggggcugcacaaguuaggauauauccugcgcgauaucuccaagauccccggcgggaacauguacgccgacgacacggcugggugggacacucgcaucaccgaagacgaccugcagaacgaggccaagaucaccgacaucauggagcccgagcacgcccuccuggcgacgaguaucuucaagcugaccuaccaaaauaaggucguccgagugcagcguccugcaaagaaugggacgguaauggacgugaucucccggcgcgaccagcgaggcagcggccagguggggaccuacgggcuccacacguucaccaauauggagguccagcugaucaggcagauggaguccgaagggaucuuccugcccagcgagcucgagaccccgaaucuggcggagcggguccuggacuggcucgagaagcacggcgcugaacgccugaagcggauggcaauuuccggggaugacugcguggucaagcccauugacgaccgcuucgccaccgcuuugaccgcgcuuaaugacaugggcaagguucgcaaggacaucccccagugggagcccagcaagggauggaacgacuggcagcaaguaccauucuguucccaccacuuccaccagcuuaucaugaaggauggccgcgagauagucgugccgugucggaaccaggacgagcuggugggcagagcccgggucagccagggcgccggcuggucgcuccgcgagacggccugccugggcaagagcuacgcacaaauguggcagcugauguacuuccaccggcgcgaccuccgacuggcggccaaugccauuugcuccgccgugcccguggacuggguucccaccucacgcaccaccuggagcauccaugcgcaccaccaguggaugacgaccgaggacaugcuguccguguggaaccgcguguggaucgaggagaacccguggauggaagacaagacccacgucucauccugggaagaggugcccuacuuggggaagagagaagaccaguggugcgggagccugaucggccugaccgcccgcgccaccugggcuacaaacauccagguggccaucaaccagguccggcgccugaucgguaaugagaauuaccuggacuacaugaccuccaugaaacgguuuaagaacgagucagaccccgagggggcgcugugguag

SEQ ID NO: 23763 - RNA, 9879 nt, Artificial Sequence
  derived and/or modified CDS sequence (opt11) from DENV-1__FJ850070__SS-prME
agcgugacgaugcuauugaugcugcugcccaccgcccucgccuuucaccugaccacccgcggcggagaaccccacaugaucguuagcaaacaggagcggggcaagagccuccucuuuaagaccagcgugggcgugaacaugugcacccugaucgccauggaccugggcgagcucugcgaggacaccaugacauauaagugcccccgcaucacagaggccgagccggacgacguggacuguuggugcaacgccaccgacacgugggucacguacgguacuugcagccagaccggcgaacacaggagagacaagagguccguggcgcuggcgccccacguugggcuggggcucgagacccgcaccgaaaccuggauguccucugagggcgcguggaagcaaauucagaagguggagaccugggcgcugcggcaccccggguucaccgucaucgcucuguuccucgcccacgcgaucgguacaagcaucacccagaaggggaucaucuucauccugcugauguuagucacccccuccauggccaugcggugcguaggcauaggcaaccgagacuucguggaggggcugagcggcgcuaccugggucgacguagugcuggagcacggguccugugugaccaccauggccaagaacaagcccacgcuagacaucgagcuguugaagacggaggugacuaaccccgccguacucagaaaacugugcauugaggcgaaaaucagcaacaccaccacagacucgcggugucccacgcagggcgaggccacccugguugaggagcaggacgccaauuucguaugccgccggaccuuuguggaccgcggaugggggaacggcugcggccucuuugggaaggggagccuguuaacaugcgccaaguuuaagugugucaccaaguuggaggguaagauagugcaguacgagaaccugaaauacuccgugaucgucacaguacacaccggcgaccaacaucagguggggaacgaaacgacggagcacggcaccaucgccacaaucacgccccaagcgcccacgucggagauccagcugaccgacuacggggcgcucacucuggacugcuccccccggacaggccuggacuucaacgaaauggugcuccugacgaugaaggagaagucuuggcuggugcacaagcagugguuccucgaccuuccgcugcccuggaccuccggggccagcaccagccaggaaaccuggaaccgccaggaccuccuggucaccuucaagaccgcccacgcuaaaaagcaagagguagugguccuuggcucacaggaaggcgcaaugcacaccgcccucacgggggccacggaaauccagaccuccggcaccaccacgaucuucgcagggcaccucaaaugccggcugaagauggacaagcucacccugaagggcauguccuacgugaugugcacagggagcuucaagcuggagaaggaggucgcugagacucagcacgguacgguccugguccaggucaaauaugagggcaccgacgcacccugcaagaucccauuucuaacucaggacgagaagggggugacccagaauggccgucugaucacggcgaacccgaucgugacggacaaagagaagcccgugaauaucgaaaccgagccgcccuucggggaauccuacaucguggugggcgccggcgagaaagcccugaagcucagcugguucaagaagggguccagcaucggaaagauguuugaagcgaccgcccgcggggcgcgcagaauggcuaucuugggcgauacggcuugggacuucgggaguaucgguggccuguucaccucgguggggaagcucauccaccaggucuucggaacagcguacggggugcuguucucaggcgugagcuggaccaugaagaucgguaucgggauauuauugacguggcugggccuuaauagucgcagcacgucccucagcaugaccugcauagcagucgguauggugacccuguaccugggcgucaugguccaggccgacuccgggugcguuauaaacuggaagggcagagagcucaagugcgggagcggcaucuucgugacuaacgagguccacacauggacggagcaguacaaauuccaggccgacucaccgaagcggcucagcgccgcgaucggcaaggccugggaggaggguguuugcggcauccgcagcgccacccgguuagagaacaucauguggaagcagaucucaaacgagcucaacuacauacugcuggagaaugacaugaaauucaccguggucgugggagacgcaaacgguauacucgcccaggggaagaagaugauaagaccccagccaauggaacacaaauacucguggaaaucguggggcaaggcuaagaucauuggcgccgauauccagaacaccacuuucaucaucgacgggcccgauaccccggagugccccgacgaccagagggccuggaacaucugggagguggaggacuacggcuucgggaucuucaccacgaacauauggcugaagcugcgggacagccauacccagaugugcgaccaccgguuaaugucggcugcgauaaaggauagcaaggccguccaugccgacaugggcuauuggauugaauccgaaaaaaacgaaaccuggaagcuggccagagcuagcuucaucgaaguaaaaacgugcaucuggcccaagucccauacgcucugguccaacggcguccucgaguccgagaugaucauccccaagaucuacgggggcccgaucagccagcacaauuacaggcccgguuacuuuacccagaccgccggccccuggcaucuggguaaguuggagcucgacuucgaccugugcgagggcaccacggucgugguggaugagcacugcggcuaccgggguccuagucuccggaccaccaccguaacgggcaagauuauccacgaauggugcugucgaagcugcacccugccccccuuacgguuccgcggugaggacggcugcugguaugggauggaaaucagacccgucaaggaaaaggaggagaaccuggugcguuccauggucucagccggcucgggcgaaguggacagcuucucacuagguauacuguguguauccauucugaucgaagaggucaugcggagccgguggucacggaaaaugcugaugacaggcacccuggcgguguuccugcuccugaucaugggucagcuaaccuggaacgaucugauucgccugugcaucauggugggcgccaacgccagcgaccgcauggggaugggcacaacuuaccuugcccucauggccaccuucaagaugcggccgauguucgcggucgggcugcuguuccgccgguuaacgucccgcgagguacugcuguugaccaucggccugagccuaguggcguccguagagcugccgaacagccuggaggagcuaggcgacggguuggccaugggcaucaugaugcugaagcugcucaccgacuuccaaccccaccagcuguggaccacgcugcucucucugaccuucauccguacgagccuuuccuuggacuacgcguggaagaccauggccauggcgcugagcauuguguccuuguucccucucugccucagcacuacuucccagaagaccaccuggcugccgguacuccuagggagcuuuggguguaaaccccugacgauguuccucauuaccgagaauaagaucuggggucgcaaauccuggcccaucaacgaggggauuauggccgugggcaucgugagcauccugcuguccagcuugcugaagaacgacgucccacuggccgggccgcucaucgccggcggaaugcugaucgcuugcuacgugaucagcggguccuccgccgaccugucccucgaaaaggccgcggaggugagcugggaggaggaggccgagcacuccggcacuagucacaacauccuggucgaggugcaagacgacgggaccaugaagaucaaggacgaggaacgggacgacaccuuaaccauacuccugaaggccaccuuguuggcagccagcgguguguaccccaugagcauucccgcgaccuuguucgucugguauuucuggcagaaaaagaagcagcgcuccggagugcugugggacacccccagcccgcccgaaguggagcgggccguccuggacgauggcauauaccgcauccuccagcgcggauuacuggggcgcagucaggugggcgugggggucuuccaggacggcguguuccacaccauguggcacgugacccgcggggccguccucauguaccagggcaaacgucucgagcccagcugggccuccgugaagaaggacuuaauuagcuacggcgggggcuggcguuuucagggguccuggaacacaggcgaggaggugcaagucaucgcaguggagcccgggaagaacccgaaaaaugugcagacgacuccgggcacauucaaaaccccugagggcgaggucggggcgaucgcccuagacuuuaagccaggaaccagcgggucuccuaucgugaaccgcgaggguaagauugugggccuguacgggaacggugucgugacgacuagcggaaccuacguguccgcuauugcccaggccaaggcgagccaggagggucccuugcccgagauagaggacgaggucuucaaaaaacggaaccuuaccaucauggaccuacacccgggaaguggaaaaacgcgcagauaucugcccgccauagugcgcgaagcaaucaagagaaagcuccgcacccugauacuggccccuacccgcguagucgccuccgagauggccgaagcccuuaagggcaugcccauccgguaccagaccaccgcagucaagucugagcacacagggcgagagaucguagaccugaugugccacgccaccuucacgaugagacugcucucccccguccgcgugcccaacuacaacaugaucaucauggacgaggcgcacuuuacggacccagccaguauagccgcccggggcuacaucuccacccgcguugggaugggcgaggcugcggccaucuucaugaccgcuaccccaccagggagcgucgaagcguucccccaguccaaugccguuauucaagacgaggagcgggacauccccgagcguagcuggaacuccggcuaugacuggaucaccgacuuccccggcaagacggugugguucgucccuagcaucaaauccgggaacgacauagcgaacugucugcggaaaaauggcaagcgggugauccagcugagccgaaagaccuucgacaccgaguaccagaagacgaagaacaaugacugggauuaugugguuacuaccgauauuuccgagaugggcgccaacuuccgcgccgaccgggugaucgacccucgccggugccuaaagccuguuauccugaaagacggccccgagcgugucauacuggccgggccgaugcccguaaccgucgcgagcgccgcccagcggcggggccggaucggccgcaaccagaacaaggaaggggaccaguacaucuauaugggccagccccucaauaacgacgaggaccacgcccacuggacugaggccaagaugcuucuggauaacaucaacaccccagagggcaucaucccggccuuguuugagcccgagcgcgagaaguccgcugccaucgauggcgaguaccggcugcgcggggaagcccguaaaacguucgucgagcugaugcgccggggcgauuugcccgucugguugagcuacaaggucgccucugagggcuuccaguacagcgaccgccgguggugcuucgauggggagcgcaacaaccaagugcuggaggagaacauggacguggagaucuggaccaaggagggcgagagaaagaagcuccgcccccgguggcuggacgcgcgcacguacuccgacccgcuggcccuccgugaguucaaagaauucgccgccgggcggcgcagcgugagcggagaccugauacuggaaaucgguaagcucccccaacacuugacccugcgcgcucagaaugcgcucgacaaucugguaaugcugcauaacuccgagcagggcgggaaggccuaccggcaugccauggaggagcuccccgauaccaucgagacacugaugcugcucgcccugaucgccguacugaccgggggcgugacccucuuuuuccugagcgggaagggccugggaaagaccuccauagggcuccugugugugauggccaguagcgcccugcucuggauggcaucaguugagccccacuggauugccgcgucgaucauccuggaguucuuccugaugguguugcugauaccggagccugacaggcagcggacuccccaggacaaccagcuggccuacguggugauuggacuccuguucaugauccuaaccgucgccgccaaugagaugggguuacuggagacgacuaagaaagaucuuggcaucggucacguggccgcggagaaucaucaccacgcuaccauguuagacguagaccugcauccggcaagcgccuggacccuguacgccguugcgacgaccguaaucacccccaugaugcggcacaccauugagaacaccacggcaaauaucucccugacagccaucgccaaccaagccgcgauccugaugggccuggauaagggcuggccuauaucuaagauggacauagggguaccgcucuuggcacugggcugcuacucccaggugaacccgcucacccucacggcggccgugcugaugcugguagcacacuacgccaucaucggacccggcuuacaggccaaggcaacccgggaggcccagaaacgcacugcggccgggaucaugaagaacccgacagucgaugguaucgugacaaucgaccuagaccccguuguauacgacgcgaaguucgagaagcaacucggccagaucaugcugcucauccuaugcaccucccagauccuacuaaugcgcaccaccugggcccucugcgaguccaucacguuggccaccgggccgcugaccacuuugugggagggcagccccgggaaauucuggaacacgaccauagcugugucaauggcgaacauuuuccggggcagcuaccuggccggcgcggggcucgcguuuucguuaaugaagucgcugggcgguggccgcagggggaccggugcgcagggcgagacccugggggagaaguggaagcgccagcuuaaccagcuguccaagagcgaguucaacacguacaagaaguccggaaucauggagguagaccgguccgaagcgaaggaggggcuaaagcgcggcgagaccaccaagcacgcugucucacgggggaccgccaaguugagaugguuuguggaacggaaucucguaaaacccgagggcaaggucaucgacuuggguugcgggcgcggcggguggagcuacuacugcgccggccugaagaaggugacggaggugaaaggguacacaaaaggcggcccugggcacgaggagccgaucccaauggccacauacggcuggaaccuggucaagcugcauagcgggaaggauguguucuucacgcccccggaaaagugcgacacccugcuaugcgacaucggggaguccagcccgaaccccacgaucgaagaggggcggacccugagaguacugaagauggucgaacccuggcuucggggcaaccaauuuugcaucaagauccugaaucccuacaugccuuccgucguagagacucuggagcagaugcagcgcaagcacggcgggaugcucguccguaacccccugagccgcaacuccacacacgaaauguacugggugagcugcgguaccgguaacaucguuucggccgugaauaugaccucccggaugcuacucaaccgcuucaccauggcccaccggaagcccacauacgagcgggauguggaucugggcgccggcacgcgccacguggcugucgagcccgagguggccaaccuggauaucauagggcagcggaucgagaacaucaagaacgagcauaaguccaccuggcacuacgacgaggacaacccauacaagaccugggcguaccacggcagcuacgaggugaaguccagcggcuccgccagcuccaugguuaacggcguggugcgccuccugaccaaacccugggacguaauccccauggucacccagaucgccaugaccgauacgacuccguucggucagcagcggguuuucaaggagaagguggacacgaggaccccgcgggcaaagcgcggcaccgcacaaauuauggaggugaccgccaagugguuguggggcuuccucucccggaacaagaagccccgcauaugcacgagagaggaguucacccgcaaagugcggagcaaugcagcaaucggggcgguguuuguggacgagaaccaguggaacucagcaaaggaggccgucgaggacgagcgcuucugggaucuggugcacagggaacgcgagcugcacaaacagggcaagugcgcgaccugcguguauaacaugauggguaagcgggaaaagaagcucggugaguucggaaaagcgaaggggagccgcgccauuugguacauguggcugggggcccgguuccuggaguuugaggcccucggguucaugaacgaggaccacugguucagccgcgagaauucucugagcggcguugagggggaggggcugcauaagcucggguauauccugcgggacaucucaaagauccccggcgguaacauguacgccgacgacaccgcgggcugggacacacgcaucaccgaagacgaccugcagaacgaggccaagaucaccgacaucauggagccggagcacgcccuccuugccaccuccaucuucaagcucaccuaccagaauaaggugguaaggguccaacggcccgccaagagcggcacggugauggauguaauuagucgccgggaccagcgcgggagcggucagguuggcaccuacgggcucaacaccuuuacgaacauggaggugcagcugauacgacagauggaguccgaggggaucuucucaccauccgagcuggagacccccaaccuagcaaagaggguccuggacuggcuugaaaaacacggggcagagcggcucaagcggauggcgaucucgggcgaugacugugucguuaagccgaucgaugaccgguucgcuaccgcccugaccgcccugaacgauauggggaaggugcgaaaagacaucccccaaugggagcccucaaagggguggaacgacuggcaacagguacccuucugcagccaccacuuccaccagcucaucaugaaggacggcagagagauaguggugccgugcaggaaccaggacgagcuggucgggcgugcccgaguaucgcagggcgcaggguggagccugcgggagacagcgugccucggcaagagcuacgcacagauguggcagcugauguacuuccacagaagggacuuaagguuagcagccaacgccaucugcuccgcggugccugucgacuggguacccaccucuagaaccaccuggaguauccacgcgcaucaccaguggaugaccacggaggacaugcugagcguuuggaaccgcgucuggaucgaggaaaaucccuggauggaagacaagacccauguguccucuugggaggaggugccguaccuggggaagcgggaggaccagugguguggcucccucauaggccugaccgcgcgcgcgaccugggccacaaauauccaggucgccauuaaccaggugcgccggcugauagggaacgagaacuaccuugacuacaugaccagcaugaaacgcuucaagaacgaguccgaccccgaaggcgcgcuuugguga

SEQ ID NO: 23764 - RNA, 9879 nt, Artificial Sequence
  derived and/or modified CDS sequence (opt11) from DENV-1__FJ850071__SS-prME
aguguuaccaugcugcucaugcugcugcccaccgcccucgccuuccaccugacgacccggggcggggagccccacaugauaguguccaagcaggagaggggcaagagccuccuguucaagaccagcgugggggugaacaugugcacccugaucgccauggaccugggcgagcucugugaggacaccaugaccuacaagugcccccggauaaccgaggccgagcccgacgauguggauugcuggugcaacgccaccgacaccugggugaccuacgggaccugcagccagaccggcgaacaccgccgcgacaaacguucaguggcccuagcgccccacgucggccuggggcucgagacgcgcaccgagaccuggaugagcuccgagggcgcguggaagcagauccaaaagguggagaccugggcucugcggcaccccggguucacgguaaucgcccuguuccuagcccacgcgaucggcaccagcaucacccagaagggaauuaucuucauccugcugaugcucguaacccccuccauggccaugcgaugcgugggcaucggcaaccgggauuucguggaggggcugagcggcgcaacaugggucgacgucgugcuggagcacgggucaugcgucaccaccauggccaagaacaaacccacccucgacaucgagcugcugaagaccgaggugaccaaccccgccgugcuccgcaagcugugcaucgaggcuaagaucagcaacaccaccacggacagccggugcccgacccagggcgaggccacccuggucgaggagcaggacgccaacuucguuugccgccggaccuucguugaccgcggcugggggaauggcugcggccucuucggcaaggggagccugcugacgugcgccaaguucaagugcgucaccaagcucgaggggaagaucgugcaguacgagaaccugaaguacuccgugauagucaccgugcacaccggcgaccagcaccaggucgggaacgagacgaccgagcacggcaccaucgccaccaucacgccacaggcgcccacgagcgagauccagcugaccgacuacggggcccucacccuggacugcagcccccggaccggcuuagacuucaacgagauggugcuccugacaaugaaggagaaauccuggcuggugcacaagcagugguucuuggaccugccgcugcccuggaccuccggagccagcaccagccaggaaaccuggaaccgccaggaucuccuggucacauuuaagacggcccacgccaagaagcaggaaguggugguccugggcucucaggagggcgcgaugcacacagcccucaccggggccacggagauucagaccagcgggacaaccacgaucuucgcaggacaccugaaaugccggcugaaaauggacaaacucacccugaaggguaugaguuacgugauguguaccggaucuuucaaacuggaaaaggagguggccgagacccagcacggcacggugcugguccaggugaaauacgagggcaccgacgcgcccugcaaaaucccuuuccucacccaggaugagaagggggucacccagaacggccgcuugaucacggccaacccgauugugaccgauaaggaaaaacccguaaacaucgaaaccgagccgccauuuggggaguccuacaucgucgugggagccggcgagaaggcccugaagcucagcugguuuaagaagggguccagcaucgguaagauguucgaggcgaccgcccgcggggcccgcaggauggccauccugggcgacacggccugggacuucggguccaucggcggacuguuuaccagcguggggaaacucauccaccaggucuucggcaccgcguacgggguccuguucaguggcgugucauggacaaugaagaucgggauaggcauccugcucaccuggcugggccugaacagcagaaguaccucccucagcaugaccugcaucgccgucgggauggugacccuguaccugggcgugaugguccaggcagacuccgggugcgugaucaacuggaagggccgcgagcucaagugcggguccggcaucuucgugaccaacgagguccacaccuggacugagcaguacaaguuccaggccgacucgccgaagcgguuaagcgcggcgaucggcaaggccugggaggagggggugugcggcauccgcucugcgacccgacuggagaacauaauguggaagcagaucuccaacgaguuaaacuacauccugcuggagaaugacaugaaguucaccguggucgugggggaugccaacggcauccucgcccaagggaaaaagaugauccgcccccaacccauggaacacaaguacagcuggaagucauggggcaaagcgaagaucaucggcgccgacauccagaacacgaccuuuaucaucgacgggcccgacaccccggagugcccggaugaucagcgggccuggaacauuugggagguggaagacuacggcuuugggauauucacgaccaacaucuggcugaaacugcgcgacagccacacccaaaugugcgaccaccggcuuauguccgccgcaaucaaggacucgaaggccguccacgcugacaugggcuacuggaucgagagcgagaaaaacgagacauggaagcuggcacgcgccagcuucaucgagguuaagaccugcaucuggcccaagucccacacguuguggagcaacggcgugcucgaguccgagaugaucauccccaaaaucuacggaggcccgaucagccagcacaacuaccggcccggcuauuucacccagacagcgggccccuggcaccuggggaagcucgaacucgacuucgacuuaugcgaaggcaccacggucguggucgacgagcauugcggcuaccgcggcccgucccugcggaccaccaccgucacggguaagaucauucacgaguggugcugcagaagcugcacccuaccgccucugcgguuccgcggagaggacggcugcugguacgggauggaaaucaggccggugaaggagaaagaggagaaccuggugcgcuccauggugucagcaggcuccggcgagguggauagcuucucacucgggauccugugcgugucuauccugaucgaggaggucaugcggucacgcugguccaggaagaugcuaaugacgggcacucucgccguguuuuuucugcucaucauggggcagcugacguggaaugaccuuauccgccucugcaucauggugggcgccaaugccagcgaucgcaugggaaugggcaccaccuaccuggcccucauggcgaccuucaagaugcggccgauguucgccgucgggcuccucuuccgcaagcugacaucccgcgaggugcuccugcugaccaucgggcucagccuuguggccuccgucgagcugcccaacagucucgaggagcugggcgaugguuuagccaugggcaucaugaugcucaaacugcugacggacuuccagccccaccagcucuggaccacgcugcugucccucaccuucauccgcacuagcuugucccuggacuacgcguggaagacaauggccauggcccuuagcauugugucccuguucccccugugucucucgacgaccucccagaaaaccaccuggcugccggucuuacucggcagcuuuggaugcaaaccccugacgauguucuuaaucaccgagaauaagaucuggggcaggaagucguggcccaucaacgagggcaucauggcugucggcaucguguccauccugcuguccagccugcucaagaacgacgucccccuggcggggccccugaucgccggcggcaugcucaucgccugcuacgugaucagcggguccagugcggaccuuagucuggagaaggccgcagaggugagcugggaggaggaagccgagcacuccggcaccagccacaacauccuuguugagguccaggacgacgguaccaugaagaucaaggacgaggagcgcgacgauacccugacgauccuacucaaagccacccugcuggccguguccggcguuuaucccaugaguauccccgcuacccucuucgugugguauuucuggcagaagaagaagcagcgguccggggugcugugggacacacccagcccgcccgaggucgagcgcgcgguacuggacgauggcaucuaccguauccugcagcguggccuccuggggcggagucaggugggcgucgggguguuccaagacggcguguuccacacgauguggcacgucacgcgcggggccguguugauguaccagggcaagcggcucgagcccagcugggccuccgugaagaaggaccucaucagcuacggcgggggcuggcgcuuccaaggguccuggaacaccggcgaggagguccaagugaucgccguggagcccgggaagaacccgaagaacguccagacgacgcccggcaccuucaagacccccgagggcgaagugggggccaucgcgcuggacuucaagcccggcaccagcgggagcccaaucgugaaccgugaggguaaaauugucggccucuacgggaacggcguggugacgaccagcgggaccuacgucuccgcuauagcccaggccaaggccagccaggagggcccccugcccgagaucgaggacgagguguucaagaagaggaaucuuaccaucauggaccuccacccggggagcgguaagacucggcgcuaccugcccgcgaucgugcgggaggccauuaagcggaagcugcggacccucaucuuagccccgacacgcgucguggccuccgagauggcggaggcccugaagggcaugcccauacgcuaccagaccaccgccgucaagucagagcacaccgggcgagagaucgucgaccucaugugccacgccaccuucacaaugcgccugcuguccccggugcgggugcccaacuacaacaugaucaucauggacgaggcccacuucacggaccccgcgucgauugccgcccgcggcuacauauccacuagagucgggaugggcgaggccgccgcgaucuucaugacggccacgccgcccgggagcguggaggccuucccccaaucgaacgccgugauccaggacgaggaacgggacauccccgagcgaagcuggaacuccggcuacgacuggauaacugacuucccgggcaagaccgucugguucgugcccagcauaaaguccgggaacgacaucgccaacugccuccgcaagaauggcaaacgggugauccaacugagucgcaagaccuucgacaccgaguaccagaagacgaagaauaaugacugggacuacgucguaaccaccgauaucuccgagaugggagcgaacuuccgggcagaccgcgucaucgacccccggagaugccugaagcccgucaucuuaaaggacggccccgaacgggugauccuggccgggccgaugcccgugacagucgcaagcgcggcccagagacggggccgcauagggcggaaccagaacaaggagggugaccaguauauuuacaugggccagccacugaacaacgacgaggaucacgcccacuggaccgaggcaaagauguugcuggacaacaucaacacccccgaagggaucaucccggcacuguuugagcccgagcgcgagaaguccgcggcgaucgacggcgaguacaggcuccgcggggaggcccgcaagaccuucguggagcugaugcggcgcggagacuuacccgucuggcucuccuacaagguggccuccgaaggguuccaguacagcgaccggcgguggugcuucgacggggagcggaacaaccaagugcuggaggagaacauggacguugagaucuggaccaaggagggcgaacgcaagaagcugcggccccguuggcucgacgcccgcacguacuccgacccgcuggcgcugcgcgaguucaaggaguucgcugccgggcggagaagcgugagcggcgaccucauccuggagaucggcaaacugccccagcaccucacucuccgggcccaaaacgcccuggacaaccucgugaugcugcacaacuccgagcagggcgggaaggcguaucgccaugccauggaggagcugcccgauaccauugagacccucaugcugcuggccuugaucgcgguauuaacagggggcgugacgcuguucuuccucucggggaagggccugggcaaaaccuccauagggcugcucugcgugauggccuccuccgcgcugcuguggauggcgagugucgagccccacuggaucgccgccuccaucauacuagaguucuuucugaugguucugcuuaucccggagcccgaccggcagagaacuccccaggacaaccagcuggcguacguggucaucggccuccucuucaugauccugaccguggccgccaacgagauggggcugcucgagacgacgaagaaggaccugggcaucgggcacguggccgccgagaaccaccaccacgcuaccaugcuugacguagaccugcggccggccagcgcguggacccuguacgccguggcuacgacagugaucacccccaugaugcgccacacaaucgagaacacgacugcgaacaucucccugaccgccaucgcgaaccaggcggcuauccucaugggccuggacaagggauggcccaucagcaagauggacaucggggucccccugcucgcgcugggcugcuacucccaggucaacccccuuacccucacggccgccgugcugaugcuggucgcucacuacgcgaucaucggucccggccuccaagccaaggccacccgggaggcccagaaacgcacagccgcggggaucaugaagaaccccaccguggauggcaucgugacuaucgaccuggaccccguaguguacgacgccaaguucgaaaagcagcugggccagaucaugcuccugauccuguguaccagccagauccuccugaugaggaccacuugggcccugugcgaguccaucacgcuggccaccgggccgcugaccaccuuaugggagggaagccccgguaaguucuggaacacgaccaucgccguguccauggcgaacauuuucagagggagcuaucucgccggcgccgggcuggccuucucccuaaugaagucccucggcgggggccgccgcgggacuggcgcccagggcgagaccuuaggggagaaguggaagcgccaacugaaccagcucuccaagagcgaauuuaacacguacaagaaguccggcaucauggaggucgaccggucugaggcgaaagaggggcugaagcgcggcgagaccaccaagcacgccgugagccgggggaccgccaaacugcgcugguucguggagcggaaccuggucaagcccgagggcaagguuauagauuuaggaugcgggcgcggcgggugguccuacuacugcgccggccugaagaagguuacggagguuaagggcuauaccaagggcggccccgggcacgaagagccgauccccauggcgaccuacggcuggaaccuggugaagcuccacucagggaaggacguguuuuucacaccccccgagaagugcgacacccugcugugcgacaucggcgagucuucgccgaaccccacuaucgaggaggggcgcacccuccgcguccuaaagaugguagagccuuggcugcgggguaaccaguuuugcaucaagaucuugaaccccuauaugccauccgugguagagacccuggagcagaugcagcgcaagcacggcgguaugcuggugcggaacccccucucucgcaacuccacccacgagauguauugggugagcugcggcacugggaacaucgucuccgcgguuaacaugaccucucggaugcugcugaaccgcuucaccauggcgcaccggaagcccacuuacgagcgagacguggaccugggggccggcacgcgccacgucgccguggaacccgaaguggcgaaccuggacaucaucggccaacgaaucgagaacaucaagaacgagcacaagagcacuuggcacuacgacgaggacaacccguacaagacaugggcauaccacggcuccuacgaggucaagcccuccgggucagccuccucgauggugaacgggguggugaggcugcucaccaagccuugggacgugauucccauggucacgcagaucgcuaugaccgacaccaccccuuucgggcagcagcgggucuucaaagaaaagguagacacgcgcacgccccgcgccaagcgcggcaccgcacagaucauggaagucacugccaaguggcuguggggcuuccugucccggaacaagaagccaagaaucugcacacgggaggaguucacccgcaagguacggagcaacgccgccaucggagcuguguucgucgacgagaaccaguggaauagcgccaaggaggccguggaggacgagcgcuucugggaucuugugcaccgggagcgcgaacugcacaagcagggcaaaugcgcgaccugcgucuacaacaugauggggaagcgggaaaagaagcuuggcgaguucgggaaggccaagggcucacgugcgaucugguacauguggcuaggcgcccguuuccuggaguuugaggcccugggcuucaugaacgaggaccacugguucagccgcgagaacucccucagcggcguggagggggagggccugcacaagcucggguacauccuccgggacaucuccaagaucccgggcggcaacauguacgccgacgacaccgccgggugggacacgcgcaucaccgaggacgaccugcagaacgaggcuaagaucacggacaucauggagcccgaacaugcccugcucgcuaccagcaucuucaagcugacguaccagaacaagguaguacgggugcagcgccccgccaaguccggcacggugauggacgucaucucgcgccgggaucaacgcggguccggccaggugggcacauacgggcugaauaccuucaccaacauggaggugcagcucauccggcagauggagagugagggcaucuucucccccagcgagcucgagaccccgaaucuggccaagcgcguucucgauuggcuggagaagcacggcgcggagcggcugaagcgcauggccaucuccggcgacgacugcguggucaagcccaucgacgaucgguuugccaccgcacucaccgccuuaaacgauauggggaagguccgcaaggauaucccccagugggagcccagcaagggcuggaacgacuggcagcaggucccguucugcagccaccacuuccaccagcugaucaugaaggacggccgggaaaucguggucccuugccgcaaucaggacgagcucguggggcgggcgagggugagccaaggugccggguggucccugcgggagaccgccugucuggguaagagcuaugcccagauguggcagcuuauguacuuccaccgccgggacuugcgacuugcugcgaacgccaucugcagcgccguccccgucgauugggugcccaccucgcggaccaccuggaguauccacgcccaccaccaguggaugaccacggaagauaugcucuccgucuggaacaggguguggauugaggagaacccguggauggaggacaagacccacgucagcuccugggaagagguccccuaccuggggaagcgggaggaccaguggugcggcagccugaucggccucaccgcgagagccaccugggccacgaacauccagguggccaucaaccagguacgccggcugaucgggaacgagaacuaccuugacuacaugaccuccaugaagcgcuucaagaacgagagcgaccccgagggcgcccucugguga

SEQ ID NO: 23765 - RNA, 9879 nt, Artificial Sequence
  derived and/or modified CDS sequence (opt11) from DENV-1__FJ850073__SS-prME
uccguaacgaugcuucucauguuacugcccacugcgcucgcguuccaucugacuacacggggaggggaaccccacaugaucgucucgaaacaagagagggggaaaaguuuacucuucaaaaccuccgcgggagugaauaugugcacgcugauugcgauggaccugggagagcuuugcgaggacacuaugacguauaaauguccccggauaaccgaggcggagcccgacgaugucgacugcuggugcaacgccaccgacacaugggucaccuacgggaccugcucccagaccggagagcaucggcgggacaagcgguccguggcccuggccccgcacguuggccugggcuuagaaacaaggacugagacuuggaugagcuccgagggcgccuggaagcagauccagaaggucgagacuugggcccuuaggcaucccggguucacaguaaucgcccuguuucucgcgcaugccaucgguaccagcauaacccagaagggcauuauuuucauccuuuugaugcucgugacacccuccauggcuaugcgcugcgucggcauuggcaacagagauuucguugaaggucugagcggugccacguggguggacgucgucuuagagcacggguccugcguaacaaccauggcgaagaauaagcccacuuuggacauagagcugcugaagacggaggucaccaaccccgcaguuuugcgcaagcugugcaucgaggcgaagaucaguaacacgacaaccgauucucguugcccaacacagggugaagccacccugguagaggagcaggacgcgaacuucgucugccgccgcaccuucguggauagggguuggggcaacggcugcgggcuuuuuggcaaagggucacuguuaacuugcgccaaauuuaagugugugaccaagcucgaggguaagaucguccaguacgagaaccugaaguauuccguaauagugacagugcacaccggagaccagcaccaaguggggaacgagacuaccgaacacggcaccaucgcgaccaucacgccacaggcgcccacgagugagauccaacugaccgacuauggcgcccugacacuagacuguagcccgcgcacaggacuagacuucaacgagaugguacuacugacgaugaaagagaagucguggcuggugcauaagcagugguuccucgaccugccuuugccuuggaccuccggggccuccaccagucaggaaaccuggaauaggcaagaucuccugguuacauucaagacagcccacgcgaagaagcaggaggugguagugcucgggagccaggagggcgcuaugcauacugcacucaccggggccacugagauucagacauccgguaccacaaccaucuucgcggggcaucugaaaugucggcugaaaauggauaaguuaacacugaagggcacuuccuaugucauguguaccggcagcuucaagcuggaaaaggagguagccgagacgcaacacggcacggugcugguucaggugaaguacgaaggcaccgaugcuccgugcaagaucccuuuuuccacccaggacgagaagggggucacgcagaacggccgacucaucaccgcuaacccgauagucaccgauaaggaaaagccagugaacaucgaaaccgaaccgcccuucggagagagcuacauuguggugggagccggcgagaaggcacugaagcucuccugguucaaaaaggggucuucgaucgguaagauguucgaggccacagcgcgcggggcucgccguauggccauccuaggugauacagcuugggacuuuggcagcauaggcgggguguucacguccgugggaaagcugguccaccaggucuuugguacugccuacggcgugcuguucaguggaguguccuggacgaugaaaauagggaucgguauacuccugaccuggcugggccuaaauucgcgcucgacgagccuauccaugacaugcaucgccguugggaugguaacgcuguaucucggagucaugguacaggccgacagcgguuguguaaucaauuggaaaggccgcgaguuaaagugcggaucagguaucuuugucacaaacgagguccauaccuggaccgaacaauacaaguuucaagcggauagcccaaagagacucagugccgccaucggccgcgccugggaggaaggcguguguggcauucggagugcaacgcggcucgagaauauaauguggaaacaaaucagcaacgaacuaaaccacauacugcucgaaaacgacauuaaauucacggucguaguagggaacgcugacggcauccuugcucaagggaagaagaugauacggccacagccuauggagcacaaguauucauggaaaagcugggggaaggccaaaaucaucggcgccgacauccagaauacaacguucauuaucgacggccccgacaccuuagagugccccgacgagcagcgugcuuggaacauuugggaagucgaggacuacggauucgggaucuuuacgaccaacauuuggcuaaagcugcgggauagcuacacgcaaaugugcgaccaccggcugaugagcgcagccauaaaggacuccaaggccgugcaugccgacauggguuacuggaucgaguccgagaagaaugagacuuggaagcuggcccgcgcauccuuuauagaagugaagacauguauuuggccgaagucucacacccugugguccaacgggguccuggagagcgagaugaucauacccaaaauguauggagggccggugucacagcacaacuaccggccaggcuacuucacccagaccgccggucccuggcaucucgguaaacuugaguuagauuucgaccucugcgagggaacgaccgucgucguugacgagcacuguggcucgcggggucccucgcuacgcaccacgacagugacggggaagauaauacaugaguggugcugccggagcuguacccugccgccccuucgauuccggggagaggacggcugcugguacggcauggaaaucagacccgucaaggagaaggaagagaauuuggugcgcucuaugguuucagcggguucuggcgaggucgacaguuuuagccuuggggugcuaugcguuuccaucaugauagaagaggugaugaggaguagguggucacgcaaaaugcugaugacggggacgcuugcuguauuccuccugcuuauuauggggcaacuaaccuggaacgauuugauccgccuuugcaucauggugggcgccaacgcaagcgacaagauggggaugggcaccacauaccucgcacucauggcgacguuuaagaugcggcccauguuugccguuggacuacucuucaggcggcugaccagucgggaggugcucuuacucaccaucggcuugagcuuagucgccaguguagagcugccaaauagcuuggaggagcucggcgacgggcuugcaaugggaaucaugaugcugaaguuacugaccgaauuucagccgcaccaguuguggacgacucuccugucguugaccuucaucaagaccacacucucacuggacuacgcuuggaagacgacggcgauggugcucucgaucgucucucucuuuccgcugugccugucaaccacuucgcagaagacaacaugguuacccgugcugcugggcuccuucgggugcaagccgcucaccauguuucuaaucaccgagaacgagaucuggggcaggaaaaguuggccauugaacgaaggcaucauggcuaucgggauaguuuccauccuccucagcuccuuacuuaagaacgacgucccucuagcugguccacuuaucgccggagggaugcuuaucgccuguuaugugaucuccgguucguccgcagaccuaagccuggagaaggcagcggagguuuccugggaggaagagguggaacauagcggaacgucccauaacauccucguggaagugcaggacgacgggacgaugaagaucaaggaugaggagcgagacgacacccugaccauucuacucaaggccacgcugcucgccguuagcggagucuacccgauguccauaccggccaccuuauucgugugguacuuuuggcagaagaaaaagcaacggucggggguccugugggacacaccgagcccucccgagguugagcgcgcggucuuggacgacggcaucuaccggaucuuacagaggggucuccugggccggucucaagucggcguggggguguuccaagacggagucuuccacaccauguggcacgucacgcgcggggcugugcucauguaccagggcaagcgacucgaaccauccugggccuccgucaagaaggaccuuaucuccuacggagggggcuggcgcuuucaggggucauggaacacuggagaggaaguccaggugaucgccguugagcccgggaaaaaccccaagaacguucagacuaccccugguacauucaaaacgcccgaaggggagguuggcgcuauagcguuggauuucaagccggggacaagcgggagccccauugucaaccgggagggaaagauagugggccuauacgguaacggcgucguaacgacguccgggaccuacguuagcgcuaucgcucaggccaaggcgucccaagagggcccucugccugagaucgaagaugaaguguucaagaaaaggaaccugaccauuauggaucuucacccaggguccgguaagacaaggcgauaccugccggcuaucgugcgggaggcgaucaagcguaagcugcggacacugauccuggcacccacacgcguaguagcauccgaaauggcggaagcgcucaagggaaugccuauucgcuaccaaaccacugccgucaaguccgagcacacuggacgggaaaucguagaccucaugugucaugcuacguuuaccaugcggcuuuuaucccccguccgaguuccgaacuacaauaugaucauaauggacgaggcccacuucaccgaccccgccucgauagccgcccguggcuacaucagcacgcguguggggaugggcgaggccgcggcgauauuuaugacugcgacucccccugggaguguggaggcguucccucagagcaaugccguuauucaggaugaagaacgggacauccccgagcggucauggaacucaggcuacgacuggaucacagacuucccgggaaagacggucugguucgugcccagcaucaaaucgggcaaugacauagccaacugccucagaaagaaugguaaaagagucauccaacucucccgcaagacguucgacacagaguaucagaaaaccaaaaauaacgacugggacuacguggucacgaccgauauaagcgagaugggagccaauuuccgagcugaucgugucaucgauccucggagauguuugaaacccguuauccuuaaggauggaccagagcgggugauccuggccgggccuaugccggucaccguggcuucggcugcacaaagaagggggcggaucgggcggaaucagaacaaagagggagaucaguacgucuacaugggacagccgcugaacaacgaugaggaccaugcccacuggaccgaagccaagaugcuucuggauaauaucaacacgccagaggggauaauaccagcacucuucgagccugagcgcgaaaaguccgcagcgaucgacggagaguaucgccucagaggggaagccaggaagaccuuuguggagcugaugcggagaggggacuuaccaguuuggcugucauacaaggucgccagcgagggcuuucaauacucugacagacgauggugcuucgacggggagcggaacaaccaaguuuuagaagagaacauggacguggagauuuggaccaaggagggcgaaagaaagaagcuaaggccccgcuggcucgacgcccggacauacagcgauccccucgccuugcgcgaguuuaaggaguucgcugcagggcgucgaagcgucuccggggacuugauucuggagaucggcaagcucccgcagcacuugacauugcgggcccagaacgcgcuggacaacuugguuaugcugcacaauucugagcagggcggcaaggcauaccgccacgcuauggaggagcugccagauacuaucgagacucucaugcuccuggcacucauggccgugcugacagggggugugacacuguucuucuuguccgggaagggcuugggaaagacgagcaucggacuacucugcguaauggccagcagcgcccuccuauggauggcauccguugaaccgcacuggauagcagccagcaucaucuuggaguuuuuccugauggugcuccucauucccgaaccggaucgccaacgcacgccccaagacaaucagcucgccuacgugguaaucgggcuccuuuuuaugauccuuacugucgcugcgaacgaaauggggcugcuugagacaaccaaaaaggaccugggcauugggcacguagccgcggagaaccaucagcacgccaccauguuagacguggaccuccacccugcuuccgccuggacccuguacgcaguggccacuacaguaaucaccccuaugaugcggcauacgauugaaaauacgacggcgaacaucucucugacggccauagcuaaccaggcagcaauucucaugggccuagacaaggguuggccaaucaguaagauggaccugggggugccccuucucgcccucggauguuacucccaaguuaacccccuaacgcugaccgccgccguguugaugcucgucgcccauuacgccauaauaggcccaggccuccaggcgaaggcuacgcgggaggcucagaagaggaccgccgccgguaucaugaaaaaccccacggucgacggcauaguagccaucgaccuagaccccguggucuacgacgcuaaauucgaaaagcagcucggccagaucaugcugcucauccuuuguaccucacagauccugcuaaugcgcacuaccugggcacugugcgaauccaucacgcucgcuacugggccucuaacaaccuugugggaaggaucuccggggaaauucuggaauaccacaaucgcugugucaauggcgaauaucuucaggggauccuaccuggcuggcgcagggcucgcguuuagcuuaaugaagucguuaggcgggggucgccgcgggaccggcgcucagggggaaacucugggggagaaauggaagagacagcucaaccaauuaagcaagagcgaguuuaauaccuacaagcgcuccggcaucauggaggucgacagaagcgaggccaaggagggccugaaacgcggcgagacuacgaagcacgcagucucccgaggaaccgccaaacuacgcugguucguagaaaggaaccucgugaagcccgagggcaaagucaucgaccuggguugugggcgcggagguugguccuacuacugcgccggccugaagaaggucacugaagucaaaggcuacaccaaaggaggucccgggcacgaggagcccauccccauggcaacguacggcuggaaccucgucaaacuccacagcggaaaggauguguucuucaugccaccggagaagugugacacgcuccucugcgauauuggcgaguccucaccaaacccgaccauugaggagggccggaccuuacgagucuugaagauggucgaacccugguuacggggaaaccaauuuuguaucaaaauccugaaccccuacaugcccucugugguggagacccucgaacagaugcagcgcaagcacgguggcaugcuaguccggaacccguugucacgcaacagcacucacgagauguauugggucuccuguggcaccgggaauaucgugucugcagugaauaugacaagcagaaugcuacucaaccgcuucacuauggcgcaucgaaagcccacguacgagagggauguagaccugggagcgggaacacgacacguggccguugaacccgaggucgcgaaccuggacaucaucgggcaacggauagaaaacaucaagaacgaacauaaauccaccuggcacuacgacgaagacaaccccuacaagacuugggccuaccacggaucauacgaagucaaacccucgggcucugcuaguuccauggugaacggugugguccgacugcuaacaaagccuugggauguaauuccaauggugacucagaucgccaugacggacaccacaccauuugggcaacagcggguauucaaggaaaaaguggacacccgcaccccgcgggcaaagagaggcacugcucaaauaauggaggugaccgcaaaguggcuguggggcuuccucucccggaacaaaaagccccgaaucugcacccgggaggaguucaccaggaagguaagauccaaugcugcuauuggggcaguguucguggacgagaaccaguggaauagcgcuaaggaggcggucgaggaugagcgcuuuugggacuuaguccaccgugagcgcgagcugcauaaacaggggaagugugccacuuguguguacaacaugaugggaaaacgugaaaagaagcucggugaguucgggaaggcgaagggcagccgugcgaucugguauauguggcugggggcccgguuccuggaguuugaggcccucggguucaugaacgaggaccacugguucucgcgcgagaauagccugaguggcgucgagggagagggucugcacaagcugggguauauauugcgggauauuucaaagauacccggcggcaauauguacgcggaugacacggcggguugggacacaaggaucaccgaggacgaccugcgcaacgaagcaaagauaaccgacaucauggagccggagcaugcguuauuagccacgucgaucuucaaguuaacguaccagaacaaggugguaaggguucaacgccccgcuaagaacggaaccgugauggauguuaucucuagacgcgaucagcgggggucuggccagguggggaccuauggguuaaacaccuucacaaauauggagguucaauugaucaggcaaauggaaagugaggguaucuucuucucgagcgagcuagagagccccaaccucgcggaacgggugcuggacuggcuggagaagcauggggcugagcgguugaagcggauggcuaucucaggugacgacugcguagugaaaccgaucgaugaucgcuucgcgacggcccugauugccuugaacgacauggggaaggugaggaaagacaucccgcaaugggagcccuccaagggcuggaacgacuggcaacaggucccauuuugcucucaccacuuccaccagcucaucaugaaggacggacgcgaaaucguagugcccugccgaaaucaagacgagcugguuggacgcgcgcgggugagccaaggugcuggcuggaguuugcgcgaaacagcaugcuugggcaagagcuaugcccaaauguggcagcucauguacuuucaucggcgagaccugcggcuugccgcgaacgcuauaugcuccgcagugccggucgauugggugccaacaucgcgaacuaccuggucgauccaugcgcaccaccaguggaugaccaccgaggacauguuaagcguguggaacagggucuggaucgaagaaaaccccuggauggaagauaagacgcacguuagcagcugggaggaggugcccuauuugggaaaaagggaagaucaguggugcggcucccucaucggucugacugcgagggcgacaugggcaaccaacauccaagucgcuaucaaccaagugaggcgccugaucgggaauggcaacuaucuagacuacaugacgaguaugaaacgguuuaaaaaugaauccgacccggaaggggcccugugguag

SEQ ID NO: 23766 - RNA, 9879 nt, Artificial Sequence
  derived and/or modified CDS sequence (opt11) from DENV-1__FJ850075__SS-prME
agcguaacuaugcugcucaugcugcuacccaccgcccuugccuuccaccucaccacaaggggcggggaaccgcacaugauagugucgaagcaagaacggggcaagagccuucuauucaagacuagcguaggggugaacauguguacccugaucgccauggaccuuggagagcucugugaggacaccaugaccuauaaaugcccccguaucaccgaggcugaacccgacgacguggacugcuggugcaacgccaccgacaccuggguuaccuacgggaccugcagccaaaccggcgagcaccggcgggacaagcgguccguggcccuggcgccccacgucggccuugggcucgaaacucgcaccgagacuuggaugagcuccgagggcgccuggaagcagauccagaagguggagaccugggcccugcggcacccuggguuuacugugauugcccuguuucuugcccacgccaucggcaccucgaucacgcagaaggggauuaucuuuauccugcugauguuagugacucccuccauggccaugcgcugcgugggcauaggcaaccgcgacuucguggaagggcugagcggcgccacgugggucgacguggugcuggagcacggcucuugugucacaaccauggcgaagaacaagccgacccucgacaucgagcugcugaagacggaggugaccaaccccgcggugcuccgaaagcuguguaucgaggcaaagaucagcaauaccaccacugacucucggugccccacccagggcgaggcaacgcuaguggaggagcaggacgccaacuucgugugucgccggaccuucguggaucgcggcugggguaacggcugugggcuauucggcaaagggagccugcugacgugcgccaaguucaagugcgucaccaagcucgaaggcaagauaguucaguaugaaaaccucaaguacuccgugauugucaccguccacaccggcgaccaacaccaaguugggaacgagacgaccgaacacggaaccaucgccaccaucacuccgcaggcgcccacgagcgagauccaguuaaccgacuacggagcacuaacgcuggacugcagccccaggaccggccucgacuucaacgagaugguccuccugacgaugaaggagaaguccuggcuggugcacaagcagugguuccucgaccuuccgcugcccuggaccucgggggcuagcaccagccaagagaccuggaaccgccaggaccuccugguaacguucaaaaccgcccacgccaagaaacaggagguggugguguuaggcucccaagagggagcgaugcacaccgcccucacuggagccacugagauccagaccagcgggaccaccacgaucuucgccgggcaccugaagugccggcugaagauggacaagcucacccugaaggggauguccuacguaaugugcaccgggagcuuuaagcuggagaaagagguggccgagacccagcacggcacgguccuuguccaggucaaguacgagggcaccgacgcgcccugcaagauaccguucuugacccaggaugagaaaggaguuacacaaaaugggcgcuuaaucaccgccaacccgaucgucaccgacaaggagaagcccgucaacauugaaaccgagccgccguucggggaauccuacaucgucgugggugccggcgaaaaggcccugaagcucucaugguucaagaagggcuccagcaucggcaagauguucgaggcgaccgcucgcggggcacggcggauggccauccuuggcgauacggccugggacuucggguccaucggcggcuuguuuaccagcgucgguaaacucauccaccaggucuuugguacggcguacggggugcuauucuccggcguguccuggaccaugaagaucgguaucggcaucuugcugacguggcugggccugaacuccaggagcaccuccuugagcaugaccugcauugccgucgggauggugacucuguacuuaggggugaugguccaagcggacuccgggugcgugaucaacuggaagggccgcgaauugaagugugggagcggaaucuucgugacgaaugagguccacaccuggaccgagcaguacaaguuccaagccgacucgccgaagcggcugagcgccgcgaucggcaaggccugggaggagggugugugcggcauccgcagcgccacccgccuggaaaacaucauguggaaacaaaucuccaaugaacucaacuacauacugcuggaaaacgacaugaaguucaccguggucgugggggacgcgaacggcauccucgcccaggggaaaaagaugauccgcccccagcccauggagcacaaguacagcuggaaguccuggggcaaggcgaagaucaucggagcugauauacagaacacgaccuucaucauagacgggccggacaccccugagugccccgacgaccagcgggccuggaacaucugggagguggaggacuauggcuucggcaucuuuaccacgaacaucuggcuaaaacugagagauagccacacccagaugugugaccaccgacucaugagcgccgcgauaaaggacagcaaggccguccaugccgacaugggcuacuggaucgagucggagaagaacgagaccuggaaacuggcccgcgccuccuucaucgaggugaagaccugcaucuggccgaaaucccacacgcuauggagcaacggcgugcuggagagugagaugaucaucccaaagauauacggaggcccgaucagccagcacaacuacaggccggguuacuucacgcagaccgcgggccccuggcaccugggaaagcuggagcucgacuucgaccugugcgagggcaccacgguuguaguggacgagcacugcggcuaccgcgggccgucccugcggacgaccacggugacgggcaagacaauucacgaguggugcugccggagcuguacguuaccaccccuucgguuuagaggggaggacggcuguugguacggcauggagauacggcccgugaaggagaaggaggaaaaccuagugcgcuccauggugucagccggcaguggcgagguggacucguucagucucgggauccugugcgugagcauccuuaucgaggagguuaugcggagccgcuggucccggaagaugcucaugacggggacgcuggccguuuuccugcuuuugaucauggggcaguuaaccuggaacgacuuaauucgccuguguaucauggugggcgccaacgccuccgacagaauggggaugggcaccacguaccuggcgcucauggccacguucaagaugcggcccauguuugccgucgguuuguuguucagacggcucaccucccgggaggugcugcugcucacgaucgggcugagccugguggccucugucgaauugcccaacucucuggaggagcuuggcgacgguuuggcaaugggcaucaugaugcugaaguuauugacggacuuccagccgcaccagcuuuggacgacccugcuuucccugacguuuauccggaccagcuuaucccuggacuacgcguggaaaacgauggcgauggcucugagcaucgugaguuuguuuccucucugcuugagcaccaccucccagaaaaccacauggcugcccguccuccugggauccuucggauguaagccccugaccauguuuuugaucacugagaacaaaaucuggggccgcaaauccuggccgaucaaugaggggaucauggccgugggaauuguaucgauccuacuguccagccucuuaaagaacgacgucccucuggcggggccguuaaucgcggguggcaugcugaucgcuugcuacgugaucagcggguccagcgcagacuugucccuagagaaggcagcagaggucagcugggaggaggaggccgagcauuccggaaccagccacaacauucuggucgaaguccaagacgauggcacuaugaagaucaaggacgaggagcgggacgauacuuugaccauccuccugaaggccacccuguuagccgugucgggcguuuaccccaugagcauccccgccacucuguucguaugguacuuuuggcagaagaaaaagcagcgcuccgggguacugugggacacgcccagcccgcccgaggucgagcgcgcgguucuggacgacggcauuuacagaauccuccaacggggcuuacuggggcguagccagguaggcgucgguguguuucaggauggcgucuuccacaccauguggcacguaacgcgcggggccguacucauguaucagggcaagagauuggagcccaguugggccuccguuaagaaggaccugaucuccuacggugguggcuggagguuccagggguccuggaacaccggagaggagguccaggugauugcgguggagcccgggaagaacccgaaaaacgugcagacaaccccuggcacauucaagacccccgagggcgaggugggcgccauagcgcucgacuuuaagccgggcacgagcgggucaccgauagucaaccgcgagggcaagauugucggccuguaugggaacggcgugguuaccaccucggggaccuacgucagcgcgaucgcccaggcgaaggccagccaggagggccccuugcccgaaaucgaggacgaaguguucaagaagcggaaucucaccaucauggaccugcaccccggaagcggaaagaccagacguuaucuucccgcgaucgugcgcgaggccaucaagagaaaacuccgaacccugauccuggcccccacccgggucgucgccagugagauggcggaggcccuaaaggguaugcccauccgguaucaaacgacugcgguaaagagcgagcacaccggacgcgagaucgucgaucugaugugccacgcgaccuuuacgaugcggcugcuguccccggugcgcguuccgaauuacaacaugaucauaauggacgaagcacacuucacugaccccgcgagcaucgccgcccggggcuacauuagcacgcgcgucggaaugggcgaggcagccgcuaucuucaugaccgcuacgccgccaggguccguggaagcauuuccacagagcaaugccgucauccaggaugaggagcgggacauccccgagcgcagcuggaacuccggcuacgacuggaucacagacuuccccggcaaaacugugugguuugugccgagcaucaaauccgggaacgacaucgccaacugccugcggaaaaacggcaagcgcgugauccagcuuagccggaagaccuucgacacggaguaccagaaaacuaagaacaacgauugggacuacgugguaaccacggacaucuccgaaaugggcgcuaacuucagagccgaccgggugaucgacccgagaaggugccucaagccggucauccugaaggacggccccgagcgcgugauccuggccgggccuaugccggugacggucgccagcgcggcgcagcgucgcggccggaucggccguaaccaaaauaaggagggggaccaauauaucuacaugggccagccccucaacaacgacgaggaucaugcccacuggaccgaggccaagauguuacuggacaacaucaauacccccgagggcaucaucccggcccucuucgagccagagcgcgagaaguccgcugccaucgauggagaguaccgguuacgcggugaggcccggaagaccuucgucgagcugaugcgccggggcgaccucccagucugguuaagcuacaagguggccuccgaaggcuuccaguacucggaucgccgguggugcuucgacggggagcgcaacaaccagguacuggaggagaacauggaugucgagaucuggacgaaggaaggcgaaaggaagaaguugcgcccacgguggcuggacgccaggaccuauuccgacccgcuugcgcuccgggaguuuaaggaguucgccgcugggcgccguagcgugagcggugaccugauacuggagaucggcaagcucccccagcaccugacccugcgcgcgcagaacgcauuagacaacuuagucauguugcacaauucugaacagggcgguaaagcguaucggcacgccauggaagaacuccccgacaccaucgagacccugaugcugcucgcgcugaucgccguccugaccggaggugugacucucuucuuucugucagguaagggucugggcaagaccuccaucggguugcugugcgugauggcguccuccgcacuguuguggauggccucagucgagccacacuggaucgccgccuccaucauucuggaguucuuccuuaugguucuccugaucccggagcccgaccgccaacgcacgccccaggacaaucagcuggcguacguggucaucgggcuccuguucaugauucugacgguggcugccaacgagauggggcuacuggaaaccaccaagaaggaucugggcauugggcacguggccgccgagaaccaucaccacgcaaccaugcucgacgucgaucugcgcccagccucagccuggacgcuguacgccgucgccaccaccgugauuacccccaugaugcggcauacgaucgagaacacgacugcgaacaucucccuuaccgcgaucgcuaaccaagccgccauccuuaugggucuggacaagggcuggcccauauccaaaauggacaucggggucccccuccuggcucugggcugcuauucccagguuaacccguuaacgcugaccgccgcugugcugauguuggucgcccacuacgcgaucaucggacccggccugcaggcuaaggccacccgagaggcacagaaacgcaccgcagcagggaucaugaagaaucccacgguagacgggaucguuaccaucgaccuggacccggucguguacgacgcuaaguucgagaagcagcuuggccagauuaugcugcugauccugugcaccucucaaauucuucugaugaggacaacgugggcccuuugcgagucaaucacccuggccaccgggccccugaccacgcugugggaagggagccccgguaaguucuggaacaccaccaucgcuguuuccauggcgaacaucuuccgcggcucuuaucuugccggcgccggcuuggccuucucccucaugaagucccugggcgggggccggcgcgggaccggcgcccagggggaaacgcugggggagaaguggaagcggcaguugaaccagcuguccaagagcgaguucaacacuuauaagaaguccggaaucauggaggucgacagguccgaggcgaaggaggggcugaagcguggcgagaccaccaagcaugccgugagccgcgguacggccaaguugcggugguucguggagcguaaccugguaaagcccgaaggcaaagugaucgaccugggcugcgggcggggcgggugguccuacuacugcgccggccugaagaaggugacagaagucaaagguuacacaaagggcggcccagggcaugaggaaccgauccccauggcaaccuacgguuggaauuuagugaagcugcacucagggaaggacguguucuucacgccgcccgagaaaugcgacacgcugcuuugcgacaucggggagagcagcccgaaccccaccauugaggaggggagaacgcuccggguccugaagaugguggagcccugguugcguggcaaccaguucugcaucaagauccuuaaccccuacaugccuuccgucgucgagacccucgagcagaugcagcggaagcauggcgggaugcucgugcguaacccucugagcagaaacuccacgcacgagauguauuggguaucgugcggcaccggaaacaucgucuccgccgugaacaugacgucucgcauguuacucaaccguuucaccauggcccaccgcaagcccacguacgaacgcgacguagaucuuggcgcuggcacgagacacguugcgguggagccugagguggcgaaccuggauaucaucgggcagagaaucgaaaauaucaagaacgagcacaaguccaccuggcacuacgaugaggacaaucccuacaagaccugggccuaccacggcagcuacgaggucaagcccucugggagcgccagcagcauggugaacggcgugguccggcuccugacgaaacccugggacgugauccccauggucacccaaaucgccaugacagauaccacgccguuugggcagcaaagaguguucaaggagaaaguggacacacggacgccacgggccaaacggggcaccgcgcagaucauggaggugacggccaaguggcuguggggcuuccucucgaggaauaagaagccccggaucugcaccagggaggaguucacccggaaggugcgcagcaacgccgccaucggcgccguguucgucgaugaaaaucaguggaacagcgcgaaggaagccgucgaagacgagcgguucugggaccugguccaccgcgagcgugagcugcacaagcaggggaagugcgcaaccugcguuuacaacaugauggggaaaagagagaagaagcucggcgaguucgggaaggccaagggcucccgggcgaucugguacauguggcucggggcacgcuuccuggaauuugaggcccucggguucaugaacgaagaccacugguuuagccgugagaacucccugagcggcguggaaggggagggccuucacaaacucggguacauccugcgcgacaucuccaagaucccgggcggcaacauguacgcugacgacacggccggaugggacacccggaucaccgaggacgaccugcaaaacgaggcgaagaucaccgacaucauggagcccgagcacgcccuucuggccacgagcaucuuuaaacugacguaccagaacaaggugguucggguucagaggcccgcuaaaagcggcacggugauggacgucauaagccggagggaccagcggggaucgggccaagugggcaccuacgggcuuaacacguuuacuaauauggaggugcagcugauccgacagauggagagcgagggcaucuucucccccucugagcuggagacuccaaaccuagccaagcgaguucuggacuggcuggagaagcacgggguggagcgacucaagcggauggcaauauccggcgacgauugcguggucaaacccaucgacgaccgcuuugcuacagcccuaacggcguugaacgacaugggcaaggugcgaaaggacaucccccagugggaacccucuaagggcuggaacgacuggcagcaagucccguucuguucccaccauuuccaccagcucaucaugaaggacggccgugagaucgucgugcccugucggaaccaagacgagcuaguggggcgcgccagagugucgcagggggcggggugguccuuacgcgagaccgccugccucggaaagagcuacgcccagauguggcagcugauguacuuccacaggcgcgaccugcggcucgcagccaacgcaaucugcagcgccguccccguggacugggugcccaccucacgcacgaccuggagcauccacgcccaucaccaguggaugaccaccgaggacauguuaagcguguggaaccguguguggauagaggagaacccguggauggaggacaagacccacgucucaagcugggaggaggugcccuaccuggggaagcgcgaggaucaguggugugggagcuugaucggccugaccgcccgagcgacgugggcuaccaacauccaaguggccauaaaucagguccgccgccugaucgggaaugagaauuaccucgauuacaugacaucaaugaagcgguuuaaaaaugagagcgauccagagggcgcucuuugguag

SEQ ID NO: 23767 - RNA, 9879 nt, Artificial Sequence
  derived and/or modified CDS sequence (opt11) from DENV-1__FJ850077__SS-prME
agcgugaccauguuacucaugcugcugccgaccgcccuggccuuccauuugaccacccguggcggcgagccccacaugaucgugagcaagcaggagcggggcaaaucacuccucuucaaaaccuccgugggggugaacaugugcacccugauagccauggaccugggcgaacucugugaggacaccaugacuuacaaguguccaagaauaaccgagguggaacccgaugacguggacugcuggugcaaugccaccgacacgugggugaccuacgggaccugcagccagaccggcgagcaccggcgcgauaagagguccgucgcccuggcgccccacgugggccugggacucgagacgaggacggagaccuggaugagcucggagggagcguggaagcagguucaaaagguugaaacaugggcgcugagacaucccggguucacggugaucgcccuauucuuggcccacgccaucggcaccagcaucacucagaaaggcaucaucuucauccugcugaugcucgugacaccuagcauggcgaugcgaugcguaggcaucgguaacagggauuucguggaagggcugagcggcgccacgugggucgacgucgugcuggagcaugguuccuguguaaccaccauggccaagaacaaacccaccuuagauaucgagcuccuaaaaaccgaggucaccaaccccgccgugcugcggaagcuuugcaucgaagccaagaucagcaacacgacaacggauucccggugcccgacucaaggcgaggcgacccugguagaggagcaggacgcgaacuucgugugucgaaggacauucguggaccgcggcuggggaaacgggugcggccucuucggcaagggcucucugcugacgugcgccaaguucaagugugugaccaagcucgagggaaagauaguccaauacgagaaccuuaaguauucggugaucgucacugugcacacaggagaccagcaccaggucgggaacgagacgacggagcauggcaccaucgccacaauuacgccccaggccccgacgagcgagauccagcugacagacuacggugcgcucacccuggacugcucuccccggaccgggcuggacuucaacgagaugguccuacugaccaugaaggagaaguccuggcuggugcacaagcagugguuccucgaccugccgcugcccuggacaagcggagccagcacaucacaggagacauggaaccgccaggaucuccuugugacguucaagaccgcccacgccaaaaagcaggagguagucgugcuaggcucccaggagggcgccaugcacacggcgcucaccggggccacggagauccagaccagcggcaccaccacgaucuucgccgggcaucugaaauguagacugaagauggacaagcuuacccugaaggguauguccuacguuaugugcaccgggagcuucaaacuugaaaaagagguagccgagacccaacacgggacgguucugguucaggugaaguacgagggcacugacgcacccugcaagauccccuuccucacccaggacgagaagggggugacacagaacggccgccugauuacggcgaacccgauugucacagacaaagaaaagcccgugaacaucgaaaccgagccacccuucggggaguccuacaucguagucggugccggugagaaggcccuuaaacugagcugguucaagaagggguccagcaucgggaagauguucgaggccaccgcgcgcggggcucgccggauggccaucuugggcgauacggcuugggacuuugggucgaucggcggcuuauucacgucaguugggaaguugauccaucaaguauucgguaccgcguacggugucuuauucuccggcgugagcuggacuaugaagaucgggauuggaauccuguuaacguggcuaggccugaauucccgcagcaccucccucagcaugaccugcauagcggucgggauggugacccuguaccugggcgugauggugcaggccgacuccgggugcgugaucaauuggaagggcagggagcugaagugcggcagcggaaucuucgugacgaacgaagugcacacuuggaccgagcaguacaaguuucaggccgacuccccgaagcggcugagcgccgccaucggcaaagcgugggaggaggggguaugcggaaucagaagcgcaacccggcuggagaacaucauguggaagcagauauccaacgaacucaacuacauccucuuagagaacgacaugaaguucaccgugguggucggugacgccaacggcauccugacgcaagggaagaagaugauacggccucagcccauggagcacaaguacucuuggaaguccuggggaaaggccaaaauaaucggcgccgacauccaaaauaccaccuucaucaucgacgggcccgauaccccggagugccccgacgaucagagagcguggaacaucugggagguggaggacuacggcuucgggaucuuuacgaccaacaucugguugaaguuacgcgacucguacacccagaugugcgaucaucggcucauguccgccgcuauaaaggacuccaaagcugugcacgcggacaugggcuacuggaucgaguccgagaagaaugagaccuggaaguuagcccgcgcuucguucauagaggucaagaccugcaucuggccuaagucccacacgcuguggagcaacggcgugcucgagucugagaugaucauccccaagaucuacgggggcccgaccagucagcauaacuaccggcccggauacuucacccagacggccgggcccuggcaccuggggaaacuggaguuagacuucgaccugugcgagggcaccaccguggucguggacgagcauugcggcuaucgugggccgagccugcggaccaccacugucaccggcaagaucauccacgaguggugcugccgcucuugcacacugccgccccuacgauuccgcggugaggacggcuguugguacgggauggagauccggccagucaaggagaaggaggagaaccuggugcgcucaauggugagugccggcuccggcgaggucgacagcuucagccucgggauccugugcgucuccauccugaucgaggaggugaugcggucacgcuggagcagaaagaugcuuaugacgggcacgcuggcggucuuucugcuccucauaauggggcagcugaccuggaacgaccuuauacgauugugcaucauggugggugcuaacgccagcgacaggauggggauggggacaaccuaccuggcucucauggccaccuucaagaugcggccaauguucgccguggggcuccuguuccgcaaguuaaccucccgggagguucugcuucucaccauugggcuuagccuggucgccuccgucgagcuacccaauucucuggaagaacuuggugacgggcucgccaugggcaucaugauguugaagcugcucacagacuuucagccccaccagcuguggaccacauuacucuccuugacguucauccgcacgagccugucccucgauuacgccuggaagaccauggccauggcucugucuauugugagccucuucccccuaugccugagcaccaccucgcagaaaacgaccuggcugccggugcuccugggaagcuucgggugcaagccccuaaccauguuuuuaaucaccgagaacagaaucuggggccgcaaguccuggcccauaaacgagggggucauggccgugggcaucgugagcauacugcugucuucgcuccugaagaacgauguuccccucgccgggccacucaucgccggcggcauguugaucgcgugcuaugugaucagcggguccuccgccgaccuaucccucgagaaagcagccgaggugagcugggaggaagaggccgagcacuccggcaccagccacaacauacuggucgaggugcaggaugacgguacgaugaagauaaaagacgaggaacgugaugacaccuuaacgauccuucuuaaggcgacccuacuugccgugaguggaguguaccccaugagcauucccgcgacucuguuuguuugguacuucuggcagaaaaagaagcagcguuccggggugcugugggacacaccaagcccuccugaggucgagcgggccgugcuggacgacggcaucuaccgcauucuccagcggggccugcuggggcguucccaggugggcgucgggguuuuccaggacggcguguuucauaccauguggcacgucacgcguggcgccgugcucauguaucagggcaagcgccuagagcccagcugggcauccgucaagaaggaccugauuagcuauggaggcggcuggcgguuccaggguaguuggaacacgggcgaagagguccagguaaucgccguggagcccgggaagaaccccaagaacguccagaccacuccaggcaccuucaagacucccgagggcgaagugggggcgaucgcccucgacuucaagccgggcaccucgggguccccuaucgucaaccgcgaaggcaagaucgucggcuuauaugggaacggggucgugaccaccagcgggacguacgucuccgccaucgcgcaggccaaggcgagccaggaaggcccucugccggagauagaggacgagguguucaagaagcggaaccucacuaucauggaccuucacccgggaagcggcaagacccgccgguaccuccccgccaucgugcgcgaggcgaucaagagaaaguugaggacccugauccuggcgccgacgcgcgucguggccuccgagauggccgaagcacucaagggcaugcccauccgguaccagaccaccgcugucaagagcgaacacaccgggagggagaucgucgaccugaugugucacgccacguucacgaugcggcugcucaguccggugagggugcccaacuacaauaugauuaucauggacgaggcccacuuuaccgaccccgccagcaucgccgcucgaggcuacauaucuacccgcgucgggaugggcgaggccgccgccauauuuaugacggccacgccgcccgguagcguggaggcguucccccaauccaacgccgugauccaggacgaggagagagacauacccgagagaagcuggaauagcggauaugauuggauaaccgacuuccccggcaagaccguuugguucgugcccucuaucaaguccgggaacgauauagccaauugccugcgaaagaacggcaagcgcgugauacagcuaagucggaagacguucgacaccgaguaccaaaagaccaagaacaacgacugggacuacgucgugaccacugacaucuccgaaaugggggccaauuuccgcgccgaccgggugauagacccccgccguugccucaagcccguaauccugaaagacggccccgagagagugauccuggcgggaccgaugcccgucaccguggccagcgccgcccagcgucgcggccggauaggccgcaaccagaacaaggagggagaccaguacaucuacaugggccagccccucaacaaugaugaggaccaugcucacuggacugaggcgaagaugcugcuggacaacaucaacacccccgaggggauuauaccggcccucuucgagcccgaaagggagaaguccgccgcuaucgacggcgaauaucgacuccgcggugaggcgagaaagacguuuguggagcugaugcgccgcggcgacuugcccgucuggcugagcuacaagguugccucugaaggauuccaguacagugaucgccgguggugcuucgacggggaaagaaacaaccagguacuggaggagaauauggacgucgagaucuggaccaaggagggcgagcgaaagaagcuccgaccgcggugguuagacgcgcgcaccuacuccgacccgcuggcccuccgggaguucaaggaguucgcagcggggcgccggagcgugagcggcgaccugauccuggagaucgguaagcucccccagcaccugaccuugcgcgcccagaacgcccucgacaacuuagugaugcugcacaacuccgagcaaggcgggaaggccuaucggcaugcgauggaagagcuccccgacaccaucgagacacugaugcugcucgcgcugaucgccguccugaccggcggcgugacccucuucuuccugagcggaaagggcuuaggaaagaccuccauaggguuauuaugcgucauggccucauccgcccugcucuggauggcgagcguagagccccacuggaucgccgccuccaucauccuggaguucuuucugauggugcuccugaucccagagcccgaccgccagcggacgccccaggacaaccaacuugccuacguggugaucggauugcuguucaugauccuuacaguagcugcgaacgagaugggucuccuugagaccaccaagaaagaucuggggaucgggcauguggccgcggagaaccaucaccacgccacgaugcuugacguagaccugaggccggccagcgcguggacguuauaugccguggcgacuaccguuauaacucccaugaugcggcacaccaucgaaaacaccaccgccaacauaucccuuacggccauagcaaaccaggccgccauccugaugggccuggacaaagguuggcccaucagcaagauggacaucgggguaccccuucuugcacuggguugcuacagucaggucaacccgcuaacgcugacugcuaccgugcugaugcuugucgcucauuacgccaucauagggcccggacugcaggcaaaggcuacgcgggaggcgcaaaagagaaccgcggccggcaucaugaagaaucccaccguggacggcaucgugacgauugaccuggaccccgucguguacgaugccaaguucgagaagcagcucggccagauuaugcugcugauauugugcacgagccaaauccugcucaugcgaaccaccugggccuugugcgagucuaucacgcuggcaacggggccgcucacaacccucugggagggcucccccgggaaguucuggaacaccacgaucgccgugucaauggccaacauauuccgcggaagcuaucuggccggcgcuggucuggcguucagucucaugaaaucccugggcgggggccggcgcgggaccggugcgcagggcgagacacugggggagaaguggaagagacagcucaaccagcuguccaaauccgaguucaacaccuauaagaaguccggcauuauggaggucgaccguuccgaggccaaggaaggacugaagcggggggagacgaccaaacacgcagugucccgcgggacugcgaagcugcggugguuuguggagaggaaccucguaaagccugaggguaaggugaucgauuuaggcugcgggcggggagggugguccuacuacugcgcgggccugaagaaggugaccgaggucaaagguuacacgaagggcggccccgggcacgaggaaccgauccccauggccacguacggcuggaaccucgugaagcugcauagcggcaaggaugucuucuuuacgccucccgagaagugcgacacgcugcuaugcgacauaggugagagcagccccaaucccacuauagaggagggucgcacguuacggguccugaagaugguggagccauggcuacgcggcaaccaguucugcaucaagauccugaaucccuauaugccaucgguggucgagacccucgaacaaaugcagcgcaagcacggcgggaugcucgugcgcaacccccugagccgaaauuccacccaugaaauguauuggguaagcugcggaaccgggaacaucguuuccgcagugaacaugacaucuaggaugcugcucaaccgguucaccauggcacaccgcaagcccaccuaugagcgugacguggaucugggcgcggggaccagacaugucgccgucgaacccgagguggccaaccuugacaucaucgggcagcgcaucgaaaacaucaagaacgaacacaagucgacguggcacuacgacgaggacaacccauacaagaccugggccuaucacggcagcuacgaggucaagcccuccgggagcgccuccagcauggugaacggcgucgugcggcuccuuaccaagcccugggacgugauccccauggucacucagauugcgaugacggauaccacuccguucgggcagcaacgaguguucaaggagaagguggacacccggacgccccgcgcgaaacggggcacagcccaaaucauggaggucacggccaaauggcuguggggcuuccucucccgcaauaagaaaccccggauuugcacacgcgaggaguucacgcggaaggugagaagcaacgcugcgaucggcgcaguguucgucgacgagaaucaguggaacagcgccaaggaggccguggaggacgaacgguucugggacuuagugcaccgagaacgggagcuucacaagcaggggaaaugcgcgacgugcguuuacaauaugaugggaaagcgcgaaaagaagcucggcgaguuuggaaaggcgaaagguucccgggcgaucugguacauguggcugggcgcccgcuucuuggaguucgaggcacuuggguucaugaacgaggaccacugguuuagccgggagaacucccugagcggcguggagggggagggccugcacaagcucggguauauccugcgagacauauccaagaucccgggcgguaacauguacgcggacgacacugcugggugggacacgaggauaaccgaggacgaccugcagaacgaggccaagaucaccgacaucauggagcccgagcaugcccuccuggccaccagcaucuucaaguugaccuaucagaacaagguggugcgcgugcagcgccccgcaaagucgggcaccgugauggacgucaucucgcggcgcgaccagcgcggguccggacaggugggcaccuacgggcuaaacaccuucacgaauauggagguacagcugauccgacagauggagagcgagggaaucuucucacccagcgagcuggagacgccgaaucucgccaagcggguucuagacuggcuggagaagcacggggccgagcgucucaaacggauggcgaucuccggcgacgacugcgugguaaaacccauagaugaccgguucgccacagcgcugacagcccugaacgacauggggaaaguccggaaggacaucccccagugggaaccuagcaaaggguggaacgacuggcagcaggucccguucugcagucaccacuuucaccagcucaucaugaaggacggcagagacaucguggucccgugccggaaccaggacgagcugguggggcgcgcgcgugucagccagggcgccggguggagccucagggagacggcuugccucggcaagaguuacgcacagauguggcagcugauguacuuccaccgacgagaccugcggcuggcggccaacgccaucugcagcgcggucccgguggacugggugcccacaucccgcaccaccuggagcauccacgcgcaccaccaguggaugaccaccgaggauaugcugagugucuggaaccgggucuggaucgaggaaaacccguggauggaggauaagacccacguguccagcugggaagaggucccguaucugggcaagcgcgaggaccaguggugcgggagccucaucggccugacugcucgcgccaccugggcuacaaacauccagguggcgaucaaccagguacggcgucugaucggaaacgagaacuaccucgacuacaugacguccaugaagcgguucaagaacgaaagcgaccccgagggcgcccugugguaa

SEQ ID NO: 23768 - RNA, 9879 nt, Artificial Sequence
  derived and/or modified CDS sequence (opt11) from DENV-1__FJ850081__SS-prME
agcguaacuaugcugcucaugcugcugcccaccgcccucgccuuccaccugaccacgcggggcggggaaccccacaugaucgugucaaaacaggagcggggcaaaagccuccuguucaagacuucagucggggugaacaugugcacccugaucgcgauggaucugggcgaacucugugaggacaccaugacauacaaguguccccgcaucaccgaagccgaacccgacgacguggauugcugguguaacgccacagauacguggguaacguacgggaccugcagccagaccggcgagcaucguagggacaagcggucaguagcgcuggccccucacgugggccuggggcuggagacucggaccgagaccuggaugagcuccgagggcgccuggaagcagauccaaaagguggagaccugggcuuugagacaccccggcuucacgguaaucgcgcuauucuuggcccacgcgaucgguacaucaauaacccagaaggggauuaucuucauccugcugauguuagucaccccaucaauggccaugcguugcgugggcaucgguaaccgggacuucguggaagggcugucuggcgccacguggguggacguuguguuagaacauggauccugcgucaccaccauggcgaagaauaagcccacacucgacaucgagcuacugaaaaccgaggugacaaaccccgccguguuaagaaagcugugcaucgaagcgaagauaagcaacacuacuacggacucccggugcccgacccagggcgaagcaacccuggucgaagaacaggaugccaacuucgugugucgccggaccuuugucgaucgcggcugggggaacggcugcgguuuauucgguaaagggagccugcugacgugcgcgaaauucaagugcgucaccaaauuggagggcaagaucgugcaauacgagaaccugaaguauuccgucauagugaccguccacaccggcgaccagcaccagguugggaacgaaacuaccgagcacggcaccauugccacuaucacuccccaggcgccuacgagcgagauacagcugacugacuacggggcgcuaacccuggacuguagcccucggacgggucuggacuuuaacgaaaugguacuccugacuaugaaagaaaaguccuggcugguucacaaacagugguuccucgaccugccguugccguggaccagcggagcuaguaccagccaggaaaccuggaaucgccaagaucuccugguaacauucaaaacggcccacgccaagaaacaggagguaguaguacucggcucccaggagggcgcgaugcacacggcccucacaggggccacggaaauccagacuucuggcacgacuacuaucuucgccgggcacuuaaagugcagauugaaaauggacaagcucacucugaagggcauguccuacguaaugugcaccggaucguuuaagcuggagaaggaagucgcugaaacccagcacggcacaguuuuaguccaggugaaguacgagggcacagacgcgccuuguaagauacccuuccugacccaggacgaaaagggcgucacucagaacgggcggcugaucacggccaaccccauagugaccgacaaggagaagcccgugaacaucgagaccgagccgccguucggggagaguuacaucgucguaggggccggggagaaggcccugaaguugucaugguucaagaaaggauccagcaucggcaagauguuugaggcgaccgcccgcggggcgcgccggauggccauccugggcgacacugcaugggacuucggcuccaucggcggccucuucaccucgguggggaaacuuauucaccagguuuucggcaccgcguaugggguccuguucaguggcguaagcuggaccaugaagauagggauaggcauccuucucacuugguugggccuaaauucccgcagcaccucccucagcaugaccugcauagcuguagggauggugacccuguaccugggcgugaugguacaggcagacuccgggugcguaaucaacuggaagggucgagagcugaagugugggucgggcaucuucguuaccaaugagguccacaccuggaccgagcaauacaaguuccaggccgacucgccgaagcgacugagcgcugcgaucggcaaggcaugggaggaggggguuugcggcauucgcagcgccacccgguuggaaaacauaauguggaaacagaucuccaacgagcucaacuacauacugcuugagaacgacaugaaguucacaguugucgugggggaugccaauggcauccucgcccaggggaaaaagaugauccgcccccaacccauggaacacaaauacagcuggaagucgugggggaaggccaagaucaucggcgcggacauucaaaauacgaccuucaucauagacggacccgacaccccagagugccccgacgaccagcgagccuggaacaucugggagguggaagauuauggcuucgguaucuucaccacgaacaucuggcugaagcugagggauagccacacccagaugugcgaccaccggcuaauguccgcagcgaucaaagauagcaaggccguccacgccgacaugggcuacuggaucgaauccgagaagaacgagaccuggaagcuggcccgugccaguuucaucgaagugaagaccugcauauggccgaaaagucauacgcuguggagcaauggcgugcuggaguccgagaugauaaucccgaagaucuaugggggcccuaucucccaacacaacuaccggcccggcuacuuuacccagaccgcgggcccguggcaucuggggaagcuggaacuggacuucgaccugugugaggguacgacgguuguuguggacgagcauugcggauaucgugguccgucgcugcggacaacuaccgucacggguaagauaauccacgaauggugcugucgcagcugcacucugccgccccugcgcuucagaggggaagacggcuguugguacgggauggagauccgcccugugaaggagaaggaggaaaaccuggugcgcagcauggucagcgccggcagcggcgagguggacagcuuuaguuugggcauauugugcguguccauuuuaaucgaagaggucaugcggucucgcuggucccguaagaugcucaugaccgguacacuggccgucuuccugcuccugaucauggggcagcugacguggaacgaccucauccgccucugcaucaugguuggcgccaacgccuccgacagaaugggaaugggcaccaccuaucuggcacuaauggccaccuuuaagaugcggcccauguucgcuguagggcugcuguuccgccggcucaccucccgcgaaguucugcugcucaccauaggucuuagccugguggccaguguugagcuccccaauagcuuagaggagcugggcgacgggcucgcaaugggcauuaugaugcugaagcuauugaccgauuuccagccgcaccaguuauggacuacacuccuuucccugaccuucauucggaccucauugucccucgacuacgcauggaaaaccauggccauggcacugucuauugugucacuguucccacucugcuuguccacgaccucucagaagaccacauggcugccuguccuccugggcagcuucggguguaagccccugacaauguuccuaaucacugagaauaagaucuggggccgcaagucuuggcccaucaaugaagggaucauggcgguaggcaucguuagcauccuccuauccucgcuccugaagaaugacguccccuuggcggggccgcucauagcuggcggcauguuaaucgccuguuacgugaucucuggguccagcgcugaccuuucccucgagaaggccgcugagguaucuugggaggaggaggccgagcacucgggcaccagccauaacaucuuggucgaagugcaggacgacgggacgaugaagaucaaggacgaggagcgggacgauaccuugacgauccuccugaaggccacccugcucgcaguguccggcgucuaucccaugucgauaccugcuacccuguucgugugguacuucuggcaaaagaaaaagcagagguccggaguacugugggauaccccuuccccgcccgaagucgaacgggccgugcucgaugacgguaucuacaggauccuccagcgcggucugcuggggcgcucccaggugggcgucgggguguuucaggacgggguuuuucacacgauguggcacgucacccgaggggccguacucauguaucagggcaaacgacuggagcccagcugggcgucggucaagaaggaccugauuagcuauggcggaggcuggcgauuccagggcagcuggaacaccggcgaagagguccagguuaucgccgucgagcccgggaagaacccuaaaaauguccaaaccacgcccgguaccuuuaagacccccgagggcgaggugggggccaucgcgcucgacuucaagcccggcacgagcgguucuccgauagugaaccgcgagggcaagauugucggccucuacggaaacggaguggugacaaccucagggacguacgucuccgccaucgcccaggcgaaggccagccaggaaggcccccuacccgagaucgaggacgagguauuuaagaagcguaaccuuacaauuauggaccugcacccggggagcggaaagacaaggcguuaccugccugcgauaguucgggaagccauuaagcggaaguuacgcacccugauucuggccccgacccgcgucguggccuccgaaauggcugaggcucuuaaaggcaugcccauacgguaccagaccacggcgguaaaaucagaacacacugggcgcgagaucguggaccuuaugugccaugcgacauucacgaugagacuguuauccccggugagagugcccaacuacaacaugaucaucauggacgaggcucacuucaccgacccggcguccaucgcugcccgcggcuacaucuccacgcgcgucgggaugggagaggccgccgccaucuucaugaccgccacgccuccugggucggccgaggccuuuccccagaguaacgccgucauccaggacgaagagagggacauccccgagcgcagcuggaacucgggcuacgacuggauaacggacuucccgggcaagacggugugguuuguccccucgaucaaguccggcaaugacaucgcgaacugcuugcggaagaacggaaaaagagugauccagcugagucggaagaccuucgacacagaguaccagaagaccaagaacaacgacugggacuacgugguaacgaccgacaucuccgagaugggugccaacuuccgcgcagaucgcgugauugacccccgccguugccucaagccggucauucugaaggacggcccggagagagucauccuagccgggccgaugcccgugacugucgcgucggccgcccagcgccgcggucggaucggaaggaaucaaaauaaagaaggagaccaguacaucuauaugggccagccacugaauaacgaugaggaccacgcccacuggacggaggccaagaugcugcuggauaacaucaacacuccugaggggaucauaccggcccuauucgagcccgagagagagaaguccgcggccauugacggcgaguauagacucagaggggaagcgcggaagacuuucgucgagcugaugcgccguggcgaccucccuguguggcucuccuauaaggucgcgucggagggauuccaguacagcgaccgacgcuggugcuucgauggcgagagaaauaaccaagugcucgaggagaacauggacgucgagaucuggaccaaggagggcgagcggaagaagcuccguccccgauggcuugacgcgaggacguacucugacccgcuggcgcuccgggaguuuaaagaauuugcagcugggcgccgcagcgucaguggugaccugauccuagagaucggcaagcucccgcagcaccugacucuccgcgcccaaaacgcguuagacaaccuggugauguuacacaacuccgagcagggugggaaggccuauagacacgccauggaggagcugcccgacaccauugagacccugaugcugcucgcccugaucgcggugcugacagguggcguuacucucuucuuucugagcgggaaggggcuaggcaagacaucuaucgggcuccugugcgugauggccucauccgcacugcucuggauggcaagcguggagccccacuggaucgccgcaagcaucauacuggaguucuucuuaauggugcuccugaucccagagcccgaccgccagcggacgccccaggacaaccagcuggcguacguagucaucggacuacuguucaugauccuuacgguggccgcuaacgagauggguuuacuggagacgacgaagaaagaucugggcauagggcaugucgccgcggagaaccaucaucacgccacuaugcucgacguggaccugcgcccagcuucagcuuggacgcuguaugccgucgcuacaacugugaucacccccaugaugcggcacaccaucgaaaacacgacagcaaauaucagucucaccgcuaucgccaaccaagccgcgauccugaugggccuagacaaaggcuggccgaucaguaagauggauauuggggugccccuccucgcucugggcugcuacagucaggugaacccgcucacccuaacggcugccgugcugaugcucgucgcgcacuacgccauaauugggcccgggcugcaggccaaagccacccgugaagcacaaaaacgcaccgcggccgguauuaugaagaacccaaccgucgacggcaucgugacgaucgacuuggaccccguagucuaugacgccaaauucgagaagcagcucggccagaucaugcuccugauccucuguaccagucagauccuguugaugcggacaacuugggcccucugcgagucgauuacguuagccaccgggccacugaccacccucugggaagguagccccgggaaguucuggaauacaaccaucgcgguguccauggccaacaucuucaggggaagcuaccuugcgggcgcuggucucgccuucucucugaugaagucccugggcgggggucggcgcgggacgggcgcgcagggcgagacccucggggagaaguggaagcgccagcucaaccaacuuucaaaaagugaguucaauaccuacaagaagucagggaucauggagguggaccggucagaagccaaggaagggcucaaacggggugagaccacaaagcaugcugucagccgcgggacugccaagcugcggugguucguagagagaaaccucgugaagccugaaggaaaggucaucgaccuggguugcggacguggcgggugguccuacuauugcgcgggccugaaaaaggugacagaggugaagggguacacaaagggcggcccagggcacgaggaacccaucccgauggccaccuacggcuggaaccucgugaagcugcauucggguaaagacgucuucuuuaccccgcccgagaagugcgauacccugcucugcgauauaggcgagaguaguccaaauccgacgaucgaggaggggcguacccugcggguccuuaagauggucgaaccauggcugcgcggcaaccaauucugcaucaaaauacugaaccccuacaugccgaguguuguggagaccuuggaacaaaugcagcggaagcauggagggaugcucgugcgcaaccccuuaucccgcaauuccacucacgagauguacugggugagcugugguacggggaacaucgugagugccgucaacaugacaagccgaaugcuacucaaccgauucaccauggcccaccggaaacccaccuaugagcgcgauguggaccugggcgccggcacccggcacguggcaguggagccagagguagccaaccuugacaucaucggacaacgcaucgagaauaucaagaacgaacacaaauccaccuggcacuacgacgaggacaauccguauaagaccugggccuaccauggcagcuacgaaguuaagcccuccgguucagccuccucgaugguuaacggcguaguccggcuccugaccaagcccugggacguaauccccaugguaacgcaaauugcaaugaccgauacaacgccguucgggcaacagcgcgucuucaaagagaagguggacacgcggacuccccgggcuaagcggggcaccgcccagauuauggagguuaccgccaaauggcuguggggcuuccucucacgcaacaagaaaccgcggauaugcacgagagaggaguucacccggaagguccgcagcaacgccgccaucggggccguguucguggacgagaaccaguggaauagcgccaaggaggccguggaggacgagcgguuuugggaccuggugcaccgggagcgggaauugcacaaacaaggaaagugugcgaccugcguguacaauaugauggggaagcgggaaaagaagcucggcgaguucgggaaggcuaagggcucgcgggccaucugguacauguggcugggcgcacgcuuccuggaguuugaggcccucggguuuaugaacgaggaccacugguucagccgggaaaauucgcuuagcggagucgaaggagaaggccuccacaagcucggcuacauccugcgcgauaucuccaagauuccagguggaaauauguacgcagacgacaccgcgggaugggauacgcggauaacugaggaugaccugcagaacgaagcgaagauaacggacaucauggagccggaacacgcgcuucuagccacgagcaucuucaaacugacguaccagaacaaaguagugcggguccaacgccccgccaaguccggcacugugauggacguuauaagccggcgcgaccaacgugggucuggccagguugggaccuacgggcucaacacauucacaaacauggaagugcagcugauccgccagauggagucggagggcaucuucagucccuccgagcucgagaccccgaacuuggcgaaacgagugcuggacuggcuugaaaaacacggggccgagcgccucaaacgaauggcuauauccggcgacgacugcgucgugaaaccuaucgacgauagauucgcaacugcauuaacggcgcugaacgacauggggaaggugcggaaggacaucccccagugggagccuuccaagggauggaacgacuggcagcaggucccguuuugcagccaccacuuccaccaacucaucaugaaggacggccgcgaaauuguggugcccugccgcaaucaggacgagcugguugggcgcgcacgugugagccaaggcgccggguggagucuucgcgagaccgccugccucggcaagagcuacgcccaaauguggcagcucauguacuuccaccggagggauuuacggcuggcggccaacgccaucugcucugccguacccgucgacuggguacccacgucccgaacgaccuggagcauccacgcgcaccaucaauggaugaccaccgaggauaugcugagcguguggaaccggguuuggauugaggagaacccauggauggaagacaagacccaugugagcaguugggaggagguacccuaccuggggaagcgugaggaccaguggugugguagccuaauuggucugaccgcccgugccaccugggccacgaacauucagguggcaauaaaccaggugcgacgcuugaucgggaacgaaaacuaucucgacuacaugacgucuaugaagcgcuucaagaacgagagcgacccagagggcgcgcugugguga

SEQ ID NO: 23769 - RNA, 9879 nt, Artificial Sequence
  derived and/or modified CDS sequence (opt11) from DENV-1__FJ850084__SS-prME
agcgugacaaugcugcucaugcuguugcccaccgcccucgccuuccaccuuaccacccgggguggggaaccccacaugaucgugagcaagcaggaacgggggaagucucuccuguucaagaccagcgugggggugaacauguguacccugauugcgauggaccugggcgaacucugugaagacaccaugaccuacaaguguccccgcaucaccgaagucgagcccgacgacguggacugcuggugcaacgcuaccgauaccugggugaccuacgggacgugcagccagaccggagagcaccggcgcgacaagcgguccgucgcgcuggcgccccacgugggcuuagggcucgagacccgcaccgagacuuggaugucuuccgagggcgccuggaagcagauccagaagguggagacaugggcgcugcggcaccccggauucacggugaucgcccuuuuccucgcucacgccaucggcaccucaaucacccaaaaggguaucauauucauccugcugaugcuagugaccccuuccauggcgaugcgcugcguuggcaucggaaaccgagauuucgucgagggacuaagcggcgcaacuuggguggacguggucuuagagcacggguccugugugaccaccauggccaagaauaagcccacucuugauauagagcugcugaagacugaagucaccaaccccgccguccuucggaagcugugcaucgaggccaagaucucuaacaccacaacugacucucgaugcccgacccagggcgaggcgacacugguugaggagcaggaugccaacuuugucugccgcagaacguuugucgaccgcggcugggggaacggcugcggccuauucggcaaagggagccuacugacgugcgccaaguucaaaugcguuaccaagcuagagggcaagaucguccaguacgagaauuugaaauacuccgucaucgugaccguccacaccggcgaccagcaccagguugggaaugagacgaccgagcacggcacuaucgccaccaucacgccucaggcucccacgucggagauccagcugacagauuacggggcgcucacacucgauuguagcccccggaccggccuagacuucaacgagauggugcuccugacuaugaaggaaaagucguggcugguccacaagcagugguuccucgaucugccgcugccguggaccuccggggccagcacgagccaggagacuuggaauagacaggaccuucugguaacguuuaagaccgcccacgccaagaaacaggagguggucgugcugggcucccaggagggcgccaugcauaccgcgcucacaggggcuaccgagauccagacaucaggcaccacgacgaucuuugcggggcaucugaagugccgccugaagauggacaagcucacucugaagggaauguccuacgugaugugcaccggauccuucaagcuggagaaggaggucgccgagacccagcacggaacggugcugguucaggucaaguacgagggcaccgaugcaccgugcaagauccccuuuuugacacaggaugagaagggggucacccaaaacggucggcuaauaacggcuaauccgaucgugaccgauaaagaaaagcccgugaacaucgagacugagccuccauucggggagucguauauagucguuggcgcuggcgaaaaggcgcuuaagcuaagcugguucaagaagggguccuccauagggaaaauguucgaggccaccgcuagaggggcccgccggauggcuaucuuaggugacaccgccugggacuuuggguccaucgggggccuguucacuagcgucgggaagcucauccaccaaguguucggcgcugcguauggcgugcuguuuuccggcguaagcuggaccaugaaaaucgggaucggcauccugcugaccuggcugggacuaaauuccagaagcacguccuuaagcaugaccugcaucgcugucgggaugguuacccucuaccugggcgucauggugcaggccgacuccgguugcguuauuaacuggaaagguagagagcucaaguguggguccgggaucuuugucaccaacgaggugcacaccuggaccgagcaguacaaguuccaggccgauagcccgaagcgauuaucugccgcgaucggaaaggccugggaggaggguguuugcgguauccgcagcgccacccggcuggagaacaucauguggaaacagaucuccaacgagcucaacuacauacugcuggagaaugacaugaaguucaccgucguugugggggacgcaaacggcauucucacccaggggaagaagaugauccgcccccagccaauggaacacaaguacagcuggaaguccuggggcaaggcgaagaucaucggcgccgacauccagaacacgacauucaucauugacggacccgacacaccagaaugccccgacgaccagcgggccuggaacauaugggaggucgaggacuacggcuuugggaucuucacuacuaauaucugguugaaacugcgcgacagcuacacucagaugugcgaccaccgauuaauguccgccgcuauuaaagacagcaaggcggugcacgccgauaugggcuacuggaucgagagcgagaaaaacgagacguggaagcuagcccgcgccucauucaucgagguaaagaccugcauauggcccaagucccacacgcuguggagcaacggcguccuggaguccgaaaugaucaucccaaagauauacgggggcccgaccagccagcacaauuaccgcccuggguacuucacccagaccgccgggcccuggcaccuggggaaguuggagcucgauuucgacuugugcgaaggcacgacuguggugguggaugagcacugcggcuaccgcgggccgucacugcggaccaccacggugacugguaagaucauccacgaguggugcugccgcucuuguacccucccgccccugcguuuccgcggggaagacggcugcugguauggcauggagauccggcccgucaaggaaaaggaggagaaccugguccgcuccauggugagcgcgggauccgcggagguggacagcuucagcuuggggauacugugcguuuccaucuuaaucgaggagguaaugcgcagcagauggucucggaagaugcucaugacuggaacgcuggccguguuccugcuucugaucaugggccagcugaccuggaacgaccucauccgccugugcaucauggucggcgccaacgcgagcgaucgcaugggaauggggaccaccuaccuggcgcucauggccacguuuaaaaugcggccaauguuugccguggggcuguuguuccgcaagcucaccuccagagaggugcuucuuuugaccauaggccuuagccuggucgcguccguggagcucccuaacucccuugaagaacuuggggacggcuuggccauggggaucaugaugcuaaaauugcuuaccgacuuccaaccgcaccaguuguggacgacccugcugucccugacuuucauccgaacuagcuuaagucucgacuaugcguggaagacuauggccauggcacucagcaucgucucgcuguucccacucugccugucgaccacaucccagaagaccacguggcugccgguccuccugggcagcuucggauguaaaccucugaccauguuccucaucacagaaaacaagauaugggggcggaaguccuggcccaucaacgaagguauuauggcaguagggaucguaagcauccuguuaucgagcuuacugaagaaugacgugccacuggcggguccgcucauugccgggggcaugcugauagccugcuacgugauaagcggcucaucggccgaccugucccucgagaaggccgcggaagucucuugggaggaggaagccgagcacuccgguacuucccacaacauccugguugaggugcaggacgacggcacuaugaagauaaaggacgaggagcgcgacgacacuuuaaccauucuccugaaggccacccuccucgccguaagcgggguguacccaaugagcauccccgccacacuguucgugugguacuucuggcagaagaagaagcaacggaguggcguccugugggacacgcccaguccacccgaggucgagcgagccgugcuggacgacgggaucuaucguauccuccagcggggccugcucggccggucccagguagggguaggcguguuccaggacggggucuuccacaccauguggcacgugacccgcggagcgguuuugauguaccaggggaaaagacuggaaccgaguugggccucugucaagaaggaucuuaucagcuacggcggcggguggagauuccagggcucauggaacaccggcgaggaggugcaaguaaucgccgucgagcccggcaaaaacccuaagaacgugcagacgacccccgggaccuucaagaccccggagggagaggucggcgcgaucgcguuagacuucaaaccuggaacgaguggcuccccgauugugaaccgcgaggguaagauagugggccucuacggcaacggaguggucaccacaagcggaaccuacgugucagcuaucgcccaggcuaaggcgucacaagaggggcccuugcccgagaucgaggacgaaguauucaagaaacgcaaucucacaauuauggaccuacacccggguagcgggaagacgcggcgcuaccugcccgcgaucguccgagaggccaucaagcgcaaacuccggacccuaauccuggccccaacccgcguuguggccucagaaauggcggaggcccucaaaggcaugccaauccgcuaccagacgaccgccgucaagagcgagcacaccggccgggagaucguggacuugaugugccacgcgaccuuuacgaugcgccuguuauccccgguacggguccccaacuauaacaugauuaucauggacgaagcccacuucaccgacccagcgaguauagccgcaaggggauacauaaguacgcgggugggcaugggugaagccgccgcgaucuuuaugaccgcgacgcccccggggucaguggaagccuuuccgcagaguaacgccgugauccaggaugaggagcgcgacauucccgaacgcagcuggaacaguggauacgacuggaucacggauuuucccggcaagaccguuugguucgugccgagcaucaaaucuggcaacgacauagcgaacugucugcggaaaaacgggaagcgaguaauacagcuaucgcgcaaaaccuucgacacagaguaucagaagacaaagaacaaugacugggacuacgugguuaccacugacaucuccgagaugggcgcuaacuuccgugccgaccgcgucauugacccccggcgcuguuugaagcccgugauccugaaggacggucccgagcgggugauccuggccggcccgaugccaguuacuguggccucugcggcccagcgccggggacggaucggccggaaccagaacaaggagggcgaucaguacaucuauauggggcaaccccucaauaacgacgaggaccacgcgcacuggaccgaggccaagauguugcuggacaauaucaacacccccgagggcaucaucccggcccucuuugagcccgaacgcgaaaagucugcggcaaucgacggcgaauaccgcuuacggggcgaggcacgcaagaccuuuguagagcugaugcggcgcggggaccuaccgguauggcugagcuacaagguugcuuccgagggguuucaguacagcgaccgaagaugguguuucgacggcgaacguaacaaucaggugcuugaagaaaacauggauguggaaaucuggacgaaggaaggcgagcgcaagaagcuccggccacgcuggcuggacgcacggacauauucugacccuuuagcacuccgcgaguucaaggaguucgcugccggccggcgcucagugagcggggaccuaauccuugaaaucggcaaacucccccagcaccugacccugcgggcccaaaacgcccucgauaaccugguuaugcugcacaacucggaacaaggcgggaaggcauaccggcaugccauggaggagcucccagacaccaucgagacccugaugcugcucgcccugaucgccgugcugacaggaggagucacacucuucuuucuaagugguaaggggcugggcaaaaccuccaucggcuuacugugugucauggcgagcagugcccuguuauggauggccuccguggaaccucacuggauagcggccuccauaauccuggaguucuuccugaugguucucuugauuccagagcccgaucggcagcgcacgccgcaggacaaccagcuggcguacgucgugaucggacuccuguuuaugaucuuaacgguggccgccaaugagaugggccucuuggagaccacuaaaaaggacuuggguaucgggcauguggcagcugagaaccaccaccacgcgaccaugcuggacguggaccugcggccugccagcgccuggacgcuguacgccguggccaccacggucauuacccccaugaugcgccauacgauagagaacacuacagcgaacaucucgcucacugcgaucgcuaaccaggccgcgauccugauggggcuggauaaaggauggcccaucagcaagauggacaucgguguuccucuccuggcgcugggguguuauucacaggugaacccgcucacgcugaccgccaccguccugaugcucguggcucauuacgccaucaucggccccggacugcaggcgaaggccacccgggaagcgcagaagcgcacggccgcgggcauaaugaagaacccuaccguggaugggaucgucacgaucgaccuggaucccgucgucuacgacgcgaaguucgagaaacagcucggucagaucaugcuucugauucucuguaccucacagauccugcucaugcgcacgacaugggcccugugugaguccaucaccuuggcgaccggcccucugacgacccucugggagggcaguccagguaaguuuuggaauaccaccaucgccgucucaauggcaaauauuuuccggggcagcuaccuggcgggcgccggccuggcauucucucuuaugaagagucucgguggcgggaggcgggggacgggggcucagggcgaaaccuuaggagaaaaguggaagcgccaauugaaccaacuuuccaagucggaguuuaacaccuauaagaagucagggaucauggagguggacagaucggaagccaaagagggcuuaaagcggggagagacuaccaagcacgcagugagcagagguaccgcuaaacuuagaugguuugucgagcggaaccucgugaagcccgaggggaaggugaucgaucucgguugcggccgcggcggaugguccuacuacugcgcaggccugaagaaggucacugaggugaagggauacaccaagggcggucccggccacgaggagcccaucccgauggcgacguacggguggaaucucgugaagcugcacuccggcaaggacgucuucuucacaccgcccgagaagugcgacacacugcuaugcgacaucggggagucaagcccgaacccuaccauugaggaggggcggacccugcguguacugaagaugguggagccauggcuucgagggaaccaguucugcaucaaaaucuugaacccguacaugcccuccgucguugagacgcuggagcagaugcaacgcaagcacggcggcaugcucgugcgaaauccccugucuagaaauuccacccaugaaauguauuggguaucaugcgggaccggcaacaucgugagcgcggugaauaugaccucucggaugcuacugaaccgcuuuacgauggcccauagaaagcccacauaugagcgcgacgucgaccugggagccggcacccgccauguggccguagaacccgaggucgccaaccucgacauuauuggccagaggauagagaauauuaaaaacgaacacaagagcaccuggcacuacgaugaggacaacccguacaaaacgugggcguaccacggguccuaugaggugaagcccuccggcagcgcaucaagcauggugaacgguguggugcgcuugcugaccaaacccugggauguuauccccauggugacccaaaucgccaugaccgacacgaccccguucggacagcaacgcguauucaaagagaaggucgacaccagaacaccccgcgcgaagcgcgggacggcgcagauaauggaggucaccgcgaagugguuguggggcuuucugagccguaacaaaaagccccgcaucugcacccgggaggaguucacgcgcaaggugcggagcaaugccgccaucggcgccgucuucguggaugagaaucaguggaacagcgccaaggaggcgguggaggaugagcgcuuuugggaccugguccacagggagcgcgagcugcauaagcaagggaagugcgccacgugcguguacaacaugaugggcaagagagagaagaagcucggggaguucggcaaggcuaagggcucccgggccaucugguacauguggcugggcgcacgguuccuggaguucgaggcccucggauucaugaacgaggaccacugguucucucgcgagaacucccugagcggggucgagggcgaggggcugcacaaacuggguuacauccugcgagacaucuccaagauaccaggcgggaauauguacgccgacgauaccgccgggugggacacuagaaucaccgaggacgaccugcagaacgaggccaaaaucacggacaucauggaacccgaacacgcccuuuuagccacaagcaucuuuaaacugaccuaucagaacaaggucgugcgaguccagaggcccgcuaagucaggcacggugauggaugugauuagucgcagagaccagcgcgggagcggccaagugggcacuuauggcuuaaacacguucaccaauauggagguccaacugauccgccagauggagagcgaagggaucuucuccccuagcgagcuggaaaccccgaaucucgccaagcgcguccuggauuggcuggagaaacacggcgcugagcguuuaaaaaggauggcgaucuccggggacgacuguguggucaagcccaucgacgaccguuuugccacagcccugaccgcccugaacgacaugggcaaggugagaaaggacaucccccaaugggaacccagcaagggguggaacgacuggcagcaagugccguucugcucccaucacuuucaccaacucauuaugaaggacggaagagacauugucgugcccugccgcaaccaggacgaacuggugggacgggcgcgcguuagccaaggcgcaggcuggucccugcgggagacugccugccucgguaagucuuacgcacagauguggcagcugauguacuuucacaggcgggaccugcgccucgccgccaaugccaucugcagugccgugcccguugacuggguacccaccucucggaccacguggagcauccaugcccaccaccaguggaugaccaccgaggacaugcuauccguguggaaucgcguguggauagaggagaacccuuggauggaggauaagacccacgucucuucuugggaggagguccccuacuuaggcaaaagggaggaucaguggugcggguccuuaaucggcuuaacggcccgcgccacuugggccacgaacauccaggucgccauuaaucagguccgccggcugaucggcaacgagaauuacuuagacuacaugaccaguaugaagagauucaaaaacgagagugaccccgagggggcccugugguaa

SEQ ID NO: 23770 - RNA, 9879 nt, Artificial Sequence
  derived and/or modified CDS sequence (opt11) from DENV-1__FJ850087__SS-prME
agcgugaccaugcugcuaaugcuguugcccaccgcguuagcauuccaccucaccacccguggcggggaaccccauaugauagugagcaagcaggaacggggcaagagccuguuguucaagacgagcgugggggucaacaugugcacccugaucgccauggaccugggcgagcucugcgaggacacgaugaccuacaagugcccccgcaucacggaggccgagcccgacgacguagacuguugguguaacgcaacggacacuugggugacauacgggaccugcagccaaacuggcgagcaccgccgcgacaagcggagcguggcccuggcgccccacguaggccuggggcucgagacgcgaacggagacguggaugagcuccgagggcgcguggaagcagauccaaaagguggaaaccugggcgcugagacaccccggguucacagugaucgcucuguuccucgcacaugcgaucggcaccucaaucacacagaaggggaucaucuucauucuguugaugcucgucacacccagcauggccaugcgcuguguggggaucggcaaccgggacuucguggaagggcugagcggcgccaccugggucgacgucgugcuggagcacggguccugcgucaccaccauggccaagaacaagccgacccucgacaucgagcugcugaagacugaggugaccaaccccgccguccuccgcaaacuguguauagaggcgaaaauuagcaacaccaccacggacucccgaugccccacccagggcgaggccacgcugguagaggagcaggacgccaacuucgugugucgccggacguucguagaccgggggugggggaacggcugcggccucuucggcaaggggagccugcugacgugcgcgaaguucaagugcguuaccaaauuggagggcaaaaucgugcaguacgagaaucugaaguacagcgugauugugacggugcacaccggcgaccagcaccaggucgguaacgaaacaaccgagcacgggaccaucgccaccaucacgccucaggcccccacaagcgagauucagcugacagauuacggggcccucacuuuggacuguagcccccgaaccggccucgauuucaacgagauggugcuccugacgaugaaggagaaguccuggcuugugcacaagcagugguucuuggaccugccgcugcccuggaccucuggggcaagcacuucgcaggagaccuggaaccgacaggaccucuuagucacguuuaaaaccgcacacgcuaagaaacaggaggugguuguacuggguucccaggagggcgcuaugcacaccgcccucaccggcgccaccgagauccagaccagcggcaccaccaccauauucgcggggcaucugaagugccggcugaagauggacaagcucacuuugaagggaauguccuacgugauguguaccgggagcuucaagcuggagaaagagguggccgagacccagcacggcaccguucugguccaggugaaguacgagggcaccgaugcccccugcaaaauucccuuccucacccaagacgagaaagggguuacccagaacggucgccugauuacggccaauccuauagugacagacaaggagaagcccgugaacaucgagaccgagccgccguucggugagagcuacauaguggugggcgccggcgaaaaggcucugaagcucucaugguucaaaaaggguuccuccaucggcaagauguuugaggcgacggcccgcggggcgcgccguauggccauccucggcgauacggccugggacuuugggucgaucggagggcuguucaccagcguggggaagcucauccaccaggucuuuggcaccgcguacggggugcuguucagcggcgugagcuggacgaugaagaucggcaucggcaucuugcucacguggcuuggccuaaauucccggagcaccagucucagcaugaccugcaucgcugucgggauggugacccuguaccugggcguuaugguccaggcagauuccgggugcgugauuaacuggaagggccgcgagcucaaaugugggagcggcauauucgucacgaacgagguccacaccuggaccgaacaguacaaguuucaagccgacucaccgaagcggcugagcgccgcgauaggcaaggccugggaggagggggugugcggcauacgcagcgcaacccgguuggagaacaucauguggaagcagaucuccaacgagcucaacuacauucuguuagaaaaugauaugaaauucaccguggucguaggugacgucaacgggauccucgcccaggggaagaagaugauccggccccagcccauggagcacaaguauagcuggaaguccuggggcaaagccaagauaauuggcgcggacauccagaacacgaccuucaucauugacgggcccgauacgccggagugccccgacgaccagcgggccuggaacaucugggagguugaggacuacggcuucgguaucuucacuacgaacaucugguuaaagcugcgcgacagccauacccagaugugcgaccaucggcucauguccgccgccaucaaggacagcaaggcggugcacgccgauaugggcuauuggaucgaguccgaaaagaacgagacuuggaagcucgcccgcgcuagcuucauugaggugaagacauguaucuggcccaagucccacacgcuguggagcaacggcguacucgaauccgagauggugauccccaagaucuauggggguccaaucagccaacacaacuaccggccgggguauuucacccagacggccggacccuggcaccugggcaaguuagagcuagacuuugaucugugcgaaggcaccacgguggucguggacgaacacuguggcuaccgcgggccgucucugcggaccaccaccguaacggguaagaucauccacgaguggugcugucgcagcuguacccucccgccccugcgguuccgcggggaggacgguugcugguacgggauggagauaaggccgguuaaggagaaagaggagaaccuggugagguccauggugagugcgggaucaggcgaggucgacagcuucagccuugggauccugugcguguccauuuugauugaggaggugaugcggagccguuggucccggaagaugcucaugaccggcacccuggucguguucuuacuccucaucaugggacagcugacguggaacgaccucauucgccugugcaucaugguaggugccaaugccucggaccguauggguaugggcaccacauaccuugcccucauggccacguucaagaugcggcccauguucgcggucggccugcuguuccgccggcucacaagucgggaaguguuacugcucaccgucgggcugagccucguggccucgguggagcuccccaacagccuggaggagcugggggacgggcuugccaugggcaucaugaugcugaagcuguugaccgauuuccagccccaccaacuguggacaacgcugcucucccugaccuucauucggacuagccugucccucgacuacgcguggaagacgauggccauggcgcuuucgauugucucccuguucccccucugccugagcacgacaucccagaagaccaccuggcugccggugcuccuugggagcuucggauguaagccccugacgauguuccucaucaccgagaauaaaaucuggggccgcaaguccuggcccaucaaugaggggaucauggcggugggaaucgucuccauucuucuguccagccuuuuaaagaacgacgugccccuggccggcccccucaucgccgguggaaugcuuaucgcguguuacguuauuagcggguccagcgccgaccugucccucgagaaggcagccgaagucagcugggaggaggaggccgagcacuccggcacgucacacaacauacugguggaagugcaggacgacgggaccaugaagauuaaggacgaagagagggacgacacccugacgauccuccuaaaggcgacccugcucgcgguuuccggcguguaccccaugucgauucccgccaccuuauucgugugguacuucuggcagaagaaaaagcagcgcucugguguucugugggacacccccagcccgcccgagguggaacgggccgugcuggacgacggcauuuaucgcauccuccagcggggccugcuggggaggucccaagugggcguggguguccuccaagauggcgucuuccacacgauguggcacgugacccgcggcgccgugcugauguaccagggcaagcgccuggaacccaguugggcuuccguaaagaaagaucucaucucauacggcgggggcuggcgguuccaaggauccuggaacacgggagaagagguccaggugauagccgucgaacccgggaaaaacccgaagaacgugcaaaccacucccggcaccuucaagaccccugagggcgaagugggggcaauugccuuggauuucaagcccggaaccucaggauccccgaucgugaaccgcgagggaaaaauugucggacuguacggaaacggcguggucacgacaagcgggaccuacguuuccgccauugcgcaggcuaaagccacccaggaaggccccuugcccgagauagaggacgaaguguucaagaagcggaacuugacgauaauggaccugcauccagggagcggaaagacccgccgguacuugcccgccauuguccgcgaggccaucaagcggaaacugaggacacugauucucgcgcccacccgggugguggcuagcgagauggccgaggcccugaagggaaugccuauccgcuaucagacgaccgcggugaagagugagcacaccgggcgcgaaaucguggaccugaugugccacgcaaccuuuacgaugcggcucuuguccccggugcggguccccaacuacaauaugaucaucauggaugaggcccacuuuacugaucccgcguccaucgccgcgcguggcuacaucagcacgaggguggggaugggcgaggccgcugccaucuucaugaccgcaacacccccaggguccguggaggcguucccccagucaaacgccgucauucaggaugaggagcgggacauacccgagcgcagcuggaauagcggcuacgacuggaucacggacuuccccgguaagaccgugugguucguacccuccaucaagagcgggaacgacaucgcaaacugcuuacggaagaacggcaagcgcgucauucaguugucgcggaagaccuuugacacggaguaucagaagaccaaaaacaacgacugggacuauguggugaccacggauaucagcgagaugggggccaacuuucgcgccgaccgggucaucgauccccgaagaugcuuaaagcccguaauccuaaaggagggccccgagcgcgucauccucgcagggcccaugccugugaccguggccuccgcggcccagcgucggggccggaucgggcgcaaccagaacaaggagggggaccaauacauuuacaugggccagccccugaauaacgacgaggaucacgcgcacuggaccgaggccaaaaugcuccucgauaauaucaacacccccgaggggaucaucccggcgcuguucgagcccgagcgcgagaaguccgcagccauagacggcgaguaccggcugcgcggagaggcacgcaagaccuucgucgagcuaaugcgccgaggcgaccugcccguguggcuguccuacaagguggccucggaaggcuuccaguacucggacaggcgcuggugcuucgacggcgagcggaacaaccagguccucgaggagaacauggacguggagaucuggacgaaggagggcgagaggaagaagcugcgcccacgguggcuggaugcucgaaccuacagcgacccgcucgccuuacgcgaauuuaaagaguucgcggcgggacgccggucugugagcggcgaccugauccucgagauugggaagcugccccagcaccugacccuccgcgcccagaacgcccuggacaaccuggucaugcugcacaacagcgaacagggcgggaaggccuaccggcaugcaauggaagaacugcccgacaccauugaaacccugaugcuccuggcuuugauugccgugcucaccggcggggugacccucuucuuccugucggggaaagggcuuggcaaaaccagcaucggguuacugugcgucauggccuccuccgcccugcuguggauggcguccguggagccacacuggaucgcggccagcaucauccuggaauuuuuccucauggugcugcucauaccggagccugaccgccagcggacaccccaggauaaccagcuagccuaugucguuaucggccuguuauuuaugauauugacgguggccgcgaacgaaauggggcugcuggagacgaccaagaaggaccucggcaucgggcacgucgccgucgagaaucaccaccacgccaccaugcuggacguggaccugcgcccggccuccgccuggacguuguacgcgguugccaccaccgugaucacccccaugaugcggcauacaauugagaacacuaccgccaacaucagcuugaccgcgaucgcgaaccaggcggccauucuuaugggccucgacaagggcuggcccaucuccaagauggacaucggggugccccuguuggcccucggaugcuacagccaggucaacccccugacccugaccgccgcuguuuugaugcuuguugcucacuacgccaucaucgggccugggcugcaggcgaaagcaacccgcgaggcgcaaaagaggaccgccgccggaaucaugaagaaucccacgguagacggaaucgugacgaucgaccucgaccccguggucuacgacgccaaguucgaaaagcagcugggccagaucaugcuguuaauccugugcacgagccagauccugcucaugcggaccacuugggcccugugugagagcaucacucuggcgaccgggccauuaaccacgcuaugggagggcagucccgguaaguuuuggaacaccaccauagcagugagcauggcuaacauauuccgcggguccuaccuggcuggcgccggguuagcguuuucacugaugaaaucccugggcggagggcggcgcggcaccggcgcccagggcgagacgcucggggagaaguggaagcggcaguuaaaucagcugaguaagagcgaguucaacacauacaagaagucaggcaucauggaagucgaccguagcgaggccaaggaggggcugaagaggggcgaaaccacaaagcacgcggucucccgcgguacggccaagcuccggugguucguggagaggaaccucgugaagccagagggcaaggucauagaccugggcuguggcagaggggguuggagcuacuacugcgcggggcucaaaaaggugaccgaaguaaaaggauauacgaaaggcggucccgggcacgaggagccgauuccaauggccaccuacggcuggaaccuggucaagcugcacuccgggaaggacgucuucuuuacgccgcccgagaagugcgacacacuccugugcgauauaggcgaaagcucccccaaccccacgaucgaagaggggaggacccugcgaguccucaagaugguagagcccuggcugcgcggcaaccaguucuguaucaagauccugaacccauacaugccuagcguuguggagacccuagaacagaugcagaggaagcauggcggcaugcuagucagaaaccccuuaucccggaacagcacgcacgagauguacugggucuccugugguaccgggaacauaguuagcgccgucaauaugaccucgcggaugcuccucaaccgguucaccauggcccaucgcaagccuacguacgagcgcgauguggaucucggagcgggcacccgacacguggccgucgagccggagguggccaaccucgacaucaucgggcaaaggauugaaaacaucaagaacgaacacaagagcaccuggcauuacgacgaagacaaccccuacaagaccugggccuaucacggcucguaugagguuaagcccagcggguccgccagcuccauggugaacggcgugguccggcugcugacgaagccgugggacgucauccccaugguaacccaaauagcgaugacugacaccacuccguucgggcagcagcgcgucuucaaggaaaagguggacacccggacgccccgggcgaagcggggaacugcccagaucauggaggugacagccaaguggcucuggggcuuccuaucacgcaauaagaagccccggaucugcacccgcgaagaguuuacccggaaaguccgcuccaacgccgcgaucggggccguuuucguggacgagaaccaauggaacucggccaaagaggccguugaagacgagcgguuuugggaccuggugcaccgcgagcgggaguuacacaagcagggaaagugcgcgacuugcguguacaacaugauggggaagagagagaagaagcugggcgaguucggcaaagcaaagggcagccgggccaucugguacauguggcugggcgcgcgguuccucgaguucgaggcccugggguuuaugaacgaggaccacugguucuccagggaaaauagccuauccggcgucgagggggagggccuucacaaacugggguacauccugcgcgacaucagcaagaucccgggcggcaacauguaugcggacgacacagccgggugggacacccggauuaccgaggacgaccuccagaacgaggccaagaucaccgacaucauggagcccgaacacgcucugcuggccacgaguaucuucaagcucaccuaccagaacaaggugguccgcguccagcgccccgcuaagucgggcaccgugauggacgugaucucccggcgggaccagcgcgggagcggccaggucggcaccuacgggcugaacacguucaccaacauggagguacaacugauucgccaaauggagucagaggguaucuucagccccuccgagcucgaaaccccaaaccuggccaaaaaggugcuggacuggcucgaaaagcacggggccgaacggcugaagcgcauggccauuucuggcgacgacugcgucgugaaacccaucgacgaccgguucgccaccgcgcuuacugcccucaacgacaugggcaaggugaggaaggacaucccgcagugggagcccuccaagggguggaaugacuggcagcaggucccguucugcagccaucacuuccaucagcucaucaugaaggacggccgggagauaguggugccaugucgcaaccaagacgagcuggucgggcgcgcucgggugucacagggcgccggguggagccuccgggagaccgccugccuggggaaauccuacgcucagauguggcagcuuauguacuuccaccgucgagaccugcgccuugccgccaacgcuauaugcagcgccgugcccguagacugggugcccaccagccggaccaccuggucuauacacgcgcaccaccaauggaugacgaccgaggacaugcugucaguguggaaccgcgucuggaucgaggagaacccauggauggaggacaagacccacgugagcagcugggaggagguacccuaccucggaaagcgggaggaccaguggugcggcucacugauaggauugaccgcgcgcgccacuugggccaccaacauccaggucgcuauaaaccagguucgcagauuaauugggaacgagaacuaccuggacuacaugaccagcaugaagcgauucaagaacgaguccgaccccgagggcgcccucugguaa

SEQ ID NO: 23771 - RNA, 9879 nt, Artificial Sequence
  derived and/or modified CDS sequence (opt11) from DENV-1__FJ850090__SS-prME
agcgugacaaugcugcuuaugcugcugccuacagcguuagcuuuucaccugaccaccagggguggagaaccccauaugauugugagcaagcaagaacggggaaagagccuccucuucaagaccagcgugggggugaacaugugcacccugaucgcgauggauuuaggcgagcuuugcgaagacaccaugaccuacaagugcccacgcauuacagagguugagcccgacgacgucgacugcuggugcaacgccacugacaccugggugacuuacgggaccugcagccagaccggcgaacacagaagagauaagcgaagugucgcccuggcgccacacgugggccuggggcucgagacgcgcaccgagaccuggaugagcuccgagggcgcguggaagcaaauccagaagguggagaccugggcgcugcggcauccaggguucacagugaucgcccuguuucuugcccacgccaucggcaccucuauuacucaaaaggggaucauauucauccuacugaugcuugugaccccaucgauggcgaugcgcuguguuggcaucggcaaccgggacuucgucgagggguuaucaggcgcaacguggguggacgugguccuggagcacggguccugcgugaccaccauggccaagaauaagccaacccucgacauagaacugcugaagacggagguuacaaaccccgccguccuccgcaaacuuugcauagaggccaagaucucuaacacgaccacggacucccggugccccacccagggcgaagcgacccuaguggaggagcaagacgcaaauuucgugugccggagaaccuucgucgaccgcggcuggggcaacggcugcggccucuucggcaaggguucccucuugacgugugccaaauucaagugcgugacaaaguuagaaggcaagaucguucaauaugagaaccugaaguacuccgucauagugacgguccacaccggagaccagcaccagguggggaacgagacgaccgaacacggaaccauagcuaccauaacgccccaagcccccacgucggagauacagcugacugacuacggggcccuaacgcuggacuguagcccccggaccggcuuagacuucaacgagauggugcuccugacaaugaaagagaaauccuggcugguccauaagcagugguuccuggaccugccgcugccauggaccuccggggcuagcacaucccaggagaccuggaaccgccaggaccuccuggugacguucaagaccgcccaugccaagaagcaggaaguggucguacugggcucccaggagggcgcgaugcauaccgcgcucaccggggccacggagauccagaccagcggcaccaccacgaucuucgccggucacuuaaaaugccggcugaagauggauaagcucacccugaagggcaugucauacguuaugugcacaggcagcuucaagcuggagaaggaggucgccgagacccaacacggcacggugcuggugcaggucaaguaugaggguaccgacgcgcccuguaagauccccuuucucacucaggacgagaaaggggucauccagaacggccgacuuaucaccgcaaacccgaucgugacggacaaagaaaaaccaguaaacaucgagacggagccuccauucggggaaucuuacaucguggugggugcgggagaaaaagcacugaaacuuagcugguucaaaaaggggagcagcauaggcaagauguucgaagccaccgcccgcggagcccggcggauggccaucuugggcgacaccgcuugggauuucgggagcauugggggccuguuuacgagugucgggaaacuuauccaccaaguauucggcaccgccuacgggguacucuucucgggcgucaguuggaccaugaagaucgggaucggcauccugcucaccuggcuaggauuaaacucacgcucgaccagccucucgaugacuugcaucgcggugggcauggugacccuauaccugggcguuaugguacaggccgauuccgggugcgugauaaauuggaagggucgagagcucaaguguggcagcgguauuuucgucaccaacgaagugcacacguggacugagcaguauaaguuccaggccgacuccccgaagcgucucagcgcugcaaucgguaaagccugggaggaaggggugugcggcauccgcagugccacacggcuagagaacaucauguggaagcagaucuccaacgaacuaaacuauauccuccuugagaacgacaugaaguucaccgucguagugggggaugccaacggcauucucacucagggcaagaagaugauccgcccucagccuauggagcauaaauacagcuggaaguccuggggaaaggcaaagaucauuggcgcggacauccagaacacuacauucaucauagacgggccugauaccccggagugcccugacgaucaacgggccuggaauaucugggaaguagaggacuacggauucgggauuuucaccacgaacauuugguuaaaguugcgcgacagccacacucagaugugcgaucacaggcuaauguccgccgcuauuaaagacuccaaggcaguucacgcggacauggguuacuggaucgagagcgagaagaacgagaccuggaagcucgcccgagccagcuucauugaggugaagaccugcaucuggcccaagucgcacacgcuauggucgaacggcguucucgaguccgagaugaucauacccaagauuuacgggggcccaaccucccagcacaauuaccggcccggcuacuucacccagacggccggccccuggcaccuggggaagcuggaguuagauuucgaccugugcgaggggacuacgguggugguagaugagcauugcggauaccgcgguccgucccugcggaccacuacggugacaggcaagaucauucacgaauggugcuguagaagcuguacccugccgccgcugcgguuccguggggaagacggguguugguacgguauggagaucaggcccguaaaggagaaggaagagaaccugguccgcuccaugguaagcgcaggcuccggugaggucgacagcuucucgcuugggauccugugcgucagcauucugauagaggaggugaugcguagccgcuggucccggaagaugcuuaugaccgguacgcuagcgguauuccuucuacugauaauggggcaguuaaccuggaacgaccucauucgcuuaugcaucaugguuggcgccaaugccagcgaucgaaugggcaugggcaccacguaccuugcccucauggccacguucaaaaugcgcccaauguucgcggucgggcugcuguuccgcaaauugaccagucgugaggugcugcuccucacgaucggacugucccuaguggccaguguggaacucccaaacagucuugaggagcuaggcgauggucuagcaaugggcaucaugaugcugaaacuguugaccgauuuucagccucaccaguuguggacgacacugcucucccugacauucaucaggaccagccugucgcuugauuaugccuggaagacaauggccauggcgcugagcaucgugucucuguuuccacucugccugagcaccaccucccagaagacuacgugguugccggugcuccugggcagcuucgguugcaagccccugaccauguuuuugauuacggagaacaagaucuggggccggaaauccuggcccaucaaugaggguaucauggccgugggaaucgucagcauccugcuaucaagccuccuuaagaacgacgugccccuagcugguccguugauagcgggcggcaugcucauagcaugcuacgugaucucuggguccuccgcggaucugagccucgagaaggccgccgaaguauccugggaggaggaggccgagcacucaggcaccucccacaauauccugguggagguacaagacgacggaacgaugaagaucaaggaugaagagagagaugacacgcugaccauccuccugaaggcaacccugcuggcuguguccggcgucuaccccaugagcauacccgccacccuguucgugugguacuucuggcagaagaagaagcagcgguccggcguccuuugggacacgcccagcccgcccgagguggaacgcgccguucuggaugauggcaucuaccggauccugcagcgcggguuauugggucggucccaaguuggugugggcgucuuccaggacggcgucuuccacaccauguggcacgugacccgaggggccgugcucauguaucaggggaaacgacuggaacccagcugggcguccgucaagaaggaccugaucaguuacggcggcggcuggcgcuuccaggggagcuggaacaccggugaagagguccagguuaucgccgucgagcccgguaagaaucccaagaacguccagacgacgccaggcaccuucaagacccccgaaggcgaggugggggccaucgcuuuggacuucaaacccggaacuagcggguccccgaucgugaaccgggaagggaaaaucguagggcuguaugggaacggcgugguuacgacuagcgggacauacguguccgcgaucgcgcaggccaaagccagccaggaggggccccugcccgagaucgaggaugagguauuuaagaagcgcaaccugacaauaauggacuuacacccagggucaggcaaaacucggcgcuaccuucccgcgaucguucgggaggcuauaaagcguaagcuacggacccuuauccuagcccccacuagagugguugccuccgaaauggcugaagccuuaaagggcaugcccauccgcuaccaaacuaccgcugucaagagcgagcacacaggacgggagauuguggaucugaugugccaugccaccuucacgaugcgccuguugucccccgugagagucccaaacuacaacaugaucaucauggacgaggcccauuucaccgacccugccagcauagcagcccgcggcuacauuuccacacgcguggggaugggagaggccgccgccaucuucaugacggccacgccgccagggucuguggaggcauucccccaguccaaugccgucauucaggaugaggagcgggacauuccggagagaucauggaacuccggcuacgacuggauaaccgacuuuccgggcaaaaccgucugguucgucccgagcauaaaguccgggaaugacaucgccaauugccuucgcaagaacggaaagcgagugauccagcuaagcaggaaaaccuucgacaccgaguaccagaaaacaaagaacaacgacugggacuacguggucacgacugacauuuccgagaugggcgcgaacuuccgugccgaccgaguaauugacccccggaggugcuugaagccgguuauccugaaggacggccccgagcguguaauccuugcgggaccgaugccuguuacgguggccagugcugcgcagcgccggggccgcaucggcaggaaucagaacaaagagggggaccaguacaucuacaugggccaaccccucaacaacgacgaggaccacgcgcacuggaccgaggccaagaugcucuuggacaacaucaacacccccgaggguaucauuccggccuuguuugaacccgagcgcgagaaguccgcggccauagacggcgaguaccgcuugcgcggugaagcucgaaaaaccuucgucgagcuuaugaggcgcggcgaccugcccguauggcugucuuacaagguggcaagcgaaggcuuccaguauuccgaucggcguugguguuucgacggugagaggaauaaccaaguccuggaggagaauauggacguggagauauggacuaaggagggugagcguaagaaauuacgcccucgcuggcuggacgcccggacauacuccgacccucuagcccucagagaguucaaggaguucgcagcggggcggagaagcgugucgggcgaccugauccuggaaaucggcaagcucccccagcaucuaacccugcgggcccaaaacgcgcucgauaacuugguuauguugcacaacucggagcagggcgggaaggcuuaccgccacgcuauggaggagcugccagacaccaucgagacccugaugcugcucgcgcugaucgcggugcugaccggcggggugacacucuucuuucuguccgggaaaggacugggaaagaccuccaucgggcugcugugcgucauggcgaguuccgcccugcucuggauggccagcguggagccccacuggaucgcugcuuccauaauauuggaguucuuccugaugguucuucugaucccggagcccgaucggcaacgcacgccccaggauaaucagcuggcauacgucguaaucggccuauuauucaugauucugacaguggcggccaacgaaauggggcuguuggagaccaccaagaaggaccugggcaucgggcacgucgccgcugaaaaccaucaucacgcgaccaugcucgauguggauuugcggccagccagugcuuggacauuauacgccguggccacaacugucauaacccccaugaugcgccauacuauugagaacacaacugccaacaucagucucacugccaucgccaaccaggccgccauacugaugggcuuggacaaaggcuggcccaucuccaagauggacauuggggugcccuuacuagcucuuggaugcuauucccaagugaacccucucacgcugaccgcgacggugcugauguuagucgcacacuaugccaucaucgggcccggccugcaagcuaaggccacccgggaggcgcagaagcgcacggcugccgggaucaugaagaaccccaccguggacggcaucguuacgauagaccuggaucccgugguguacgacgcgaaauucgagaaacagcucggacagauaaugcugcugauacugugcacuagccagauccugcugaugcgcacaaccugggcccuaugcgaaaguaucacccuagcgaccgggccucugaccacccucugggaggggagcccuggcaaguucuggaacaccaccaucgccguguccauggcuaacauuuuccgagggagcuaccuugcgggcgcagggcuggcguuuucccuaaugaagucacugggagggggccggcgggggacgggggcucagggcgagacccugggggagaaguggaagcgccaacucaaucagcugagcaagucggaauuuaacaccuacaaaaagagcggcaucauggaaguugaucggucagaggcuaaggagggguuaaagcgcggagagaccaccaaacacgcaguuagccgggguaccgcaaagcugcggugguucguagagcggaaccuagugaagcccgagggcaaggugaucgaccuggggugcgggcgaggcgguugguccuacuacugcgcaggccuaaagaagguuacggaggugaaaggguauaccaaaggcgggcccggccacgaggaacccauccccauggcgaccuacggcuggaaccucgugaaacuccacagcgggaaggauguguucuuuacgccgccggagaagugugauacccugcuaugcgacaucggggaguccucaccgaaccccacaauugaggagggucgcacccuuagagugcuuaagaugguagagccauggcuccgggggaaccaguucugcaucaaaaucuugaaucccuacaugcccuccguaguggaaacguuagagcagaugcaaagaaagcacggcgggaugcuuguccguaacccacugucucgcaauucaacucaugagauguacugggucagcugcggcacggggaauaucgugucugccguuaacaugaccucgagaauguuacucaaccgcuucacgauggcccaccggaagcccaccuacgagcgcgacgucgaccugggcgcuggcaccaggcacguagcgguggagcccgaagucgcaaaccucgacaucauaggucaacgcaucgaaaacauaaagaacgagcacaagucgaccuggcacuacgaugaggacaauccguacaagacgugggccuaccacggcagcuaugagguaaaaccuuccgggagcgcuucgagcaugguaaaugguguggugcgccucuuaaccaagcccugggacgucaucccaauggucacgcagaucgcgaugacggacacuacgccuuuugggcagcagcguguauuuaaggagaagguugacacccgcacgccccgggccaagcgcggcacugcccaaauaauggaggugaccgccaaguggcugugggauuuucucucacggaacaagaagccgcgcaucugcacccgggaggaguuuacucgcaaagugcggagcaacgcagcgaucggugccgucuucguggacgagaaccaauggaacuccgccaaggaggcaguggaggaugagagauucugggauuuaguacaccgggagcgggaacugcauaaacaggguaagugugccacuugcguauacaacaugauggggaagcgcgagaagaaacuuggggaguuuggcaaagcgaaggguagccgcgccauaugguacauguggcuaggcgcccgcuuccuggaguucgaggcccucggcuucaugaaugaggaccacugguucagccgcgagaacucccugucugggguggagggggagggcuugcacaagcucggcuauauucugcgggacaucuccaagauacccggcgggaacauguacgcagacgauaccgccgggugggacacccgcauuaccgaggacgacuuacagaacgaggccaagaucacggacaucauggagcccgagcacgcccuucucgccaccagcaucuucaaauuaacguaccagaacaaggugguacgggugcaacgccccgcaaagagcggcaccgucauggacgugaucucgcgccgggaucagcgcggaucaggucaggugggcacguacggucucaacacguuuaccaacauggagguccaacugaucaggcagauggagucggaggggaucuucagccccagcgagcucgagacuccgaaucucgccaagcguguucuggacugguuggagaagcauggugccgagcgacucaaacgcauggccaucucaggugacgacuguguggucaaacccaucgacgaccgguucgccacagcguuaacugcccugaacgacaugggaaaggugcggaaggacaucccccagugggaacccucaaagggguggaacgacuggcagcaggucccauucugcucccaucauuuccaccaguugaucaugaaggauggccgggacaucgucgugccaugccguaaccaagaugagcugguuggccgggcccgcguuagucagggggcgggcuggucccuccgggagacugccugccucgggaagucguacgcccagauguggcagcugauguauuuucaccgccgagauuugaggcucgccgccaaugcaaucuguucggccgugcccguugauuggguccccacuucccggaccacguggagcauucacgcgcaucaccaauggaugacaaccgaggauaugcuuuccguguggaacagaguauggaucgaggagaaccccuggauggaagauaagacccacguuagcucgugggaagaggugcccuaccugggcaagcgcgaggaccaauggugcgggucgcucaucggucugaccgcucgcgccaccugggccacuaacauccagguugccauuaaccaggugcgccggcugauaggcaacgagaacuacuuagauuauaugacguccaugaagcgcuuuaagaacgaaagcgaccccgagggggcgcugugguga

SEQ ID NO: 23772 - RNA, 9879 nt, Artificial Sequence
  derived and/or modified CDS sequence (opt11) from DENV-1__FJ850093__SS-prME
agcgugacgaugcuccucaugcugcuuccuacggcccucgccuuccaccugacgacgaggggcggcgagccccauaugauugugucgaagcaggagcguggcaagucgcugcuguucaagacaagugccggggugaacaugugcaccuugauagcgauggaucucggcgagcucugcgaagacacaaugaccuacaagugcccucgcaucaccgaggccgagcccgacgacgucgacugcuggugcaaugccacugacacuugggucaccuacgggaccugcagccagaccggcgaacacaggagggacaagcggucaguggcacuggcgccccauguaggccuggggcucgagacccgaaccgagaccuggaugagcagugaaggcgccuggaagcagauucagcgggucgagaccugggcacugcgccaccccggguuuacggucaucgcccuuuuccucgcucacgcgaucggcacgaguaucacacagaaggggauuauuuucauccuucuuaugcuuguaacccccuccauggcaaugcggugcguaggcaucgguaaccgcgacuucguggaggggcuauccggcgccacguggguggacguuguccuugagcacggguccugcgucaccacuauggcgaaaaauaagcccacccucgacaucgagcugcugaaaacggaggucaccaacccagcggugcuccggaaacugugcaucgaggccaaaaucagcaacaccaccacagauucccgcugcccgacccaaggagaggcgacccucguggaggagcaggacgccaauuucguuugucggcgcacguucguggaccgggguugggggaacggcugcggucuuuucggcaaggggagcuugcucacgugcgcuaaguuuaagugcgugaccaagcucgagggaaagauaguccaauacgagaaccugaaguacucagugauagugaccguccacaccggcgaccagcaucagguggggaacgagacgacagagcacggcaccaucgcaacgauaacgccccaggcccccacuagcgagauccaguuaaccgacuacggugcgcugacccuugauugcagcccccgcaccggcuuggacuucaacgagauggugcuucugacgaugaaggagaaguccugguuaguucacaagcaaugguuccucgaccugccgcugccauggaccuccggggcgagcaccagccaggagacuuggaaccgacaagacuuacuggugacguucaaaaccgcccacgcuaagaagcaggaggucgucgugcugggcucccaagagggcgccaugcacaccgcccucaccggugccacggagauccagaccagcggaaccaccacgauuuucgcgggccaccuaaagugccgccuuaagauggacaagcucacgcugaaaggcauguccuacgucaugugcacagggagcuucaagcuggagaaggaaguggcggagacucagcacggcacggugcuuguccaggugaaguacgaggguacagacgcucccugcaaaauucccuucuccacccaggacgagaagggggugacgcaaaacggcagacucauuaccgccaacccgaucgucacggacaaagagaagcccgugaacaucgagaccgagccgcccuucggcgaaucauauaucguagucggcgccggcgagaaggccuugaaacuuagcugguucaaaaaggguagcucaaucggcaagauguucgaggccacugcccgcggggcucggcgaauggcuauccuuggcgauacggcuugggauuuugggagcaucggcggcguuuucacguccguggggaagcugguccaucagguguucggcacagccuacgggguauuguucagcggcguguccuggacgaugaagaucgguauagggauccuccugacgugguuaggacucaacagucgauccaccagccuauccaugaccugcaucgcgguggggauggugacacuguaucuaggcgucauggugcaggccgacagcggcugcgugaucaacuggaagggccgggagcugaagugcgggucugguaucuucgucaccaacgagguacacaccuggaccgagcaguacaaguuccaagccgacagcccgaagcgucucuccgcggccaucggcaaggccugggaggagggggugugcggcaucagauccgccacccgcuuggaaaacaucauguggaagcaaaucagcaacgaguugaaccauauccugcuugagaacgacaugaaguuuaccguuguggugggggacgcaaacggcauacuggcucaggggaagaagaugauucggccacaacccauggagcacaaguacuccuggaaguccuggggcaaagccaagaucaucggcgccgauauccagaacacgacguucaucaucgacgggcccgacacgccggagugccccgacggccagcgcgccuggaacauuugggaggucgaagacuauggguuugguaucuucacaacgaacaucuggcugaaacuucgggacuccuacacucagaugugcgaccaccgcuuaaugagcgcagccaucaaggacuccaaggcugugcacgcggacaugggauacuggaucgaauccgagaaaaacgagaccuggaagcuggcccgggcgucauucaucgaggugaagaccuguacguggcccaaaagccacaccuuaugguccaacggaguccuggaaagcgagaugauuauccccaagauuuacgggggacccaucucccagcacaacuaccgcccaggguacuucacccagaccgccgggccauggcaucuggguaagcucgagcuggacuucgaccugugcgagggcaccacaguaguggucgacgagcacugcgggaaccggggcccgagccugcgcacuaccacggugaccgggaagaucauccacgaauggugcugccgguccuguacgcugccuccccugcgcuuccgaggugaggacggaugcugguaugguauggagauacggcccgugaaggaaaaggaggagaaccucguccguagcauggucucagccggcagcggggaaguggacagcuucagccucggcauccugugcgucagcaucaugauugaagaggugaugcgcagucgguggagccgcaaaaugcugaugacugggacgcuggccguguuccugcuccugaucaugggccaacugaccuggaaugaccucauccgccugugcaucauggucggggccaaugcgagcgaccggauggguaugggaaccacccaccuggcccugauggccacguuuaagaugcgcccgauguucgccguagggcugcuguucaggcgccucaccuccagagaagugcugcugcuuaccaucggucucagcuugauggccagcauggagcuccccaacucccuggaggaguugggugacggccucgcuaugggcaucaugaugcuaaaguugcucaccgaguuccagccccaccaacuguggacgacgcugcucucgcugaccuucgucaagaccacgcugucgcucgacuacgcuuggaagaccaccgcuaugauccugagcauugugucccuuuucccccucugccugagcacgacgucgcagaagaccaccuggcuaccaguucuccuggggucuuucggaugcaagcccuuaaccauguuccucaucaccgagaacaagaucugggggcgcaaguccuggccccuaaacgaaggcauuauggccauugggaucgugagcauccugcucuccagccugcugaagaacgacgugccccucgcggguccucugaucgcaggcggaaugcugaucgccugcuaugugaucagcggcuccagcgcagaccuuagucuggagaaagccgccgaagugagcugggagcaagaggccgagcacagcggggccagccacaacauccugguggagguacaggaugacggcacgaugaagaucaaagacgaggagcgcgacgacacucucaccauccuccugaaggccaccuugcuggccguguccgggguguaccccaugagcauccccgcgacgcuguucguaugguacuucuggcagaaaaaaaagcagcgcuccggcgugcugugggacacacccuccccgccggagguggagcgggccguccuggacgacggcaucuacaggauucugcagcgggggcugcucggucggucacaagugggagugggcgucuuccaggacgggguguuccacaccauguggcacguaacccgaggcgccguccugauguaccagggcaaacgcuuggagcccagcugggccuccgugaagaaggaucucaucuccuaugggggcggguggcgguuucagggcuccuggaacacgggggaagaggugcaagucauagcgguggagcccgggaagaacccuaagaacguccagaccacccccggcaccuucaagacacccgagggggagguuggugcgaucgcccuggacuucaagccagguaccucuggcagcccgaucguuaauagggaggguaagaucguggggcuguacggcaacgggguugugaccacaucuggcacguacgugucagccauagcccaggccaaggccagccaggaaggcccacuccccgagauugaggacgaggucuucaagaagcggaaccugacgaucauggaccugcauccgggcucaggcaagacccgccgguaucucccugccaucguaagggaggccaucaagcggaagcugcgcacucugauccucgcccccacgcgcguggucgcguccgagauggccgaggcccugaaaggcaugcccaucagauaccagacgaccgccgucaagagcgagaccacggggcgcgagaucguggaccugaugugccaugcgaccuucacaaugagacugcugaguccuguucgagugcccaacuacaacaugaucaucauggacgaggcgcacuucaccgacccugccagcaucgccgcccggggguacaucuccacgcgcgucggcaugggggaggccgcggccaucuuuaugacggccacgccacccgguagcgucgaggcguucccccaauccaacgccgugauccaggacgaggaacgggacauccccgagcggagcuggaacagugguuacgacuggauuaccgacuucccagggaaaacggucugguucguucccucaauuaaauccggcaacgauaucgcgaacugccugcggaagaacggcaaacgcgugauucaauugagucggaagaccuucgacaccgaauaccagaagaccaagaacaacgacugggacuacguggucacgacggauaucuccgagaugggcgccaacuuccgcgccgaccgggugaucgauccccgccggugccugaagcccgucauucugaaggacggucccgagcgcgugauccuugcgggucccaugcccgugaccguggcgagcgcugcccaacgacgcggccggaucgggcgcaaccagaacaaggaaggcgaucaguacgucuacauggggcagccccugaacaacgacgaggaccacgcccacuggacugaggccaagaugcuguuagacaacaucaacacccccgagggcauuaucccggcgcuguuugagccggagcgcgaaaaguccgcagcuauagacggcgaguaccguuugcgcggcgaggcccggaagaccuuuguagaguuaaugcgccggggcgaccugccggucugguugaguuacaagguggcgucggagggcuuccaauacucggaccgccgguggugcuucgauggcgagcgcaauaaccaggugcucgaggagaacauggacgucgagaucuggaccaaagagggagagcggaagaaacugcgcccgagauggcuggacgcgcgcaccuacuccgacccgcucgcccuacgggaguucaaggaguucgccgccggcagaaggagcgugagcggcgaucuaaucuuggaaaucgggaaacugccccagcaucugacacuacgcgcccagaacgcgcuggacaacuuagucauguugcacaacagcgagcagggcgguaaggccuaucgucacgccauggaagagcuccccgacaccaucgagacccugaugcuccuagcccucaucgcuguccucaccggcgggguaacccuguucuucuugucgggcaaggggcucgggaagaccuccaucggccuguugugcgugaccgccagcuccgcgcugcucuggauggccagcgucgagccccacuggauagccgcguccauaauuuuagaauuuuuccuuaugguucugcugaucccggagcccgacaggcagcggacgccccaggacaaccagcucgccuacguggucauugggcugcuguucaugaucuugaccguggccgccaacgagaugggcuuguuggagacgaccaagaaggaccucgggaucggauauguagccgcggaaaaccaccagcacgccaccaugcuggaugucgaccugaggccggccagcgccuggacccucuacgccgucgcgacgaccgucaucacccccaugaugcggcacacaaucgagaauacgaccgccaacaucucccucaccgccaucgccaaccaggccgcgaucuugaugggccucgacaaaggguggcccauaagcaagauggacaucggcgucccgcugcucgcucuggggugcuacucccaggucaauccguuaacacucacggccgccgugcuaaugcuggucgcucacuacgccauaaucgggcccgggcugcaagccaaggccacccgcgaggcgcagaagcgaaccgcagcgggaaucaugaagaauccgaccguggauggcaucguggcaaucgaccucgaucccgugguguaugaugccaaguucgagaaacagcuggggcagaucaugcugcucauccugugcacgagucagauacuacugaugcggaccaccugggcacuaugugaauccaucacccuggcuacggggccgcucaccacgcugugggaagggagcccgggcaaauucuggaacaccacaaucgccguguccauggccaacaucuuucgcggcaguuaccuggccggggccggcuuggcuuucagucugaugaagucccucgggggcggacggcgcgggaccggagcgcagggggagacccuaggcgagaaguggaagcggcagcugaaccagcugagcaagagcgaguuuaacaccuacaagcgcagcggaaucauggagguugaccgguccgaggccaaggagggccuuaagcgcggggagacuaccaagcacgccguaagccgaggcaccgcgaagcugcggugguucguggagcggaaucuggucaagccagagggcaaggugaucgaccuggggugcggucgcgggggcugguccuacuacugcgccgggcugaaacgggugaccgaagucaagggcuacacuaagggaggacccggccacgaagagccgaucccuauggccacguacgguuggaaccuggugaagcugcacagcggcaaggacguguuuuucaugccgcccgaaaagugcgacacuuugcucugcgacaucggggaguccagcccgaaccccaccauagaggaggggagaacccugaggguccucaagaugguggagcccuggcuuaagggcaaccaguucuguaucaagauucugaauccuuacaugccguccguggucgaaacgcucgaacaaaugcagcgcaagcacgggggcaugcuggugagaaacccccugucucgcaauuccacccacgaaauguacugggugucuugcgggaccgggaacauuguauccgccguuaauaugaccagccggaugcuccugaaccgauucacuauggcccaccggaagcccaccuacgagcgggacguggaccugggcgcugggacccgacauguagccguggagcccgaaguggccaacuuggacaucaucggccagcggaucgagaacaucaagaacgagcauaaguccaccuggcauuacgaugaagacaacccguacaagaccugggcauaccacgggagcuaugaggucaagcccuccggcagcgccuccagcaugguaaaugggguuguccgccuacuaaccaagccaugggacgugaucccaaugguaacgcagaucgcuaugaccgacacgaccccguucgggcaacagcggguguuuaaggagaaaguggacacucgcacgcccagggccaaacgcggcacgacccagaucauggaggucaccgccaaguggcucuggggauuccugucccggaacaagaagccucgcaucugcacccgggaggaguucacgcgcaagguccggagcaacgccgccauuggcgcgguguucguugaugagaaccaguggaacagcgccaaggaggccguagaggaugaacgcuucugggaccugguucaccgggagagggagcuccauaagcaggggaagugcgcgacuugcguuuacaacaugaugggcaagcgggagaagaagcugggggaguucgggaaggccaaaggcucccgcgccaucugguacauguggcuaggggcccgguuccucgaguucgaggccuugggcuucaugaacgaagaucauugguucagccgcgagaacucacugagcgggguggaaggcgagggcuugcacaagcugggcuacauccugcgugacaucuccaagaucccgggcgguaacauguacgccgacgauaccgcagggugggacacccgcauuacggaggacgaccuccagaacgaggccaagauuaccgacaucauggagccggagcacgcccugcuggccacaucuaucuucaagcuaaccuaccagaacaaggugguccgcgugcagagacccgccaagaaugggacgguaauggacgucaucucccgccgggaccagcgcggcagcggccagguggggaccuacgggcuuaacaccuucacgaauauggaggugcaacugauccggcagauggagagugagggcaucuuccuccccagcgaguuagagacgccgaaucuggcggaacgcguccucgacuggcuggaaaaacacggggccgagcggcugaagcgcauggccaucucgggggaugacugcguggugaagcccauugacgacagguucgccaccgccuuaacggcgcugaacgacaugggcaagguccgcaaggacaucccccaaugggaacccagcaagggcuggaacgauuggcagcagguccccuucugcucccaccauuuccaccagcuuaucaugaaagacgggcgggagaucguggucccgugccgcaaccaggacgagcucgucggucgggcccgcgugagccagggggccgguuggagccugcgggagacugcuugucuggggaaauccuaugcucaaauguggcaacucauguacuuccaccgccgggaccugcgccuggcggccaacgccaucugcucugcaguaccgguggauugggugccgacaagucggacgaccuggagcauucacgcgcaccaucaguggaugacaacagaggauaugcucuccgucuggaaccgcguguggaucgaagagaacccguggauggaggacaagacgcauguuagcuccugggaggaggucccguacuuaggcaagagagaagaccaauggugcggcucucugauuggcuuaaccgcccgggccaccugggccaccaacauccaagucgccaucaaccaaguccgacgccugaucggcaacgagaauuaucuggacuacaugacauccaugaagcgauucaagaacgagagcgaccccgagggggcgcuuugguga

SEQ ID NO: 23773 - RNA, 9879 nt, Artificial Sequence
  derived and/or modified CDS sequence (opt11) from DENV-1__GU131863__SS-prME
ucggucaccaugcugcucaugcugcugccaacagcccucgccuuccaccuuaccaccaggggcggggagccccauaugaucgugagcaaacaagagaggggcaagagccuccucuucaagaccuccgugggggugaacauguguacccugaucgcgauggaucugggcgagcucugugaagacacgaugaccuacaaguguccccggauuacggaggcagagccggacgacguugacugcuggugcaacgcaacagacaccugggugaccuacgggaccugcucgcagaccggcgagcaucggagggacaaacguuccguggcccucgcaccccacgugggccuggggcucgagacgcgcaccgagaccuggaugagcuccgagggcgcauggaagcagauucagaagguagagaccugggcccuccggcaccccggguucacugugauagcauuguuccucgcccacgcgauagggaccagcaucacgcagaaagggauuauuuuuauccuguugaugcuggucaccccuuccauggccaugcgcugcgugggcauaggcaaccgggacuucguggaggggcuuucaggcgcuaccuggguagacguggugcucgaacacggguccugcgucacaacuauggccaaaaacaagcccacucucgacaucgagcuucugaagacggaagugaccaaccccgccguacugagaaagcuguguaucgaggcgaagaucagcaacaccaccaccgacucccggugcccuacacagggcgaagccacucuggucgaggaacaagacgccaacuuuguaugucgcagaaccuucguagauagaggcugggggaauggcugcggccucuucggcaaggggagccugcugacgugugcuaaguucaagugugucacgaagcucgagggcaagaucgugcaguaugagaaccugaaguacuccgucaucgucaccgugcacacuggcgaccagcaccaggucgggaacgagacgaccgagcaugguacaauagccaccaucacgccucaggcucccacuucggagauccaguugacugacuacggugccuugacccuggacuguagcccgcggaccggccucgacuuuaacgagauggugcuccugacgaugaaggagaagaguuggcugguucauaagcagugguuccucgaucuaccgcugcccuggaccucaggugccucgaccagccaggagaccuggaaucgccaagaucuguuggucacguucaagaccgcccaugccaagaaacaggaaguugugguccugggcucccaggagggcgcgaugcacaccgcccucaccggggcuacggaaauccaaaccagcggcaccaccacaaucuuugccggacaccugaagugcagacugaaaauggauaagcucacucugaagggcaugaguuaugucaugugcaccgggucguucaaacuggagaaggaggucgccgagacccagcacggcacuguccugguccaggugaaguacgagggcaccgacgcgcccugcaagauccccuuccucacccaagacgagaagggggucacacagaacggccgacuuaucacagcuaacccgaucgucaccgauaaggagaagcccgugaacaucgagaccgagcccccuuucggggagucuuauauugucgugggagccggcgaaaaggcccuaaaacucagcugguuuaagaagggguccagcaucggaaagauguucgaggcgaccgcacgcggggcacgccgcauggcgauccugggcgacacagcuugggacuucgggucuaucggcggacuguucaccucgguggggaaacuaauccaccaagucuucggcaccgcguacgggguguuauucuccggcgugucguggacgaugaagaucgggaucggcauccugcucacguggcucgguuuaaacucgcgcaguaccagccucagcaugaccuguaucgccgucgggauggugacccuuuaccucggcguaaugguccaggccgauuccgggugcguuaucaacuggaagggccgagagcucaagugcggcagcggaaucuucgugacgaacgaaguccacaccuggaccgagcaguacaaauuccaggccgacucaccgaagcggcugagcgccgcgaucggcaaagccugggaggagggugugugcggcauccggagcgccacaaggcucgagaauaucauguggaagcagaucaguaacgaacucaacuacauucucuuggaaaacgacaugaaguucaccguggugguaggagacaucaacggcauacucgcccaggggaagaagaugauccgcccccagccaauggagcacaaguacagcuggaaauccuggggcaaagccaaaaucaucggagccgacauccagaacacgaccuucaucaucgacgggccugacaccccggagugccccgaugaccagcgggccuggaacaucugggaaguggaggacuacggguucggaaucuucacuacgaacaucuggcugaagcugcgggacagucacacccagaugugcgaccaccggcucaugagcgccgcuauaaaggacagcaaggcgguccacgccgacaugggcuacuggaucgaauccgagaaaaacgagaccuggaagcuggcccgcgccagcuucaucgaagugaagaccugcauauggcccaagucccacacccuguggagcaacggcgugcucgaguccgagauggucaucccuaagauauacgggggccccauaucucaacacaacuauagaccuggguauuucacccagaccgcaggccccuggcaccuggggaagcuggagcuugacuucgaccugugcgagggcacgacugugguggucgacgagcauugcgguuaccgcgggccuucguuaagaacgaccaccguuacgggcaagaucauccacgaguggugcugccgcagcugcacauugccgccucugcgguuccgcggggaagacggcugcugguacgggauggagauccggccagucaaggaaaaagaggagaaucuggugcgcuccauggugucggcuggcuccggugaaguggacagcuuuagccuggggauccugugcgugucaauccugauagaggaggugaugcggagccgcuggucucgaaagaugcucaugacuggcacccuggccguguuccuacugcugaucauggggcaacugacguggaacgacuuaaucagacugugcaucauggucggcgccaacgcaagcgaccgaauggggaugggcacaaccuaccuggccuuaauggcgacguucaaaaugagaccgauguuugccgugggccugcuauuccgccggcugacuucgcgcgaggugcugcuccucacggucgggcugagccugguggcuuccguagagcuccccaacagccuggaggaguugggcgacgggcucgcgaugggcauaaugaugcucaagcuucucaccgauuuucagccccaccagcuguggaccacccugcucucccugacguucauccggaccucgcugucucucgacuacgcguggaagacgauggcaauggccuugucuauugugucccucuucccccucugccugagcacgacgucccaaaagaccacuuggcugccugugcuccucgguagcuucgggugcaaaccccugacgauguucuugaucaccgaaaacaagaucuggggucguaaguccuggcccaucaacgaggggaucauggccgucggcaucgucucuauccugcuguccucacuccugaagaacgacgugccccuggccgguccgcucaucgcaggcggcaugcugauagcuugcuacguuauaucaggauccagcgcagaccugucccuggagaaggccgcugaaguuagcugggaggaagaggcggagcacuccggcacgagccacaacauccugguugagguucaggacgacgggaccaugaagaucaaagacgaggagcgggacgacacucugacgauucuccugaaagccacccugcucgccguguccggcguguaccccaugagcauccccgcgacccuguuugucugguauuucuggcagaaaaagaaacagcgguccggggugcugugggauacccccagcccacccgagguggagcgcgcuguccuggacgacggcaucuaccgcauccuccaacggggacugcuggggcgcucccaggugggagugggagucuuccaggauggcguguuucacacgauguggcacgugacccgcggggcgguccucauguaccaggguaaacggcuggagcccaguugggcuagugugaaaaaggaccucaucagcuacggcggcggauggcguuuccagggaucauggaacacgggcgaggagguucagguaaucgcuguggagcccgggaagaacccgaagaacgugcagaccacgccaggcaccuucaagacaccugaaggugaggucggcgccauagcccucgacuucaagccgggcaccagcggcuccccgaucgugaaccgggagggcaaaaucguuggccuguacgggaacggagucgugacgaccagugggacauacguguccgcgaucgcccaggcgaaggccacacaggagggcccccucccagagauagaggacgaaguauucaaaaagcggaaccuuaccaucauggacuugcacccgggaagcggcaagacccgucgguaccuccccgccauugugcgcgaggcgaucaagcggaagcuccgcacccugauucuggcaccaacucgcguagucgcaagcgagauggccgaggcgcucaagggaaugcccauccgguaucagacgaccgccguaaagucugagcacaccgggcgcgagaucguagaccugaugugccacgccacguucacgaugcggcugcuaagcccaguacgcgucccuaacuacaacaugaucauuauggacgaagcucacuucaccgaccccgccuccauagcugcucggggcuauauaucgacccgcguggguaugggcgaggccgcugccaucuucaugacagcgacgcccccuggguccgucgaggccuucccucagucuaacgccgugauccaggacgaggagcgggauaucccggagcgaucauggaacuccgguuacgauuggauaaccgacuuccccggaaagaccguuugguucguaccauccaucaagagcgggaacgacaucgccaacugccugcggaagaaugggaagcgcgugauccaacucucacggaaaaccuucgacacggaguaccagaagacgaaaaacaacgauugggauuacgugguaaccacagacauuagcgaaaugggggccaauuuccgcgcggaucgggugauagacccacgccggugccucaagccagucaucuuaaaggagggcccagagcguguuauccuggccggaccgaugcccgugacgguugccucugccgcacagcggaggggacggauuggccguaaccagaacaaggagggugaccaguauaucuacaugggccagccucucaacaacgacgaggaccaugcccacuggaccgaagccaaaaugcugcuggacaauaucaacacccccgaggggauaaucccugcgcuauucgaacccgaaagagaaaaguccgccgcgauugauggcgaguaccgguuacgcggagaggcccggaaaaccuuuguggagcugaugaggcggggcgacuuacccgucuggcuaaguuacaaggucgccucggagggcuuccaguacuccgaccgccgguggugcuucgauggugagcguaacaaccaagugcucgaggagaauauggaugucgagaucuggacuaaggagggggagcggaagaagcuuaggcccagauggcucgacgcgcgcaccuacagcgauccuuuggcucucagagaguucaaggaguucgcggccgggcgccgguccgugagcggggaccugauccuggagauuggcaaguugccccagcaucugaccuugcgcgcacagaacgcccuagacaaccugguuaugcuccacaacagcgaacaaggcgggaaggccuaccgccacgcgauggaggagcugccggauaccaucgagacccugauguuacucgcccugauugccgugcugaccggcggggucacccucuucuuccuguccgggaagggccugggcaaaaccagcauuggucuacugugcguaauggcuuccagcgcccugcuuuggauggccucaguugagccccacuggaucgccgccucgaucauauuggaguucuuccuuaugguccuccugaucccggagcccgauaggcagcggaccccccaggauaaccaacuggccuacguuguuaucgggcuccuguucaugauccugacgguugcugccaacgagauggggcugcuggagaccacgaagaaagaccugggcaucgggcacguggcaguagagaaucaccaucacgcaacaauguuagauguagaccugagaccagccuccgcguggacgcucuacgccguggcaaccacggugaucacacccaugaugagacacacgauugagaacacuacggcaaacaucagcuugaccgcgauagcgaaccaggcugccauucugaugggacuagacaagggcuggcccaucucuaagauggacauuggggucccccuccuggcccuagguugcuacucccaggucaacccguugacacuaaccgccgcggugcugaugcugguggcacacuaugccauaauuggaccaggcuuacaggccaaagcgacccgcgaggcccagaagaggaccgccgccgggaucaugaaaaaccccacgguagacgguauugugaccaucgaucuggaccccgucguguacgacgccaaguuugagaagcaacucggccagaucaugcuguugauucucugcaccucccaaauauugcuaaugcgcaccacgugggcgcugugcgaguccaucacgcuagccaccgguccgcugacaacgcucugggagggcagccccgggaaguucuggaacaccaccaucgccgugucuauggcaaacauauuccgcggcuccuacuuggcgggcgccgggcucgccuuuagcuuaaugaagucacugggcgggggccggcgcgggacuggcgcccagggggagacuuugggggagaaguggaaaaggcaauuaaaccagcuguccaaguccgaguucaacacauacaagaaguccggcaucauggaggucgaccgcagcgaagccaaagaaggacugaaacguggcgagaccaccaaacacgcgguuucacgcgggacugcgaaacuccggugguucguggaaagaaacuuagucaagcccgagggcaaagugauagaccuagguugcgggcggggcggguggagcuacuacugcgccggauuaaagaaggugaccgaagucaagggguacaccaagggcggccccgggcacgaggagccgaucccaauggccaccuacggauggaaccucgucaagcugcacucaggaaaggacguguucuucacgccucccgaaaagugcgacacccuacuuugcgacauaggggagagcuccccgaauccuaccaucgaggaagggcgcacccuaagaguccuaaagauggucgaacccugguuacgugguaaccaguuuugcauaaaaauucugaaccccuauaugccgucagugguugaaacgcuggagcagaugcagcgaaaacacggggggaugcuggugcgcaacccccuaucccggaacagcacgcacgaaauguacuggguaagcuguggcaccgggaauaucguguccgccguaaacaugaccucccgaaugcugcuaaaccgguucacuauggcgcaccggaaacccacguaugagcgcgacguggaccugggcgccggcacgcggcacgucgcaguggagccugagguggcgaaccucgacaucaucgggcagcguaucgaaaacaucaagaacgaacauaagagcacuuggcacuacgaugaggacaacccguacaagacaugggcuuaccacggcuccuacgagguaaagcccuccggguccgcgagcuccauggugaacggaguugugagacuucugacgaagcccugggacguuauacccaugguaacccaaaucgccaugaccgacacgacgccguuugggcagcagcguguguuuaaggagaagguggauacgcggacuccucgagccaagcggggcacagcacagaucauggagguaacggccaaguggcuaugggguuuucucagccgcaacaaaaagccgcggauaugcacccgugaggaguucacucggaaagugcguuccaacgccgccaucggagcuguguucguagacgaaaaccaguggaauucugcuaaggaggccguggaggaugagcgguucugggaccuugugcacagagagcgcgagcuucacaagcaaggcaagugcgcgaccugcgucuauaacaugaugggaaagcgggagaaaaaacuaggggaguuugggaaagcaaaaggcagcagagccaucugguauauguggcugggggcccgcuuccuggaguucgaggcuuuaggauucaugaacgaggaucacugguucucaagagagaacagccugaguggaguagagggugagggacugcacaaacugggauauauccuccgugacaucagcaagaucccgggcggcaacauguacgccgacgacacagccggaugggacacccgaauuaccgaagaugaccuacagaacgaggcaaagaucaccgacaucauggagccugagcacgccuuauuagcgacguccauuuucaaacugacguaccagaacaaggugguccgagugcaacgccccgccaagagcggaaccgugauggacguuaucuccaggcgcgaccaacggggcucaggacaggugggcacguacgggcucaacacauucacaaacauggaggugcagcugauccgccagauggaauccgaggguauauucagcccguccgagcuggagaccccgaaccucgccaagaagguccuggauugguuagagaaacauggggccgagagacucaagcgcauggcgaucagcggggacgacugugucguuaagcccauagacgaccgcuuugcgaccgcccugacggcccugaacgacauggggaagguccgcaaggacaucccccagugggagccuuccaagggcuggaacgauuggcagcaagucccguucuguucccaccacuuccaccagcucaucaugaaggacggccgggaaaucgugguacccugccggaaccaggacgagcugguggggcgugcccgcgugucccagggagcgggguggagcuugcgagaaaccgcuugccucggcaagucauacgcgcagauguggcagcugauguacuuccaccgucgagaccugcgacucgccgccaaugccaucugcagcgccgucccggucgauugggugccuaccagccggaccaccuggucgauccacgcacaccaucaauggaugacgaccgaagacaugcugagcguuuggaacagaguguggaucgaggaaaacccuuggauggaggacaaaacacacgugucaucaugggaggaagucccauaccuugggaagcgggaggaucaguggugcggcucccuaauuggccugaccgcacgggccacaugggcgaccaacauccaaguggcaauuaaccaggugcgccgucugaucgggaacgagaacuaucuggacuacaugaccucuaugaagcgcuucaaaaacgagucugauccugagggugcccugugguag

SEQ ID NO: 23774 - RNA, 9879 nt, Artificial Sequence
  derived and/or modified CDS sequence (opt11) from DENV-1__GQ868559__SS-prME
ucagugacaaugcugcucaugcugcuucccaccgcuuuggccuuccacuuaaccacccgcggcggugagccccacaugaucgugagcaagcaggagcggggcaagucccugcuguucaagacgagcgcgggcgugaacaugugcacccugaucgcuauggaccugggcgagcucugcgaagacacgaugaccuacaagugcccccgaaucacugaggccgaaccagacgacguggacugcuggugcaacgcuaccgacacuugggugacguacgggaccugcagccaaaccggcgagcaucggcgagacaagcggagcguggcccuggcgccccacgugggccuggggcuugagacccggaccgagacauggaugagcuccgaaggugcguggaagcagauucagagagucgagaccugggcccugcgacaccccggguucacggugauagccuuauuccucgcucacgccaucgggacaagcaucacccagaagggaaucaucuuuauccugcugauguuagugacccccagcauggcgaugcgaugcgucggcaucggcaaccgugacuucguggaggggcugagcggcgccacguggguggacgucguacuggaacacggcuccugcgugacuaccauggcaaagaacaagccgacccucgacaucgaacugcugaagacggagguaacaaacccugcggugcuucggaagcuaugcaucgaagccaagaucagcaacacaaccacggacucucgcuguccgacgcagggcgaggccacccugguggaggagcaggaugccaacuucgugugccggcgcaccuuugucgaccggggcugggggaacggcugcggccuguucggcaaagggagccugcugacgugugccaaauucaagugcguaacuaagcucgagggcaagauaguccaauacgaaaacuugaaguauucggugauagucaccguacauaccggcgaucagcaucaagugggcaacgagacgaccgagcaugguacuauagcgaccaucacgccccaggccccuacgagugagauccagcugaccgacuacggggcccucacccuggacugcucuccccgcaccggacuugacuucaacgagaugguccuccugacgaugaaggagaaguccuggcuggugcacaagcagugguuccucgaucugccgcugcccuggaccuccggggccagcaccucccaggagaccuggaaccggcaggaccuccuggugacguuuaagacagcucaugcgaagaagcaggaggucguggugcugggcucccaggagggcgcgaugcauaccgccuuaaccggggccacggagauccagacgagcggcacaaccacgaucuucgccggucaccugaagugccgccucaagauggacaagcucacucugaagggcaugucuuacgucaugugcacggggagcuucaagcuggagaaggagguggcggagacccaacauggcacggucuugguccagguaaaguacgaggguaccgacgcccccugcaagauccccuucaguacccaggacgagaaggguguuacccagaacggcagguugaucacggccaacccgaucgugacugauaaggagaagccggugaacaucgagaccgagccgccguucggggaaucuuauaucguggucggcgccggcgaaaaggcucugaaguuguccugguuuaaaaagggguccuccaucggcaagauguuugaggccacggcccguggggcccggcgcauggccauccucggcgacacggcgugggacuuugguucuaucgggggcguuuucaccuccguggggaagcuuguccaccagguuuucggcaccgccuacggggugcucuucagcggagucuccuggaccaugaagaucggaaucgggauccuccugacguggcugggacucaacagccguuccacaagccuguccaugaccugcaucgccguggggauggugacccuauaccucggcgucaugguacaggcugacagcgggugcguuauuaauuggaagggccgggagcugaaguguggguccggcaucuucgucacgaaugaggugcacaccuggaccgagcaguacaaguuccaggccgauagcccgaagcgccugagcgcggcgaucggaaaggccugggaggagggggugugcggcauccgguccgccacccgccucgagaacaucauguggaagcagaucagcaacgagcugaaccauauccugcucgaaaacgacaugaaauucaccgucguggucggggaugccaacggcaucuuggcgcaggggaagaagaugauccgcccccagcccauggagcacaaguacuccuggaagagcuggggcaaagcaaagaucaucggugccgacauucagaacacgaccuucaucauugacgggcccgacaccccggagugccccgauggccagagggccuggaacaucugggaagucgaggacuacggguucgguauuuuuaccacgaacauuuggcugaagcuccgggacuccuacacccaaaugugcgaccaucgccugaugagcgcggcaaucaaggauucaaaggccgugcacgccgacaugggcuacuggaucgagagcgagaagaacgagacguggaagcuggcgcgggcguccuucaucgaggugaagaccugcacguggcccaagagccauacccucugguccaacggcguccuggaguccgagaugaucauucccaagaucuacggugggccgauaucgcaacacaacuaccgccccggcuacuuuacucagaccgccggccccuggcaucuaggcaaacucgaacuggacuucgaccucugugagggcacgaccguggucgucgaugagcacugcgggaaccggggcccgagccuccgcaccaccaccgugaccgggaagaucauccaugaguggugcugccgguccuguacacuaccuccucuucgguuccggggagaggacgggugcugguacgggauggagauccgcccagucaaggagaaggaggaaaaccucguccggucuaugguauccgccggcagcggggagguagacagcuucucccugggcauacugugcgucagcauuaugaucgaagaggugaugcgcuccagauggagccggaaaaugcucaugacugguacgcuggccgucuucuuauuacugaucauggggcagcucaccuggaacgaccucauccgccugugcaucauggucggggcuaacgcauccgaccgaaugggcaugggcacaaccuaucucgcccucauggcgacguucaagaugaggccaauguucgccguaggucuccuguuucggcgccuaaccucucgggaggugcugcugcugaccaucgggcugucccugguggcaagcguggaacuccccaacucccuggaggagcugggggauggccucgcgaugggcauuaugauguugaagcuguuaaccgaguuucagccacaucagcuguggacgacccugcucagccugaccuucguaaagaccacgcugucccucgacuacgccuggaagaccaccgccaugguauuaagcaucguaucccuguucccgcucugccugagcaccacgucccagaagaccaccuggcugccgguccuccugggcagcuucggcuguaagccccugaccauguuccucaucaccgagaacaagaucugggggcgcaaguccuggcccuuaaaugagggcaucauggccauagguaucgugaguauacugcucuccagccugcuuaagaacgacguuccccucgcgggcccgcugauagccggcgggaugcucaucgccugcuacgucaucagcggcuccagcgccgaccucuccuuggagaaggccgcggaggucagcugggagcaggaggccgagcacuccggggccagccauaacaucuugguggagguccaggacgauggcacgaugaagaucaaggaugaggaacgggacgacacguugaccauccuccucaaggcgacccuccucgccguguccgguguguaucccaugagcaucccggcgacgcuguucgucugguauuucuggcagaagaagaaacaacgcucaggcguucucugggacaccccuagcccgcccgagguggagcgugccguccuggaugacggcaucuaccguauucugcagcguggguuacuuggccgcucccaggugggggugggcguguuccaggacgggguguuccacaccauguggcacgugacacggggcgcaguccugauguaucagggcaagcgccuggagcccagcugggccuccgugaagaaggaccucaucagcuaugggggcggguggagauuccagggguccuggaacacaggugaggaagugcaggucauagcgguagagcccggcaaaaacccgaagaacguccaaacuacccccggcaccuucaagacuccggagggugaagucggcgcgaucgcccuggacuucaagcccgggaccuccggcuccccaauugugaaccgcgagggcaagauugugggccuguaugggaacggggucgugaccaccagcggcacauacguuuccgccaucgcgcaggccaaggcgucacaggaggggccccuucccgagaucgaggacgaggucuucaagaagagaaaccuaacgaucauggaucugcauccgggcagcggcaagacacgccgguaccuccccgccaucgugcgcgaggccaucaagcgaaagcugcgcacccuuauccucgcuccuacgcgcguagucgcguccgagauggccgaggccuugaagggaaugcccauacgauaccagaccaccgccgucaagagcgagcacacuggccgggagaucguggaccugaugugccacgcuacguucacgaugcggcuccugaguccuguccgcgugcccaacuacaacaugaucaucauggacgaggcgcacuucaccgaccccgcuagcaucgcggcccggggguacaucuccacccgcguaggcaugggggaagccgccgcgaucuuuaugacggccacgccccccggauccgucgaggccuucccccagaguaacgcuguaauccaagacgaggagcgggacauccccgagcgcagcuggaacucuggcuacgacuggaucaccgacuuccccgggaaaaccgugugguuugucccgagcaucaagucuggcaacgacaucgcgaauugccugcggaagaacggcaagcgugugauccagcucagccguaagacguucgacaccgaguaccagaagaccaagaauaacgacugggauuacgucgucaccacggauaucuccgagaugggcgccaacuuccgcgcugauagagugaucgauccccggagaugccugaagcccgugauccugaaggacgggcccgagcgcgucauccucgccggcccgaugccaguaaccgucgcgagcgccgcccagcggcgcggcaggaucgggcgaaaccagaacaaggagggcgaccaguacguguauauggggcaaccgcugaacaacgacgaggaucacgcccacuggaccgaggcaaagaugcugcucgacaacauuaacacccccgagggcaucaucccggcgcuguuugagcccgagcgcgagaaguccgccgccaucgacggggaguaccggcugcgcggcgaggcgcggaagacguucguugaacucaugcgacggggcgaccugccggucugguugagcuacaagguggccuccgaaggguuccaguacagcgaccgucggugguguuuugauggcgagcgcaacaaccaggugcucgaagagaacauggacgucgagaucuggaccaaggagggggagcggaagaaguugcgcccccgguggcuggacgcucgcaccuacagcgacccgcucgcccugagggaguucaaggaguucgcggccggcagacggagcgugucgggcgaucugauacucgagaucgggaagcugccccagcacuuaacauugcgcgcccagaaugcacuggacaaucuggugaugcuccacaacuccgagcagggcgggaaggcguaccgucacgcaauggaggaguugcccgacacuauugagacguugaugcuccucgcccuuaucgcgguccucaccggcggagugacccuguucuuccugagcggcaagggccugggaaagaccuccaucggccugcugugugugacagccagcagcgcccuccuguggauggccucgguagaaccccauuggaucgccgcguccaucauccuggaguucuuccucauggugcugcugaucccggaaccugaccgccagcggacgccccaggauaaccagcucgccuacguggucauugggcugcuauucaugauccucaccguggcggccaacgagaugggccugcuagagacuacgaaaaaggaccucggaaucggcuacgucgccgcggagaaucaccagcacgccacuauguuggacgucgaccugcgcccggccagcgccuggacucuguacgcaguugcgaccacugugaucacccccaugaugcggcacacgauagagaacaccacggcaaauauuucucugaccgccaucgccaaccaggccgcgauccugaugggccuugacaaaggguggcccauuagcaagauggauaucgggguuccccugcuggcccucggcugcuacucccaagucaacccacuuacccugaccgccgccguguuaaugcuggucgcacacuacgcuaucaucgggcccgggcuacaggcaaaagccacgcgcgaggcccagaagcggaccgcggcgggaaucaugaagaaccccaccguggauggcaucguggccaucgaccucgauccggucguguacgacgccaaguuugaaaagcaacuggggcagauuaugcugcucauccuuugcaccagccagauacugcucaugcggacgaccugggcccuuugcgaguccaucacccuggcaacgggcccgcucacgacccugugggaggggagccccggcaaauucuggaauaccacuaucgccguguccauggccaacaucuuccgcggcagcuaccuggccggggcgggccuagcguucucccugaugaaaucccucgggggcgggcggagagggacgggcgcccaaggggagacccucggagagaaauggaagcggcagcuuaaucagcugaguaagagugaauucaacaccuacaagcgcaguggcaucauggaggucgaccggagcgaagccaaggaggggcucaagcgcggggagacuacgaagcaugccgugagccgcggcaccgcuaagcugaggugguucguggaacgaaacuuagucaagccugagggcaaagugaucgaccugggguguggccgugguggcugguccuacuauugcgcagggcucaagaaggugaccgaggucaagggcuacacgaagggcgggccugggcacgaggagccgaucccgauggccaccuacggguggaaccuggugaaguuacauagcggcaaggacguguucuuuaugccccccgagaagugugauacucuccugugcgacaucggggaguccagcccgaacccaaccaucgaggagggccggacccugcgcguccucaagaugguggagcccugguugcggggcaaccaauucugcaucaaaauccugaaucccuacaugccuuccguggucgagacccucgaacagaugcaacgcaagcacgggggcaugcuagugcggaacccccuuagccgcaacuccacgcacgagauguacugggugaguuguggaaccgguaauaucgucagcgccgugaacaugaccagccggaugcuccugaaccgcuuuacaauggcccauagaaaaccuacauacgagcgagaugucgaccuuggggcggggacacgccaugucgccguggagcccgaggaggccaaccucgacaucauaggccagcggaucgagaacauaaagaacgagcauaaguccaccuggcacuacgacgaagacaacccuuacaagaccugggccuaucacgguagcuacgaggugaagcccuccggcagcgccaguagcaugguuaacggggugguccgccugcugacgaagccgugggaugucauccccauggucacccagaucgcgaugaccgacaccacaccguucggccagcagcgggucuuuaaggagaagguggacacccgcacgccccgggcuaagcgcggcaccacgcaaauaauggaagugaccgccaagugguuguggggguucuugagucggaacaagaagccgcgcaucuguacccgggaggaguucacacgcaaaguccggagcaaugccgccaucggcgcgguguucguggaugagaaccaguggaacagugcaaaggaagccguggaggacgagcgcuucugggaucuggugcaccgggagcgcgagcuccacaagcagggcaagugcgccacgugcguguauaacaugaugggaaaacgggagaagaaacugggcgaguucggcaaggcaaaggguucccgcgccaucugguacaugugguuaggggcccgguuccucgaguucgaggcccuggguuucaugaacgaggaucauugguucagccgcgaaaacucccugagcgggguggagggcgaggggcuccacaagcugggguacauacugcgggauaucuccaagaucccgggcgggaacauguaugccgacgacacugccgguugggauacucgcaucacggaggacgaccuccaaaacgaggccaagauuacggauaucauggagcccgagcaugcgcuacuagccaccagcaucuuuaagcucaccuaccagaacaaaguggugcgcguucagcggcccgccaagaacggaaccgugauggacguuaucucccgccgggaccagcgcggcagcggccaggucgggacguacggucuaaacaccuucaccaacauggaggugcagcugaucaggcagauggaguccgaggggaucuuccucccgagcgagcuggagaccccgaaucuggcggagcgcgugcucgacuggcuggagaagcacggcgcagagcggcuaaagcgaauggccaucuccggggaugacugcgucguaaagcccaucgacgaccgguucgccaccgcauuaaccgcguuaaacgacaugggcaaggugcgcaaggauauaccccaaugggagccguccaagggauggaacgacuggcaacaggucccguucugcucccaccacuuccaccagcugaucaugaaggaugggcgggaaaucguggugcccugccgcaaucaggacgagcucgucggacgggcccgaguaagccagggggccggcuggucccugcgggagaccgccugccugggcaaguccuacgcccagauguggcagcuuauguacuuccaccggcgggacuuacgccuggcggcuaacgccaucugcuccgccguccccguugacugggugcccaccagccggaccacguggagcauccacgcgcaucaucaguggaugaccaccgaggacaugcugaguguguggaacagagucuggaucgaggagaaccccuggauggaggacaagacccacgugagcucuugggaggaggugcccuaccugggcaagcgcgaggaccaguggugcggcucacugaucggucucacagcccgggccaccugggcgaccaauauccaggucgccauuaaccaggugcgccggcugaucggaaacgagaacuaccuggacuacaugaccuccaugaagcgcuucaagaacgagagcgaccccgagggggcgcuuugguaa

SEQ ID NO: 23775 - RNA, 9879 nt, Artificial Sequence
  derived and/or modified CDS sequence (opt11) from DENV-1__GQ868560__SS-prME
agcgugaccaugcugcucaugcugcuccccaccgcucucgccuuccaccugaccacccgcggcggggaaccccacaugaucgugagcaagcaagaacguggcaagagccugcuguucaagacuagcgcgggggugaacauguguaccuugauagccauggaccugggggagcuaugcgaggacaccaugacguauaagugcccccgcaucacagaggccgagcccgacgacguggacugcuggugcaacgccaccgauaccugggugaccuacgggacaugcagccagaccggcgagcaccggcgcgacaagcgcuccgucgccuuggcgccacacgugggccugggccucgagacccgcaccgagaccuggaugagcuccgagggcgccuggaagcaaauacagcgggucgagaccugggcacugaggcaccccggcuuuacaguaaucgcucuuuuccuggcgcacgcuaucgggaccagcaucacccagaaggggaucaucuuuauccugcuaaugcucgugaccccuucaauggcgaugcguugcgucggcaucggcaaccgcgacuucguggagggguugagcggcgccacguggguagaugucguccuggagcauggguccugcguaaccaccauggccaagaauaagcccacccucgacaucgagcugcugaagacggaaguuaccaaccccgcgguguuacggaaacuuuguaucgaggcaaagaucucaaacacgaccacggacucccgcugcccaacccagggcgaagccacccugguggaggagcaggacgccaacuucgucugccggaggacguucguggaccgggguugggggaacggcuguggacucuucggcaaggggucacugcuuacgugcgccaaguucaagugcgugaccaagcucgagggcaaaauaguccaguaugagaaccugaaguacuccguuaucgucaccguccacacgggcgaccagcaccagguugggaacgaaacaaccgagcacgggaccaucgcgaccaucacgccccaggcccccacguccgagauacagcugaccgauuauggggcacuaacacuggauugcagcccccgcaccgggcuggacuuuaacgagaugguacuccugaccaugaaggagaaguccuggcuggugcacaagcagugguuccucgaccuuccccuaccuuggaccuccggggccagcaccucgcaggaaaccuggaaccggcaggauuugcuggugacguucaaaacugcccacgcaaagaaacaagaggucgucguacugggcucccaggagggcgcaaugcacaccgcccucaccggugccaccgagauacagacaagcggcaccaccacgauuuucgccgggcaccugaaaugccguuuaaagauggacaagcucacccugaagggaauguccuacgucauguguaccgguagcuucaagcuggaaaaggagguggcagagacccagcacggcacgguccugguacaggugaaguaugagggcacugacgcccccugcaaaaucccguuuuccacacaggacgagaaaggggugacccagaauggccgucucaucacggccaaccccaucgugacggacaaggagaagcccgucaacauagagaccgagccgcccuucggggagagcuacaucguggucggcgcaggcgagaaggcucugaagcuguccugguuuaagaaagggagcuccaucggcaagauguucgaagcgaccgcccgcggagcccggcgcauggccauauuaggcgacacggcgugggacuucgggagcaucggcggaguguucacauccguugggaaacugguccaccagguguucggcaccgccuacgggguguuauucucuggagucuccuggaccaugaagaucgggaucgggauacuucugacguggcuaggccucaauucccgcuccaccagccuauccaugacauguaucgccguggggauggugacgcuguaccuaggcguaaugguucaggccgacagcgggugcguuaucaacuggaaggguagagagcuaaagugcgggucgggcaucuucguuacaaacgaggugcacacguggacugagcaguacaaguuccaggccgauagcccgaagcgacugagcgcggcgauuggaaaagcgugggaggaggggguuugcgggauccgguccgccacccgccucgaaaacaucauguggaagcaaaucaguaaugagcuaaaccacauccugcucgagaacgacaugaaauuuacgguggugguuggggaugcuaauggcauccuggcgcaggggaagaaaaugauccggccucagccaauggagcacaaguacuccuggaaguccuggggcaaggcgaagaucauuggggccgauauccagaacacgaccuuuauuaucgaugggccggacacuccggagugccccgacggccagcgcgccuggaacaucugggagguugaggacuacggauucgguaucuucaccacgaacauuugguuaaagcuccgggauucuuacacccagaugugcgaccaccggcugaugagugcagcaaucaaggauuccaaagccguacaugcagacaugggcuacuggauugagagcgagaaaaaugaaaccuggaagcuggcccgggcguccuucaucgaggugaagaccugcacguggcccaagagccacacccucuggagcaaugggguacucgaguccgagaugauaauccccaagauuuacggcgguccgauuucucagcacaacuaccgcccuggcuacuucacccagacugcagggcccuggcaccuggguaaacuugaguuggacuucgaucuuugcgagggcacgaccgugguugucgacgagcacugugggaaccgcggcccgagccuccgcaccaccacagugaccgggaaaaucauacacgaguggugcugccggucgugcacccugccgccccugcgcuucagaggcgaagaugggugcugguacggcauggaaauucgccccgucaaggagaaagaggaaaaucuggugcggagcauggugagcgccgguagcggcgagguggauagcuucucacugggcaucuugugcgucuccaucaugaucgaggaggugaugcgcagccgguggagccgcaagaugcucaugacugggacgcuggccguguuccugcuccugaucaugggucagcugaccuggaacgaccugauacguuuguguauuaugguaggggccaacgcguccgaccguaugggcaugggcaccacuuaccuggcccucauggcaacguucaagaugcgcccuauguucgccguggggcugcuguuccggagacucaccagccgcgaggugcugcugcugaccauuggccugucgcuggucgccucuguggagcuccccaacucccuggaggagcugggggacggacucgcgaugggcaucaugaugcugaaguugcucaccgaguuccagccccaccagcuguggacgacgcugcucucgcugaccuucgucaagacaacguugucccucgacuacgcauggaaaaccaccgccauggugcugagcaucgugucacuguucccccucugccugucaaccacgucccagaaaaccacguggcugccaguccuccuggggucuuucgguugcaaaccgcugaccauguuccuuauuacggagaacaaaaucugggggcgcaaguccuggcccuuaaacgagggcauaauggcgaucgggaucgugucgauccugcucuccuccuugcugaagaacgauguaccccuagcgggcccccugaucgccggcgggaugcugaucgccugcuacgucauuuccggcagcagcgccgaucucuccuuagagaaggcugcggaagugagcugggagcaggaggcagagcacuccggggccucgcauaacauucuggucgaaguccaagaugacggcacgaugaaaaucaaagacgaggagcgggacgacacccuaacuauccuguuaaaggccacccuccuggcuguauccgggguuuacccgaugagcaucccagcgacgcuguucguaugguacuuuuggcagaagaaaaagcagcgcuccgguguucucugggacacccccuccccgccggagguggagcgcgccguccuggacgacggaaucuaucggauucugcagcgggggcuguugggccguagucaagucgggguaggcguguuccaggacggggucuuucauaccauguggcacgugacgcgaggugcgguccugauguaccagggcaaacgccuggagccgagcugggccuccaucaagaaggaccuuaucucuuacggaggaggguggcgguuccagggcuccuggaacacgggagaagagguccaggucaucgccguagaacccggcaagaacccgaagaaugugcagaccacccccggcacuuucaagacucccgaaggugaggugggcgcuaucgcgcuggacuucaagcccgggaccucgggcuccccuauagucaaccgcgagggaaaaaucgucgggcuguaugggaacgggguggucacgaccagcggcaccuacguuuccgccaucgcacaggccaaggcgagccaggaagggccucucccugagaucgaagacgagguguucaagaagcggaaccugaccaucauggaccugcacccgggcucaggcaaaacccgccgguacuugccggcaaucguccgcgaggcuauuaagcggaaguugaggacccugaucuuggcccccacgcgaguuguggcgucagagauggccgaggcccugaagggaaugccgauucgguaucagaccaccgccgucaagagcgaacacacgggccgcgaaaucguggaccugaugugccacgcuacguucaccaugcggcuccuguccccggugcgugucccaaacuacaacaugaucaucauggacgaggcgcacuucaccgauccagccagcauagcggcccggggguacaucuccacccgcgucggcaugggggaggcagcggccaucuucaugacagccacgccgcccggcagcguggaggccuucccgcaguccaacgcggucauacaggacgaggagcgugauauccccgaaagguccuggaacuccggcuacgacuggaucaccgacuuccccggaaagaccgugugguucgugccgucaaucaaauccggcaacgacaucgcgaacugcuuaaggaagaacgggaagcguguuauccagcucagccggaagacguucgacaccgaguaccagaaaaccaagaacaacgauugggacuacguggucaccacggacauauccgagaugggugcgaacuuccgcgccgaccgggucauugacccccgccgcugccugaagccugucauacugaaggacggacccgagcgcgugauccucgcaggcccgaugcccgucacuguagccagcgccgcacagcggcguggaaggaucgggcgcaaucagaacaaagagggcgaccaguacgucuauaugggacagccccugaacaaugacgaggaccacgcccacuggaccgaggcuaaaaugcuccuugauaacaucaacacccccgagggcaucauccccgcgcuguucgagccggaaagagagaaguccgcugccauugauggggaguaccggcuacgcggcgaggcucggaagaccuucguggagcucaugcgccggggcgacuugcccgugugguuauccuacaaggucgcguccgaaggguuccaauacucggaccgccggugguguuucgacggggaaaggaacaaccagguccucgaggagaacauggacguggagauauggacgaaagagggggagcggaagaagcugcgaccucgguggcuggacgcgaggaccuacucggacccgcuagcgcugcgggaguucaaggaguucgccgccgggcgccggagcguuaguggcgaccuaaucuuagagauagggaagcugccccaacaccugacccuccgcgcccagaacgcgcuggauaaccugguaaugcuccacaauuccgagcagggcggcaaggcguaccggcacgcuauggaagaacugcccgacaccauagagacucugaugcuccucgcccugaucgcggugcucacuggcgggguaacccuguucuucuugagcggcaaggggcucggaaagaccagcaucggccugcucugcgugacggccagcuccgcccuccuguggauggccucuguagagccccacuggaucgcggcgagcauaaucuuggaguucuuccuaaugguuuuacugauaccagaacccgaccgccagcggacgccccaagacaaccaguuggcguacguugugauugggcuacucuucaugauccucaccguagccgccaacgagaugggccugcuggagaccacuaagaaggaccucggaaucggcuacguugcggcggagaaccaccagcaugccaccaugcuugacguggacuuacgcccggccagcgccuggacucuuuacgccgucgcuaccacggugauaacccccaugaugcggcacaccaucgaaaacaccacagccaauauuucccugaccgccaucgcgaaccaggccgcgauccugaugggcuuagacaagggguggcccauuucgaagauggacaucggcgugcccuugcucgcucucgggugcuauucucagguuaacccgcuaacccugaccgccgcgguacucaugcugguggcccacuacgccaucaucggacccgggcugcaggccaaggcuacgcgcgaggcccagaagcgaaccgcggccggcaucaugaagaaccccaccgucgauggaauuguggcaaucgaucucgaucccguggucuacgacgcaaaguucgaaaagcaauuagggcagaucaugcugcucauucuaugcaccagccaaauauuacucaugagaacgaccugggcgcugugcgaaucgauaacccuggcuaccggcccacucaccacucuuugggaggggagccccggaaaguucuggaacaccaccaucgccgucagcauggccaacauauuccgcggcagcuaccuugcaggcgcaggccucgcuuucucgcucaugaagucccucgggggcgggcggagagguacgggcgcccagggcgagacccucggggaaaaguggaagcggcagcuaaaccagcugagcaagucggaguucaacacuuacaagcgcagcgggauaauggaggucgaccgguccgaggccaaggagggacucaaacgcggggagaccacaaagcaugccguaagccggggcaccgcuaagcugcgcugguucguggaacguaaccuggugaagcccgagggcaaggucaucgaccuggggugcggccgcgggggcugguccuacuauugcgccggacucaagaaggugacggaggugaagggcuacacaaagggcgggcccggucacgaggaaccaauccccauggccaccuacgguuggaaccuggucaagcugcacuccgguaaggacguguucuuuaugccgcccgaaaagugcgacacgcucuuaugcgacaucggggaguccagcccgaaccccaccaucgaagaaggccgaacccugcgcgugcucaagauggucgagcccugguuacgcggcaaucaauuuugcaucaagauccuuaaccccuacaugccgagugugguggagacccucgagcaaaugcagcgcaagcaugggggcaugcugguucggaacccccugagccgaaacagcacucacgagauguacuggguaagcugcgggaccggcaacaucgugagugccgucaacaugaccagccggaugcuccugaaccgcuucacuauggcccaccgcaagccaacguaugagcgggacguagaccugggcgcgggaacccgucacguggccgucgagcccgaggaggccaaccucgacaucaucggccagcggauugagaacaucaagaacgagcacaaauccacuuggcacuacgaugaggacaauccauacaagaccugggcauaccacgggaguuacgaagugaagcccuccggcagcgcauccagcauggugaauggagucguuagacugcugacgaaaccgugggaugucauccccauggugacccagaucgccaugaccgacaccacgccguucggccagcagagaguguucaaggagaaggucgacaccagaacgccccgggccaagcgcggcaccacgcagaucauggagguaaccgccaaguggcucuggggguuuuugucucggaauaaaaagccucgcaucugcacccgggaggaguucacacgcaaaguucgcucaaacgccgccaucggggcugucuucgucgacgagaaucaauggaacagcgcuaaagaggccguggaggacgagcgcuuuugggaccugguccaccgggaacgcgagcuccacaagcaagggaagugcgccaccuguguguacaacaugaugggcaagcgggagaagaaacuuggcgaguucggcaaggccaaagguucccgcgcaaucugguacauguggcugggugcccgguuucuagaguucgaggcgcugggcuuuaugaacgaagaccacugguucucacgcgagaacagccugagcgggguugagggcgaagggcuccacaagcugggcuacauauuacgggacaucuccaagaucccggguggcaacauguacgccgacgacacagcgggcugggauacucgcauuacggaggacgaccuucagaacgaggcgaagauaacggauaucauggagccagaacacgcccuguuggccaccagcaucuucaaacugaccuaccagaacaaggucgugcgcgugcagcggcccgccaaaaacgggaccgucauggacgugaucucccgccgggaccagcgaggcagcggccagguggggacguacggccugaacaccuuuaccaacauggagguccagcugauuaggcagauggagucagaggggaucuuccugcccagcgaacuugagaccccaaacuuagcggaacgugugcucgacuggcuggagaaacacggcgccgagcgucugaagcgcauggccaucucgggggacgauugcguggucaagcccaucgaugaucgguucgcgacggcccucaccgcgcugaacgacaugggcaagguccgcaaggacaucccccagugggagcccagcaagggcuggaacgacuggcagcagguucccuucugcucacaccacuuucaccagcuaaucaugaaggacggacgcgaaaucgucgugcccugccgaaaccaggacgagcucgugggcagagcccgcgucucucagggugccggauggucccugcgggagaccgccugccugggcaagagcuaugcccaaauguggcagcuaauguauuuccaccgccgggaccugcgccuggcugccaacgccaucugcuccgccgugcccguggacuggguacccaccagccggaccacguggucgauccaugcgcaccaccaguggaugaccacggaagacaugcuuuccguguggaaccgcguguggaucgaggagaacccauggauggaagacaagacccacguaucaucgugggaggagguaccguaucugggcaagcgugaggaucaguggugcggcagucugauugggcucacggcacgggccaccugggcgaccaacauccagguggcuauuaaccaaguccgccggcugaucggcaaugagaacuacaucgacuacaugaccuccaugaagcgcuucaagaaugagagcgacccggagggggcgcugugguaa

SEQ ID NO: 23776 - RNA, 9879 nt, Artificial Sequence
  derived and/or modified CDS sequence (opt11) from DENV-1__GQ868561__SS-prME
ucggugaccaugcuguugaugcuguuaccuaccgcgcucgccuuucaccugaccacccgcggaggggagccccacaugaucgugucgaagcaggagcggggcaagucccucuuauucaagacaagcgccggggugaauaugugcacccugauugccauggaccucggcgaguuaugcgaagacaccaugaccuacaagugcccccgcauuacagaggcagagccggacgauguagacugcugguguaacgcaaccgacaccugggucaccuacgggaccugcagccagacaggcgaacacagacgcgacaagcgguccguggcccuggcuccccaugugggauugggucucgagacccgcaccgaaaccuggaugagcuccgagggagcauggaagcagauucagagagucgaaaccugggcuuugcgccaccccggguucacggugauagcguucuuccuggcgcaugccaucggcaccagcaucacccagaaggggaucaucuucauucuccugaugcuggugacccccucgauggccaugcggugcguuggcaucggcaaccgcgauuucguagaggggcucagcggcgccacguggguagacgucgugcuggagcacggguccugcgugaccaccauggcaaagaacaagcccacccuggacaucgagcuccugaagacggagguaacgaaccccgcggugcugcggaagcucugcauugaggcuaagaucagcaacaccacaacagacucucgcugcccgacccaaggcgaggcaacccugguggaggagcaggaugccaacuucgucugccggcguacauucguggaucggggcugggguaacggcugcggccuguucggcaagggcagccuccugacgugcgccaaauucaagugcgugaccaaacuggaggggaagaucguccaguacgagaaccucaaguacuccguuaucgugaccguccacacgggcgaccagcaccaggugggcaacgagacgaccgagcacgguacuaucgccaccaucacgccucaggcucccacgagcgaaauacaguuaaccgauuacggggcgcuaacccucgacugcagcccccgcacuggccuggacuucaacgagaugguccuguugacgaugaaggagaaguccuggcuuguucacaagcagugguuccuggaccucccgcugccguggaccuccggagccagcaccagccaggagaccuggaacagacaggaccuccucgugacguuuaagaccgcgcacgcuaagaagcaggaggugguggugcuggguagucaggagggggcaaugcacaccgcccugaccggggccacggagauacagaccagcgguacgaccacgaucuuugcaggucaucucaagugccgccugaagauggacaagcugaccuuaaaagguauguccuacgucaugugcaccgggagcuucaagcuggagaaggaggucgcggagacccagcacgggacggugcugguucaggugaaguacgagggcaccgacgccccgugcaagauccccuucucaacacaggacgagaagggggugacccaaaacggccgacucaucacggccaacccgaucgugaccgauaaggagaagccugucaacauagagaccgaaccgcccuucggggaaucguacauaguugucggagccggcgagaaagcgcucaaacuguccugguuuaagaaagggaguuccauaggcaagauguucgaggcaaccgcucgcggggcccggcgcauggccauccugggcgauacggcgugggauuuugggagcauaggaggcguguucacauccgucggaaagcucguccaucagguguucggcaccgccuacggggugcuguuuagcggugucucguggacuaugaagaucggaaucggcauccuguuaacguggcugggccuaaacagccgcucgaccagccucaguaugacgugcaucgcgguggggauggugacccucuaccugggagucauggugcaagcagacagcgggugcguuauuaacuggaaaggucgggaguuaaagugcggguccggcaucuucgucacgaacgagguacacacuuggaccgagcaguacaaguuccaggccgacagcccgaagcgccuaagcgcggccaucggcaaggcgugggaggagggggugugcggcauccggucagcuacccgccuggagaacauuauguggaaacagauuagcaacgagcuuaaccauauuuuacuggaaaacgauaugaaauucaccguuguggugggggacgccaacggcauccucgcgcaggggaaaaagaugauacggccucaacccauggagcacaaguacucuuggaaguccuggggcaaagcaaagaucaucggcgccgacauccagaacacgacguucaucauugauggcccggacacgccggagugccccgauggccagcgcgccuggaacaucugggaggucgaggacuacggguucggcaucuucaccacgaacaucuggcugaagcugcgcgacuccuacacccagaugugcgaucaccgccucaugagcgcggcgaucaaagacuccaaggccgugcacgcagacaugggcuauuggauagagucggagaaaaacgagaccuggaaacuggcccgggcgucauuuaucgaggugaagacguguacguggcccaaaagccauacgcuuugguccaacgggguccucgagagcgagaugauuauccccaagaucuacggcgggccgaucucccagcauaacuaccgccccggcuacuucacccagaccgcagggccguggcaccugggcaagcuggagcuugacuucgaucugugcgaggggacgaccgugguaguggaugagcacugcgggaaccgggggccgagccugcgcacuacuacggugaccgggaagaucauccacgaguggugcugccgguccuguacccugccgccccugcgcuuccggggagaggacgggugcugguauggcauggagauccggcccgugaaggaaaaggaggagaaccugguacggagcaugguguccgccgggagcggcgaagucgacucuuuuucuuugggcauucucugcgucagcaucaugaucgaagaaguaaugcgcagccgguggucgcgcaagauguuaaugaccgggacgcucgccguuuuccugcugcucaucaugggccagcugaccuggaacgaccugauccgccucuguaucauggucggcgccaacgcuucugacagaaugggcaugggcaccacguaccuggcccugauggcaacguuuaagaugcguccgauguuugcugucgggcuucuuuuccggaggcuaaccagcagagagguguugcugcugaccauaggccucucccugguagccucuguggagcugcccaacucccucgaggaguugggggacggccuggcgaugggcauaaugaugcucaagcuguuaaccgaauuccagccccaucagcucuggaccacccugcugucacucaccuucgucaagaccacucugucccuggacuacgccuggaagaccacggccauggugcucagcaucguaucccuguucccccugugucucagcaccacgucccagaagaccaccuggcugccgguucugcuagggagcuucggaugcaagccccugaccauguuccugauaaccgagaacaagaucugggggcgaaagucauggccccucaacgaaggcaucauggcuaucgggauugugagcauacugcuguccucgcuccuaaagaaugacgugccccuggcgggcccgcucaucgccggagggaugcugauagccugcuacgucauuagcggcucgagcgccgaccugucccucgagaaggccgcggaggugagcugggagcaggaagccgagcacucgggggccagccacaacauccucguagaaguccaggacgacggcacgaugaaaaucaaggacgaggagcgggacgacacgcugaccauucuccugaaggccacccugcucgccguauccgguguguacccuaugucgauccccgcaacgcuguucgucugguacuucuggcaaaagaagaaacagcgcuccggcgugcugugggauacccccucaccgcccgagguggaacgggccguccucgacgacggcaucuaccggauccugcagcggggacugcugggccgcagucaaguaggcgugggcgucuuccaggacgggguguuccacaccauguggcacgugacccggggcgccguccucauguaccagggaaagcgccucgagcccucaugggccuccgugaagaaagacuuaaucagcuacgggggcggguggcgguuccagggcuccuggaacaccggggaagaggugcaggucaucgccgucgagccgggcaagaaccccaaaaacgugcagacgacccccggcacguuuaagacuccggagggggagguaggcgcgaucgccuuggacuucaagccagggacuaguggcuccccgauagugaaccgcgagggaaagaucguggggcuguacggcaacggggucgugaccaccagcggcacguacguguccgccaucgcccaggccaaggcgucgcaggaagggccccugcccgaaauagaggacgaggucuucaaaaaacggaaccucaccaucauggaccugcacccgggcagcggcaaaacccgccgguaccugcccgcgaucguucgagaagccaucaagcggaagcuccgcacccugauauuagccccaacgcgcguggucgcguccgagauggccgaggcacucaaggggaugccaauccgguaccagaccacagcgguaaagucugagcacaccggccgugagaucgucgaccugaugugccacgccaccuucaccaugcggcuucuguccccgguccgcgugcccaacuacaacaugauuaucauggacgaggcgcacuucaccgaccccgccagcaucgccgcccggggguauaucuccacccgugucggcaugggagaggccgcagcaaucuucaugacggccaccccgcccggcagcgucgaggcuuucccccaguccaacgccguaauucaagacgaggagcgggauauccccgagcgcaguuggaacucgggcuacgacuggaucaccgacuucccaggcaaaaccgucugguuugugcccagcaucaagucgggaaacgauaucgcgaauugccuucggaagaacgggaaacgcgugauccagcucucacggaagacguucgacaccgaguaccaaaagaccaagaauaaugacugggacuacguggucaccacggacaucuccgaaaugggcgccaacuuccgcgccgaccgggugaucgacccccgccguugccugaagccggugauacugaaggacgggcccgagcgcgucauccuggcuggcccgaugcccgugaccgucgcgagcgcugcccaacggcgcggccggaucgggcguaaccagaauaaggagggcgaccaguacguguacaugggccagccccucaacaaugacgaggaccacgcccacuggaccgaagccaagaugcugcuggauaacaucaacacacccgagggaauuaucccagccuuguucgagcccgagagagagaaguccgccgccaucgacggggaguaccgccugcgcggcgaggcccggaaaacauuuguagagcugaugcgccggggcgaccuccccgucuggcuuagcuauaagguggcauccgagggguuccaguauagcgaccgccgguggugcuucgacggggaacguaauaaccaggugcuggaggagaacauggacgucgagaucuggacuaaagagggggaacggaaaaagcuccgaccgcgguggcuagacgcgcgaaccuacuccgacccgcucgcccuccgggaguuuaaggaguucgccgccggccgacggagcguuagcggcgaucucauacuggaaaucgguaagcucccccagcaucugacgcugcgcgcccagaacgcgcucgacaaccuggugauguugcacaacuccgagcagggcggcaaggcauaccggcacgccauggaggagcuccccgacaccauagagacgcugaugcuguuggcccugauugcgguccugacuggcggcgugacccucuucuuccugagcggcaaggggcugggcaaaaccuccaucggccuacugugcgugacggccagcuccgcccugcuauggauggcuagcgucgagccccauuggaucgccgcguccaucauccuugaguucuuucugauggugcuccugaucccggagccugaccgacagcggacgccccaggauaaccagcuggccuacguggucaucgggcuccuguucaugauccuaaccguggccgccaacgagaugggccuucuggagaccacgaagaaggaccuggggaucggcuacguugcggcggaaaaccaccaacacgccaccaugcucgacgucgaccugcgucccgccuccgccuggacccuguacgccguggcgaccaccgugauaaccccuaugaugcggcacaccauugaaaacaccacggccaacaucucccucaccgccaucgcuaaccaggcagcgauccugaugggccuggacaagggauggcccaucagcaagauggauaucggcgucccgcuccuggcccucgggugcuacucccaggugaauccgcucacccugacugccgcugugcugaugcucgucgcucacuacgccaucaucggccccgggcugcaggcuaaagcuacgcgcgaagcccaaaagcgcacggcggccggcaucaugaagaaccccaccguggaugggaucguggccauagaccuggaccccgucguguacgacgccaaguucgagaagcaacucgggcagaucaugcugcugauccuuugcaccagccagauccuacugaugcgcacgaccugggcucucugcgaguccauaacacuggcgaccggcccccugacgacccucugggaggguagcccgggcaaauuuuggaacaccaccaucgcaguguccauggcuaacaucuuucggggcaguuaccuggccggggccggacuggccuucucccuaaugaagucccucgggggcgggcgccgcggcacgggcgcucagggggagacccugggcgagaaauggaaacggcagcucaaccaacuguccaagagcgaguucaacacuuacaagcgcagcgggaucauggaggucgacagauccgaggcuaaggagggucuaaagcgcggggagaccacgaaacacgccgucagccgggguaccgcgaaguugcgcugguucguagaacggaaccugguuaagcccgagggcaaggugaucgaccuggggugcggccgcgggggcugguccuacuacugcgccgggcugaagaaggugaccgaggucaagggcuacaccaaaggagggcccggccacgaggagccgaucccaauggccacguauggguggaaccucgugaagcuucacagcggcaaggauguguucuucaugccgcccgagaagugcgacacucugcucugcgacaucggggaauccagcccguccccaaccaucgaggagggccggacucugcgcguccugaagaugguggaacccuggcuccggggcaaucaguucugcaucaagauccugaacccauacaugccgagcguggucgaaacccuggaacaaaugcagcgaaagcacgggggcaugcucguaagaaacccccugucccgcaacagcacacacgagauguacuggguaucgugcgggaccggcaacaucgucagcgccgugaauaugacuucacguaugcugcucaaccgcuucaccauggcacaccgcaagccgacuuacgagcgggacgucgacuuaggcgcggggacucggcacgucgccguggaaccugaaguggccaaccuggacaucaucggacagcgcauugagaacaucaagaacgagcacaaaucaaccuggcacuacgacgaggacaauccguacaagaccugggccuaccacgggucauacgaagucaagcccagcgguuccgccagcuccaugguaaacggggucgugcgacuccugacgaagccgugggacgugauccccauggucacgcagaucgcgaugaccgacaccacgccguucggccagcagcggguguucaaggaaaagguggacacccgaacgcccagggccaagcgcggcacgacgcaaaucauggaggucaccgccaaguggcuguggggguuccucagccggaacaagaagccccgcaucugcacccgcgaggaguuuacgagaaaggugcggagcaaugccgccaucggcgcgguguuuguggacgagaaucaguggaacuccgccaaagaggccguggaggacgaacgcuucugggaccucgugcaccgggagcgcgaacugcacaagcagggaaagugugcaacgugcgucuacaauaugaugggcaagcgggaaaagaagcucggcgaguucggcaaggcgaagggcagcagggccauaugguauauguggcugggggcccgguuccuggaguucgaggcccucggcuucaugaacgaagaccacugguucucccgcgagaacagucuguccgggguggagggcgaggggcugcacaagcucggcuauauccugcgugacauaagcaagaucccggggggaaacauguacgccgacgacacggcgggcugggacacaagaaucaccgaagacgaccugcagaacgaagccaagauuacggacaucauggagcccgaacacgccuugcuggcuacguccaucuuuaagcugaccuaccagaccaaggugguccgcgugcagcggcccgccaagaaugggacgguaauggacgucauuagccgacgcgaccagcgcggcuccggccaaguggggaccuacggccucaacaccuucaccaacauggaagugcaacugauccgccagauggagagcgaggggaucuuccugccgucugagcucgagacgccgaaccuagcggagcgcguccuggacuggcucgagaagcacggcgccgagcggcuaaagcgcauggccaucucaggagacgacugcguagugaagcccauugacgaccgguucgccaccgcccugaccgcgcucaacgacaugggaaaaguccgaaaagacaucccucaaugggagccgucuaagggcuggaacgacuggcagcagguaccguucuguagccaccacuuccaccaacugaucaugaaggacgggcgugagauagugguccccugccgcaaccaggacgagcugguuggccgggcccgcgugucccagggggccggcuggagccuccgggagacagccugccuuggaaaaaguuacgcccagauguggcagcugauguacuuucaccgacgagaucuccgccuggcggccaacgccaucugcagcgccguccccguggacugggugccuaccagcaggacaaccuggucuauccacgcgcaccaccaguggaugaccaccgaggacauguugagcguuuggaaccgcgucuggaucgaagagaauccguggauggaggacaagacgcacgugucgagcugggaggagguccccuaccucggcaaacgcgaggaccaguggugcggaucgcugaucgggcugaccgcccgggccacuugggccaccaacauccagguggccaucaaccagguacgccggcucaucggaaacgagaacuaccuggacuacaugacgucgaugaagcgcuucaagaacgaguccgaccccgagggggcgcucugguga

SEQ ID NO: 23777 - RNA, 9879 nt, Artificial Sequence
  derived and/or modified CDS sequence (opt11) from DENV-1__GU131948__SS-prME
uccguaaccauguuguuaauguuauugccgacugcacuggcguuccaccugaccacucgagggggcgaaccccacaugauugucaguaagcaagaacggggcaaaucacuacuguucaaaaccuccgcuggcgugaacauguguacgcucauugcaauggaucuaggagaacugugugaggacacaaugaccuacaaaugccccagaauaacagaggcugagccagaugacguggacugcuggugcaacgcuacugacacuugggucaccuacggaaccuguucacagacaggggaacauaggcgcgacaagcguucggucgcucuggcaccacaugugggccugggacuagaaacccgaacugaaacauggaugaguagcgaaggggcauggaaacaaauacagcgaguugaaaccugggcccuccgccauccgggauucacggugauagccuuguuccucgcccacgccauaggcacguccaucacgcaaaaaggaauaauauuuauacuccucaugcuagugacaccguccauggccaugcgguguguuggaaucggcaaccgggacuucgucgaagggcugaguggggccaccugggucgaugucgugcucgaacacggcuccugcgucaccacuauggccaaaaauaagccaacacucgauauugagcuacuaaagaccgagguaaccaacccagccguacuaagaaaguuaugcaucgaagcaaagauaucuaacaccacaacggacucgaggugccccacgcaaggagaggcaaccuuaguagaggaacaagaugccaacuucguaugcaggcgcacauucguggauagaggauggggcaacgggugcgggcuauucggcaaagguuccuugcucaccugugcaaaauucaaaugcgucacaaagcuagaaggcaagauagugcaguacgaaaauuuaaaauacagcgucauagucaccgugcauacaggugaccagcaucagguaggcaacgaaaccaccgaacauggaacaauagcuacgauaacaccgcaagcacccaccagugaaauccaguuaaccgauuauggcgcccucacacuagacugcaguccuaggacaggccucgauuucaacgaaaugguguuacuaaccaugaaagaaaaauccuggcucgugcauaaacaaugguucuuagaccuaccacucccguggacuucaggagccaguacaagccaagaaacguggaacagacaagaccuacucgucaccuucaaaacggcacaugccaaaaagcaagaagugguugugcuaggcagccaagaaggggccaugcacacagcucugacgggcgcaacggaaauccaaacgagcgggacgacuaccauuuucgccggccaucuaaagugccggcucaaaauggacaaauuaacgcucaaagggaugaguuaugucaugugcacgggcuccuucaaauuggagaaagagguggcagaaacacagcauggaacagugcucguccaaguaaaguacgaaggaacagacgcgccauguaaaauacccuuuucaacucaggacgaaaagggcgucacacagaauggccgucuaaucaccgccaaccccauagucaccgacaaggagaaacccguaaacauugagaccgaaccucccuucggagaguccuacauaguaguaggcgccggugagaaggcauuaaagcuaagcugguucaagaaagggucauccaucgggaagauguucgaagccacagccagaggagcaagacgcauggcgaucuugggggauacggcaugggauuuuggcuccauaggaggggucuucacaucugugggaaagcuaguacaccaggucuuugggacagcguauggcguccuauucagcggcguaagcuggacuaugaagauagggauaggaauacuacugacguggcucgggcucaacagccgaucaaccagccuaagcaugacauguauagcggucggaauggugacucucuaccucggcguaauggugcaggcagacuccggcugcguaauaaacuggaagggacgagagcuaaaaugcggcaguggcauauucguaaccaaugaaguucacacguggaccgagcaguacaaguuccaagcggacucgccaaagagacugucagccgcuaucgggaaggcgugggaggagggcguaugcgggaucagaagcgcaaccagacucgagaacaucauguggaagcagaucucaaacgaauuaaaucacauccuacuagaaaaugacaugaaauuuaccgucguagucggagacgcaaaugggauauuggcacaagggaagaaaaugauaagaccacaaccgauggaacacaaguacuccuggaaaucauggggcaaggccaagauaaucggagccgauauacagaauaccacuuucaucaucgacgggccggacacacccgaauguccugacggccagcgagccuggaacaucugggaaguagaagacuauggguucggcaucuucacaacgaauaucugguugaaacuucgagauaguuauacgcaaaugugcgaccaccgccuaauguccgcagccaucaaggacuccaaagcaguccacgccgacaugggguacuggauagaauccgagaaaaacgaaaccuggaaauuagccagagcaucguuuauagaggucaagacaugcacguggccaaaaagccacacauuauggaguaaugguguacuugaaucagaaaugauaauaccaaaaauuuacggcggaccaaucucccaacacaacuaccgaccaggauauuucacgcaaacagcgggcccauggcacuuagggaaacucgaacuagacuucgauuuaugcgaagggacgacgguagucguagacgagcacugugguaacagaggaccaucgcucaggacaaccacggucacgggcaaaauaauacaugaauggugcugccgcagcugcacucugccuccccuccgauuccgcggggaagacgggugcugguacgggauggagauaaggcccguaaaagagaaagaagagaaccuuguacgguccaugguaagugccggcucaggagaggucgacuccuucagucucgguauacucugcguaucaaucaugauugaagaggucaugagauccagauggagccgaaagauguuaaugacggggacacuugccguauuccugcugcuaaucaugggccagcuaacuuggaaugaccugaucagacuauguauaauggugggcgcaaaugccagugacaggauggguaugggcacgacauacuuggccuugauggcaacuuucaagaugagacccauguucgccgugggacugcuauuccgccgccuuacaucccgcgaaauuuugcugcuaacaauuggccucagucucguggccucagucgaacuuccgaacagucuggaagaauuaggcgauggucucgcgaugggaaucaugaugcuaaagcuacucacagaauuucaaccgcaccaacucuggacuacgcuacuaagccuaacauucguaaaaaccacacucagcuuagacuacgcuuggaaaacaacagccauggugcugucaaucguaucacuguucccacuaugccucaguaccacaucccaaaagacgacaugguugcccguacuccucggaucguuuggcuguaaaccauugaccauguuccucauaacagagaacaaaauauggggacguaagaguuggccgcugaacgaaggaauaauggcaauagggauaguaaguauacuacugagcucacuucucaaaaaugaugugccacuagccgguccacugaucgcaggcgggaugcuaaucgcauguuacguaauauccggcuccagugcagaccuaucccuagaaaaggccgcugaagucucaugggagcaagaagccgaacauucgggugcuucccacaacauucuaguugaaguccaagacgacgggacgaugaaaauuaaagacgaagaacgcgacgauacacuaacaauccuccugaaggcgacgcuacuugcugucagcggcguauaccccauguccauuccagcaacccucuucguuugguacuucuggcagaaaaagaaacaaaggucagggguucugugggacacgcccagucccccggaggucgaacgagccgugcuugacgacggcauauaccgaauauugcagagaggccuauuagggagaagccagguaggugucggaguuuuccaggacggcgucuuccacacgauguggcacguuacgaggggagcaguucucauguaccagggcaaacgccuggaacccucaugggcgucggugaagaaagaccuaaucucguaugggggcggauggcgguuccaagggaguuggaacacaggagaggaaguacaagucauagcgguagaacccggcaaaaaucccaaaaacguacaaaccacgcccggaaucuucaaaacgccugaaggggagguaggugcaauugcacucgauuucaaaccggguacgagcgggagccccauagucaaccgagagggaaaaaucguaggccuguaugguaauggaguggucacaacauccggaacauacgucucggcaaucgcccaggccaaggcgucacaagaaggaccucucccagaaauagaagacgagguguucaaaaagcgaaaccugaccaucauggaucugcacccagggagcggcaaaacacgccgauaccucccggcaauuguacgagaggcgauaaaacgcaaacuccgcacccuuauacucgcuccgacacgagucgucgcuuccgagauggcagaggcccugaaaggcaugcccauaagauaccaaacaacagccguuaaguccgagcacacaggccgugaaaucguugaccuaaugugccacgcgacauucacaaugcgacucuuguccccaguuagaguacccaauuauaacaugauaaucauggaugaggcccauuucaccgacccagcgucuauagcggcaagagguuacauauccacacgcgugggcaugggcgaagcggccgcaauauucaugaccgccacucccccgggaagcguugaggcguucccucagagcaaugcagucauacaggacgaagagagagauauaccagagcggagcuggaacagcggcuaugacuggauaaccgacuucccaggaaaaacagucugguuugucccaucuaucaaaaguggcaacgacaucgcaaacugucuucggaagaauggcaaaagaguaauccagcuuucgcggaagacauucgauacagaguaucagaaaacaaagaauaacgacugggauuauguagucacaacagacauuucggaaaugggagcaaauuucagggcagaucgggugaucgacccgcggagaugucuaaagccgguaauacucaaagacgguccggaacgcguuauauuagccgggccuaugccgguuacaguagccuccgccgcccaaagacgaggccgcauaggccguaaucagaauaaggaaggagaccaauacguauacauggggcagccgcuaaauaacgacgaagaccacgcacacuggacagaagcaaagaugcuucuggacaauaucaacacgccugagggcauaauaccagcguuauucgagccggaacgcgaaaaguccgccgccauagacggggaguaucgacucaggggcgaggcgaggaagacguucgucgaacugaugcgaagaggcgaccugcccgucuggcugaguuacaaaguagcaagcgagggcuuucaauauuccgaccgacggugguguuucgacggagagaggaacaaccaaguccuggaagagaacauggacguggaaauauggacaaaggaaggcgagcgaaagaaacugaggccgagguggcuagacgcgagaacguauucagacccacuagcucuccgcgaguucaaagaguucgcugccggcaggaggaguauaagcggcgaccugauacuagaaaucggcaaacugccacagcaccuaacacuacgagcccaaaacgcgcuggacaaccuaguaaugcugcauaacagcgaacaagggggcaaagcguaucgucacgcaauggaagaacuaccagacaccauagaaacgcuaaugcugcuggcacuaauagcaguauuaacugguggcgugacacucuucuuccuaagcggaaagggucucggaaagacgucaauaggacuacuuugcguaacggccagcuccgcauugcuguggauggccagcguagaaccccacuggaucgccgcaagcauaauucuggaguucuuucuaaugguacucuugauccccgaaccugaucgccagagaacaccgcaggacaaccagcucgccuauguagucauaggccuccuauucaugauccugacgguagcggccaacgaaaugggccuauuagagacuacaaagaaggaccugggcaucggguacguggcggcggaaaaucaccaacacgcaacgauguuagacgucgacuugcgaccagccagugcauggacauuauaugccgucgcaacuacgguaaucacaccgaugaugcgacacacuauagaaaacaccacagcaaacauaagccuaacagcuaucgcaaaucaggccgccauccuaaugggacuggacaaaggauggccgaucagcaaaauggauaucggcguuccgcuucuagcucuaggguguuacagucagguaaacccgcuuacacugacggccgcagugcuaaugcuaguagcacauuaugccauuauugguccaggacuacaagcaaaagcaacccgcgaggcacagaaaagaacggcggcggggauaaugaagaacccaaccguagaugggaucguagccaucgaccucgaccccguuguguaugacgccaaguucgagaagcaguuaggacagaucauguuguuaauccugugcacaagccagauccuccucaugcgaacaacuugggcacuaugugaauccauaacacuugcgacaggcccucucaccacacugugggagggaucucccggaaaauucuggaacacgacaaucgcagucagcauggcgaacauauuccgcggaucguaucuagccggcgccgggcuggcuuuuagccucaugaaaucucuaggaggaggccguagaggcaccggagcacaaggggagacacuaggcgaaaaguggaaaagacagcucaaccaauuaucaaaauccgaauuuaacacuuauaaaagaagcggcauaauggaagucgaccggagugaggcaaaggaaggccuaaaaagaggggagaccaccaagcacgcagugucaagagguacagcgaagcuccgaugguucgucgaaaggaauuuggugaaaccagaaggcaaggucaucgaccuaggcugcggacggggcggauggagcuacuacugugcaggacuaaagaaaguuacagaaguuaaaggguacaccaaaggcggcccugggcacgaagaaccaauaccaauggcgaccuacggcuggaaccuagugaaacugcacucagguaaggacgucuucuucaugccaccagaaaagugcgacacgcuccucugcgacaucggagaaagcaguccaaacccgaccaucgaagaaggaagaacgcuuaggguacuuaaaaugguagaaccauggcuacggggcaaccaguuuugcaucaagauccucaacccguacaugccaagcguaguagaaacucucgagcaaaugcaacgcaaacacggcggaaugcucgugcgcaacccacuaagcagaaacucgacgcaugagauguacuggguaagcuguggcaccgggaacaucgucagcgccguaaacaugacguccagaaugcuucugaacagauuuacaauggcccaccgaaaaccuacguacgaaagagacguagaccugggggccgggaccaggcacguggccguagaacccgagguagcuaacuuagacauaaucggacaacggauagagaacaucaaaaaugaacacaagaguacguggcauuaugacgaagauaacccguacaagacaugggcauaccacggaagcuacgaggucaagccgagcggaagcgcgucguccauggucaacggggucguccgacuacuaacgaaaccaugggacguaauccccauggugacacaaauugcaaugaccgacaccaccccauucggucagcaacgggucuucaaagaaaaagucgacaccaggacaccgagggcaaaaagggguaccacgcagauaauggaaguaacggcgaaguggcuguggggauuccugagcaggaauaagaagcccaggaucuguacgcgcgaggaauuuaccagaaaggugcggucuaacgcggcaaucggggccguguuuguggaugagaaccaauggaacucggcuaaggaggcaguggaagacgagagauucugggauuuaguacacagggagcgggaacuccacaagcaggggaagugcgcaacuugcguguauaacaugauggggaagagagagaagaaacuaggugaguucgggaaagcgaaggguucacgugcaauaugguacauguggcugggagcgcguuuucuagaguuugaagcgcucggauucaugaacgaagaccacugguucagucgagagaacagucucagugguguggaaggagaaggacuccacaagcucggguacauacuucgggacaucagcaaaauaccaggaggcaauauguacgcagacgacaccgcuggaugggauacuaggauaaccgaggacgaccuacaaaacgaagcgaagauaacugacaucauggagccggaacacgcccuacuagcaacaagcaucuucaaacuaaccuaucaaaacaaggucgugcgcgugcagcggccggcaaagaacggcacaguaauggacgucaucucaagaagggaccaaagaggcagcggccaggucggaacauauggccucaacaccuucacaaauauggaaguacagcuaauucgacaaauggagagcgaaggcaucuuucugcccagcgagcuggaaacacccaaccuggcagagcgcgugcuggauuggcuagagaaacauggcgcagaaagacucaaacgaauggccauaagcggagacgacuguguagugaagcccaucgacgacagauucgccacggcccuaacagcacuaaaugacauggggaagguaagaaaggacacuccgcagugggaacccaguaagggcuggaacgacuggcagcaaguuccauucugcagccaucacuuccaccaguugaucaugaaagacggcagggaaauaguugucccgugccgcaaccaggaugagcugguaggacgcgccagggugucucaaggagccggcuggagucuuagagagaccgccugccucggcaagagcuaugcacaaauguggcaacucauguauuuccaccguagggaccugcgccucgcagccaacgcgauuuguucagcggugccgguagacuggguacccacauccagaacgaccuggagcauacaugcacaccaucaauggaugacgacggaagauaugcugagcguauggaaccggguauggauugaagagaacccguggauggaggacaaaacacacgucucuuccugggaggaaguccccuaccucggaaagagagaagaucagugguguggcagccucauaggccucacggcacgagcaacuugggcgaccaacauacaaguggccauaaaccaaguccgcagauuaauagggaaugaaaacuaccuagacuauaugaccuccaugaagagauucaaaaaugagagcgacccugaaggagcacuaugguaa

SEQ ID NO: 23778 - RNA, 9879 nt, Artificial Sequence
  derived and/or modified CDS sequence (opt11) from DENV-1__GQ868562__SS-prME
agcguuaccaugcugcucaugcugcugccgacugcauuggccuuucaccugaccacccgcggcggggaaccccauaugaucgugagcaagcaggaacggggcaagagccugcuguuuaagacuagcgcgggggugaauaugugcacccugaucgccauggaccucggggaguuaugcgaggauaccaugaccuacaagugcccccguaucaccgaggccgagcccgacgauguggauugcuggugcaaugccacggacaccugggucacguacgggaccugcagccagaccggcgagcacaggagagacaagcggucuguagcacuggcgccacacgugggacuggggcucgagacccgcaccgagacuuggaugagcuccgagggcgcauggaagcagauccagcgggucgagaccugggcccugcgccaucccggguucacagugaucgcccuguuccucgcgcaugccaucggcacaucgauuacccagaaagggauuaucuucauccuacuuaugcucgugaccccguccauggcaaugcggugcgucggcauuggcaaccgcgacuucguggaggggcugagcggcgccacguggguggaugucguacucgagcacgggagcugcgugaccacaauggccaagaauaagcccacgcucgacaucgagcuccuuaagacggaggucaccaaccccgcggugcuccggaaauuauguaucgaggccaagaucagcaacaccaccacggacucccgcugcccgacccagggugaggccacccugguggaggagcaggaugcaaacuucgucugccggcgcaccuucguugaccggggcugggggaacggcugcggcuuguucgguaaggggagccugcugacgugugcgaaguucaagugcgugaccaaacucgaggguaagaucguccagcacgagaaccugaaguauuccgugaucgucacgguccauaccggcgaccagcaccagguggggaacgagacgaccgagcauggcaccaucgcgaccaucacgccccaggcccccacgucagagauccagcugaccgacuacggugccuuaacccuggacugcucgccgcgcaccggccucgauuucaaugaaaugguccuccucacgaugaaggagaaguccuggcuagugcacaagcagugguucuuggaccugccgcugcccuggaccucuggggccagcaccagucaagagaccuggaaccggcaggacuuacuggugacguucaagaccgcccacgccaagaaacaggaagugguggugcugggcucccaggaaggcgccaugcacaccgcacucaccggggccacggagauccagacaaguggcaccaccacgaucuucgcggggcaccugaagugccgccuaaagauggacaagcugacacugaagggcauguccuacgucaugugcaccgggaguuucaagcuggagaaggagguggcggagacccaacacggcacggugcugguccaggugaaauacgagggcaccgaugcccccuguaagauacccuucaguacccaggacgagaagggagugacccaaaacggcagacuaaucacagccaacccuaucgucacagacaaggagaagccagugaacaucgaaaccgaaccgcccuuuggugagucuuauaucgugguaggcgcgggcgagaaggcgcugaaacucucaugguuuaagaaggggagcucaaucggcaagauguucgaggcaaccgcccgcggggcccggcgcauggcgauccugggggauaccgcgugggacuucgggagcaucggcggaguguucaccuccgugggcaagcugguccaccagguguucggcaccgccuacggagugcuguucagcggcgucucuuggacgaugaagaucgggauuggcauccugcugacguggcugggccuuaacagccgcuccaccagccuguccaugacgugcaucgccguggggauggugacccuguaccucggcguuauggugcaggccgauagcgggugugugaucaacuggaagggccgggagcugaagugcggguccggaaucuucgucacaaaugaggugcacaccuggaccgagcaguacaaguuccaggcugacagcccaaagcgccugucugcggccauuggaaaggcaugggaggaggggguguguggcauccgguccgcuacucgccuggagaacaucauguggaagcagaucagcaacgagcugaaccacauucugcucgagaacgacaugaaguuuaccgucguggugggcgacgccaauggcauccuugcccagggcaagaaaaugauccggccccagccaauggagcacaaguacucuuggaagucguggggcaaggccaagaucaucggcgcugacauccaaaacacgacauucaucaucgaugggccagacacaccagagugccccgacggccagcgcgccuggaacauuugggaggucgaagauuacggguucggcauuuucaccacuaacaucuggcuaaagcuccgggacuccuacacccagaugugcgaucaccgccucaugagugcggccaucaaggacagcaaggccgugcacgccgacaugggcuacuggaucgagagcgagaagaaugagaccuggaagcuggcccgggcguccuucaucgaggugaagaccugcacguggcccaaaucacauacccuaugguccaacgggguccuggaaagcgagaugaucauccccaagaucuacggugggccgauaucucagcacaacuaccguccuggcuauuucacccagaccgccggccccuggcaccugggcaagcucgagcuggacuuugaccugugcgaaggaacaaccguaguggucgacgagcacugugggaaccggggcccgagccucaggacgacaacggugacugggaagaucauccacgagugguguugccgguccugcacccugccuccccugcgcuuuagaggggaagacgggugcugguacggcauggagauccgccccguuaaggagaaggaggagaaccucgucaggagcaugguguccgcgggcagcggagagguggacagcuucucccugggcaucuugugcgucagcaucaugaucgaggaggucaugcgcucccgauggagcagaaagaugcucaugaccgggacgcuggccguguuccugcuacugauuaugggccagcuuaccuggaaugaccuaauccgccugugcaucauggucggggccaacgcuucugaccgcaugggcaugggcaccacccaucuggcccucauggccaccuucaaaaugcgcccgauguuugccguggggcuucuguuccggcgucucaccagccgagaagugcuucugcucacgaucgggcuguccuuagucgccagcguggagcuccccaauucacuggaagaauuaggggacggucucgcgaugggcaucaugaugcugaaacuguuaaccgaguuccagccucaccagcuguggacgacccugcucagucuuacguucgucaagacuacguuaucacucgacuacgccuggaaaaccacagccauggugcugagcaucgugucccuguucccacugugccuguccaccacgucccagaagaccaccuggcugccgguccuccugggcaguuucggcugcaagccgcugacgauguuccucaucaccgaaaauaagaucugggggcgcaagagcuggccccucaacgagggaauuauggcuaucgggaucgugagcauccugcucuccaguuugcucaaaaacgacgucccucucgcgggaccgcugaucgccggcgggaugcugauagccugcuauguuauaucgggcuccagcgccgacuuaucccuugagaaggccgcugaggugaguugggagcaggaggccgagcauaguggggccagccacaacauccuuguggagguccaggacgacgggacuaugaagaucaaggacgaggagcgggacgacacccuaaccauccugcugaaggcuacccuauuggcugugagcgggguauaccccaugagcauacccgcgacccuguucgucugguacuucuggcagaagaagaaacagcgcaguggcguguuaugggacacccccagcccgcccgagguggagcgggccguccuggacgauggcaucuaccgcauccugcagcgagggcuccucggccgcucgcagguaggggugggcgucuuccaggacgggguguuccacaccauguggcacgugacacggggcgccguccugauguaccaaggcaagcgcuuggaacccagcugggccaguguaaagaaagaccucaucagcuacggaggcggcuggcgauuccaagguuccuggaacacaggggaggaggugcagguuaucgcgguggagcccggcaagaauccgaagaacgugcagaccacccccggaaccuucaagacacccgagggggaagucggcgcgauagcucuggacuucaaacccggaaccucuggcuccccgaucgugaaucgcgagggcaagauugugggacuguacggaaacggggucgugaccaccagcggcacguauguguccgccaucgcucaagcgaaggcgagccaggaggggccccugcccgagaucgaggaugaagucuucaagaagaggaaccugaccaucauggaccugcacccuggcagcggcaagacucgccgguaccuccccgccaucgugcgggaggccaucaagaggaagcugcgcacccugauccucgcccccacccgcgugguugcguccgaaauggcggaggcucugaaggguaugcccauccgguaccagacuaccgccgucaagagcgagcacaccggccgcgaaaucguggaccugaugugucacgccacguucacgaugcggcuccuguccccgguccgcgugccuaauuacaacaugaucaucauggacgaagcacauuuuaccgacccggccuccauugccgcccggggcuauaucagcaccagaguaggcaugggggaggccgcugccaucuuuaugacugccacgccucccgguagugucgaagccuucccacagagcaacgccgugauucaggaugaggaacgagacauccccgaacgcagcuggaacucgggcuacgacuggauaaccgacuuccccggaaagaccgugugguuuguccccucuaucaaguccggcaacgacaucgcgaacugccuacggaaaaacgggaagcgcgugauccagcucagccguaaaacguucgacaccgaauaccagaagacgaagaacaacgacugggacuacguggugaccaccgauaucuccgagaugggcgccaacuuucgcgccgacagagucauugacccccggcggugcuuaaagcccgugauccuaaaggacgggcccgagcgcgucauccucgcaggcccgaugcccgugaccguugcuagcgccgcccagcggcgcggacggaucgggcgcaaccagaacaaagagggcgaccaguacguguacauggggcagccccugaacaaugacgaagaccacgcucacuggaccgaggcaaagaugcugcucgacaacaucaacacacccgagggcauuaucccggcgcuuuucgaacccgagcgcgaaaaguccgccgccaucgacggggaguaccggcugcgcggcgaagcacgaaagacauucguggagcucaugcgccggggugacuugcccgucuggcugagcuacaagguggcguccgagggguuucaguauagcgaccgccggugguguuucgacggcgagcgcaacaaccaggugcucgaagagaacauggacgucgagaucuggaccaaggagggggagcggaagaagcuccgccccaggugguuagacgcgcggacuuacuccgacccgcucgcgcugcgggaguucaaggaguucgccgccggcagacggucggugucuggcgaccugauccuggagauuggaaagcugccccagcaccugaccuuacgagcccagaacgcgcuggacaaccuggugaugcuccacaacuccgagcagggcgggaaggcauaccggcacgccauggaggaacugcccgacacuaucgagacacugauguuauuagcccugaucgccguccugacgggcggugcuacccuguucuuccucagcggcaagggccuugggaagaccuccaucggccugcugugcgugacggcgagcuccgcccuccuguggauggccagcguggagccccacuggauagcggccuccaucauccucgaguucuuccucaugguccugcugauuccggagcccgaccgccaacgaacgccccaggacaaccaacuugccuacgugguaauagggcugcuguucaugauccuuaccgucgccgccaacgagaugggccuccuggagaccaccaagaaggacuuggggaucggcuacguggcggccgagaaccaccagcacgccacgaugcuggacguggauuugcgaccggcgagcgccuggacgcucuacgcgguggccaccacggugaucacccccaugaugcgccauaccaucgagaacacuacagccaacaucucacuuaccgccaucgccaaccaggcggccauccugaugggccucgacaagggguggccaaucagcaagauggacaucggcgugccgcugcuggcccucggaugcuacucccaggugaauccgcugacccugaccgccgcggugcuaaugcugguggcucauuacgccaucaucggccccgggcugcaggcaaaggccacucgcgaggcgcaaaagcgcaccgccgccggcaucaugaagaacccaaccguugacggcaucguggccauagaccucgaccccgugguauacgacgcgaaguuugaaaagcagcuggggcagaucaugcugcucauacugugcaccagccagaucuuacuaaugcggacgaccugggcgcucugcgaguccaucaccuuggccaccggcccgcucacgacccugugggaggggagccccggcaaauuuuggaacacgaccauagccguguccauggccaacaucuuccgcggcagcuaccuggccggagcgggacucgccuucucuuugaugaaaagccucgggggcgggcgacgggggacgggggcacagggugagaccuugggugagaaguggaagcggcagcugaaccagcuguccaagagcgaguucaacacuuacaagcgcagcgggauaauggagguggaccggagcgaggccaaggagggucucaagcguggggagaccacgaagcacgcagucagccggggcaccgccaagcugcgcugguucguggagcguaaccucgugaagcccgagggcaaggucaucgaccuugggugcggucgaggaggguggucuuauuacugcgccgggcucaagaaggugaccgaggugaaggguuacaccaaaggcgggccgggccacgaggaaccgauccccauggccaccuacggguggaaucuggucaagcugcauagcggcaaggacguguucuucaugccgcccgaaaagugcgacacccuccugugugauaucggggaguccagcccgaaccccaccaucgaggagggccggacccuacgcgugcucaaaauggucgagcccuggcugaagggcaaccaguuuugcaucaagauucugaaucccuacaugccguccgugguggagacccuugaacaaaugcagcggaaacacgggggaaugcugguccgcaacccccugagcaggaacuccacgcacgaaauguacugggugagcugcgggacgggcaacaucgucuccgcagucaauaugaccagccgcaugcuccugaacagauucaccauggcucaccgcaagcccacguacgagcgcgacguggaccugggugccgggacccggcauguggccgucgagcccgagguggcaaaccucgacaucaucggccagcguaucgagaauaucaagaacgaacacaaauccaccuggcacuacgacgaggacaacccguacaaaaccugggccuaccacgggagcuacgaggugaagcccagcggcagcgcguccagcauggugaacggggugguccggcugcuuacgaagcccugggacgugaucccgaugguaacccagaucgccaugaccgacaccacgccguucggccagcagcggguguucaaagagaagguggacacccgcacgccccgcgccaagcgggguaccacgcagaucauggaaguaaccgcuaaguggcucuggggauuccugucccgcaacaagaaaccccggaucugcacucgugaagaguucacccggaaggugcgaucuaaugcagcgauuggcgccguuuucguggacgaaaaccaguggaacagcgcgaaggaggcggucgaggacgagcgauuuugggaccuugugcacagagagcgggaguugcacaagcaagggaagugcgcgacaugcguguacaauaugaugggcaagagggagaagaagcugggggaguucggcaaggccaagggcucgcgggcuaucugguacauguggcuaggggcccgcuuccucgaguucgaggcccugggcuucaugaacgaggaccacugguucagccgggagaacucacugagcggggucgaaggggaggggcuccacaaacuuggcuacauccugcgcgauaucuccaagauaccgggcgggaacauguacgcggaugacaccgcuggaugggacacacggaucacugaagacgaccugcagaaugaggcaaagaucacggacaucauggagcccgagcacgcacucuuggccaccagcaucuucaagcucaccuaccagaacaagguggugcgcguccagcgccccgcgaaaaacgggacugugauggacgugaucucccggagagaccagcggggcagcggacaagucgggacguauggccucaacacuuucaccaacauggaagugcaacugauccgucagauggaguccgaggggaucuuccucccaagcgagcuggagacaccgaaccuggcugagcgcgugcucgacuggcuggagaagcauggcgcggagaggcugaagaggauggccaucucaggggacgacugcguaguaaagccuauugaugaucgcuucgccacggcgcucaccgcucugaacgacaugggcaaggugagaaaggauaucccacagugggagccaagcaagggcuggaacgacuggcaacaagucccguucugcucacaccacuuccaccaacugaucaugaaggacgggcgugagaucgucgugcccugccggaaucaggacgagcuugucggccgcgcucgggugagccagggagccggcuggucccugcgcgagacggcaugccugggcaagagcuacgcgcaaauguggcagcucauguacuuccaccggcgcgaucugcggcuggccgcuaacgccaucugcucggcggugcccgucgacuggguaccuaccagccgcaccacguggucuauccacgcccaccaccaguggaugacuaccgaggauauguuguccguguggaaccgcguuuggaucgaggagaacccguggauggaggacaagacgcacgugucauccugggaggaaguacccuaccugggaaaacgcgaggaccaguggugcggcagccugaucgggcucacggcccgcgccaccugggccacaaacauccaggucgcgaucaaccaggugcggcgccugauuggcaacgagaacuaccuggacuacaugaccuccaugaagcgguucaaaaaugagucagaccccgagggggccuugugguga

SEQ ID NO: 23779 - RNA, 9879 nt, Artificial Sequence
  derived and/or modified CDS sequence (opt11) from DENV-1__GQ868563__SS-prME
agcguuaccauguuacuaaugcugcuucccaccgcccucgcguuucaccugaccacgcguggcggagaaccucauaugauugucagcaagcaggaacggggcaaaagccuccuuuucaaaacgagcgccggcguuaacaugugcacccugaucgccauggaccugggcgaacucugcgaggacacuaugacguacaagugcccccgcaucaccgaagccgagcccgacgacguggauugcuggugcaacgccaccgacaccugggugaccuacgguaccugcucccagaccggggaacaucggcgcgauaaacgcuccguggcccuugcgccccacgugggccuggggcucgagacacgcaccgaaacuuggaugagcucagagggcgcuuggaagcagauacaacgggucgagaccugggcccugcgccacccugguuuuacugugaucgcgcuguuccucgcgcacgccaucggcaccagcaucacccagaaggggaucaucuucauccugcugaugcuugugacccccuccauggccaugcggugcgugggcaucggcaaccgugauuucguggaagggcugucaggcgcuaccuggguggauguagugcuggagcacgggucgugcgugacuaccauggcuaaaaacaagcccaccuuagacauugagcuucugaagacugaaguuaccaauccugcaguacuccggaagcugugcaucgaggcaaaaaucagcaacacgacaacggacucgcgcuguccuacgcagggcgaagccacccuuguggaggaacaggacgccaacuucgucugccggcgcacauucguggaccggggcugggggaacggcugcggccuguucggcaaaggaagccugcuaacgugcgcaaaguucaagugugugaccaagcucgaggggaagauuguucaguacgagaaccucaaguacuccgucaucgugaccguucacaccggagaccagcaccaggucgggaacgagaccaccgagcacggcacuaucgccacaaucacgccccaggccccgacaagcgagauucagcugaccgacuacggggcucucacccuggacugcagcccacggaccggacuggacuucaaugagaugguccuccugacgaugaaggagaagucuuggcuagugcacaagcagugguuccucgaccugccgcugccguggaccuccggggcgucaaccucacaggagaccuggaaccggcaagaccuccuuguaacguucaagaccgcacaugcuaagaagcaagaggucgugguacugggaucccaagagggcgccaugcacacggcccucaccggggcaacggagauccaaaccagcgggaccacuacgaucuucgcuggucacuugaagugucgccugaagauggacaagcucacucugaagggcaugucguacgucauguguaccgguagcuucaagcuggaaaaggagguggcggagacccagcauggcacagugcugguucaagugaaauacgagggcaccgacgcucccuguaagauuccuuuuuccacccaagacgagaagggggugacccagaacggccggcuaaucacggccaacccgaucguaaccgacaaggagaagcccgugaacaucgagaccgagccgcccuucggggagagcuacauaguggucggcgccggcgagaaagcucugaagcuguccugguucaagaagggguccuccaucggcaagauguucgaggccaccgcacgaggagcccggcgcauggccauccuaggagacacugccugggacuucggcucaauuggcggaguguucaccuccguggggaaguuaguccaccagguauucgggaccgccuacggaguguuauucagcggcgucuccuggaccaugaaaaucggcaucggcaucuugcugacguggcugggccucaacagccgcucgaccagcuuauccaugacuugcaucgccguggggauggugacccuuuaucugggcgucauggugcaggcugacagcgggugugugaucaauuggaagggccgugagcugaaaugcgggucaggcaucuuuguaacaaacgaggugcacaccuggaccgagcaguacaaguuccaagccgacagcccgaagcgccugagcgcggccaucggaaaagccugggaggagggggugugcggcauccgguccgccacacgccuugaaaacauaauguggaagcagaucagcaacgaguuaaaccacauacuucucgagaacgacaugaaguucaccgucgugguaggcgacgcaaacggcauccuggcgcaagggaagaagaugaucagaccccagcccauggagcacaaguacuccuggaaguccugggguaaggccaaaaucaucggcgccgacauucagaacgccacguucaucaucgacgggcccgacaccccggagugccccgacggccagcgcgcguggaacaucugggaggucgaggacuauggguucggcaucuucaccaccaauaucuggcugaagcuccgugacuccuacacgcagaugugcgaccacagacugaugucagccgcaaucaaggauuccaaggccguucacgcugacaugggcuacuggaucgaaucagagaagaacgagaccuggaagcucgcgcgcgcuuccuucaucgaggugaagaccugcaccuggcccaaaagccacacgcucuggaguaacgguguccuggagagcgagaugaucauccccaaaauuuacggcgggccgauuucccagcacaacuaucgccccggauacuucacccagacggccgggcccuggcaccuaggcaaacucgaacuggacuucgacuugugcgagggcaccacgguagugguggacgagcacugcgggaaccggggcccgagccuccgcaccaccacugucacugggaaaaucauccacgaguggugcugccgguccugcacacugccgccccugcgcuucaggggcgaagacggguguugguacggcauggagauucgaccggugaaggaaaaggaggaaaaccucguccggagcaugguauccgcugguagcggugagguggacagcuucucccuagggauccucugcgucagcaucaugauagaggaagugaugcgcucccguuggucccgcaagaugcucaugacagguaccuuagccguguuccugcuacugaucaugggccaacugacguggaacgaccuaaccaggcugugcaucauggugggugcaaacgccuccgaucggauggggaugggcaccaccuaccuggcguugauggccacguucaaaaugaggccgauguuugccguggggcugcuguuccggaggcuuaccagucgggaaguacuacugcucaccauugggcugucguuggucgcgagcguggagcuccccaacucccuggaggagcugggggacgggcucgccauggguaucaugauguuaaaacuucucacugaguuccaaccccaccagcuguggacgacgcugcucagccugaccuucgucaagacuacgcugucccucgauuacgccuggaagaccacagcuaugguuuugagcauuguuucccuguucccccuuugccugagcaccacgucccagaagaccacuugguuaccaguccugcuugguagcuucggcugcaagccccugaccauguuccucaucaccgagaacaagaucugggggcgcaaguccuggccccugaacgaggggauaauggcuaucggcaucgugagcauccugcuaaguagccugcuaaagaacgacgugccccuugccgggccgcuuauugcaggcggcauguugaucgcgugcuacgucauaagcggcuccagcgccgacuuguccuuggagaaggcggcagaggugagcugggagcaagaagccgagcacaguggggcgagccauaacauccugguggaaguccaggacgacggcacgaugaagaucaaggacgaggagcgggacgauacccucaccauacugcugaaggccacccuacuggcggucuccggcguguaccccaugagcauucccgcgacgcuguuuguuugguacuucuggcagaagaagaagcagcgcuccggcgugcucugggacaccccuagcccgcccgagguggagcgggcagucuuggacgacgguaucuaccggauccugcagcgugggcugcucggccgcucccaggugggugugggcgucuuccaggacgggguguuucacaccauguggcacgugaccaggggagcuguccugauguaucaggguaagcgccuggagccuagcugggccuccgugaaaaaggaccugaucagcuacgggggcggguggcgguuccagggccuauggaacacgggggaggaggugcagguuauagccguggagcccggaaagaaccccaagaacgugcaaaccacccccggcacauucaagacacccgagggugaggucggcgcaaucgccuuagacuuuaagcccgggaccuccggcagcccaauagucaaccgcgaaggcaagauuguggggcucuacggcaauggggucgugaccaccuccggaacguacgugagcgccaucgcccaggcgaaggccucccaggaggggccucugcccgagaucgaggacgaagucuucaagaaacggaaucugaccaucauggaccuccacccggggagcggcaagacacgccgguaccugcccgcaaucgugcgcgaggccaucaagcggaagcugcggaccuuaauacuggcgccgacgcgcguagucgccucugagauggcggaggcacugaaggggaugcccauccgguaccaaacuaccgcggugaaguccgagcacaccggccgcgagaucguggaucucaugugucacgcgacguucaccaugcgccuccugaguccgguccgcguucccaacuacaacaugaucauaauggacgaggcacacuucaccgaccccgccuccaucgcagcccggggguacaucagcacccgcguuggcaugggagaagcggccgccaucuuuaugaccgccacgccgcccggcuccgucgaagccuucccccagucgaacgcgguaauccaggacgaagagagagacauccccgagcgcaguuggaauagcggcuaugacuggaucaccgacuuucccgggaagaccgugugguucguucccuccaucaagagcgguaaugacaucgccaauugccuccguaagaacgggaagcgcgugauacagcugucgcggaagacguucgacaccgaauaccaaaagacgaaaaauaacgacugggacuacgucgugacgacggacaucagcgagaugggcgccaauuuucgcgccgaucgggucaucgacccaagaaggugccugaagcccgugauccucaaggacgggccggagcgugucauacuggcgggcccgaugccugugacagucgccagcgccgcccagcgucgcggccggaucgguaggaaucagaauaaggagggcgaccaguacguguacaugggacagccccugaacaacgaugaggaucaugcccacuggaccgaagcgaaaaugcucuuggacaacauaaacacccccgaagguaucauuccugcccuguucgagcccgagcgcgaaaaguccgcagccaucgacggggaauaccgguugaggggcgaggcgcggaagacguucguggagcugaugcgccggggcgaccugccuguuugguuauccuacaagguggcgucagaaggguuccaguacuccgauagacgguggugcuucgacggcgagcgcaacaaccagguacuggaagagaacauggacgucgagaucuggaccaaggagggcgagcggaagaagcugcgcccccggugguuggacgcccgcaccuacucugacccgcuagcccugcgagaguucaaggaguucgccgccggccgccggucaguaucaggcgaccucauccuggagaucggcaagcugccccagcaccuuacacugcgugcucagaacgcccuggacaacuuaguaaugcugcacaacuccgagcagggcgggaaggccuaucggcacgccauggaggagcugccugauaccaucgagacccucaugcuucuggcacucaucgccguucugacgggcggggugacccuguucuuccuuuccggaaagggccuggggaagacuagcaucggucuccucugcgugacggccucgagcgcccugcuuuggauggcauccgucgaaccccauuggauugcugccucaaucauccucgaguucuuucugauggugcuacucauaccggagcccgaccgccagcggacgccacaggacaaccaguuagccuaugugguaaucggucuccucuucaugaucuugaccguggccgccaacgagaugggccuucuggaaaccacuaagaaggaccuugggaucggcuacgcggcggccgagaaccaccaacacgccaccaugcuggacguggaccuccgcccggccuccgcguggaccuuguacgccguggccacgacggugaucacccccaugaugcgccacaccaucgagaacaccacggccaacaucagccugacggccaucgcgaaccaggccgccauccugaugggccuggacaagggguggcccaucagcaaaauggauaucggcgugccgcucuuagcacuggggugcuacagccaggucaacccccugacccucaccgcugccgugcuuaugcugguggcccacuacgccauuaucggccccgggcuccaggcgaaggcaacgcgcgaggcccagaagcgcaccgccgccggcaucaugaagaacccuaccgucgacggcauaguggccaucgaccucgaccccgugguguacgacgcaaaguucgagaagcaacucgggcagaucaugcucuuaauccucugcacaagucagauccuccugaugcggacgaccugggcucuuugcgagaguaucacccuagccaccggcccccugacuacccugugggagggaucccccggcaaauucuggaauaccaccauugccgugagcauggccaacauuuucaggggcuccuaccucgcaggggcgggucuggccuucagccugaugaagucccucgggggaggccggcgugguaccggcgcccagggggagacacucggcgaaaaguggaagcggcagcuaaaccagcucuccaaguccgaguucaacacuuauaagcggagcgggauaauggaaguggaccggagcgaggcgaaggagggccugaagcgaggugagaccacgaagcacgcugucucgcggggcaccgccaagcugcgcugguuuguggagcggaaccuggugaagcccgagggcaaggucauagaccucgguugcggcagagggggauggucguacuacugcgcaggacugaagaaagucaccgaggugaagggcuacaccaagggcgggcccggccacgaggagccaauccccauggccaccuacggcuggaaccuaguaaaauuacacucuggcaaggauguguucuucaugccgcccgagaagugcgacacgcugcugugugacaucggagagagcaguccgaaccccacgaucgaagagggccggacucucagagugcuuaagauggucgagccuugguuacgugguaaccaauucugcaucaagauccucaaccccuacaugccgagcguuguggagacccuggagcaaaugcagcgcaagcacgggggcaugcugguccggaacccccucagccgaaacucuacgcacgagauguacuggguguccugugggacgggcaauauugucagcgcggucaacaugacaucccggaugcugcugaacagguucaccauggcccaccgcaagccuacguacgaacgggauguagaucuuggagccgggacccgccacguggccgucgagccggagguuccgaaccuggacaucaucgggcagcggaucgaaaacaucaagaacgagcacaagagcaccuggcauuacgacgaggacaacccauacaagacaugggccuaucacggguccuacgaaguuaaacccucgggcuccgcgagcucaauggucaauggcgugguacgccuguugacgaagccaugggacguuaucccgauggugacccagaucgccaugacagacaccacgcccuucggccagcagcgugucuucaaggagaaaguggauacccgcacgccccgcgcgaagcgcgggacgacgcaaaucauggaggugacagccaaguggcuguggggcuuccugagucggaacaagaaaccucggauauguacccgggaggaguucacuagaaaagucagaucuaacgccgcuauaggcgccguguucguagacgagaaccaauggaacagcgccaaggaagccgucgaggacgaacgcuuuugggaccucgugcaccgggagcgcgagcugcacaagcagggaaaaugcgcuacaugcgucuacaacaugaugggcaagcgagagaagaaacugggcgaguucgguaaagcuaagggcagccgugcaauuugguauauguggcuuggggcccgguucuuagaguuugaggcauugggcuucaugaacgaggaccacugguuuucccgcgagaacagccuuuccggcgucgaaggggaggggcugcauaagcucggcuacauacuuagagacaucucgaagauaccgggcgggaacauguacgcggacgauaccgccggcugggacacccguaucaccgaggaugaucugcagaacgaagccaaaauaacggacauaauggagcccgagcacgccuuacucgcaaccuccauuuucaaacuuacguaccagaauaagguggugcgcguccagcggcccgcuaaaaaugguacugugauggacgugauaagccgccgggaccagagggguucgggucaggucgguacguacggucugaacaccuucaccaauauggaggugcagcucauccgucagauggagagcgaggguaucuuucugccuuccgagcuggagacccccaaccucgcggagcgcgugcuggauuggcuggagaagcauggcgccgagcggcucaagagaauggcgaucagcggggacgacugcgucguaaagcccaucgaugaccgguucgccacggcguuaaccgcucugaacgauaugggcaaaguucgcaaggacaucccccagugggaaccauccaagggcuggaacgauuggcagcaaguacccuuuugcagucaccacuuccaucagcuuaucaugaaggacgggcgggaaaucguggugcccugucgaaaccaggacgagcuggucggucgggcucgagugucccagggggccggcuggucgcuccgggagaccgcaugccucggcaaguccuacgcgcagauguggcagcugauguauuuccaccgccgggaucugcgccucgccgccaaugccaucugcagcgcggugcccgucgagugggugccgacaucccggaccacguggagcauccacgcgcaccaccaguggaugaccacugaggacaugcugagcgucuggaacagaguauggaucgaggagaauccauggauggaggacaagacacacguguccagcugggaggaggugcccuaccugggcaagcgcgaggaucaguggugcggaucccugaucgggcugacugcccgugcuaccugggcuacaaacauucaggucgcgaucaaccaggugcgucggcucaucggcaacgagaauuaccucgacuacaugaccucuaugaaacgcuuuaagaacgaguccgaccccgagggagcccugugguga

SEQ ID NO: 23780 - RNA, 9879 nt, Artificial Sequence
  derived and/or modified CDS sequence (opt11) from DENV-1__GQ868564__SS-prME
agcgugaccaugcuacucaugcugcugcccaccgcucucgccuuccaccucaccacucgaggcggggagccccacaugauugugagcaagcaggagcggggaaaagcacuacuguucaagaccagcgccggggugaacaugugcacucugaucgccauggaccugggcgagcugugcgaggacacaaugaccuacaagugcccccguaucaccgaggccgagcccgacgauguggauugcugguguaaugcgaccgacacaugggugaccuacggcacaugcucccagaccggcgaacaucgcagggacaagcggagcguggcgcuggcgccucacgugggccuggggcuggagacccguaccgagaccuggaugucaucagagggcgccuggaaacaaauccagcgggucgagaccugggcccuucgccaccccggcuucacgguaaucgcauuauuccucgcccacgccauugggaccuccaucacccaaaaggggauaaucuucaucuuauugaugcuugugacccccagcauggccaugcggugcguuggcauaggcaaccgcgacuucguagaggggcugucuggggcuacauggguggacgucguguuagagcacgggagcugcgugaccacgauggcgaaaaacaagccgaccuuagacauagagcuacuuaagacagagguuacuaaccccgccgugcucaggaagcuauguaucgaggcaaagaucuccaauaccacgaccgacucacgcugcccgacucagggcgaagcuacgcugguagaagaacaggacgccaacuuugucugccggcguacguucguugaccggggcugggggaauggcugcggauuauuuggcaaggggucucugcugaccugcgcgaaguuuaagugugugaccaaguuagaagguaagauuguccaauacgagaaccugaaguacuccgucauugugacaguucauaccggugaucagcaccagguggggaacgagacgaccgaacacggcacaaucgccacaauuacgccccaggcucccaccuccgagauccagcuaaccgacuacggggcccucacccuggacugcucuccccgaaccggguuggauuucaacgagaugguccuccugacgaugaaggaaaaauccuggcuaguacacaaacagugguuucuugaccugccauuaccauggaccuccggggccuccaccagccaggagaccuggaaccggcaagaccugcuagugaccuucaaaaccgcgcacgcgaagaaacaggagguggucgugcuaggcucacaggagggcgccaugcacaccgcccucaccggggccacggagauucagacaagugguaccaccaccaucuucgcggggcacuuaaagugccgccuuaagauggacaaauugacccucaaggggaugucuuacgugaugugcaccggauccuuuaaacuggaaaaggagguggccgaaacucagcauggaacagugcugguccaagugaaguacgagggaaccgacgccccaugcaaaaucccguucagcacucaagacgagaagggggugacccagaacgggcggcucauuacagcaaacccaauugucacggacaaggagaaacccgugaacaucgaaacugaacccccuuucggggagucuuauaucgugguuggagcgggcgagaaggcuuugaagcugagcugguucaagaaggguuccagcaucggcaagauguuugaggccaccgcccggggugcucggcgcauggcgauacucggugacacugccugggauuucgguuccauuggagggguuuucaccucaguggggaagcugguccaucaaguguucggaaccgcuuacggggugcuguuuucugguguuagcuggacuaugaagauugggauuggcauccugcuuacguggcuggggcucaacucccgcuccaccucguuaagcaugacuugcaucgccguggggaugguaacacuguaucucggcguuauggugcaggccgacuccgggugugugaucaacuggaagggacgggaacugaagugcgguuccggcaucuucgucacgaacgaagugcacacuuggaccgaacaauauaaauuccaggcugacagcccgaagcgccuguccgccgcuaucggcaaggccugggaggaggggguuugcggcauacggagcgccacacgccucgaaaacauaauguggaagcagaucucgaaugagcugaaccauauccuguuggagaacgacaugaaguucacagugguggugggggacgcgaacggcauccuggcccaggggaagaagaugauaaggccucagcccauggaacacaaguacagcuggaaaagcugggguaaggcaaagaucauaggcgcggauauccagaacacgaccuucaucaucgacgggccugacacaccggagugccccgacggccagcgugcauggaacaucugggaggucgaagacuacggguucggcaucuucaccacgaacaucuggcugaagcuacgggauagcuacacccagaugugcgaccaccgccugauguccgccgccauaaaggacagcaaggccgugcacgccgauaugggcuauuggaucgaguccgagaagaacgagacauggaagcuggcacgggccagcuucaucgaagugaagaccugcacguggcccaagucccauacccuuuggagcaauggggucuuggaauccgaaaugauaaucccgaaaaucuacggcggaccgaucagucagcacaacuaccgccccggcuacuucacacagaccgccgggccguggcaccugggaaagcucgagcuugacuucgacuuaugugaaggcaccaccguuguggucgaugaacauugugggaaccgggguccgagucuucgaaccacgacggugacgggaaagaucauccacgaaugguguugucggucgugcacgcuuccgccacugcgcuucagaggggaagacgggugcugguacggcauggagauacgccccgugaaagaacgggaggaaaaccuaguucgcuccauggugagugcaggcaguggagaaguggacucguuuagccuggguauccugugcguauccaucaugaucgaagaggugaugagaucgagauggucucgcaagaugcucaugaccggaacccuggccguguuuuugcucuugaucauggggcagcugaccuggaaugacuugaccagacuguguaucauggugggagcgaacgccucugaccggauggguaugggcaccaccuaccuggccuugauggcuacuuucaagaugcgacccauguuugcggugggguuauuguuccggcggcucaccucccgcgagguccuauuacucaccaucggcuuaucgcugguggcguccguggagcucccaaacucucuggaggagcuuggggacggucuggccauggguaucaugaugcugaagcugcucaccgaguuucagccgcaccagcuguggaccacccugcucucccugaccuucgucaagacaacccugagccucgauuaugccuggaaaacuacugccauggugcugagcauaguuucccuguucccauugugccuguccacgaccagccagaagaccaccuggcuaccgguccuauuggggucuuucggcugcaagccccucaccauguuccucaucacagaaaauaagauauggggccgcaagaguuggccccugaaugagggcaucauggcgauugggauaguguccauacugcucagcucccuacugaagaaugaugugccccucgccgguccgcugaucgcuggcggaaugcugaucgcaugcuaugucaucaguggcagcuccgccgacuugagucuagagaaagcggccgaaguaucgugggagcacgaggccgagcacagcggcgccucccacaacauccuaguugagguccaggacgauggcacgaugaaaaucaaggacgaagaacgagacgacacacucaccauccuguuaaaagcugcgcuccuggccgugagcgggguguacccuauguccauuccggccacgcuauuugucugguacuucuggcaaaagaagaagcagcggagcggcgugcuaugggacaccccauccccgcccgagguggagcgcgccguguuggacgacggaauauaccggauucugcagagaggucugcucggucggucccaggugggggucggugucuuccaggacgggguguuucacaccauguggcaugugacccgcggcgccguccugauguaucaaggcaaacgguuggagcccuccugggcgagcgugaagaaggaccucauauccuauggggguggcuggagguuccagggcagcuggaacacaggggaggaggugcaaguuaucgccguggagccaggaaagaacccgaaaaacgugcaaacaacccccggcaccuucaagacgccggagggagaagucggcgcgaucgcgcuggacuuuaaacccgguacguccggcucucccaucgucaaccgugaaggcaagaucguggguuuauacggcaacggcgucgugaccaccuccggcacauaugugagcgcaaucgcgcaggccaaggcuucccaggaagggccacuccccgagaucgaggacgagguauucaagaagcggaaccucaccauaauggaccugcacccggguaguggcaagacccggcgguacuuacccgcuaucgugcgggaggcgaucaaacgcaaguugcgaacccuuauuuuagcacccacucggguggucgccagcgagauggccgaggcccuaaaagguaugccgauccgcuaccagaccaccgcggugaaauccgagcacaccggccgggagaucguggaccugaugugccacgcaacguuuaccaugcgccugcugagcccggugcgcguacccaacuacaacaugaucaucauggacgaggcgcauuucacggaccccgcgucgauagccgcgcggggguauaucagcaccagggugggaaugggggaggccgcagccaucuucaugaccgccacgccaccuggauccgucgaggcauucccccagucuaacgccgugauucaagaugaggaaagggacauacccgagcggucauggaacucagguuacgacuggauaaccgauuucccaggcaaaaccguaugguucguccccuccaucaagagcggcaaugacauugccaacugccuuaggaagaaugggaagagggugauucagcucucccgcaagacguucgacacggaguaccagaaaacgaagaauaacgacugggacuacgugguuaccacggauaucucagagaugggggcgaacuuccgagcggauagagugauagacccucggcggugccugaagcccgugauucugaaagaugggcccgaacgggucauccucgccggcccgaugcccgucacagucgccuccgccgcacagcgacgcggacgcaucgggcgcaaccaaaauaaggagggagaccaguacguguacauggggcagccgcugaacaaugacgaggaucacgcgcacuggaccgaggccaaaauguuacucgacaacaucaacacccccgagggcauuaucccggcccuguucgaacccgagcgagagaaguccgcugcaaucgauggggaguaucgucuacggggugaggcgcgcaagacguucguggagcucaugcgacgaggcgaucugcccgucugguugagcuacaaaguggccagcgagggcuuccaguauuccgaucggcgcuggugcuucgacggcgagcguaacaaccaggugcuugaggaaaacauggacgucgagauauggacgaaagagggcgagcgcaagaagcugcguccccgcuggcuugaugcucggacauacagugaccccuuagcccugcgcgaguucaaagaguucgccgcgggccgucgcuccgucagcggggaccugauccucgagaucgggaagcugccacagcaccuuacccuccgggcucagaacgcccuugacaaccuggugaugcuccacaacagcgagcaagggggcaaagccuaccggcacgcgauggaggaacugcccgacaccaucgagacgcuuaugcucuuggcccuaauugccgucuugaccggcggggugacccuguuuuuccugucagguaaggggcucgggaagacuagcauuggccuguugugcguaacagcauccucggcucuccuguggauggcguccgucgaaccacacuggauugcggcgagcaucauacuggaguuuuuccucauggugcuccugaucccggagcccgaccggcagagaacgccgcaggacaaccagcucgccuacgugguuaucgggcuguuguuuaugauccucaccguggcggcgaacgagaugggucugcuugaaaccacgaagaaggacuugggcaucggccacguagccgccgagaaucaccagcacgcuaccaugcuggacguugaucuccggcccgcuucagcguggacccucuaugcuguggccaccacggugauuacacccaugaugcgacauaccaucgagaauaccacggccaacaucagucugacggccaucgcgaaucaggccgccauucugaugggccucgacaagggguggcccauaucuaaaauggacauaggcgucccucuacuugcgcucgggugcuacucacaggugaauccgcucacccugaccgcggccguccucaugcucgucgcccacuacgccaucaucggccccgggcuacaagccaaggcgacgcgcgaggcccagaaacguacagccgcgggcaucaugaagaaccccaccguggacgguaucguggccaucgaccuagauccagucguguacgacgcgaaguucgagaagcaacuaggacagaucaugcugcucauccugugcaccucccaaauccugcucaugcgcacaacaugggcacugugcgagagcaucacccuggccacgggcccccucacgacgcucugggagggcuccccuggcaaauucuggaacaccacaaucgcagugagcauggccaacaucuuucguggcucuuaucucgcgggggcugggcucgccuucucgcucaugaaaucccucgguggcggacgccguggcacgggagcucaaggggaaacccucggcgagaaauggaagcgucagcugaaccagcugucuaagagcgaguucaacaccuacaagcguagcgggaucauggaagucgaccgcagcgaggcgaaagagggccucaaacgcggggagaccacuaaacaugcaguaucccgcggaacugccaagcugcggugguucguggagcgcaaccuggucaaaccugagggaaaggugauugaucugggcugcggacgcggaggcuggagcuacuauugcgcgggucuuaaaaaggugaccgagguaaaaggauacaccaagggcgggcccggucacgaggagccgauccccauggccaccuacggguggaaccuggugaagcuccacuccggcaaggacguauucuucaugccgcccgagaaaugcgauacguugcugugugauaucggggaaagcuccccgaaucccacaaucgaggagggccggacucugcggguauugaagaugguggagcccuggcuacgcgguaaccaguucuguauaaagauacugaaccccuauaugccuaguguggucgagaccuuggagcagaugcagcggaagcacgggggcaugcugguccgaaacccccugucccgaaauuccacucacgagauguacuggguguccugcgguaccggcaacaucgucagcgcgguaaacaugacgucucgcaugcucuuaaaucgcuucacuauggcccaccggaagcccacguacgagagagacguggacuugggcgcgggaaccaggcacgucgccguggagccagaggucgccaaccucgacauaaucggccagcgcauagaaaacauaaagaacgagcauaagagcaccuggcacuacgaugaggacaacccguacaagacgugggcguaucacggcaguuacgaaguuaaaccuuccgguuccgccagcucuauggugaauggggucgugcgucuccugacgaagcccugggacguaauccccauggucacccagaucgccaugacugauacuacgccguuuggacagcagcgcguauucaaagagaagguggacacccguacgccccgcgcaaagcgggggaccacccagaucauggaggucaccgccaaguggcuauggggguuccugagccgcaacaagaagccgaggauuugcacacgcgaggaguucacucggaaggugcgcuccaacgcggcgaucggagcaguguucgucgacgaaaaucaguggaauagcgccaaggaagcgguggaggacgaacgguucugggaccuggugcauagggagagagaauugcacaaacaaggaaaaugugccacgugcgucuacaacaugaugggcaagcgcgagaagaagcugggggaguuugguaaggccaagggcagccgagcgauuugguacaugugguuaggcgcccgcuuccucgaguucgaagcgcugggauucaugaacgaagaucauugguucuccagggagaacagcuuguccgggguggagggcgagggcuugcacaagcugggcuacauccuccgcgauaucagcaagauuccgggcgggaacauguaugccgacgacacugcggggugggauacccgcaucaccgaggaugaucuccagaacgaggcuaaaaucacagacaucauggagcccgagcacgcccugcuggccaccuccauuuucaaacucaccuaucagaauaaggugguccgcguucagcgccccgccaaaaacggaaccgucauggaugucauuucucggcgcgaccagcggggcuccggccagguggggacauauggccugaacacguucaccaacauggaggugcagcugaucagacagauggagagcgaggggaucuuccugccauccgagcucgaaacgccgaaccuggcagagcgggugcucgacuggcuggagaaacauggcgccgagcgccugaagcggauggcuaucagcggugacgacugcguggugaaacccaucgacgaccgcuucgcuacggcucugaccgcacugaaugacaugggcaagguucggaaggacauuccccagugggagcccuccaaggguuggaacgauuggcagcagguuccguucugcagccaccacuuccaucagcuaaucaugaaagacgggcgcgagauaguaguccccuguagaaaccaggaugagcucgucggacgcgcccggguaucccagggggccggcuggagccugcgcgagaccgcgugccuggggaaaagcuaugcccagauguggcagcucauguacuuccaccggcgcgaccugagguuagccgcaaacgcaaucugcagcgccguccccguggaguggguccccacgucccgcaccacgugguccauccacgcgcaccaucaauggaugacuacggaagacaugcucagcgucuggaaucgcguauggaucgaagaaaauccguggauggaggauaagacucacgugucgucuugggaggaggucccauaucuggggaagcgagaggaccaguggugcggcucccuaauaggguugacagcgcgagccaccugggcuacgaacauccaaguggccauaaaccagguccggcgacugauuggcaaugaaaacuaccuagacuacaugacuucaaugaagcgcuucaaaaacgaguccgauccugagggcgcccuaugguaa

SEQ ID NO: 23781 - RNA, 9879 nt, Artificial Sequence
  derived and/or modified CDS sequence (opt11) from DENV-1__GQ868565__SS-prME
ucagugaccaugcugcucaugcugcugcccaccgcguuggccuuccaccugaccacgcguggcggggagccccacaugaucgucucuaagcaggagcgaggcaagagcuuacuguucaagaccagugcgggggugaauaugugcaccuugaucgccauggaccugggcgagcucugcgaggacaccaugaccuacaaguguccccguaucacggaggcugagcccgacgacguggacugcuggugcaacgccaccgacaccugggucacuuacgguaccugcagccaaaccggcgagcaccggcgcgacaagcgguccguggccuuggcgccccacgugggccuggguuuggagacccgaaccgagacuuggaugagcuccgagggugccuggaaacagauccagcgggucgagaccugggcccugcgccaucccggguuuacgguuaucgcccuguuccuggcucaugccauaggcaccagcaucacccagaaggggaucaucuucauccuccuuaugcucgugacacccucgauggccaugcggugcgucggcaucggcaaccgcgacuucguggaggggcugagcggugcgacguggguggacgucgugcuggagcacggcuccugcgugaccacgauggcuaagaauaagcccacccucgacaucgagcugcugaagacggagguaacaaaccccgcggugcuccggaagcucuguaucgaggccaaaaucagcaauaccaccacggauucccgcugcccgacucaaggcgaggccacccugguugaagagcaggacgcgaacuucguaugccggcgcaccuuuguggaccggggcugggguaacggcuguggccuguucggcaaggggagccugcuaacuugugccaaauucaagugugugaccaaguuggaagggaagaucguccaguacgagaaccugaaguacuccgugaucgugaccguccacacgggcgaccaacaccaaguggggaacgagacaaccgagcacggaaccaucgcgaccaucacgccccaagcccccacgagcgagauccagcugaccgacuacggggcccucacccuggacuguagcccccgcaccggccuggacuuuaacgaaaugguccuccugacaaugaaagagaaauccuggcugguucacaagcaaugguuccucgacuuaccucugcccuggacguccggggccagcacuagccaagagaccuggaaccggcaagaccucuuggugacauuuaagaccgcccacgcgaagaaacaagaggucguggugcugggcucccaggagggcgccaugcauacagcccucaccggggccacagagauccagacauccggcaccacgaccaucuucgccgggcaccuuaagugucgccugaagauggacaagcucaccuugaagggcauguccuacgucaugugcaccgggucguucaaguuagagaaggagguagcugagacccagcacgggacggugcugguccagguuaaguacgaaggcaccgacgcccccuguaagauccccuuuaguacccaggacgagaaggggguuacccagaauggccggcucaucacggccaacccgaucguuaccgacaaggaaaaacccgucaacauagaaaccgagccgcccuucggggagaguuacaucguugucggugccggcgagaaggcgcugaagcuguccugguuuaagaaggggagcuccaucggaaagauguucgaggccaccgcccgcggggcccgccgcauggccauucucggcgauacggccugggacuucggcagcaucggcggcgucuucaccucgguggggaaguugguccaccagguauucgguaccgccuauggagugcuguucagcggggucucuuggaccaugaagaucggaauuggcauacuccugaccuggcugggccugaacagccgcaguacaagccuguccaugaccugcaucgccguggggauggugacccuguaccucggcgucauggugcaggccgauucugggugcgugaucaacuggaagggccgggaguuaaagugcggcuccggcauuuuugucacgaacgaagugcacaccuggaccgagcaguauaaguuucaggccgacagcccgaagcgcuugagcgcggcuaucggcaaggccugggaggagggggugugcggcauucgguccgccacccgccucgagaacaucauguggaagcagaucagcaacgaguuaaaccacaucuugcucgagaacgacaugaaguucaccgucguggugggggacgcaaacggcauccuggcccaagggaagaagaugauccggccccagcccauggagcacaaguacuccuggaaauccuggggcaaggccaagaucaucggcgccgauauccagaacgcuacguucaucauugacgggccagacacaccggagugccccgacggacagcgcgcguggaacaucugggaagucgaggacuacggguucggaaucuucaccaccaacauauggcugaagcuccgggacuccuacacccagaugugcgaccacaggcugaugucugccgccauuaaggacuccaaggccguacacgcugacaugggauacuggaucgagagcgaaaagaacgagaccuggaagcuggcgcgcgccucguuuaucgaagugaagacuugcacuuggccgaaaagccacacgcucugguccaacggggugcuggagagcgagaugaucauccccaaaaucuacggcgggccuauuucccagcacaauuaccgccccggcuacuucacccagaccgccgggccauggcaucuuggcaagcucgagcuggacuucgaccugugugagggcacaacggugguggucgacgagcacugcgguaacaggggccccagccuccguaccaccaccgugacgggcaagaucauccaugaguggugcugccgguccuguacucugccgccccugcgauuucgcggggaggacgggugcugguacggcauggagauccgccccgugaaagagaaggaagagaaccucguucggagcauggugagugccggaucgggggagguggauucauucucccugggcauacugugcguuuccauuaugaucgaggaagucaugcgcucccgguggagccgcaagaugcucaugaccgguacccuggccguguuccugcuccuuauaaugggccagcucacguggaaugaccucacucgccucugcaucauggucggggcgaaugccagugaccggaugggcaugggcaccaccuaccuggcccucauggcgacguucaagaugcgcccgauguucgccguggggcugcuguuccggcgccucaccagccgggagguccuucugcucacuaucgggcugagucugguugcgucuguggagcuccccaacucccuggaggagcuaggugacggccucgccaugggcauuaugaugcugaagcugcucaccgaguuucaaccccaccagcuguggacgaccuugcucaguuuaacguucgucaagaccacgcugucccucgacuacgccuggaagaccaccgccaugguguuaagcaucgugucccuguuuccccuaugccuguccaccacgucccaaaaaaccaccuggcucccggucuuauuaggaagcuuuggcugcaagccccugacgauguuucucauuacugagaacaagaucuggggacgcaaguccuggccuuuaaacgagggcaucauggcgauugggaucgugagcauccugcuauccagccuacucaagaacgacguaccccuggccggcccgcugaucgccggcgguaugcugauugcauguuacgucaucagcggcucgagugccgaccucucccucgagaaggcggcugaggugucgugggagcaggaggccgagcacuccggggccucucauaacauccucguggagguccaggacgacggcacgaugaagaucaaggacgaggagcgggacgauacgcucacuauccugcugaaggcgacauuacuggcaguguccgggguauaccccaugagcaucccagccacgcuguucgucugguacuuuuggcagaagaagaagcagcguuccggcguuuuaugggacacgcccagcccgccugagguggagagggccguccuggacgacggcaucuaccggauucuacaacgagggcugcucggucgcucccaggugggggucggcguuuuccaggacgggguguuccacaccauguggcacgugacccggggcgccguacugauguaccagggcaagcgccuggagcccagcugggccuccgugaagaaggaccucaucucauacgggggcggguggcguuuccagggccuguggaacacgggagaagaggugcaaguaaucgcugucgagccaggcaagaauccgaagaacguucagaccacccccggcacguucaaaacgcccgaaggggaggugggggccaucgcacucgauuucaagcccggcaccaguggcagcccgaucgugaaccgcgagggcaagaucgugggguuauacggcaacggggucgugaccacauccggaacguauguuagcgccaucgcgcaagcgaaggccucccaggaggggcccuuacccgaaaucgaggacgaagucuucaagaagcggaaucugacgaucauggaccuucacccgggcagcggcaagacccgccgguaucugccugccaucgugcgggaggcgaucaagcggaaauugcguaccuuaauauuggcgcccacgcgcguggucgccagcgagauggcggaggcccugaaggggaugcccaucagguaccagacaaccgccgugaagucagagcacaccggucgcgagaucguggaccucaugugccacgcgacguucaccaugcgguuguuaagcccgguccgcgugcccaauuacaacaugaucaucauggacgaggcccauuucaccgaccccgccuccaucgcggcgcggggguauaucagcacccgcgugggcaugggggaggcggccgccaucuuuaugacggccacgccccccggaucagucgaggccuucccccaaagcaacgcggugauccaggacgaggagcgcgacaucccagagcgcuccuggaacucuggcuacgacuggaucaccgacuuccccgggaagaccgugugguucgucccgucaaucaagagcggcaaugacaucgccaacugccuccggaagaacgggaaacgugugauccagcugucccgaaagacguucgauaccgaguaccagaagaccaagaacaacgacugggacuacgugguuaccacggacaucagcgagaugggcgccaacuuccgcgccgaccggguaaucgacccccgccggugccucaagcccgugauccucaaagaugggcccgagcgcguuauccuggcgggaccgaugcccgugaccgucgccuccgccgcccagcggcgcgggcggaucgggcgcaaccagaacaaggagggcgaccaguacguguacaugggacagccccugaauaacgaugaggaccacgcccauuggaccgaggccaagaugcuauuagacaacaucaacaccccugagggcaucaucccggcccuguuugagcccgagcgcgagaagucagccgccauagacggggaauaucggcuccgcggcgaggcccggaagacguucguggagcugaugcgccggggcgaccugcccgucuggcucuccuacaagguggcgagcgaaggguuccaauauuccgaucgccgguggugcuucgacggcgagcgcaauaaccagguguuggaggagaacauggacgucgaaaucuggaccaaagaaggggagcgaaagaagcugagaccccgguggcucgacgcccgcaccuacagcgacccgcuggcccugcgugaauucaaggaguuugccgccggccgcaggagcgucagcggcgaccucauccuggagaucggaaagcugccccaacacuugacccugcgugcgcaaaacgcccuggacaaccucgugaugcugcauaacagcgagcagggaggaaaggcauaccgucacgccauggaggaacugcccgacaccaucgagacacucaugcugcucgcgcucaucgccguacugaccggaggugucacacuguucuuccucuccggcaagggccuggggaaaaccuccaucgggcugcugugcguaacagccuccagcgccuugcuguggauggccuccguugagccccacuggaucgccgccucuauuaucuuagaguucuuccugauggugcugcucauccccgagcccgaccgacagcggacaccccaggacaaccagcuggcauacgugguaaucgggcucuuauuuaugaucuuaaccguggccgccaacgagauggggcugcucgagaccacuaagaaagaucuggggauuggcuacgcggccgcggaaaaccaccagcacgcuaccaugcuggacguagaucuccgcccggcuagcgcguggacccuguacgccguggccaccacggugauuaccccuaugaugcggcacaccaucgagaacaccacggccaacauuagccugaccgccaucgcgaaccaggccgcgauucuaaugggccucgacaagggguggcccauaucaaagauggacaucggcgugccccuguuggccuuggggugcuacagucaggucaacccucugacgcucacugcggccguccugaugcugguugcucacuacgccaucaucggccccgggcuccaggccaaggcgacgcgcgaggcccagaagcgcacagccgcgggcaucaugaagaaucccaccgucgacggcauaguggccaucgaccuggaccccguggucuacgacgcgaaguucgagaagcagcuggggcagaucaugcuccugauucuguguaccucccagauucuccugaugcgaacaaccugggcacugugcgaaagcaucacccucgccacagguccauugacaacccugugggagggaucccccggcaaguucuggaacaccacaaucgccgugagcauggccaacaucuuucggggauccuaccuggcgggagccggccuggccuucucucugaugaagucccucgggggggggaggcgcggcacgggcgcucagggggagacauugggcgagaaguggaagcgucagcugaaccaacucuccaagucugaguucaacaccuacaagcgcagcgggaucauggagguggaccggagcgaggcgaaagaaggacugaagagaggggagaccacgaagcacgccgugucccguggcaccgccaagcugagaugguucguggagcgaaacuuggugaagccagagggcaaggucauagaucucggaugcgggcgugggggcuggucauauuacugugccggccugaagaagguuaccgaggugaagggcuacaccaagggagggcccggccacgaggaaccgauccccauggcuacauacggguggaaccuggucaagcuccacuccggcaaggauguguuuuucaugccgcccgagaagugcgacacccugcugugcgacaucggcgagagcucuccgaaccccaccaucgaggagggccgaaccuugcgcguacugaaaauggucgagcccuggcugcggggcaaccaauucugcaucaagauccucaaccccuauaugccgagcgugguggagacauuggagcagaugcagcgcaagcaugggggaauguugguccggaauccccucucacggaauagcacacacgagauguacuggguguccugcgggaccgguaacaucgucagcgcgguuaacaugaccucccggauguuacugaaccgcuucaccauggcccaccgcaaaccuacguaugaaagagacgucgaucucggcgcugggacacgccacguggcggucgagcccgaaguggcaaacuuggauaucaucgggcagcguaucgagaauaucaagaaugagcacaagagcaccuggcacuacgacgaggauaacccguacaagaccugggcguaccacggguccuacgaggugaagcccagcggcucggccagcuccauggucaacggggugguccgccugcucacgaagcccugggacgugaucccaauggugacccagaucgcaaugaccgacaccacgccguucggccagcagcguguguucaaggagaaaguugacaccagaacgccccgggccaaacgcggcacaacgcaaaucauggagguaaccgccaaguggcugugggguuuccugagccggaacaaaaagccccgcaucuguacccgggaggaauucacccgcaagguccguuccaacgccgccaucggcgccguguucguggacgagaaucaguggaacagcgccaaggaggcggucgaggacgagcgcuucugggaccucgugcaccgggagcgcgagcugcacaagcaagggaagugcgccacaugcguguacaauaugauggggaaacgggagaagaagcugggggaguucggcaaagccaagggaagccgugccaucugguacauguggcuaggggccagguucuuagaguucgaggcgcugggcuucaugaacgaggaccacugguucucccgcgaaaacucacucuccggggucgagggcgaggggcugcauaagcucggauacauccuccgggacauuuccaagauuccgggcgggaacauguacgccgacgacaccgccggcugggacacgcguaucaccgaggacgaccuccagaaugaggccaagauaacggacauaauggagcccgagcacgcccuucucgccaccuccaucuucaagcugaccuaccagaacaagguggugcgcguccagcgucccgccaagaacgggaccgucauggaugucaucucaagacgugaccagcgcggcucaggccaggucgggacguacggccugaauaccuucaccaacauggagguccagcuuauccggcagauggagagcgaggggaucuuuuugcccuccgagcuggagaccccaaaccucgccgaaagagugcuggacuggcuggagaaacacggcgccgagcggcucaagcgcauggccaucagcggcgacgacugcgucgugaaacccauagacgaccgguucgcaacggcccugacagccuugaaugacaugggcaaaguccguaaggacaucccccagugggagccuuccaagggcuggaaugacuggcagcaagucccguucugcucgcaccacuuccaccagcucaucaugaaggacgggcgggagaucguggugcccugucgcaaccaggacgagcuaguaggacgcgcucgcgugucccagggggccggcuggagccugcgggagaccgcgugccucgggaaauccuacgcccaaauguggcagcugauguacuuucaccggagagaccugcgccucgccgcgaacgcgauaugcuccgcuguucccgucgagugggugcccaccagucggaccacauggagcauccacgcccaucaccaguggaugaccaccgaggacaugcugagcguguggaaucgcguuuggaucgaggaaaacccguggauggaggauaagacccacgugucaagcugggaagaggugcccuaucuggguaagcgcgaagaccaguggugcggcagccucaucgggcucacggcccgggccaccugggcaaccaauauccaggucgccaucaaccaggugcgacggcugauaggcaacgagaacuaccucgacuauaugaccucaaugaagagauucaagaacgaguccgaucccgagggggccuuaugguga

SEQ ID NO: 23782 - RNA, 9879 nt, Artificial Sequence
  derived and/or modified CDS sequence (opt11) from DENV-1__GQ868568__SS-prME
agcgugaccaugcugcucaugcugcugcccaccgcccucgccuuccaccugacgacccgcggcggggaaccacacaugaucgugagcaagcaggagagaggcaagagccugcucuucaaaaccagcgcgggugugaacaugugcacccugaucgccauggaccugggcgaacucugcgaagacacuaugaccuacaagugcccucgcaucaccgaggccgagcccgacgauguugacugcugguguaacgccaccgacaccugggugaccuacgggacaugcagccagacuggcgagcaccggcgcgacaaaagguccguggcgcuggcgccucacgugggucucgggcucgaaaccagaaccgagacuuggaugucuagugaaggugccuggaagcagauacaacgagucgagaccugggcccugcgccauccaggguucacugugaucgcacuguuccuagcucacgugaucggcaccagcaucacucagaagggaaucaucuucauccugcugaugcucgucacacccuccauggccaugcguugcgugggcauugguaaccgcgacuucguggaggggcucagcggugccaccugggucgacguggugcucgagcacgggucuugugucacaaccauggccaaaaauaaaccuacccucgacaucgaacugcuuaagaccgaggugaccaacccugccgugcuccggaagcugugcauugaggcgaagaucagcaacacaacgacggacucccgcugcccgacgcagggcgaggcuacccuggucgaggagcaagacgccaacuucgugugccggcguaccuucguggaccggggcuggggaaacggcuguggccuguuuggaaaggggagucugcugacaugcgccaaauucaagugcgucacaaagcucgagggcaagaucgugcaguacgagaaucugaaguacuccgugaucgucaccguucacacgggcgaccaacaccagguaggaaacgaaacgaccgagcauggcaccauagccacuaucacgccacaggcuccgacaucagagauccaguugaccgacuauggagcgcugacuuuagacugcagcccccgcacuggcuuagauuucaacgaaauggugcuccuuacgaugaaagagaaguccuggcuggugcacaagcaaugguuccucgacuugccgcuucccuggaccuccggggcgucgaccagccaggaaaccuggaaccggcaggaccuccucgugacauucaagaccgcccaugccaagaaacaggaaguggugguccugggcucccaggaaggcgcgaugcacaccgcccucacuggagcaacugaaauccagaccagcggcacaacuacgaucuucgccgggcaccugaagugccgccugaagauggacaaacucacccuaaaggggaugagcuacgugaugugcaccgggagcuucaagcuggagaaagagguggccgagacccagcacgggacgguccugguccaggugaaguaugaaggcaccgacgcgcccugcaagauccccuuuuccacccaagacgagaagggggucacccaaaacggccggcugaucacggccaacccgauugugaccgacaaggaaaagcccgugaacauugagaccgagccgccguucggggagagcuacaucguagugggugccggggagaaagcccugaagcuguccugguucaaaaaggggagcuccauuggcaaaauguuugaggcgaccgcccggggggcccggcgcauggccauuuuaggcgacacggccugggacuuugggucuauuggcgguguguucacauccgucgggaagcuggugcaccagguguucggcaccgcuuacgggguccuguuuucgggcguauccuggaucaugaagaucggcaucggcauccuccugaccugguugggccuuaacagccgcucaacgagccuguccaugaccugcaucgccgugggaauggucacccuguaccucggggugaugguucaggccgacagcgggugcgucaucaauuggaagggccgggagcucaagugcggcuccgggaucuuugugaccaaugagguacacaccuggaccgagcaguacaaauuccaggccgacagcccgaagcgccuuucugcagcgaucggcaaggccugggaggaggggguaugcggcaucagauccgccacucgcuuagagaacaucauguggaagcagaucagcaacgaacugaaccacaucuuacucgagaacgacaugaaguucacggugguagucggugaugccaaugggauccuggcgcagggaaagaagaugauccggccccagcccauggagcacaaguauuccuggaagagcuggggcaaggcgaagaucaucggugcugacacccagaacaccaccuucaucaucgacgggccggacaccccggaaugccccgacgggcagagggccuggaacaucugggagguggaggacuacggguucggcaucuucaccacgaacauauggcugaagcucagggacuccuacacgcagaugugcgaccaccgccugaugagugccgcgaucaaggacucgaaggccgugcacgccgacaugggauacuggauagagagcgagaagaacgagaccuggaagcuggcccgggccuccuucaucgaggucaagaccugcacauggcccaagagccauacccucugguccaacggggugcuggagucggagaugaucauccccaagaucuacggcgggcccaucucccagcacaacuaccgccccggguacuucacccagaccgcgggucccuggcaccuggguaagcuugaacuugacuuugaccugugugagggcacuaccguggucguggaugagcacugugguaaccgggggccgucucugcgcaccaccacggucacaggcaagaucauacacgagugguguugucgguccugcacacugccgcccuugcgcuuccggggcgaggacgggugcugguacggcauggagauccggcccgucaaagaaaaggaagagaaccucguuaggagcauggugucagccgguagcggcgaggucgacaguuucucccugggcauccugugugugagcaucaugauugaggaagugaugcgcuccagauggagccgcaagaugcugaugacugggacgcuggccgucuucuuauugcugauaauggggcagcugaccuggaacgaccucacccgccugugcaucaugguaggggcaaaugcauccgaccggaugggcaugggcaccacguaccuggcgcucauggcuaccuucaagaugcguccaauguucgccguggggcugcuguucaggcgccucaccagccgggagguccugcugcucaccaucgggcugucccuuguggccagugucgaacuccccaacuccuuggaagagcugggggacgggcucgccaugggcaucaugaugcugaagcuacucacggaguuccaaccccaccagcuguggaccacacugcucucgcugaccuuugugaaaaccacgcugucccuugacuacgcguggaagaccaccgccaugguacugagcauugucucccuuuucccacucugccugagcacgacaucccagaagaccaccuggcugccggugcuccugggcaguuucgguuguaagccccuaaccauguuccucauuacggagaacaaaaucugggggcgcaaaucuuggccacugaacgagggcauuauggccaucgggauugugagcaucuugcucuccagccugcugaagaacgacguaccccucgccggaccgcugaucgcgggcgggaugcugaucgcaugcuacgugaucagcggcagcagcgccgaccucucccuggagaaagccgccgaaguaagcugggagcaagaggcggagcacucgggugccagccacaauauccuggucgaggugcaggacgacggcacuaugaagauuaaggacgaagagagggaugacacccucaccauccugcugaaggcaacgcuccuugccguguccggggucuaccccaugucuauccccgccacgcuguucgugugguacuucuggcaaaaaaagaagcagcgcuccggcgugcucugggacacccccagcccccccgaggucgagcgggcgguucuggacgacggcauuuaccgcaucuugcagagagggcugcuaggccgcucccaggucggggucgggguguuccaagacgggguuuuccacacaauguggcacguaacgagaggcgccguguugauguaucagggaaagcgccuggagcccagcugggcauccgugaagaaagaucuaaucagcuacggaggaggguggcgauuccaggggucuuggaacaccggcgaagagguccaggugaucgccguggagcccggcaaaaacccaaagaacguccagaccacccccggcacguucaagacuccugagggggaagugggagccaucgcguuagauuucaagcccgggacaucuggaucccccaucguuaaccgggaggguaagaucgucggguuguacggcaacggggucguaaccacauccggcaccuaugucuccgcgaucgcccaggccaaagccucacaggaagggccacuccccgagaucgaggaugagguguuuaagaagcgcaacuuaaccaucauggaccugcacccgggcagcgggaagacccgccgguaccuccccgcuaucgugcgcgaggcgaucaagagaaagcuuaggacgcugauccucgcacccacccgugucguggccagcgagauggcggaggccuugaaggggaugcccauccgauaccagaccaccgccgucaagagcgagcacacgggacgugagaucgucgaccugaugugucacgccaccuucaccaugcgccuccugucgccgguucgcguucccaacuacaacaugaucaucauggacgaggcccacuucaccgacccugcgucgaucgccgccagaggguacauauccacgcgcgucggcaugggagaggcagccgcgaucuucaugaccgcaacuccacccgguagcguggaggccuuuccgcaguccaacgcgguaauccaggaugaggagcgggacauccccgagcgcagcuggaacuccggcuacgacuggauuacugacuuccccgguaagacggucugguucgugcccaguaucaaaucugggaaugauaucgccaacugccugcggaagaaugggaagcgcgugauccagcucucacggaagaccuucgacaccgaguaccagaagaccaagaacaacgacugggacuauguugugacgaccgauauauccgaaaugggcgcgaacuuccgcgccgaccgggugaucgacccccgccggugucugaagcccguuauccugaaggacgggcccgagcgagucauccucgcaggcccgaugcccguuaccguugccagcgcggcgcagcggcguggccggaucgggcgcaaccagaacaaggagggcgaccaguacguuuacauggggcagccccuaaacaacgacgaggaccacgcacacuggaccgaggccaagaugcugcucgacaacaucaauacccccgagggcaucaucccggcccuguucgagccugagcgcgagaaguccgcggccgucgacggggaguaccgauuacgcggcgaggcccggaagaccuucguggagcugaugcgccggggcgaccugccuguguggcugucuuauaaggucgccuccgaggguuuccaguacagcgacagacgguggugcuucgauggcgaacgcaauaaccaggugcucgaggagaacauggauguggaaaucuggaccaaggaaggagagcggaagaaguuacgaccccgcuggcuggacgcucgcaccuacuccgacccccucgcguuacgagaguucaaggaguuugccgccggccgacggucggucagcggcgacuuaauucucgaaaucgggaaguugccccagcaucugaccuuacgcgcucagaacgcucuggacaaucuggucaugcugcacaacucagagcagggcgggaaggcuuaccggcacgccauggaagaguugcccgacaccaucgagaccuugaugcuccuggcacugaucgccgugcuuacuggcggcgucacccuguucuuccugagcggcaagggccucgggaagacgucgauuggcuuauugugcgugaccgcgagcagcgcgcuccuuuggauggcuagcgucgaaccccacuggaucgcugccagcaucauacuggaguucuuccucauggugcuacuuauccccgagccugaucgucagcggacgccccaggacaaucaacucgcguacguggugaucgggcugcucuucaugauccucaccgucgccgcuaacgaaaugggccugcuggagacgaccaagaaggaucucgggauuggcuacguugccgcggagaaccaucagcacgcgacgaugcucgauguggaccugcgcccggccagcgcguggacccucuacgccgucgcuacgaccgugaucacccccaugaugcgucacaccaucgagaacacgacggcgaacaucucgcugaccgcgauugccaaccaggccgcaauccugaugggccucgauaagggguggcccaucucgaaaauggacaucggcgugccgcuguuagcacucgguugcuacucccaagucaauccgcuuacccugacggcugccgugcucaugcugguggcccacuaugcgaucaucggccccggcuugcaggccaaggccacccgcgaggcccagaagcgcaccgccgcgggcaucaugaaaaaccccaccgucgacggcaucguagccaucgaccucgaccccguaguuuaugacgccaaguucgaaaagcaacugggucagaucaugcugcucauccugugcacgagccagauccuguugaugcggaccacgugggcccugugcgagucuaucacccucgccacagguccgcucaccacgcugugggaggggagccccgggaaguucuggaacaccacgauugcggugagcauggcaaacaucuuccgcggcucguaccuggccggggcgggccucgcauucucccugaugaaguccuuggggggaggucggcgcgggaccggcgcgcaaggggaaacuuuaggcgaaaaguggaagcggcagcugaaucagcuguccaagagcgaguucaacaccuauaagcgaucugggaucauggaagucgaccgguccgaggccaaggagggccucaagaggggggagacgaccaagcacgccgucagccggggcacugccaagcugcgaugguucguggaacggaaucuggugaagccagaaggcaagguuaucgaucugggguguggccgcgggggcuggucuuauuacugugcgggacugaaaaaagugaccgaggugaagggcuacacgaagggcgggcccggccacgaggagccgauucccauggccaccuauggguggaaccuggugaagcuacauagcgggaaggacguguucuucaugccgcccgaaaagugcgacacccuccugugcgacauuggggagucuuccccgaacccuacaaucgaggagggccgcacgcuucgcgugcuaaagauggucgagcccugguuacggggcaaucaguucugcaucaagauucucaaucccuacaugccgucagucguggagacgcucgagcagaugcagcgcaaacacgguggcaugcucguccguaacccccugagccgcaacucgacccacgagauguacugggugagcugcggcaccggcaacauaguguccgccgucaacaugaccagcaggaugcucuugaauagguucacgauggcccaccgcaagccuacauaugagcgggacguugaucugggcgccgggacccgucacguagcggucgagcccgagguggcaaaccucgauaucaucggccagcggaucgagaacaucaaaaacgaacacaagucgacguggcacuacgacgaggacaacccguacaagacgugggccuaccacgggucguacgaagucaagccauccggcagcgccuccagcaugguuaacggggugguccgccugcugaccaagccaugggacgugaucccgaugguaacccagaucgccaugaccgacacgacaccguucggccagcaaagggucuucaaggagaaaguggauacccgcacgccccgggcaaagcgaggcacgacccagaucauggaggucaccgccaaguggcuauggggguuucugucccggaacaaaaaaccccgcaucugcacccgggaggaguucacgcggaagguccggagcaacgcugccauaggcgccguguuuguggacgagaaucaguggaacagugcaaaggaggccgucgaggacgagcgcuucugggaccugguacaccgggagcgcgagcuccacaagcaggggaaaugugcaacuugcguguacaacaugauggguaagcgggagaagaagcugggggaguucggcaaagccaagggcucccgagcgaucugguacauguggcugggggccagauuccucgaguucgaggcauuaggcuuuaugaacgaagaccauugguuuucacgcgagaacucccugucggggguagagggggagggguugcacaagcucggauacauccugcgggacauauccaagauuccgggcgggaacauguaugccgacgacaccgccggcugggacacccgcaucacggaagacgaucuccaaaacgaggccaagaucaccgacaucauggagccugagcacgcccugcuggccaccucaaucuucaagcucacguaccagaacaaggugguacguguccagaggcccgccaagaaugggacggugauggaugugaucagccgcagagaccagcgcggcagcggccagguugggaccuacggccugaauacauucacaaacauggaggugcagcugauccggcagauggagucagaagggauuuucuuacccagugagcuggagacuccgaaccuggcggagcgcgugcucgacuggcuugagaagcacggagcggaacggcuuaagcgcauggccauauccggcgacgauugcgucgugaaacccaucgacgaccguuucgccaccgcucuaacggcucugaacgacaugggaaaggugcgcaaggacaucccccagugggagcccagcaaaggcuggaacgacuggcaacaggucccguuuugcucccaccacuuucaccaacugaucaugaaggacggcagagagaucguggugccuugcaggaaucaagacgagcucgucggccgagcgcgcguaagccagggggccggcuggucccugagagaaacugcaugccuaggcaagucuuacgcccagauguggcagcucauguauuuccaccgacgcgacuuacgccuggccgccaacgccaucugcucggccgugccuguagaauggguacccacgucacggacuaccuggagcauccacgcccaccaccaguggaugaccaccgaggauaugcucuccguuuggaaccgcgucuggaucgaggagaauccguggauggaggauaagacgcaugugagcuccugggaagaggugcccuaucugggcaagcgugaggaccaguggugcggcucacugaucgggcucacugcacgggccaccugggcuaccaacauccaggucgccauuaaccaggugcgccggcugaucggcaacgagaacuauuuagacuacaugacuuccaugaagcgcuucaagaacgagagcgaccccgagggcgcccucugguga

SEQ ID NO: 23783 - RNA, 9879 nt, Artificial Sequence
  derived and/or modified CDS sequence (opt11) from DENV-1__GQ868569__SS-prME
agcgugaccauguugcuuaugcugcuucccaccgcccucgccuuccaucugaccacccgcgggggggagccgcacaugauuguuagcaagcaggagagaggcaagagccuccuguucaagaccagcgccggugugaauaugugcacucugaucgccauggaccugggagaauugugcgaggacacaaugaccuauaagugcccucggaucaccgaggccgagcccgacgauguagacugcuggugcaacgccacggacaccugggucaccuacgggacaugcucccaaaccggcgagcaccggcgcgacaagcggagcguggcccuggcgccccacgugggacuggggcucgaaacgcgcaccgagaccuggaugaguagugaaggcgcguggaagcagauacagcgaguagagacuugggcccugcgccaccccggguucacagugauugcacuuuuccucgcccacgccaucggcaccucaaucacccagaaggggaucaucuucaucuugcucaugcucgucacucccucuauggcgaugcggugcgucggcaucggcaaccgcgacuucguggaggggcucucuggcgcgacguggguggaugucgugcuggaacauggcuccugugugaccacaauggccaagaacaagcccacccucgacauagagcugcugaaaacggaggucgcuaaccccgccguucuccggaaacucugcaucgaagccaagaucagcaacaccaccacggacucccgcugcccgacacagggcgaagccacccugguggaggaacaggacgcuaauuucgucugccggcgcaccuuuguggaccgcggcugggggaacggcugcggacuguucgggaaggguagccugcugaccugugcgaaauucaagugcgugacaaagcucgaaggaaaaaucguccaguacgagaaccugaaguacuccguaaucgucaccguccacaccggggaccagcaccaaguggggaacgagacaacugagcacggcaccaucgccaccaucacaccccaggccccuacaagcgagauccagcugacggacuacggggcucucacccuggacugcagcccacguaccggccuggacuucaaugagauggucuugcugaccaugaaagagaaguccuggcugguucauaagcaaugguuccuugaccuaccucugcccuggacgagcggugccagcacaagccaagaaacuuggaaccggcaggaccuccuugugaccuucaaaacugcgcaugcuaagaagcaggaggugguggugcugggcucgcaggagggcgcaaugcacaccgcucucaccggggccaccgagauccagacaagcggcaccacuaccaucuucgcggggcacuugaagugccgccugaagauggacaagcucacuuugaaaggcaugucauacgucaugugcaccgggagcuucaaguuagagaaggagguggccgagacucagcacggcaccguccugguccaggucaaguacgaagggacagacgccccuugcaagauccccuucucuacccaggacgagaaaggcgugacucagaaugggcgguuaaucaccgcaaacccgauagucaccgacaaagaaaagcccgugaacaucgaaacagagccgcccuucggggagagcuacaucguggucggcgcgggagagaaggcgcuuaaacuguccugguuuaagaagggcagcucaaucggaaagauguucgaggcaaccgcacgaggggcccggcgcauggcgauccucggcgacacagccugggacuuugggucaaucggcggcguguucacguccguggggaagcuggugcaccagguguucggcaccgccuacgggguucuguuuagcggcguaaguuggacuaugaagauagguaucgggauccuccugaccuggcuggggcucaacagccgcagcacgagucugaguaugacaugcauugccguggggauggugacccuguacuuaggcguuauggugcaggccgacagcgggugcgugaucaacuggaagggucgggagcuuaagugcggauccggcaucuucgucaccaaugagguacacacauggacggagcaauacaaguuccaagcggacagcccgaagcgccugucugccgccaucggcaaagccugggaggaaggcguguguggaauccgguccgccacacgucucgagaauauuauguggaagcagauaagcaacgagcugaaccacauccugcucgagaacgacaugaaguucaccgugguggugggggaugcgaacggcauauuggcacaggggaagaagaugaucagaccacaacccauggagcacaaauacuccuggaagucauggggcaaggccaagaucaucggcgcagacauccagaaugcgaccuucaucaucgacgggccggacaccccggagugucccgacggccagagggccuggaacaucugggaggucgaggacuacggguucggcaucuucaccacgaacaucuggcugaaguuacgggacuccuacacccagaugugcgaccaccgccugaugagcgcagccauuaaggacucaaaggccgugcacgcggacaugggcuauuggaucgagagcgaaaagaacgagacuuggaaacuggcccgugcuuccuuuaucgaagucaagacaugcacauggccaaagucacacacccucugguccaacgggguccuagagagcgagaugaucauccccaagaucuacggcgguccgauuucccagcacaacuacagacccggcuacuuuacacagacggccggaccuuggcaccuuggcaagcucgagcuggacuucgaccugugcgaggggacuaccgugguggucgacgagcacugcggaaaucguggcccgagccuucgcacgaccacugugacugggaagaucauccacgaguggugcugucgcuccugcacgcugccucccuuacgcuuccggggcgaggaugggugcugguacgggauggagauucgccccgugaaagagaaggaggagaaucucguccggagcaugguguccgccggcagcggggagguggacagcuucucccuggguauccugugcgucuccaucaugaucgaggaggugaugcgcuccagauggagccgcaaaauguugaugaccgggacccuugcuguguuccugcuccugauaaugggccagcuuaccuggaacgaccucacgcgcuugugcaucaugguaggggccaacgcauccgaucgaaugggcaugggaacaaccuaccucgccuuaauggccaccuucaagaugcgcccgauguucgcgguggguuuguuauuccggcgacugacaagccgggaggugcugcugcuaaccaucggccugucacuggucgccagcguggagcuacccaacucccuggaagagcugggggacgggcucgccaugggcauaaugaugcugaagcugcucacagaguuucagccccaccagcuguggaccacucugcuguccuuaaccuucgucaagaccacccuuucccuugacuacgcuuggaaaacgaccgcgauggugcugagcaucgugucccucuucccccucugccucagcaccaccagccaaaagacgaccugguugccgguccuucuggggagcuucggcugcaagccacuuaccauguuccucaucaccgagaacaagaucugggggcgcaaauccuggccccugaacgagggcaucauggcaaucgguaucgugucaauccugcucuccagccuucugaagaacgacguuccccucgcuggcccucugaucgccggcggcaugcugaucgccugcuacguuaucucaggcuccucggcugaccuaucccucgagaaggccgccgaggugaguugggagcaggaggcggagcacuccggggccagccauaauauccuuguggagguccaggacgacggcaccaugaagaucaaggacgaggagcgggacgacacgcuaaccauacugcuaaaagcgacccuccuggccguuuccgguguguacccgaugucgauccccgccacccuguucguuugguacuucuggcagaagaagaaacagcgguccggcgugcucugggacacgccaagcccgcccgagguggagcgagccguccuugaugacgguaucuaccgcauccugcagcgggggcugcugggccgcucccaggugggggugggggucuuucaggacgggguauuccacacgauguggcaugugacccggggggccguacugauguaucagggaaagcgccuggagccgagcugggcguccgugaagaaggaccucauaagcuacgguggcggguggcgguuccagggccuguggaacaugggggaggaggugcaggucaucgccguggagcccggcaagaacccgcguaacgugcaaaccacaccgggcaccuuuaagacccccgagggggaggugggcgccauagcacuggacuuuaagcccggaaccuccggcagcccgaucgugaaccgggagggaaaaaucguggggcuguauggcaacggugucguaacgaccucuggcaccuacguuucagccaucgcucaagccaaggcgucucaggaagggccccugcccgagaucgaggacgagguuuucaaaaagcgcaaucucacgaucauggaccuccacccgggaagcggcaagacgcggcgcuauuugcccgccaucgugcgggaagcgaucaagaggaagcugcgcacccuuauccuggcacccacccggguggucgcaagcgagauggcggaggcccugaagggcaugcccauccgguaccagacaacggcgguaaagagugagcacaccggccgggagauaguggaccucaugugccacgccaccuucaccaugcgccugcugagcccggugcgggugcccaacuacaacaugauuauaauggacgaggcacacuucacagaccccgccagcauugccgcgcgcggguacaucucaacccgcguaggcaugggagaggccgccgcgauauucaugaccgccacgccacccggcuccgucgaagcguucccucagagcaacgccgucauccaggacgaggagagggauauccccgagcgguccuggaacagcggcuacgacuggaucacagacuuccccgggaagacuguaugguucgugcccaguaucaagagcgguaaugacaucgcaaacugccuccgcaaaaauggcaagcgggugauccagcugucucggaagaccuuugacaccgaguaccagaagacgaagaacaacgacugggauuacguggucacgaccgacaucucagagaugggcgccaacuuucgagcggaccgcgucaucgacccccggcgaugcuuaaagccagugauccucaaagacggucccgagcgggugauccuggcgggcccuaugccaguuacggucgccagcgcggcccagcgucggggccgaaucggcaggaaccagaacaaggagggcgaccaguacguguacaugggccagccccugaacaacgaugaggaccaugcgcacuggaccgaggccaaaaugcuccuggauaacaucaacaccccugagggcaucaucccagcccuguucgagcccgagcgggagaaauccgcugccaucgacggggaguaccgccuacggggcgaggcgagaaagaccuucguggagcuuaugagacgcggcgaucucccugucuggcugucauauaagguggccagcgagggguuucaguacuccgaccggcgcuggugcuucgacggcgaacguaacaaccaggugcuggaggagaacauggacguagagauuuggaccaaagagggggagcgcaagaagcuccggccccgcuggcucgacgcccgcacguacagcgacccucuggcccuccgggaguucaaggaguucgcugcgggccggcgcuccgugagcggcgaucucauccuggagaucgguaagcugccccagcaccucacccugcgggcccagaacgcccuggauaaccucguuaugcugcacaacagcgagcagggcgggaaagcauaccgccacgcaauggaggaacugcccgauacuaucgagacccucauguuacuggcccucaucgccguccuaacaggcggggucacgcuguucuuccuauccggcaagggcuuagggaagaccagcauuggcuugcucugcgugaccgcuucuagcgccuugcuguggauggcgucaguggagccucacuggauagccgccuccaucauccuagaguucuuccugaugguguuguuaaucccagagcccgacagacagcggacgccccaggacaaccaacuggcguacguggucaucgggcucuuauucaugauccugacaguggccgcgaacgagauggggcugcucgagaccaccaagaaggaccuggggaucggcuaugccgcugccgagaaccaccagcacgcgaccaugcuggacguggaccuccggccggcgucagccuggacgcucuacgcagucgcaacgaccgugaucacccccaugaugcgccauacgauagagaacacaaccgcaaacaucagccuuaccgcgaucgccaaccaggcggccauccucaugggccuggacaagggauggccgaucuccaagauggacaucggcgugccccugcucgcgcuggggugcuauagccagguaaacccguuaacuuugaccgccgccguucugaugcuuguggcccacuacgccauaaucggccccgggcuccaggcgaaggccacccgugaggcgcagaagcggaccgccgcgggcaucaugaagaaccccacggucgacggcauugucgcuauugaccuggaucccguuguuuacgaugcuaaguucgagaaacagcuaggacaaaucaugcuccugauccugugcaccucccagauccuccuaaugcggacaacgugggcccugugcgaguccaucacgcucgcgaccggcccgcugaccacccugugggaagggucccccggcaaauucuggaacacuaccauugccgugagcauggcgaauaucuuccggggcuccuaccuagcuggggcaggccuggccuucucgcugaugaagucccucggcggugggcgucgagggaccggcgcgcagggggagacccugggugagaaauggaagcgccagcuaaaccagcuaaguaaguccgaguucaacacuuacaaacgguccgggauaauggaaguggaccgcagugaagccaaggagggucugaagcgcggggagacgacuaagcaugccgucucccgaggcacagccaaacugcggugguucguagagcguaacuugguuaagcccgaaggcaagguuaucgaccuagggugugggcgcggcggguggaguuacuacugcgccgggcugaagaagguaacggagguuaagggguacaccaagggcggccccggccacgaggagcccauccccauggcgacuuacggguggaaccuugucaaacuccacucgggaaaggacguguucuucaugccccccgagaagugcgauacccugcugugcgacauaggagagucauccccgaacccgaccauagaggagggccguacgcuccggguguugaagauggucgaacccugguuacggggcaaccaguucugcaucaagauacucaacccguacaugccguccgugguugagacccuggagcagaugcagcggaagcacggugggaugcuggugcgcaacccccucucgcggaacucgacgcacgaaauguauugggugaguugcgggacgggcaacaucgucagcgcgguaaacaugacgucccgcaugcuccugaaccgcuucaccauggcccaccggaagccgacuuaugagcgcgacguggaccuaggcgccggcacccgacauguggccgucgagcccgagguggcgaaucuagacaucaucggccagagaauagaaaacaucaagaacgagcacaagagcaccuggcauuacgacgaagauaacccguacaagaccugggccuaccacgggucuuacgaagugaagcccagcggaucagccaguuccauggucaacgggguggucaggcuguuaaccaagccaugggacgugauaccaaugguuacccagaucgccaugacggacaccaccccauucggccagcagcgcgucuucaaagagaagguggacacccggacgccccgcgccaagcgcggcaccacccaaaucauggaagucacagcgaagugguuguggggguuccucagccgcaauaagaaaccccggaucugcacgcgcgaggaguucacccguaagguccgcuccaacgccgcuauaggggcgguguucguggacgagaaccaguggaacagcgcuaaagaagccguggaggacgagcgguuuugggaccuuguccaucgcgaacgugaauuacacaagcagggcaagugcgcgaccugcguguacaacaugaugggcaagcgcgagaagaagcugggugaguucggcaaggccaagggcagcagagccaucugguauauguggcucggagccagauucuuagaguucgaagcucugggcuucaugaacgaagaccacugguucucccgcgagaauucucucuccggcgucgagggcgaggggcuucacaaacugggcuacaucuuacgcgacaucagcaagaucccuggcgggaacauguacgccgacgacaccgccgguugggacacgcgcaucaccgaggaugaccugcagaacgaggcgaagaucaccgacaucauggagcccgagcacgcgcugcuagccaccuccaucuucaagcugacguaccaaaacaaaguaguucggguccagcgccccgccaagaacgguaccgugauggacgugauuagccgucgggaucagcgagguaguggccaggugggaacauacggccugaauacguucaccaacauggaggugcaacucauccgccaaauggagagcgaggggaucuuccugcccuccgaguuggagaccccaaaccuugccgaacgggugcuggacuggcuggagaagcacggagcggagcgccucaagcguauggcaaucagcggggacgacugcgucgugaagcccaucgacgaccgcuucgccaccgcccugaccgcacugaacgacaugggaaaggugcggaaggauauaccccagugggagccaucuaagggcuggaacgacuggcagcaggucccguuuugcagccaccacuuccaccagcucauaaugaaggacgggcgcgagauagucgugccuugccggaaccaggacgagcuggucgggcgcgcccggguuucccagggggcaggcuggagccugcgcgagacggccugccucgggaaauccuacgcacagauguggcagcugauguacuuccaucggcgcgaccugcggcucgccgcgaacgccaucugcagcgccgugcccguggagugggugcccaccuccagaaccacauggagcauccaugcccaccaucaguggaugacaacugaggacauguuaucgguguggaaccgggucuggaucgaagagaacccauggauggaggacaaaacccacguguccucgugggaggaagugccguaccuggggaagcgggaggaccaauggugcggcucccucaucggccugaccgcccgcgcgacuugggccacgaacauccaggucgcuaucaaccaggugcggcgccugauaggcaacgagaauuaccucgauuauaugacaaguaugaagcgguucaagaaugaauccgaucccgagggcgcccucugguga

SEQ ID NO: 23784 - RNA, 9879 nt, Artificial Sequence
  derived and/or modified CDS sequence (opt11) from DENV-1__GQ868570__SS-prME
agcgugacuaugcugcucaugcugcugcccaccgccuuggccuuccaccugaccaccaggggcggggagccacauaugaucgucagcaagcaggagcgcgguaagagccuccuauucaagacaagugcagggguuaauaugugcaccuuaaucgcuauggaucugggcgagcucugcgaggacaccaugaccuauaagugcccccgcaucaccgaggccgagccggacgauguggacugcuggugcaacgccaccgacaccugggugaccuacgggaccugcagccagaccggcgagcaccgucgcgauaagcgcaguguggcacuggcgccccacgugggucugggguuggagacccgcacggaaaccuggaugagcuccgagggcgccuggaagcagauccagcgggucgagacuugggcccugcgccaucccggguucacugugaucgcccuguuccuggcgcacgccaucggcaccagcaucacccagaaggggauaaucuuuauccugcucaugcucguaaccccaucaauggcuaugcgauguguaggcauuggcaaccgcgacuuuguggaaggccugagcggcgccacguggguugacguagugcuggagcacgguuccugcgucacgacuauggcgaagaacaagcccacccucgacauagagcugcugaaaacggaggucaccaaccccgcgguccuccggaagcuguguaucgaagccaaaaucagcaacacuacgacggacucccgcugcccgacccagggugaggccacccugguggaggaacaggacgccaacuucgucugccgucgaacuuucguggacagaggcuggggcaacgggugcgggcuguuuggcaaagggagccugcugacgugugccaaauucaagugcgugaccaagcucgagggcaagaucguucaguaugagaaccugaaguacuccgugaucgucaccguccacaccggcgaccagcaccagguggggaacgagacgaccgagcacgggacaaucgcgaccauaacgccccaggcucccacgagcgaaauccagcugaccgacuacggggcccucacucuggacugcaguccccggaccggccuugacuucaacgaaauggucuugcugacgaugaaggagaaauccuggcuggugcauaagcagugguucuuggaccucccgcugcccuggacgucuggggccagcaccagccaggagacauggaaccggcaggacuuacuggucacguucaagaccgcccacgcgaagaaacaagaggucgugguucuggguucccaggagggugcaaugcacacggcccucacaggugccacggagauccagaccagcggcaccaccaccaucuucgccggccacuuaaagugucgacugaagauggacaaacucacguuaaagggcauguccuacgugaugugcaccgggucauucaaacuggagaaggagguggcggagacccagcacgguacgguccucguccaggugaaguacgaggggacggacgcuccuugcaagauccccuucucaacucaggaugagaagggggucacccaaaacggccggcuaaucacggccaaccccaucgucacugacaaggaaaagcccgugaacaucgagaccgagccgccuuucggggaaagcuacaucguugugggcgccggcgagaaggcucugaagcuguccugguucaagaaagggagcuccauaggcaagauguucgaggccaccgcccguggggcucggaggauggccaucuuaggcgacacggcgugggacuuugggagcaucggaggcguauucaccuccguggggaagcugguccaucagguguucgggaccgccuacggcguccuguucagcggcguguccuggacgaugaaaguggggaucgguauucuccugacgugguuaggccuaaacagccgguccaccagucuguccaugaccugcaucgcaguggggaugguuacccuguaccucggcguuauggugcaagcugaccuggggugcgucaucaacuggaagggcagggaacugaagugcgggagcggcauuuuugugacgaacgaggugcacaccuggaccgaacaguacaaguuccaagccgacuccccgaaacgccucagcgcggccaucggcaaggcuugggaggaaggcgucugcggcauaaggagcgugacuaggcuggagaacaucauguggaagcagauuuccaaugaguuaaaccacauccuccuugagaacgauaugaaguucaccguggucgugggcgacgccaauggcauacucgcccaggggaagaaaaugauacggccccaacccauggagcacaaguacagcuggaaguccuggggaaaggccaaaaucaucggcgccgacacgcaaaauacaaccuucauuauagacgggcccgacaccccggaaugccccgacggucagcgagccuggaacaucugggagguggaggacuacggguucggcauuuucacuaccaacaucugguuaaagcuccgggacagcuauacccagaugugcgaccaccgccugaugucugccgcgaucaaggacucaaaggccguacacgccgacaugggcuacuggaucgaauccgagaaaaaugaaacguggaaguuagcccgggccaguuucaucgaggugaaaaccugcacguggcccaagucccacacccuguggagcaauggggugcuggaguccgagaugauuauccccaagauuuacggcggcccgaucucacaacacaauuaccggcccggcuauuucacccagacggcggggccguggcaccuagggaaacuugagcuggacuuugaucucugcgagggcaccaccguagugguugacgagcacugcggcaaccggggcccuagccugcguaccacuaccgucaccgggaagaucauacacgaguggugcugccgguccugcacccucccgccccugcgauuucggggagaggacgggugcugguacggcauggagauacgccccgugaaggagaaggaggaaaaucuggugcggagcauggucagcgccggcuccggcgagguggacagcuucucacugggcauucucugcguguccaucaugaucgaggaagugaugcgcagccgguggucccgcaaaaugcugaugacggggacgcuggccguauuccuccugcucaucaugggacagcugaccuggaacgaccugauacgcuugugcaucauggucggggcuaacgccucggaucggauggguaugggcaccacguaccucgcccugauggccaccuuuaagaugcgcccgauguucgcagucgggcuccucuuccggcgccugacaucucgggaagugcugcucuugaccaucggccuuucccucgucgccuccguagagcugcccaauagccuggaagaacucggagacgggcuagcgaugggcaucaugaugcuaaagcuccugacagaguuccagccccaccagcuguggacuacccuccugagccugaccuucgucaagacgacucucagccuagacuacgcguggaagaccaccgcaaugguccuguccaucguaagccucuucccccugugcuuauccacgaccucucagaagaccaccuggcucccggugcugcuggggaguuucggcugcaagccccucacaauguuccugaucacagaaaacaagauuugggggcgcaagagcuggccccugaacgagggcaucauggccaucgggaucgucuccauccuccugagcucccuguuaaagaaugacgugccccuggccggcccguugaucgcaggcggaaugcuaaucgccugcuacgugaucagcggcagcuccgccgaccugagccuggagaaggcugccgaagucucaugggaacaggaagcggagcacuccggugcaucccacaacauccuaguggaggugcaggaugaugguacaaugaagaucaaagacgaggagcgugaugacacccugaccauccuguuaaaggccacgcugcuggcugucagcgguguguauccaauguccaucccagccacccucuucgugugguacuucuggcaaaagaagaagcagcgcagcggggugcuuugggacacccccuccccgccagagguggagcgggcgguguuggaugacggcaucuaccgcauccugcaacggggguugcugggcaggucgcaggucggggugggcguguuccaggacggggucuuccacacuauguggcaugugacgagaggugccgugcuaauguaucagggcaaaaggcucgagcccuccugggccagcgugaagaaggaccugauuuccuacgggggcggguggagauuccagggcucuuggaacacuggugaggaaguccagguaaucgccguugaaccggguaagaacccgaagaacgugcagacaacucccgggacguucaagacucccgaaggggaagugggggccauagcgcuagacuucaaacccgggacguccggcagcccuaucguuaaccgcgagggcaagaucguggggcucuacggcaacgggguggucaccacguccggaaccuaugucagcgccauugcccaggccaaggcaucccaggaggggcccuugccugagauagaggaugagguguucaagaagcggaaccugacuaucauggaccuccacccgggcucgggcaagaccagacgguaccuaccggcgaucguccgcgaggccauaaagcggaagcuacgcacgcucauacuagccccgacccgcgugguggccagcgagauggcugaggcgcugaagggaaugccgauccgguaccaaaccacggcagucaaguccgagcacacggggcgcgagaucgucgacuuaaugugccacgccacguuuacuaugcgacugcugagcccggugcgcguaccuaacuacaauaugauuaucauggacgaggcccacuucaccgaccccgcgaguaucgcugccagaggguacaucagcacgcgcgugggaaugggggaggcggccgcgaucuucaugacugcaacgccgcccggguccguugaagccuucccccagucgaaugccgucauacaggaugaagaacgggacauccccgagcgcaguuggaacucaggcuaugacuggaucaccgacuuccccgguaaaaccgugugguucgugcccuccaucaaaagcggcaacgacaucgccaacugccuccggaagaaugggaagcgcguuauccaguugucacggaagacuuucgacacggaguaccagaaaaccaaaaacaaugacugggacuauguggugacgaccgacauuagcgagaugggcgcgaauuucagagccgaccgggucauagaucccagacggugccugaagccagucauccucaaggacgggccggagcgcgucauccuggccggcccaaugcccgugaccguggcguccgcggcucagcggcgcggccggaucgggcgcaaccagaauaaggagggagaccaauacgucuacauggggcagcccuuaaacaacgaugaggaccacgcccacuggacagaagccaagaugcuccuagacaauaucaacacgcccgagggcaucaucccggccuuauucgagccugagcgcgagaaaucagcggcuaucgacggggaguaccggcuccgcggcgaggcccggaagaccuucguggagcugaugcggcggggcgaccuccccguuuggcucuccuacaaggucgccagcgagggguuccaguacuccgaccggcgguggugcuucgacggcgagcgcaacaaccaagugcuggaggagaacauggacguggagaucuggaccaaggaaggugagcggaaaaagcugcgcccccgguggcucgacgcccgcaccuacagugauccgcuggcgcugcgcgaguucaaagaguucgcggcuggccgcagguccgucagcggcgacuuaauccuggagaucgggaagcugccccaacaccucacccuccgcgcccaaaacgcccuggacaaccucgucauguugcacaauagcgagcaaggagggaaggcguacaggcacgcaauggaggaacuacccgauacgaucgagacgcucaugcuacuagcucucaucgcugugcuaaccggaggggucacgcuguucuuccucuccggcaagggccuugggaagacgagcaucggccucuuaugcgugaccgcgucauccgcccugcuguggauggccagcguagaaccccacuggaucgcagcaagcauaauccucgaguucuuucugaugguccugcucauaccggagccggauaagcaaaggacgccccaggacaaccaacuggcguauguggucaucggguuacucuucaugauccuggcagucgccgccaacgagauggggcugcucgagaccacaaagaaggacuuggggaucggcuauguggccacugagaaccaccagcaugcgacuaugcuggacguagaccuccggccggccuccgccuggacccuuuacgccgucgccacgaccgugauuacccccaugaugcgccauacuaucgagaacacgaccgcgaacaucagccugacagccaucgccaaccaagccgccauucucaugggucuggacaaaggguggcccaucuccaagauggacaucggggugccccugcucgcgcuggggugcuacagccaggucaacccacugacuuuaacggccgcuguuuuaaugcuggucgcccauuacgcuaucauaggccccggccuccaggcgaaggccacgcgugaggcccagaagaggacggccgccggcaucaugaagaaccccacggucgacggcaucguggcuaucgaccuggacccuguagucuacgacgcuaaauucgagaagcagcugggucagaucaugcuccugauccuguguacgagucagaucuuguuaaugcgaacuaccugggcccugugcgagagcaucacccucgccacgggcccgcugaccacauuaugggaagggucccccggcaaauucuggaacaccacgaucgccgugucgauggcuaacaucuuccggggcuccuaccucgcuggggccggacuggccuucagccucaugaagucccucggcggcgggcgccggggcacuggcgcgcagggagagacccuuggcgagaaguggaagagacagcugaaccagcucagcaaguccgaguucaacaucuacaaaagaagcgguaucauggagguggauaggagcgaagccaaggaggggcugaaaagaggggagaccacgaagcaugccgucagucgcgguaccgccaagcugcggugguucguggagcgcaaccucgucaaacccgagggcaaagucaucgaucucgggugcggcagaggcggcuggaguuacuacugcgcgggccugaagaaggugacggaagugaaaggguauaccaagggcgggcccgggcacgaggaaccgauuccaauggccacuuacggcuggaaccugguaaagcuccacagcggcaaggacguguucuucaugccgcccgagaagugcgacacgcuuuugugugacaucggggagagcuccccgaaccccaccaucgaggagggccgaacccuccgggugcugaaaauggucgaaccuuggcuccgcggcaaucaguucugcauuaagauccuaaacccguauaugccgagcgugguggaaacucuggaacagaugcagcggaagcacggagggaugcuagugcgcaacccacugucccggaacagcacgcacgagauguacugggugucaugcgggaccggcaacaucgugucugccgucaacaugaccucccgcauguuacugaaccgauucacgauggcccaucgcaagccgacguaugagcgcgacguagacuuaggcgcugggacgcggcacguggcugucgagccugagguggccaaccuggacauaauaggccagagaaucgagaacaucaaaaacgaacacaagucaaccuggcacuacgacgaggacaacccuuacaaaaccugggccuaucacggguccuacgaggucaagcccagcggguccgccuccaguauggugaacggggugguccgucuguuaacaaagcccugggacgugauacccauggugacacagaucgccaugaccgacaccacgccguuuggccaacagcgcguuuucaaggagaaaguggauacccggacuccgcgcgcgaagcgggguacgacgcagaucauggaggugaccgcuaagugguuguggggguuucugagccgcaauaagaagccacggaucugcacccgcgaggaguucacccggaagguccgcuccaacgcugcuaucggagcaguguucguugacgaaaaccaguggaacucugcgaaagaggccgucgaggacgagcgguucugggaccucgugcaccgcgagcgggaacuacacaaacaggggaagugcgcgaccugcguuuacaacaugaugggcaagcgcgagaagaagcuaggggaguucggcaaggccaaaggcagccgggcgaucugguacauguggcucggggcccguuucuuggaguucgaggcccugggcuucaugaacgaggaccacugguucucccgcgagaauagccucucgggcgucgagggagaaggucugcacaaacuuggcuacaucuuacgagacaucagcaaaaucccgggcgggaacauguacgccgacgacaccgccggcugggacacccgcaucaccgaggacgacuugcagaacgaggcgaagaucacggauaucauggagccugagcacgcccugcuagccaccuccaucuuuaaacuuacuuaccagaacaagguggugcgcguccagcgccccgcgaagaacgggaccgucauggacguaaucagccggcgcgaccaacguggcuccggccaggucgggacguacggccugaauaccuucaccaacauggaagugcagcucauccgccaaauggaaagcgaggggaucuuccuuccguccgaacuggagacaccaaacuuggcggagcggguguuggacuggcuggagaagcacggcgcggagcgacucaagcggauggcuauuagcggggacgacugugucgugaagcccaucgaugaccgguucgccgccgcccugacggcgcuuaacgacaugggcaaggugcggaaggacauuccccagugggaaccguccaagggauggaacgacuggcagcaaguaccguucugcagccaccacuuccaccagcucaucaugaaggacggacgagagaucguggugccgugcaggaaucaggacgagcuggucggcagagcucgagugucccaaggggcagguuggucccugcgugagaccgcuugccucgggaaguccuacgcacagauguggcagcugauguacuuccaccggcgcgaucugagacucgcggccaaugccaucugcagcgccgugcccguugacugggugcccaccucucgcacuacuugguccauccacgcgcaccaccaguggaugacaaccgaagacaugcuaagcguguggaaccgggucuggaucgaggagaacccguggauggaagacaagacccacguguccagcugggaagagguaccauaucugggcaagcgugaggaccagugguguggcucccucauugggcuaacggcccgcgccaccugggcaaccaauauccaggucgccaucaaucaagugcgucgacugauugguaacgagaacuaccuugacuacaugaccagcaugaaacgguucaagaacgaguccgaccccgaaggggcacugugguga

SEQ ID NO: 23785 - RNA, 9879 nt, Artificial Sequence
  derived and/or modified CDS sequence (opt11) from DENV-1__KJ189302__SS-prME
agcgugaccauguugcucaugcugcucccuaccgcgcucgcauuccaccugacuacccggggcggcgaaccccacaugaucgugagcaagcaggagcggggaaagagccuccuguuuaaaaccagcgcgggggugaauaugugcacgcugaucgccauggaccugggggaacucugugaggacacuaugaccuacaagugcccccguaucaccgaagccgaacccgacgacguggacugcuggugcaacgccaccgauaccugggugaccuacgggaccugcagccagacuggcgaacaccggcgcgauaagcgguccguggcccuggcgccacacgugggcuuagggcucgagacccgcacagagaccuggaugagcuccgagggcgccuggaagcagauccagcggguagagaccugggcucugcgccaccccggguuuacugugauugccuucuuccuugcgcacgccauugguaccagcaucacccagaaggggauaaucuucauccuccucaugcugguaacccccuccauggccaugcggugcguaggcaucggcaaccgcgacuucguggaggggcugagcggcgccacuuggguugaugucguucuggaacaugguuccugcgugaccaccauggccaagaacaaacccacccuggacaucgagcugcuuaagacggagguaaccaaccccgcugugcugcggaagcucugcaucgaagccaagaucuccaacaccacuacggacagccgcuguccgacccagggcgaggcgaccuugguggaggagcaggacgccaauuucguaugccggcgcacuuucguggaccguggaugggguaacggcugcggcuuguucggcaaggggagcuugcugaccugugcuaaguuuaagugcguuaccaagcuggagggcaagaucguacaguacgaaaaccucaaguacagugugaucgugaccguacacacaggcgaccaacaucagguggggaacgaaacgacugaacacggcaccaucgcgaccaucacuccccaggcccccacgagcgaaauccagcucacugacuauggggcccugacgcucgacugcuccccuaggaccggccuggacuucaacgagauggucuugcucacuaugaaggaaaagucauggcucgugcacaagcagugguuccucgaccuuccgcugccuuggacauccggcgcgagcaccagccaagagaccuggaaucggcaggaucugcuugugacguucaagaccgcccacgcgaagaagcaggagguugugguacugggcucccaggaaggcgcaaugcacaccgcccugaccggggccacggagauccaaaccagcgguaccaccacgaucuuugccgggcaccuuaagugucgccugaagauggauaagcuaacccucaagggcauguccuacgucauguguacugggaguuucaaacuugagaaagagguugcggagacccagcauggcacggugcugguccaggugaaguacgaggggaccgaugccccgugcaaaaucccuuucuccacccaggacgagaagggaguuacgcagaacggccggcugaucacugccaacccaaucgucaccgacaaggaaaagcccgugaacaucgaaacugagccaccuuucggggagagcuauaucguuguaggcgccggcgagaaggcgcucaagcucucuugguucaagaaggggucauccaucgggaagauguucgaggccacagccagaggggcacggcgcauggccauccucggggacacagcgugggacuucgggagcaucgguggcguguucaccuccgugggcaagcucguccaccagguguucggcaccgccuacggggugcuguucucuggugucuccuggaccaugaaaaucgggaucggcauacuucucacguggcugggacugaacagccgauccacgucccucuccaugaccugcauugccguagggauggugacucuuuaucuggguguuaugguucaggccgacucggggugcgugaucaauuggaagggccgggagcucaagugcggguccggcaucuuugucacuaacgaggugcacaccuggaccgaacaauauaaauuccaggccgacucuccaaaacgccugucagcggccaucggcaaggccugggaggagggcgugugcggcauccguucugccacccgccuggagaacauuauguggaaacagaucagcaacgaguuaaaccacauccugcucgagaaugacaugaaguucaccgucguggugggggacgccaacggcauccucgcccaggguaagaagaugauccggccccaaccgauggagcacaaguacagcuggaaguccuggggaaaggccaagaucaucggcgcagacauucagaacaccaccuucaucauagacgggcccgacaccccggagugcccggacgggcagcgcgccuggaacauaugggaagucgaggacuacggauuuggcaucuucaccacgaacauauggcugaaauuaagggacucuuacacccagaugugcgaccaucggcucaugagcgcggcaauuaaggacaguaaagccgugcacgccgacaugggcuacuggaucgagagcgagaagaacgaaaccuggaaacuggcccgggcauccuucauugaagugaaaaccugcacguggcccaagagccacacccuguggucuaacggggucuuggagagcgaaaugaucaucccaaagauauacggcgguccuaucucccagcacaacuauagaccuggauacuucacccagaccgccggacccuggcaucugggcaagcuggaguuagacuuugaucugugcgagggcacgaccguggugguggacgagcacugugguaaucggggcccgagccuacgcacaaccacggugaccgggaagauaauccacgagugguguugccgguccugcacgcuucccccgcugcgcuuucggggagaggacgguuguugguauggcauggagauccgacccgugaaagagaaggaggagaaccugguccggagcauggugucugccggaucgggcgagguggacagcuucucucucgggaucuuaugcgucucuaucaugaucgaggaggugaugcgcagucgguggagccgcaagaugcugaugacgggaacgcucgccguguucuugcugcucaucaugggacagcugaccuggaacgauuuaauccgcuuaugcaucauggucggggccaacgcuucugaccggaugggaaugggcacgaccuaccuagcccuaauggccacauucaagaugcgccccauguucgccgugggacuucuguuccggcgucugaccucccgggagguucuauuguuaaccaucggcuuaagccuggucgcgagcguugagcuccccaacucccucgaggagcugggugacggccuggcgauggguauuaugaugcucaaguugcugaccgaguuccaaccccaccagcucuggaccacccugcugucuuuaacuuucgucaagaccacgcugagccuggauuacgccuggaagaccaccgccauggugcucagcauagucucccuguuuccccugugucucuccaccacgucucagaagaccaccuggcugccgguucugcucgggucauucggcugcaagccccucaccauguuccugaucacagagaacaagaucugggggcgcaagucuuggccccucaacgagggcaucauggcaaucgggaucguaucgauauugcuguccagcuuguuaaagaaugacgugccccuggcgggcccgcucaucgccggcgggaugcuaauugccugcuacgucaucucgggcuccagcgcugaccuaucccucgagaaggcggcagagguaagcugggagcaagaggccgagcacuccggggccagccacaauauccuggucgagguccaggacgacggcacaaugaaaaucaaggacgaggagcgggacgacacccugaccauccuccugaaagcaacucuucuggccguguccggaguauaccccaugucaauccccgcuacguuauucguaugguauuucuggcaaaagaagaagcagcguaguggcgugcugugggacacucccagcccgccagagguggagcgggccguacucgacgacggcaucuaccgcauccugcagcguggccugcugggaagaucccagguggggguaggcgucuuccaggacggaguguuccacacgauguggcacgugacgaggggcgccguccugauguaccagggcaagcgccuggagcccagcugggccuccgucaagaaggaccugaucagcuacgggggcggguggcgguuccagggguccuggaacacgggggaggaggugcaagucaucgccguggagcccggcaagaacccgaagaacgugcagaccacccccggcaccuucaagacgcccgagggggaggucggcgcgaucgccuuagacuucaagcccggcacaagcggcuccccgaucgugaaccgcgaggggaagaucguggggcuguauggcaacgggguugugaccaccucaggcacguacgucuccgccaucgcgcaggccaaagcuagccaggaagggccccugcccgagaucgaggacgagguuuucaagaagcgaaaccucaccaucauggaucugcacccgggcagcggaaaaaccagacgguaccugcccgccaucguucgcgaggccauuaagagaaaguuacguacccugauacuggcccccacgcgcguggucgcguccgagauggccgaggcacugaaggggaugcccauucgguaucaaaccaccgccgucaagagcgagcacaccggucgcgagaucguagacuugaugugucaugccacguucaccaugcggcugcucuccccgguccgcgugccaaacuacaauaugauuaucauggaugaagcgcacuuuaccgacccugcgagcaucgccgcucggggguauauaucaacccgcgugggaaugggggaggccgcggccaucuucaugacggcuacaccgcccggcuccgucgaggcguuuccccagagcaacgccgugauccaggaugaggagcgcgacaucccggagcgcagcuggaacucaggcuaugauuggaucaccgacuuccccggcaagaccgugugguucgugcccagcauaaaguccggcaacgauaucgcgaacugccuacggaagaacggaaagcgcguuauccagcuaagccggaaaacguuugacaccgaguaccagaagaccaagaacaaugacugggacuacguggucaccacggacaucuccgaaaugggcgccaacuuccgggccgaucgggugaucgacccacgccggugucucaaacccgugauccuaaaggacgggccggagcgcgucauccuggccggcccaaugcccgugaccguagcaagcgccgcccagcggcgcggccggaucgggaggaaucagaauaaggaaggcgaccaguacguguauauggggcagccucucaacaaugacgaggaccacgcacacuggaccgaggcuaagaugcugcuggacaacauuaacacccccgagggcaucaucccagcacucuuugagcccgagagggagaaguccgccgccaucgauggcgaguaccggcugcgcggcgaggcccguaaaacguucguggagcugaugaggcggggcgaccucccugucuggcugagcuauaaggucgccucugagggguuucaguacagcgacaggcguuggugcuuugacggggaaaggaacaaccaaguguuggaggagaacauggacgucgagaucuggaccaaagagggggaacggaagaagcuccgcccccgguggcuugacgcccgcaccuacuccgacccgcuggcguuacgggaguucaaggaguucgccgccggacgccggagcguuagcggugaucugauacuggagaucgggaaacucccccagcaccugacccugcgggcccagaacgcauuggacaacuuagugaugcugcauaauagugagcagggugggaaggccuaccggcacgcaauggaggaacuccccgacaccauagagacucugaugcugcuagcccugaucgcgguccugaccggcggggugacccucuucuuccugucaggcaagggacuggggaagacaucgaucggacuccugugcgugacggccucaagugcccugcucuggauggccagcgucgagccacacuggauagccgcgucgauaauucucgaguucuuccugauggugcuccugauccccgagcccgaucgccagcggacgccccaggacaaccagcuugccuacguggucaucggucuucuguuuaugauucugacuguggcggccaacgagaugggcuuacuggagaccacgaaaaaggaccuggggaucggcuacguggccgcggagaaccaucagcacgcgaccaugcucgacgucgaccugcgcccggccagcgccuggacucuguaugcgguugcgacgacgguaaucacccccaugaugcggcacacgaucgagaacaccacggccaauaucucccucaccgccaucgccaaccaagccgcaauccugaugggccuggacaagggguggcccaucucgaagauggauaucggcgucccccuacucgcccuggguugcuacucgcaggucaacccacucacacugaccgcagcuguguugaugcucguggcgcacuacgccaucaucggccccggacugcaggccaaggccacgcgagaggcccagaaacgcaccgcggccggaaucaugaagaacccaacgguggacggaauuguggcaaucgaccuggaucccgucguguaugacgccaaguucgagaagcaguuggggcagaucaugcuguuaauccugugcaccagccagauccuucugaugcggacgaccugggcuuugugcgaguccauuacacuggccacuggcccgcugacgacgcucugggaggggagccccgguaaguucuggaacaccaccaucgccgugucuauggcaaacaucuuccggggcagcuaccuggccggggccggcuuggcguuuucacucaugaaaagccucgggggcgggcggcgcggcacgggcgcccagggggagacucugggcgaaaaguggaagcggcaacucaaccagcugaguaagagugaguucaauaccuacaagcguucggggaucauggaggucgacagaucugaggccaaagagggccuaaagcgcggggaaaccacgaaacacgccgucucucggggcaccgcuaagcugaggugguucguggaaagaaaccuggucaagccugagggcaaggugauugaccucgggugcggaaggggcggcugguccuacuacugcgcugggcuuaagaaagucaccgaagucaagggcuacaccaagggcgggcccggccacgaggagccgauaccgauggcuaccuacggguggaaccucguaaagcugcacucgggcaaggauguguucuucaugccacccgagaagugcgacaccuugcucugcgauaucggggaguccagccccuccccuaccaucgaggagggccgaacccugcgcguccugaagaugguggagcccuggcuccggggcaaccaguucugcaucaagaucuuaaacccauacaugccuagcgucgucgagaccuuggagcagaugcaacgcaaacacggagggaugcucgugcgaaacccccugucccgcaacagcacccaugagauguacugggugucgugcgggaccggcaacaucguaagugccgugaacaugaccucccggauguuacuaaaucgguuuaccauggcccacagaaagcccacguacgagcgggacguggacuugggcgcugggacccgccacgucgcugucgaaccggagguagcaaacuuggacaucauaggacagcggauugagaauaucaagaacgagcacaagagcaccuggcacuacgaugaggacaacccguauaagaccugggccuaccaugggagcuacgagguuaagcccaguggcuccgccagcuccauggugaacggggucgugcgccuccuaacgaagccaugggacgugaucccgauggucacccagaucgcgaugaccgacaccacgccguucggucagcagcggguguucaaggagaagguggauacccgcacaccccgggcuaaacgcggcacgacacagaucauggaggucaccgccaagugguuguggggguuccucucccggaacaagaagccacgcaucugcaccagggaggaguucaccaggaaggugcggagcaaugccgccaucggcgcaguguuugucgacgagaaccaguggaacuccgcgaaggaggccguagaggacgagcgcuucugggacuuggugcaccgggagcgcgaacugcauaagcaggggaagugcgccacaugcgucuauaacaugaugggcaagcgggaaaagaagcucggggaguucggaaaagcgaagggcagccgagcuaucugguacauguggcugggggcccgguuucuggaguucgaggcauuaggcuucaugaacgaggaccacugguucucccgcgagaacucguuguccggcguggagggcgagggguugcacaagcugggcuacauccugcgggacaucagcaaaaucccuggagguaacauguacgccgacgacaccgcgggcugggauacccgcaucacagaggaugaccugcagaacgaagccaagaucacugacauuauggaacccgagcacgcccuacuggcaacauccaucuucaagcugaccuaccagaacaaggucguccgcgugcagcgccccgccaagaacgggacaguuauggacgucauuagccgccgggaccagcgcggcuccggccagguggggacguauggccucaacaccuucaccaauauggaggugcagcugauccggcagauggagagcgaggggaucuuuuuacccagcgagcucgaaaccccuaaucuggcggagcgcguccuagacuggcucgagaagcacggggcagagcggcugaagcguauggcaaucagcggggaugacugcguggugaaaccaaucgaugaccgguucgccacagcccugaccgcgcucaacgauaugggcaaaguccgcaaggacauuccgcagugggagcccuccaagggcuggaacgauuggcaacaggugcccuucuguagccaccacuuucaccagcuaaucaugaaggacgggcgggaaaucgucguccccugucgcaaccaagaugagcuggugggccgggcuagggugucccagggggcuggcuggagcuugcgugaaaccgcaugccucgggaaauccuacgcccagauguggcagcugauguacuuccaccggcgggaccuccgcuuagcggccaacgcgauuugcagugccgugcccguggacugggugccaaccagccggaccacauggucaauacacgcgcaucaucaguggaugaccaccgaggacaugcugagcgucuggaaccgcguguggaucgaagagaacccguggauggaggacaagacgcacguguccagcugggaggaggucccuuaccucggcaagcgcgaggaccaguggugugggucccucaucgggcugacggcacgggccacgugggccacgaacauccaggucgcuauuaaccaggugcgacgccuuaucggcaaugagaacuaccuagacuacaugaccagcaugaagcgcuuuaagaacgaguccgaccccgagggggcgcuaugguga

SEQ ID NO: 23786 - RNA, 9879 nt, Artificial Sequence
  derived and/or modified CDS sequence (opt11) from DENV-1__KJ189303__SS-prME
uccgucaccaugcuccuaaugcuacugcccacugcucuagcguuccaucuuaccacgagaggaggcgaaccacauaugauagugucaaaacaagaaagagguaaaucauuacuauuuaaaacuagcgcaggcgugaauaugugcacguuaauugcuauggaucucggggaacugugcgaggacacuaugaccuacaaaugcccgaggaucaccgaagcagaacccgaugauguagauugcuggugcaacgcaacggacaccugggugacauauggaaccuguagccaaaccggugaacaccggcgcgacaaacggucagucgcccucgcaccccacgucgggcuuggacuggagacgcggaccgaaacauggaugucaucugaaggcgcauggaaacaaauucaacgcguagagaccugggcacuaagacaccccggcuucacaguuaucgcacuauuccucgcacacgucaucggaaccagcauaacccaaaaagggauaauauucauucuucucaugcuaguaaccccaagcauggcuaugcguugugucgggaucggaaaccgggacuucgucgagggacugagcggagcgacgugggucgauguaguucuagagcacgggucaugcguaacgaccauggccaaaaacaaacccacccuugacauagagcuauugaaaacagaggucacaaaucccgcaguacucaggaaacugugcauugaagcgaaaaucuccaacacgaccacagacagucguugucccacucaaggagaagccacacucguggaagaacaagaugccaacuucgucugccggcgaaccuucguugaccgaggguggggaaacggaugcggccuauuuggcaagggcucccugcuuacaugcgccaaguuuaaaugcguaacuaagcucgaaggcaagauaguacaauacgaaaaccuuaaguacagcgucaucgucacgguccacacaggcgaccaacaccaaguagguaaugaaaccacggagcaugggacuaucgcaacuauuacgccacaagcacccacguccgaaauccagcucacggacuauggcgcauuaacacucgacugcucuccucggacgggcuuagauuucaaugagaugguccuccucacgaugaaagagaaaaguugguuaguccacaagcagugguuccuagaccuaccacuaccguggaccucaggggcaucgacuucacaagagacuuggaaccgacaggaucuccucgucacauucaagacggcgcacgccaagaaacaagaggucgucguccugggcucccaagagggagccaugcacacggcccugaccggcgcaaccgaaauucaaaccagcggaaccacaacaauuuucgcuggccaccuaaaaugccguuuaaaaauggacaaacucacacugaaagguaugucguacgugaugugcacagggagcuuuaagcucgagaaagagguagcagaaacccagcauggcacugugcuagugcaagucaaguacgaggggacagaugcaccaugcaaaauaccauucagcacucaggacgaaaaaggaguuacacaaaacggacgacuaaucacagcaaauccaaucguaacagacaaagaaaaaccagucaauaucgagacggaaccaccauucggggagucauacaucgucgucggcgcgggagaaaaagcucuaaaauugagcugguuuaagaaaggaucgucuaucgggaaaauguucgaagccacggcgcgcggugcgagacgaauggccauacugggcgacaccgccugggacuucggcucgaucggcggcguguucacuagcguggguaaauugguccaccaggucuucgguacagcauacgguguccuauuuucgggggugagcuggaccaugaaaaucggcauaggcauccugcuaacauggcuugggcuuaacucaagaagcacgucacuaagcaugaccuguaucgccguagguaugguaacacucuacuuagggguaaugguacaagcagauuccggcugcgucauaaacuggaaaggacgcgagcuaaaaugcggcuccggaauuuucguaaccaacgaaguucacacauggaccgaacaguauaaguuccaggccgacaguccaaaacgacucagcgcggcuauuggcaaggccugggaagaaggagucuguggaauaagaagcgccaccaggcuagaaaacaucauguggaagcagaucucgaacgagcuaaaccacauccugcucgaaaacgacaugaaguucacggugguggucggagacgcaaacgggaucuuagcccaaggcaagaagaugauccgcccucaaccuauggaacacaaauauucauggaaaagcuggggcaaagcgaaaauaaucggggcagauacucagaacacuacguuuauaauugacggcccugacacgccagaaugcccagacgggcaaagggcguggaacaucugggagguugaagauuauggauucgggaucuucacaacaaacaucuggcucaagcuaagagacagcuacacacaaaugugugaucacaggcucauguccgccgcgauuaaggacagcaaggcgguacaugcggacaugggcuacuggaucgagucggagaaaaacgagaccuggaaauuagcucgcgcaucauucaucgaagucaaaacgugcacauggccgaaaagccacacccuauggaguaacggagugcuggaaagcgaaaugaucauaccaaaaauuuacggaggaccgauuucacaacacaacuaccggccuggauacuucacccagacagcagggccauggcaccuaggaaaacucgaacucgauuucgaccucugcgagggaacgaccgucguaguagacgaacauuguggcaacaggggacccucauuacgaacgaccaccguuacgggaaaaaucauacacgaauggugcugccguuccugcacccuucccccgcugcgcuuccgcggcgaagacggcuguugguauggcauggaaauccgcccggucaaagagaaagaagagaacuugguacgaucaaugguguccgcaggaaguggcgagguagacagcuucucccuaggcauccuguguguuucgaucaugauagaggaggugaugcggucgagguggagccgaaaaauguugaugaccggcacucuagccguguuccuccuacucauuaugggacaauuaacguggaaugaccuaacgcgucuuuguauaaugguaggagcaaacgcaucagacagaaugggcauggggacuacguaucucgcacucauggcaaccuucaagaugcggcccauguucgcaguuggacuacucuuucgccgccuaaccaguagagagguucugcuuuuaaccaucgggcucaguuuagucgcguccgucgaacugccaaauagccuagaggagcuaggggauggccucgcaaugggaauaaugauguugaagcuacucacagaauuucagccccaccaacucuggacaacauugcucucauuaacuuuugucaagacgacccuaagccuagauuacgcguggaaaaccacagcgaugguacucucaauagucucccuauucccacuuuguuuauccaccacaagccagaaaacaacgugguugccugugcugcugggcucguucggcuguaaaccucugaccauguucuuaauaacggaaaacaaaauauggggacgaaagagcuggccccuuaacgaaggaaucauggcuauaggaaucgugaguauccucuuauccucgcuccuuaaaaacgacgucccgcucgcggguccacuaauugcaggaggcaugcuaauagcgugcuacguuauaagcggaaguagcgcugaucuuagccuggaaaaggccgccgaagugucaugggagcaggaagccgaacauuccggcgcgagccauaacauccugguugagguacaggaugacgguacgaugaaaauaaaggacgaagaacgagacgauacgcuuacgauccuccugaaggcaacucugcuagccgucagugggguguacccgaugagcaucccagcuacccucuuugugugguacuucuggcagaagaagaaacaacgcuccggagucuugugggacacgccaucaccgcccgaaguagagcgggcaguauuagacgaugguauuuacagaauccuacaacgagggcuacugggcaggucccaggucgguguaggaguguuccaagacggaguauuccacacgauguggcacguuacacgcggcgcgguccuaauguaccaagguaaaaggcuagagcccagcugggcaagcgucaagaaagaccugaucucguacggagggggcuggcgcuuccaaggauccuggaauaccggagaggaaguccaaguaaucgccgucgagccggguaaaaacccgaaaaauguacaaaccacaccaggaacguucaaaacgccagaaggcgaagucggcgcaauagcgcucgacuucaagccaggaacgagcggaucacccaucguaaacagggaagggaaaauaguggggcuguacggcaacggggucgucacaaccagcggcacguaugugucagcuauugcacaggcgaaagcaagccaagaggguccguuaccggaaauugaagacgaggucuucaagaaacgcaaucugaccauuauggauuuacaucccggaaguggaaagacgcgacgguacuugccggccauugugcgcgaagcaaucaagcgaaaacuaagaacccugauacuggcaccgacccgcguaguggcuucagaaauggcagaagcacucaaaggcaugccgauaagguaucagacaaccgcugucaagucggagcacacaggacgagaaaucguagaccucaugugucacgccacauucaccaugcgccuccuaagucccgugagggugccuaacuauaauaugauaauaauggacgaggcucacuucacagauccagccucgaucgcagcaagaggauacauaagcacaagggugggcaugggggaagccgcagccauauuuaugacggcuacuccgccggggagcgucgaggcguuuccucagagcaacgcaguaauacaagacgaagagagagauaucccggaacgcucguggaacagcggguacgacuggauaacggacuuucccgggaaaaccguaugguucguaccaucgauaaaaaguggcaacgacaucgcaaacugccucagaaagaacggcaaacgcgucauccaauugagcagaaaaacauucgacaccgaauaccaaaagacgaaaaacaacgacugggacuacgucgucaccacggauauaucggagaugggagcgaacuuucgcgccgauagagucaucgaccccagacggugccugaaacccgugauauugaaagauggcccagaacgcguaauccuagcgggccccaugcccgucacgguugcgagcgccgcucaaagacgaggacgaauaggccgcaaccagaacaaggaaggcgaucaguauguuuauaugggucagccacugaauaacgaugaagaccaugcucacuggacagaagccaaaaugcuuuuggauaacaucaacaccccagagggaauaaucccggcccuuuuugaacccgagagggagaaaagcgcagccgucgauggcgaguaccgacuucgcggggaagcaaggaagacauucguagagcucaugcgucgcggugaccucccagucuggcucagcuacaaaguagcgucagagggcuuccaguauagugacagacgcuggugcuucgacggagagagaaauaaccagguccucgaagaaaacauggacguagaaauuuggacuaaagaaggcgaacguaagaaauugcgcccccgauggcuagacgcaagaacuuacagcgacccgcuugcccucagggaguuuaaagaguucgccgcagggagaaggagcgugagcggagaccucauccucgaaauaggaaaacucccgcagcaccuaacacugcgcgcacagaacgcccuggacaauuuagucaugcuccacaacucggaacaaggagguaaggcauaucgccacgcaauggaagaacuacccgacacaaucgagacccugauguuacucgcccucaucgccgucuuaacaggaggcguaacacucuucuuccuauccgggaaaggccuaggcaagacuagcauaggccuauugugcguaacggccuccagcgcgcuuuuguggauggcaagcguggagccgcacuggauugcagcuuccauaauccucgaguucuucuugaugguucuucugauuccagaaccagacagacagcgaacgccccaggauaaccagcuugcguacguagucaucggauuacuauucaugaucuuaaccguggcagccaacgaaauggggcugcuagagacaaccaagaaagaccuugggauaggguacguggcggcagaaaaucaucagcacgccacaaugcuagacgucgaccuccgaccagccuccgcauggacucuauacgcaguggcuacaacugugauaacgccgaugaugagacauaccauagaaaauacaacagccaacaucagucugacagccaucgcaaaccaggccgcaauacuuauggggcuagauaaaggcuggccaauaucgaagauggauauuggaguaccgcuuuuggcacuaggauguuacagccaggugaacccacucacguuaacggcagcgguacucaugcucguagcccacuaugcaauaaucggaccaggccuccaagcgaaagcgacccgagaagcccagaagcggaccgcagccggaauaaugaaaaacccaacaguagacggaaucgucgcaauagaccucgauccgguggucuacgacgcgaaguuugagaaacaacuggggcaaauaaugcuucuaauuuuauguacaagccagauccuccugaugcggacaacaugggcauuaugcgagucaaucacccuagcaaccggaccgcugacuacauuaugggaaggaucacccgggaaauucuggaacacaacaauagcggugucaauggccaacaucuuuagaggcagcuacuuagcaggcgcaggacuagccuucucccucaugaagucccucggagggggucggcgcggaacaggugcgcagggggaaacccugggugaaaaguggaaaaggcagcucaaucaacugucuaagagcgaauuuaacaccuacaaacgaucggggauaauggaaguugaccgaucugaggcaaaagagggacugaaaagaggggaaacgacuaaacaugcagucucacgcgggacagcgaaacucagaugguucguggaacggaaccucguaaaacccgaaggcaaagugauagaccucgguugcgguagaggggguuggaguuacuauugugcaggccuuaagaaggucacagaagucaagggauauacgaaaggcggccccgggcacgaagaaccaaucccaauggcgaccuacgguuggaaccuuguuaagcuccauucggguaaggauguuuucuuuaugccuccugagaaaugcgacacacuucuaugcgacaucggcgaauccagcccgaauccaaccaucgaggaaggucgaacucuacgcguccugaagaugguugagccguggcuucgcggaaaccaguuuugcauaaagauauuaaaucccuauaugcccuccguaguggaaacucuugaacaaaugcaacgaaaacacggagggaugcugguccgaaacccguugagucgaaacuccacccacgaaauguacugggucagcugcgguacgggaaacaucgugagcgccguaaacaugacaagucgcaugcuccuaaaucgcuuuacaauggcccaccgcaaaccaaccuacgagagggauguagaccucggggcgggaacgcgucauguagccguagaacccgaaguagccaaccuagacaucauaggacaacgaaucgagaacauuaaaaacgaacacaaauccacauggcacuacgacgaggauaacccauauaaaacaugggccuaucacggcagcuacgagguaaagcccucagggucggcaagcucgaugguaaaugggguagucagguuacucacgaagccaugggaugugauacccaugguuacccaaaucgcgaugacggacaccaccccauucgggcaacaaagagucuucaaagaaaaaguagacacccgaacaccaagagcgaagcgcggaaccacucaaaucauggaaguaacggccaaauggcuguggggcuuuuugucgcggaacaaaaagccacgaauaugcacacgugaagaauuuacucgcaaggugagaucaaacgcagcgaucggugcugucuuuguugaugagaaccaauggaacagugccaaagaggcggucgaagacgagcgcuucugggaccugguccacagagagcgagaacuccauaaacaagggaaaugcgcaacgugugucuacaauaugaugggaaagcgcgagaaaaagcucggcgaguucggcaaagccaagggcucccgcgcaauaugguacauguggcugggagcacgauuccuugaauuugaggcccucggcuuuaugaacgaggaccacugguucucgcgagaaaacucacucuccggcguagaaggggaagggcuccacaaguuggguuacauacucagagauauaagcaaaaucccgggcggcaacauguacgccgacgacacggcugggugggacacacgaauaacagaagaugacuugcagaaugaagcaaaaauuaccgauaucauggaaccugagcacgcacuccucgccacaagcauauucaaguuaaccuaccaaaacaaagucguacgcguucaaaggccggccaaaaacggcacagucauggacguaaucagccgaagagaccagcgggggagcggacaaguagguaccuauggacuaaauaccuucacaaacauggaagugcagcugauccgccaaauggagucggagggcaucuuccugcccuccgagcuggaaacaccaaaccuagcagagcgugugcuugacuggcuagaaaaacacggagccgaacggcuaaaaaggauggcgauauccggcgacgacugcgucgugaagcccaucgacgaccgguuugcaacggcguugacggcacugaacgacaugggcaagguacgcaaagacauaccccaaugggaaccuucaaaaggguggaaugauuggcaacaagugcccuucugcucccaccauuuucaccagcuaaucaugaaggacgggcgagagauaguaguaccaugcagaaaccaggaugaguuggugggacgugcccgagugagccagggagcagggugguccuugagggaaacagcaugccucggaaaaagcuaugcacagauguggcaacugauguacuuucaccgacgagaccugcgccuugcagccaaugcuauauguucggcuguaccuguagagugggugcccaccucaaggaccaccugguccauccacgcccaucaccaguggaugacaaccgaagacaugcucuccguauggaacagagucuggauagaagagaauccauggauggaagacaagacccacguaucuuccugggaagagguaccauaccucggaaaacgggaggaccaauggugcggguccuuaaucggccucaccgccagagcaaccugggcgaccaauauucaaguagccauaaaucagguaaggaggcugaucgggaacgagaacuaccuagauuauaugacaagcaugaagagguucaagaacgaaucggacccggagggugcacuaugguga

SEQ ID NO: 23787 - RNA, 9879 nt, Artificial Sequence
  derived and/or modified CDS sequence (opt11) from DENV-1__KR028435__SS-prME
agcgugacuaugcugcucaugcugaugcccacagcccuggccuuccaccugacuacccggggcggugagccucacaugaucguguccaagcaggagcgggguaagucucuccuguucaaaaccuccgcaggggugaauaugugcaccuugaucgccauggaccugggcgagcuaugcgaagauacgaugaccuacaagugcccccguaucaccgaggccgagcccgacgacgucgacugcugguguaacgccaccgacacgugggugaccuacgggaccugcagccaaaccggcgagcaucgucgcgacaagcguuccguugcccuggcgccgcaugugggccugggccuggagacgcggaccgagacguggaugagcucggagggggccuggaagcagauccagagagucgagaccugggcccuccgccaccccggguucacgguaaucgcucuguuccuggcgcacgcaaucggcaccagcaucacccagaaggguauaaucuucauccuccugauguuggugacccccagcauggcgaugcguugcgucggcaucgguagucgcgacuucgucgaggggcucuccggggccacguggguggacguuguguuggagcacgggagcugugugaccaccauggccaaggacaagcccacccuggacaucgagcuccugaaaacggaggucaccaacccggcagugcuccguaagcucugcaucgaggcaaagaucuccaauacgaccacggacucgcgaugcccgacgcaaggugaggccacguugguugaagagcaagacgcuaacuucgucugccggcgcacauucguggaccggggaugggguaauggcugcgggcuguucggcaaggggucccucauaacgugcgcgaaguucaagugcgugacgaaacuugaagggaagaucguccaguacgaaaaccugaaguacagcgucaucguaacgguucauaccggcgaccagcaucagguggggaacgaguccacggagcacggcaccaccgccaccaucacaccccaggccccaacuaccgagauccagcuaaccgacuacggggcccugacccuugauugcucgccccgaacuggauuggacuucaaugaaaugguacugcugaccaugaaggagaaguccuggcucgugcacaagcagugguuccucgaucugccgcuacccuggacuagcggggccagcaccucccaggagacguggaaucggcaagaucuccugguaaccuucaagaccgcccacgcgaagaagcaggaagugguagugcucgggucgcaggagggcgccaugcacacugcccugacgggggccacagaaauccagaccucagguacuacaaccauuuucgccgggcaccugaagugccgccucaagauggacaaacugacccugaagggcaugagcuaugucaucugcaccggcuccuucaagcucgaaaaggaggucgcagagacacagcauggcaccguucugguccaaaucaaguacgagggcaccgacgcuccgugcaagauccccuuuucgacacaggaugagaagggggucacgcaaaacgggagacugauuaccgccaauccgaucgugaccgacaaggagaagcccgugaacaucgaggccgagccgcccuucggggagagcuacauaguuaucggcgcgggcgagaaggcacugaagcucagcugguucaaaaaggggucgagcaucggaaagauguucgaggccaccgcucgcggagcccggcgcauggcgauccuuggagacacggcaugggauuucggguccauuggcgggguguucaccagcgucggaaagcuggugcaccagaucuucggcaccgccuauggcgugcuuuucuccggcguaagcuggaccaugaagauugggaucggcguguugcugacguggcucggguuaaauucccgcagcaccucccugucgaugaccugcauagcagucgggcucgugacccuguaucuaggcguaaugguucaagccgacuccgggugcgucaucaacuggaagggucgugagcucaagugcggaagcggcaucuucgugacgaaugagguacacaccuggaccgaacaguacaaauuccaggcggacagcccgaagcgccuguccgccgccaucggcaaagccugggaggagggggucuguggaauccggagcgcaacccgucuggagaacaucauguggaagcagauuuccaacgagcucaaccacauucugcuggagaacgacaugaaguucacuguaguagucggagacguggcggggauccuggcccagggcaagaaaaugauccggccgcagcccauggagcacaaguacagcuggaaguccuggggcaaggccaagaucauaggcgccgaugugcagaacacgacguucaucaucgacgggccgaacaccccggagugccccgaugaccaacgugccuggaacaucugggagguagaggacuacggauucggaaucuucaccacgaacaucuggcugaaacugcgggacagcuauacccaggugugcgaucaccgccucaugucggcggccauaaaggacagcaaagccgugcacgccgacaugggguacuggauugagucggagaaaaacgagaccuggaaacuggcgcgggccucuuuuaucgaggucaaaacgugcaucuggcccaagucccacacucuguggagcaacggcgugcucgaguccgagaugauaauccccaaaaucuauggggguccgauuagccaacacaacuaccgccccggguauuucacccagaccgcuggccccuggcacuugggcaaacuggaauuggacuucgaucugugcgagggcacuaccguugucguugacgagcacuguggcaaccgugggccgucccugcgcaccaccaccgugacgggcaagaucauacacgaguggugcugccguaguugcacccugccgccccuccguuuccgcggugaggacgguuguugguacgggauggagauccgacccguaaaggagaaagaggaaaaucugguuaaguccauggugagugccggcagcggcgaggucgacuccuucagccucggccuccugugcaucuccaucaugauugaggagguaaugcggagccgcuggucccggaagauguugaugaccggcacccuggccguguucuuccuacuaaucauggggcaacugacuuggaacgaccugauccgccucugcaucaugguaggcgcgaacgccagcgaucgcauggggaugggaaccaccuaccuagcccugauggccaccuuuaagaugcggcccauguucgccguaggacuucucuuccggagguuaaccucccgcgaggugcuccugcugacaaucgggcucagccuggucgcguccguggagcugcccaacagccucgaggagcucggcgacgggcuggccauggguauaaugauccuaaagcugcugaccgacuuccagucccaccagcucugggccacccugcugucgcugacguucauuaagacuacuuucucccugcauuacgcauggaagaccauggcgaugguacucagcaucguuucccucuuccccuugugccugagcacuaccucucagaagaccaccugguugcccguuuugcuggggagccuagggugcaagccacugacgauguuccugauugcggagaacaagaucuggggccggaagucauggccgcucaacgaagggauaauggccgucggcauugugaguauccuguuauccucccuccugaagaacgacgugccccuggccgggccccucauugcuggcggcaugcugauagcguguuacguuaucagcgggaguagcgcugaccugucccucgaaaaggccgccgaggugagcugggaggaggaggccgagcacuccggcgcuagccacaacauccugguggagguacaggacgacgguaccaugaagaucaaggacgaggagcgcgaugacacucugaccauccuccugaaggccacucuacucgccaucuccggcguauacccgcuuaguauccccgcuacgcuguucgucugguacuucuggcagaagaagaaacagcggagugggguacucugggacacccccagcccacccgagguggagcgugcgguacuggacgacggcaucuaccggaucaugcagcgcggccugcuugggcggagccagguaggcguagggguauuucaggagaacgucuuucauaccauguggcacgugacccgcggcgcagugcucauguaccaggggaagcggcucgaacccagcugggcguccgucaagaaggaccugaucagcuacggcggcggguggcgccuccaggggaguuggaacacuggggaggagguccaggugaucgccguggagcccggcaagaacccaaagaaugugcagaccgcccccgggacguucaagacccccgagggcgaaguaggcgcaaucgcgcuggacuucaagcccgggacgucuggcucccccaucgucaaccgggaagggaagauugugggccuguacggcaauggggugguaaccaccagcggaaccuacguaagcgcaaucgcccaggccaaggccucccaggaggggccgcuuccagagauugaagacgagguguuccguaagcgcaacuugacgauuauggaccugcaccccggcucggggaaaacccgccguuaccucccggccaucguucgcgaggccauaaaacggaagcugcgaacccugauccucgcuccuacccgaguaguugccuccgagauggcggaggcccugaaggggaugcccauucgguaccagacgacggccgucaagagcgagcacacuggcaaggagauuguggaucuaaugugccacgcgaccuucacgaugcgccuccuguccccggugcgcguaccgaacuacaacaugauaaucauggaugaggcccacuucaccgacccaagcucaauugcggcccguggguacaucagcacccgggugggaaugggggaggcugccgccauuuucaugaccgcgacgccgccuggcuccguggaggccuucccacaaagcaacgccguaauccaggaugaggagggcggcauauccgagcgcucguggaacuccggcuaugaguggaucaccgacuuccccgggaagaccgugugguucgugccuucaaucaaguccggcaacgauauugccaacugccugcggaagaacgggaaacgcgucauccagcuuucgcggaagacauucgacaccgaguaccaaaagaccaaaaacaacgauugggacuacguggugacuaccgauauuuccgagaugggcgcgaacuuccgcgcggaccgggugaucgacccccgccggugucugaaaccggugauccuaaaggacgggcccgagcgcguuauccuggccgguccaaugccggucacgguggcuagcgccgcgcagcggcgcggccggaucgggcgcaaccacaacaaagagggugaccaauauaucuauaugggucaaccgcuuaauaacgacgaagaccacgcccacuggaccgaggccaaaaugcugcuagacaacaucaacaccccugaagggaucaucccugcacuguuugagccugagcgggaaaagagugccgccaucgacggggaguaccgccugcgcggugaggcgcgaaagaccuuuguggagcuaaugcgccggggcgaucucccgguguggcuguccuacaagguggcaagcgaaggguuccaguauuccgaccgacgguggugcuucgauggcgaacgcaacaaucagguccucgaggaaaacauggacguggagaucuggacgaaggagggggagcggaagaagcuacgaccccgguggcuagacgcccgcacauacagcgacccgcucgccuuacgugaguucaaagaguucgccgcuggccgccguuccgugaguggagaccugauccuagagauugggaagcugccacagcaccuaacccagcgcgcccaaaaugcccucgacaaccuuguuaugcuucacaacuccgagcagggcgggcgggcuuaccgccacgcaauggaggagcucccugacacgaucgagacgcugaugcuguuggcccugaucgccgugcuuacaggcggagugaccuuguucuuucugucgggccgcggcuuagggaagacuuccauaggccuacuaugcgucauggccagcuccgugcugcucuggauggcgagcguggagccccacuggaucgccgccuccauaauccuggaguucuuccugaugguacuucucauccccgagcccgaucgccaacgaaccccgcaggacaaccagcuggccuacguugugaucggguuauuauucaugauccugacgguugccgcgaacgagaugggccuccuggagaccaccaaaaaggaccuggggaucggacacguagcuguggagaaccaccaccacgcgacaaugcucgacgucgaccugcaucccgcaagcgccuggacgcuguaugcgguggccaccaccaucauuacacccaugaugcgccacacgaucgagaacaccacagcgaacaucucccuuaccgccauagccaaccaagcggccauccuuaugggcuuggacaagggguggccuaucagcaagauggacaucggcgugccgcuccuggcccuagggugcuacucccaaguaaauccccucacacugacagccgcgguucugaugcucguggcccauuacgccaucaucggacccggucugcaggcaaaggccacacgggaagcacagaagcgcaccgcugccggcaucaugaagaacccaacgguggacggcauaguggccaucgaccucgaccccgugguguacgacgccaaguuugaaaagcagcucgggcagaucaugcuccugauccucugcaccagccagauccugcugaugagaacuaccugggcgcuaugcgaguccauuacacuagccaccggcccccuuacaacccucugggaggggucuccuggcaaguucuggaacacgacuauugcgguguccauggcgaacaucuuccggggcagcuacuuagccggggcgggccuggcguucucucucaugaagucccucgggggcggacgccgugggaccggcgcccagggagaaacacugggagaaaaguggaagcgccaguuaaaccagcugucgaaguccgaguucaacacguacaagcggagcgggaucauggaaguggaccgcuccgaggccaaggagggccugaaacgcggagagaccaccaaacacgcggucagccgcgguaccgccaagcucagaugguucguggagcgcaaccuggucaagccggaaggcaaggucauugaccuggggugcgguagggggggaugguccuacuacugcgccgggcugaagaaaguaacggaggugaagggcuacacuaagggcggucccggccacgaggagcccauccccauggccaccuacggguggaaccucgucaaacuguacagcggcaaggacgucuucuucaucccgcccgagaagugugacacccugcucugcgacauaggagaguccagcccuaaucccacuaucgaggaaggucgcaccuuaagagugcuuaagaugguagaaccguggcuccgcggcaaccaguucugcaucaagauccugaaccccuacaugccauccguaguggagacccucgagcaaaugcagcggaagcacggcggcaugcucguccgcaaccccuugagccggaacuccacccaugagauguacugggucagcugcgggacuggcaacaucgucuccgcagucaacaugacgagccgcauguuacucaaucgguucaccauggcgcacaggaagccgaccuacgagcgcgauguggacuugggcgccgggacccggcacguagcugucgagcccgagguugcaaaccuagacaucaucggccagcggaucgagaacaucaagcacgaacacaaauccacguggcacuacgacgaggacaaccccuacaaaaccugggcguaccacgggagcuacgaggugaagccaaguggcagcgcgagcuccaugguuaacgguguggucaagcuccugaccaagccaugggacgugauccccaugguuacccagaucgcgaugacggacaccacccccuucgggcaacagcgaguguucaaggaaaagguggauacccgcacgcccaaggcgaagcguggcacagcccagaucauggagguaaccgcccgcuggcuguggggguuccucagccggaauaagaagccgcggauuugcacccgggaggaauuuacgaggaagguccgguccaacgcggccaucggcgccgucuucaucgacgagaaccaauggaacucggcaaaggaggcgguggaggaugagcgcuucugggaucugguccaccgggagcgugagcuucacaagcaagggaagugcgcgaccugcguauacaacaugaugggcaaacgggagaagaaacucggggaguuuggcaaagccaagggcucgcgcgccaucugguacauguggcugggggcccgguucuuagaguuugaggcucucggcuucaugaacgaagaucauugguucagccgggagaacucgcugagugggguggagggcgaggggcugcacaagcucggcuacauccugcgggauauuuccaaaauucccggagggaacauguacgcagacgacacagccggcugggacacccgcaucacggaagacgaccugcagaaugaagccaagaucaccgauaucauggaacccgagcacgcccuccuagcuaaggccaucuucaaguugaccuaccagaauaaaguuguacgugugcagcgcccugccaagaacgggacgguuauggacgugaucagccgccgagaccagcggggguccggccaaguggguacguacggccucaacaccuucaccaacauggaggcccagcuuauccggcagauggagucugaggggaucuucuccccgagcgaacuggaaacccccaaccucgccgagcgcguccuggacuggcuggagaaguacggcguggagcgucucaagcgcauggcgaucaguggggacgauugcguggucaaaccuaucgaugaccgauuugccacugcauuaaccgcccugaacgacauggguaaagugcgaaaggacauaccgcagugggaaccguccaagggguggaacgacuggcagcagguccccuucuguucccaccacuuccaucaacuaaucaugaaggaugggcgggagaucgucgugcccugccgcaaccaggacgagcugguggggcgggcacgcgucagccagggcgcgggcuggagccugcgggagaccgccuguuuggguaaguccuacgcacagauguggcagcugauguacuuccacaggcgggaucugcgccucgccgcgaaugccaucuguagcgccguuccgguggacuggguccccaccucccggacgacguggucaauccacgcgcaccaccaguggaugaccaccgaagacaugcugucgguguggaaccgcguguggauagaggaaaaucccuggauggaggauaagacgcacaucagcucuugggaggacguccccuaccuuggcaagcgggaggaucaguggugcggcucucucaucggccugaccgcccgcgcgaccugggccaccaacauccagguugcaaucaaccaagugcgccgguugauaggcaacgagaacuaccucgacuauaugacguccaugaagcguuuuaagaacgaaucagacccggagggugcccugugguga

SEQ ID NO: 23788 - RNA, 9879 nt, Artificial Sequence
  derived and/or modified CDS sequence (opt11) from DENV-1__JQ922548__SS-prME
ucugugaccaugcugcucaugcugcugcccacggcccucgccuuccaccucaccacccggggcggggagccgcacaugaucgugagcaaacaggagcggggcaaaagccuccuuuuuaagaccucugccgggguaaacaugugcacucugaucgcuauggaucugggcgagcucugugaggauacgaugaccuacaagugcccgcgaaucaccgaggccgagccggacgacguggacuguugguguaacgccacugacaccugggucaccuacgggaccugcagccagaccggcgagcaccggcgggacaaacggaguguggcccuugccccucacgugggccuggggcucgagacgcggaccgaaacauggaugagcuccgagggcgcguggcggcagauccaaaaggucgagaccugggcccugcgccacccgggcuucacggugaucgccuuguuucucgcgcacacaauagggaccucuaucacccagaaggggauaaucuucauucugcugauguuggugacgcccuccauggccaugcggugcgucggaaucggcaacagggacuucguggaggggcugucgggcgcgaccuggguggacguagugcuggaacacggcuccugugucaccacgauggcccggaacaaacccacucucgacaucgagcugcugaaaaccgaagucacuaaccccgcugugcucaggaagcugugcauagaagcgaagaucagcaacacaacgacagacucccgguguccgacgcagggcgaggccacccucgucgaggagcaggaugccaauuucgucugccgccgcacguuuguggaucgcggcugggggaacggcugcggucuguucggcaaggggagucuccuaaccugcgcaaaguucaagugcgucaccaagcuggagggcaagauaguccaguacgaaaaucugaaauacucuguaauagugaccguccacaccggcgaccagcaccagguggggaaugagacuacugagcacggcaccaucgccacaaucacgccccaggcgcccaugagcgagauccagcugaccgacuacggggcgcucacccuggacugcagcccgcggaccggccuggacuucaacgagaugguucuacugacgaugaaggaaaagagcuggcuagugcacaagcagugguuccucgaccugccccuucccuggaccucaggggccucaaccagccaggagaccuggaaccgccaggaccuccuggugacguucaagaccgcacaggccaagaagcaggaaguaguuguguugggcucucaggaaggcgcuaugcacacggcccucaccggggccacggagauccagaccagcggcaccaccacaauguucgccgggcauuugaagugccgacugaagauggacaagcucacccugaagggcgccucauacguaaugugcaccgggcccuucaaguuggagaaagagguggcggagacccaacacggaacggucuuaguccaggugaaguacgagggcaccgacgcccccuguaagaucccguucagcacccaagacgaaaagggggugacccagaauggccgccucaucacggccaaccccaucguaaccgacaaggagaagccugugaacaucgagacggagcccccguucggugagaguuacauugugaucggcgcgggagagaaggcgcugaagcugagcugguucaagaaggguuccucaaucgggaagauguucgaggcaaccgccaggggagcccgccgaauggccauccugggcgauacggcgugggacuucgggucuaucggcggcgccuucaccagcgucggaaaacuggugcaccagguuuucggcaccgccuacgguguccuauucucgggcguuagcuggacgaugaagauugggauaggcauccuccugacgugguuaggccucaacagccgcagcaccucacugagcaugaccugcaucgcaguggggauggucacccuauaucucggcgugauggugcaggccgacuccggguguguaauaaacuggaagggccgcgagcugaagugcgggucugggaucuucgugacaaaugaagugcacaccuggaccgagcaguacaaguuccaggcggacucccccaagcgccugucugccgccaucggcaaggccugggaagagggagucugcgguauccgcagcgccacccgucucgagaacaucauguggaagcaaaucuccaaugaguuaaaccacauccuacucgaaaacgacaugaaguucacugugguagucggugacgcgaacggaauccugacgcaggguaagaagaugauccgcccucagccuauggagcacaaguacagcuggaagaguuggggcaaagccaagauuauaggcgcggacgcccagaacacaaccuucaucauagacgguccggacaccccagagugccccgaugaccaacgagcguggaacaucugggagguagaagacuacggcuucggcaucuucacgaccaacaucuggcugaaguuacgcgacucguacacucaaaugugcgaccaccggcugaugucggccgccaucaaggacuccaaagccgugcacgccgacauggguuauuggaucgaguccgagaaaaacgaaacauggaaacugacgcgcgcgagcuucaucgaggucaagaccugcacguggccgcggucccacacacucuggagcaacggggugcuggagagugaaaugaucauaccaaagaucuacgggggccccauuagccaacacaauuaccgccccggguauuucacgcagaccgccggcccguggcacuuagggaaacucgagcuggacuucaaccugugcgagggaaccaccguggucguggacgaacacugcggaaacgggggcgccucgcucgggacgacaaccgugacuggcaagaucauccacgaauggugcugucggagcugcacgcuaccgccccugagguuccuaggcgaagacggcugcugguacggcauggagauccggcccgucaaggagaaggaggagaaccuguuccgcuccaugguaagcgccggauccggcgagguagacucauucagccugggucucuuaugcgucuccaucaugauagaggaggugaugcggucgcgcuggucccggaagaugcugaugaccggcacccuagcuguguucuuucugcucaucauggggcaacucacuuggaacgaccuuauccgcuugugcaucauggucggcgcgaacgcguccgacaggaucggcauggggacgaccuaucucgcccugauggccacguucaaaaugcgcccuauguucgccgugggccuccuguucagacggcugacuucucgcgaggugcuucuucuaacuauugggcugagccuggucgcguccguggagcuucccaacagccuggaggagcugggcgacggucuggccauggggaucaugaugcugaagcuccucaccgacuuccagucccaccaguuguggacgacacuccugagccugacguuuauuaaaaccacccugucccuggacuacgccuggaaaaccaucgcuauggugcugucgaucgugucccucuucccccugugucuuucuacuaccucccagaagacaacuuggcucccagugcuacugggcagcuucgguuccaaacccuuaaccauguuucugaucacugagaacaaaaucuggggccgcaagagcuggccccugaacgaggggaucauggcagucggcaucguguccaucuuacugagcagccugcccaaaaaugacguaccccucgccggaccccugaucgccggagggaugcugauugccugcuauguaaucuccgggagcucggccgaccucucacuggagcgggcggccgagguguccugggaggaggaggccgagcauucuggcgccucccacaacauacuggucgagguucaggaugacgguaauaugaagaucaaggaugaggaacgggacgauagccugacgaucuuacucaaggccacccugcuggcgguguccggaguguaccccaugagcauccccgccacccuguucgucugguacuucuggcagaagaagaagcaacgcuccggcgugcucugggacacgccgucaccucccgaagugguccgggccgugcuggaugacgggaucuaccgcauacugcagcggggacugcucggccgcucccaggugggggucgguguguuucaggacggcguguuucacacaauguggcacgucacccggggcgccgugcucauguaccaggggaagcgcuuggagcccagcugggcguccguuaagaaagaccucauaucguacggcgggggcuggcgguuccaggggucauggaauaccggcgaggagguucaggugaucgcgguggagcccggaaagaacccgaagaacguccagacgacgcccgggaccuucaagacacccgaaggcgaggugggagcuaucgcgcuagacuucaagcccggcacgagcggcucaccaaucgugaaccgcgaggggaagaucgucggucuguacggcaacgggguggugacgaccagcgggaccuaugucagcgccaucgcccaggcgaaggcuucucaggagggcccccugccugagaucgaggacgagguuuucaagaagcgcaaccugacgauuauggaccuccacccgggcagcgggaagacacgccgguacuugccggccaucgugagagaggccaucaaacggaaauuacgcacccugauccuugcgcccacccgcgucguggccuccgagauggccgaggccuugaaggggaugcccauacgauaccagacgacggccgucaagagcgagcacaccgggcgcgagaucgucgacuuaaugugccacgcgaacuucacgaugcggcuccuaucccccgugagagugcccaacuauaauaugaucaucauggacgaggcccacuucacggaccccgcgagcaucgccgcgcgggguuacaucagcacgcgcguagggaugggcgaagcagccgccaucuucaugaccgcuacgccgccgggcucgguggaggccuucccccaguccaacgcggugauccaagacgaggagcgugacauuccugaacguagcuggaacaguggguacgauuggaucacggacuuccccggcaaaacaguuugguucgugccgagcaucaagucugggaacgacauagccaacugucugcguaagaacgggaagcgcgugauacaguuaagccgaaagacauucgacaccgaguaccagaagacuaagaacaacgacugggacuacgucgugacgaccgacaucagugagaugggagcaaauagccgaaccgaccgcgugaucgaccccaggagaugccugaagcccgucauucuuaaggacggccccgagcgcgugauccucgccggcccgaugccggugacggcggccuccgccgcccagcggcgcgggcggaucggccguaaccagaacaaagaaggggaccaguacaucuauaugggucagccccuuaacaacgacgaggaucacgcccacuggacagaggcgaaaaugcuccucgauaauauaaacacccccgagggaaucaucccugcacucuucgagccagagagagaaaaguccgccgccaucgacggcgaguaccgucugaggggcgaggcccggaagacauucgucgagcucaugcgcaggggcgaucugcccguguggcuguccuacaaggucgcgagugagggcuuccaguacagcgacagaaggugguguuuugacggggagcgaaacaaucaggugcucgaggagaacauggacguggagaucuggacgaaagagggcgagcggaagaaguuacgcccccguuggcuggacgcccgcacauacagugacccgcucgccuugcgggaguucaaggaguucgcagcuggccgccggagcguguccggggaccugauucuugaaaucggcaagcugccccagcaccugaccuuacgcgcgcagaacgcccuggauaaccuggugaugcuccacaacagcgagcaaggcgggaaggcuuaucggcaugccauggaggagcugcccgacaccaucgaaacccugaugcuccuagcgcugauagccgugcucacaggcgguguuaccuuguucuuccuguccgggaaggggcucgggaagaccagcauaggucuguuaugcgugauggccuccagcguucuccuguggauggccuccguagagccacacuggaucgccgcgagcaucauacuugaguucuuccucaaggagcuccugauaccggacgccgacggccagcgcacgccucaggauaaccaacucgccuaugugguaaucggguugcuguucaugauucuuacgguagccgcgaacgagaugggccugcuggaaacuaccaagaaaaacuugggaaucgggcaugucgucgcagaaaaccaccaucacgccaccaugcuggacauagaccuucaccccgccuccgcauggacgcucuacgccgucgccacaaccaucauuaccccgaugaugcggcacacgaucgagaauaccacggccaacaucucucugaccgccauugccaaccaggcugcuauccugaugggccucgacaaggggcgccccaucuccaaaauggacaucggugugccccugcuggcccucgguugcuacagccagguuaaucccuugacgcugacugccgcuguccucaugcugguggcgcacuacgccaucauagguccaggccugcaggccaaggccacucgugaggcacaaaagagaaccgcggcugggcucaugaaaaacccgacaguggacggcauagccgcaauugaccuagaccccgucguuuacgacgccaaauucgagaaacagcucgggcagaucauguuauuaauccucugcacuucccagauccuccugaugcgcacaaccugggcgcugugugaauccaucacgcucgccaccgggccccuaaccacccugugggagggcuccccgggcaaguucuggaacacaaccauagccgugaguauggcgaacaucuuucgcggcuccuaccucgcgggggcgggccuggccuucagcuuaaugaagucccucggaggcggcagaagggguaccggcgcacaaggggaaaccuugggcgagaaguggaagcgucagcugaaccagcucaguaaaagcgaguucaacacauacaagcggucggggaucauggaggucgacagaagcgaggcaaaggagggccugaagcggggcgagacaaccaaacacgcggugucccgcgggacggccaagcugcggugguucguggaaaggaaucuggucaaacccgaggguaaggugaucgaccucggcugcggucgcgggggcuggagcuauuacugcgccggccugaagaaggucacggaagucaagggguauaccaagggcgggcccgggcacgaggagcccaucccgauggccaccuacggguggaaccuggugaagcugcacucagggaaggacgucuucuucacgccgcccgagaagugugauacccugcugugugauauuggcgagagcucccccaaucccacgaucgaggaggggcggacccuccguguacugaagaugguggaacccuggcugcgcggcaaccaguucugcaucaagauccugaaccccuauaugccaucagucgucgaaacccuggagcagaugcagcguaagcacgggggcauguuggugagaaacccucucucccggaacagcacccacgagauguacugggugaguugcgccacggggaacaucgugagcgcggugaauaugaccagucguaugcuguuaaaccgguuuacuauggcacaucgcaagcccaccuacgaacgcgacguggaucucggggccgggacucggcacguugccguggagccagagauugcgaaccuggacaucaucgggcagagaaucgagaauaucaagaacgagcacaagagcaccuggcauuaugacgaagauaaccccuacaagacgugggcguaccacggcacauaugaggucaaaccguccgggagcgccuccucgauggucaacggcguagugcgacuccucacgaagcccugggacgucauccccauggugacccagaucgccaugaccgacaccacgcccuuuggccagcagcgcguauucaaagaaaagguugacaccagaacgccccgccccaagcgagggaccgcccagaucauggaggugacggccagauggcuguggggguuucuuagccgaaacaagaagccccgcaucuguacccgggaggaguucacccgcaagguccgguccaaugcggccaucggggcuguguucguugacgagaaucaguggaacagcgcuaaggaagcggucgaggacgagcgcuucugggaucucgugcaucgcgaacgcgagcugcacaagcaaggcaagugcgcgacgugcguguacaauaugauggggaagagagagaagaaacuuggcgaguucggcaaggcgaagggcagcagggcgaucugguacauguggcucggagcccgguuccucgaguucgaagcguugggguucaugaacgaagaccacugguucagcagggaaaauucccucucaggcgucgagggugagggucugcauaagcugggcuacauccuccgcgacaucuccaagauuccagggggcaacauguacgcggacgacacggccgggugggacacgcgcauuaccgaagacgaccuucagaacgaggccaagaucacggacaucauggaacccgagcacgccuuacuggcgaccagcaucuucaagcuaaccuaccagaacaagguggugcgcguacaacggcccgccaaauccggcacagugauggacgugauuagccgccgcgaucagcgcggcuccgggcagguaggaaccuaugggcugaacacguucaccaacauggaggugcagcuuauccggcagauggaaagcgagggaaucuuuagcccgagcgaguuagaaaacaguaaccuggccgagcgcgcccucgacuggcuggagaagcaugggguggagaggcugaagcgcauggccauuagcggagacgacugcgucgugaagccgaccgacgaccgguucgccaccgcccucacggcguugaacgacaugggcaaagugcgcaaggacaucccccagugugaacccucuaagggguggaacgauuggcaacaaguccccuucugcagccaccauuuucaccagcugauaaugaaggacggcagggagaucguggugccgugccgcaaucaggaugagcucgucggccgugccagagugucacagggggcaggcuggagccuacgugagaccgcgugccugggcaaaucauaugcgcagauguggcagcucauguacuuccaccgccgggaccugcgccuggcggcuaacgcaauaugcuccgccgugcccgucaacugggugccaaccagccgaacgaccugguccauccacgcucaccaucaguggaugacgaccgaggacaugcucagcgucuggaaccgcguguggaucgaggagaaccccuggauggaagauaagacacacguguccagcugggccgacguccccuaccuaggcaaacgcgaggaccaguggugcgggucucugaucggccucgccgcccgggccaccugggccacgaacauccaggucgcccucaaccaggugcgucggcugauugguaaugaaaacuaccucgacuacaugaccucaaugaagcgcuucaagaacgaguccgacccagagggugcccugugguga

SEQ ID NO: 23789 - RNA, 9879 nt, Artificial Sequence
  derived and/or modified CDS sequence (opt11) from DENV-1__JQ922544__SS-prME
agcguuacuaugcuccucaugcuccugccuaccgcccuugcauuccaccugacaacccguggcggggaaccccauaugaucgugucgaagcaggaacggggcaagagccuccucuucaagaccuccgcaggggugaacaugugcacccugauugccauggaccugggcgagcucugcgaggacacgaugaccuacaaguguccccggauuaccgaggcagagcccgacgauguugacuguuggugcaacgccaccgacacauggguaaccuacgggaccugcucgcagaccggcgaacaccggagggacaagcggagcguggccuuggcgccccacgugggccuagggcuagagacgcgcaccgagacguggaugucaugcgagggcgccuggaagcagauucaaaaggucgagauaugggcccugcgucaccccggguucacggugauugcuuuauuucucgcgcaugccaucgggacuagcauuacccagaaagggaucauuuuuaucuuacucaugcuuguaacccccucgauggccaugcgcugcgucggcauaggcaaccgggaguucguugagggucucuccggagccacuugggucgacgucgugcuugagcacggcagcugccuccacacgauggcccagaauaagcccacccuggacaucgagcugcucaaaacggaggugaccaaucccgcuguccuucgcaaacuguguauagaggcgaagaucuccaacacgaccaccgacucgcguugccccacgcaaggagaggcaacgcucguggaagaacaagacgccaacuucguaugccgccggacauucgucgaccggggcugggggaacggcugcgggcuguuuggcaaggggucccugcugaccugcgcaaaguuuaagugcgugacuaaauuagagggaaagaucgugcaguacgagaaucugaaauauagcgucaucgugacgguacacaccggcgaccagcaccaggucgggaaugagacuacuacccauggcaccaucgcgacaaucacgccgcaagccccgacuuccgagauccaacucacggauuacggggccuugacucucgauuguuccccgcggaccggcuuagacuucaacgagauggugcugcugacgaugaaggagaagucgugguugguccacaaacagugguuccuggaccugccccuccccuggacuagcggggccuccaccagccaggagaccuggaaccgccaagaccugcuggugaccuucaagacagcccacgcgaagaagcaggagguggucgugcucggaucgcaggagggggccaugcauaccgcccugaccggggcaaccgagauucagacguccggcaccacuaccaucuucgccggucacuugaagugccggcucaagauggacaaauugacgcugaaagggaugagcuacgugaugugcaccggguccuucaaguuagagaaagaagucgcggagacccagcauggcaccgugcuugugcaggucaaguaugaaggcacagacgcacccugcaagauccccuucagcacccaggacgagaagggagugacccaaaauggccgacuuaucacagcgaacccgauagugacggacaaggagaagccugucaacauagaggccgagccacccuuuggggagucauacaucguagucggcgcgggcgagaaggcccugaagcucucgugguuuaagaagggguccuccaucggcaagauguucgaggcuacggccagaggggcgcgccggauggcaauccugggcgacacggccugggauuucggguccaucggaggggucuuuacuagcguggggaagcuggugcaccaggucuucggcacagcauaugggguucucuucuccgggguguccuggauaaugaagauugggaucggcaucuugcuaacguggcucgggcugaacucccgcagcaccuccuuaagcaugaccugcaucgccgucgguaugguaacgcucuaccugggcguuaugguccaggccgacagcgggugcgugauaaacuggaagggccgcgaacugaagugugggagcggcauuuuugugacaaaugaaguccacaccuggacagagcaguacaaguuccaggcggauagcccgaagagguuaagcgccgccaucggcaaggccugggaggaaggggucugcggcauacgcagugcgacucgacuggagaacaucauguggaagcaaaucagcaacgagcugaaccacauccugcuggagaacgacaugaaguucacaguugucgugggggacgcgaacgggauccuggcccaggggaagaagaugauccgaccccaacccauggagcacaaguacagcuggaagucguggggcaaggccaagaucaucggcgccgacauccagaacaccacuuucaucaucgaugggcccgauacaccggagugccccgacgaccagcgggcguggaacaucugggaaguagaggacuacggcuucgggauauucacuaccaacaucuggcuaaagcugcgcgacagcuacacgcagaugugcgaccacagguugauguccgccgccaucaaggacagcaaggccguucacgccgacaugggauacuggaucgagucugagaaaaacgagaccuggaagcucgcucgagccagcuucaucgaagugaaaaccugcaucuggcccaaaucacacacccuguggagcaauggcgugcuugagucggaaaugauuauucccaagauuuacggagggccgaucagccagcacaacuauagacccggguacuucacccagaccgccggccccuggcaccucggcaagcuggagcuggacuuugauuugugcgagggcacgaccgucguggucgaggaacacugcgggaaccgcgggccaucccuaaggaccaccacggucaccggcaagauuauacaugaguggugcugccggagcugcacacugccgccauugcgcuucaagggagaggacggcugcugguaugggauggagauaaggcccgugaaagagaaagaagagaaccuggugcguuccauggugucagccggaagcggcgagguggacagcuucagccucggguuauugugcguguccaucaugaucgaggaggucaugcgaagccguuggucucgcaagaugcugaugaccggaacgcucgccguguucuugcugcucaucauggggcagcucaccuggaacgaccugauccgacuaugcauaauggugggcgcgaacgcuucagaccgaauggguaugggcaccaccuaucuggcccugauggcuacguucaagaugcguccgauguucgcgguuggccuccuguuucgacgauugacuagccgugaggugcucuugcugaccaucgggcugagcuuaguggcgaguguagagcugcccaacagccucgaagaacugggcgaugggcuggccaugggcauuaugaugcucaagcugcugaccgacuuucagucgcaccaacucuggacuacccugcugagccucaccuucauaaagaccacgcugucgcuagacuacgccuggaagaccauggccaugguauuaagcaucguaucacucuucccucugugccucagcaccaccucccagaagacgacuugguugccgguauugcucggcagcuucgguugcaagccgcugacuauguuccucauuaccgagaacaaaaucuggggccgcaaguccuggccccucaacgaagggaucauggcggugggaauugucagcaucuuacugucgagccuccuaaagaaugaugugccccuggcagggccauuaaucgccggcggcaugcugaucaguuucuucgugaucuccgguagcucagccgaccuaucacucgagaaggccgcggaagucuccugggaggaggaggcggagcacagcgguaccucccacaacauucugguggaggugcaggacgacgggacgaugaagaucaaggacgaggagagggacgacacccugacuauccuucugaaggccacccuguuggcugucagcggcguguacccgauguccauaccagccacgcuguucguaugguauuucuggcaaaagaagaagcaaagaucugggguccuaugggacacucccaguccgcccgagguggagcgggcgguauuagacgacggcauauacaggaucuugcagcgggggcugcuggggcgcucccaggugggcguuggugucuuccaagauggcgucuuucacaccauguggcaugugacacgcggagccguguuaauguaccagggcaagcgucuggagcccuccugggccagcgucaagaaagacuugaucaguuacggcgguggcuggcgguuccaggggucguggaauacgggggaagaaguccaggugaucgccguggagcccgggaaaaaccccaagaacgugcaaaccacccccgguaccuucaagacgcccgaaggggaggugggggcgaucgcgcucgacuucaagccaggcacguccgggagccccaucgucaaccgcgagggcaagaucgucggccucuacgggaaugguguggugaccacaucggggacguacgugucggccauagcucaggcgaaagcuagccaagagggcccgcugccugagaucgaggacgagguauuccgcaagcgcaaccucacgaucauggacuuacacccagggagcggcaagacacggcgguaccugccugcgaucguccgggaggccauaaagcgaaaacuccguaccuuaauacuagccccgacgcgcguaguagccucagaaauggcggaggcccuuaagggcaugcccaucagauaucagacaaccgcggucaagucagaacacacagggcgugagauaguggaccugaugugccacgccacguucaccaugcgccugcucagccccgugcgagucccuaacuacaacaugaucauaauggacgaggcccacuuuacugaucccgccuccaucgcagcgcgcggcuacauaagcacccgggugggcaugggcgaggccgccgcgaucuucaugacagccacaccucccggguccguggaggcuuuuccucagagcaacgccgucauccaggaugaggagcgugacauccccgagcgauccuggaacaguggcuacgacuggaucaccgacuucccggguaagacagugugguucguccccucgaucaagagcgggaacgacauugcgaacugccugcgcaagaacggcaaacggguuauccagcugucccgcaagacguucgacacggaguaccagaagacaaagaauaacgacugggacuauguggugacuacggauaucagcgaaaugggggcgaacuuccgggcugaccgggucaucgacccgcggcgcugucucaagcccgugauccugaaggauggaccugaacgggugauucuggccgggcccaugccggucaccguggccuccgcggcccagcgccggggcagaaucggccgaaaucagaauaaggaaggggaucaguacgucaacaugggccagccccucaacaaugacgaggaucaugcccacuggaccgaggccaagaugcugcuggauaacaucaacaccccugagggcaucauccccgcacucuucgagccggaacgcaaaaagucagcggccguggacggggaauauagacugcgcggggaggcccgcaagacguucguggagcugaugcggcguggugaucuccccgucugguuguccuauaaggucgccagcgagggauuccaguauagcgacagacgcuggugcuucgacggggaacgaaacaaccaggugcuggaggagaacauggacguugaaaucuggacgaaggagcgcgagcggaagaagcuccgaccccgguggcuggacgcccgaaccuacagcgacccacucgcccuccgggaauuuaaggaguucgccgccggccgccgguccgucuccggggacuugauccuagagauaggaaagcucccgcagcaccugacccuucgugcccaaaaugcccucgacaaccuggugauguugcacaacucagagcagggcgggaaagcguaccggcacgccauggaggagcucccggacacuaucgagacccugaugcugcucgcccuuaucgccguccugaccggcggcguuacacuauucuucuuguccggcaagggccugggcaagaccaguaucggccuccugugcgugauggccagcagcgcacugcucuggauggccagcguagagccccacuggaucgcggccagcaucauccuggaguucuuccugauggugcuccugauccccgagccggaccggcagcgaacgccccaggacaaccagcuagcguacgucgucaucggucuccuauucaugauucucaccguugccgccaacgagaugggucuccuggagacgaccaagaaggaccucggcauuggacauguugcagcugaaaaccaccaccaugcgacgaugcucgacguagaccuucgccccgcauccgccuggacccuguacgccguggccaccaccauuauaaccccgaugaugaggcacaccaucgagaacaccacugccaauauuucucucacggcgauugccaaccaggcugccauccugaugggccuggacaaggguuggccaauuucccucauggauaucggcgugccccugcuagcgcucgggugcuacucccagguuaacccucugacccugacagccgccgugcucaugcugguggcccacuacgcgaucaucgguccggggcugcaggccaaggccacccgcgaggcucagaagcgcacagccgcggguaucaugaagaacccuaccguugacgggaucguugccaucgaccucgacccuguggucuacgacgccaaguucgaaaagcaguuaggccaaaucauguugcucauccugugcaccucccagauccugcucaugcggaccacuugggcccugugcgagagcaucacgcuggcuaccggcccccuaacuacacugugggaaggaaguccggguaaauucuggaacacgaccaucgcugucagcauggccaauaucuuccgcggguccuaccuggccggcgcaggccuugccuucagccugaugaagucccucggaggagggagacgcgggaccggugcgcagggcgagacgcuaggcgagaaguggaagcgacagcuuaaccagcuguccaaaucagaguucaacaucuacaagagauccgggaucauggaaguggaccggagcgaggcaaaggagggucugaagcgcggggagaccaccaagcacgccgucucccggggcacugccaagcugcguugguuugucgagcggaaccuggugaaaccagaaggaaaggugaucgaccugggcugcggcagagggggcuggagcuacuacugcgcggggcucaagaaggugacggaagugaagggcuacaccaagggcgggcccggccacgaggagcccauccccauggccaccuacggguggaaccuggucaagcugcacuccggaaaggacguguuuuucacaccacccgaaaagugcgacacacuccugugugacaucggugagucauccccuaacccgacgauagaggaaggccggacguuaaggguucucaagaugguugaacccuggcuccgggggaaccaguucugcauuaagauauugaaucccuacaugcccagcgugguggagacccucgagcagaugcagcgcaaacauggcggcaugcugguacggaauccccuuucacgcaacagcacgcacgaaauguacugggugucuuguggaacgggaaacauagugagcgcagugaauaugaccucccgaaugcuccugaaccgguucaccauggcccacaggaaaccuaccuacgagcgggacguggaccuuggggcgggcacgcgccaugucgcggucgagcccgaggucgccaaccuggacauuauuggccagcggaucgagaacaucaagaacgagcacaaaagcaccuggcacuacgacgaagacaaccccuacaaaacaugggccuaucacggguccuacgaggugaagccaagcggcuccgccagcucuauggucaauggggugguuaggcugcugacuaaacccugggacgugauucccauggugacacagaucgccaugaccgacaccaccccguucggccagcagcggguauucaaggagaagguggacacccgcaccccgcgggcgaagcgcgguaccgcccagauaauggaggugacagcuaaguggcucuggggcuuucugucccggaacaagaagccccgcauuugcacgcgggaggaguucacccgcaagguccggagcaacgccgccaugggugcgguguucguggacgagaaccaguggaacuccgccaaggaggccgucgaagacgagagauuuugggaccuggugcaccgggaacgcgagcuccacaaacaggguaaaugugcaaccugcguguacaacaugaugggcaagcgggagaagaaacugggggaguucgguaaagcaaaggggucacgcgccaucugguacauguggcuuggcgcccgguucuuagaguucgaagcccugggcuucaugaaugaagaccacugguucucccgcgagaacagccucuccggggucgaaggcgaggggcuucauaagcuggguuauauccugcgcgacaucagcaaaauucccggaggaaacauguacgcagacgacaccgcgggcugggacacgaggauaaccgaggacgaccuccagaacgaggccaagaucacggacauaauggagccggaacacgcgcugcuggcgaccuccauuuucaagcucacguaccagaacaagguagugcgcguccagcggcccgccaagagcggaacugugauggacgugaucucccgccgggaccagcgcggcagcggacaggugggcaccuacggccugaacaccuucacaaacauggaggugcaacugauccgccagauggaguccgaggggauuuucuuaccuagcgaacuugagacacccaaccucgcggagcgcgugcuggacugguuggagaaacacggagccgagcggcugaagcgcauggcaaucuccggggacgacugcguugugaagccgauugacgaucgguuugccacggcccucacagcacugaacgacaugggcaaggugaggaaggacauaccccagugggagcccagcaaaggguggaacgacuggcagcagguacccuucuguucccaccacuuccaccaacuuaucaugaaggacgggagagagauuguggugccgugccgcaaccaggacaagcucgucggacgggcacgugugucgcagggugccgguuggagucugcgggagacggccugccugggcaagagcuacgcacagauguggcagcucauguacuuccaccgcagagacuugaggcuggcggcaaacgccaucugcagcgcggugcccgucgacuggguccccacaucccggacgacguggagcauccacgcccaucaccaguggaugaccacagaggacaugcucucaguauggaacaaaguuuggaucgaagagaaucccuggauggaggacaagacccacguuagcuccugggaagacgugccguaccuggguaagagggaggaccaguggugcggaagccugaucggccucacugcccgcgccacaugggccacgaacauacaggucgcaauaaaccaaguaaggaggcuuaucggcaacgaaaacuaccuugacuacaugaccucaaugaaacgguucaagaacgagagcgaccccgagggggcguuaugguga

SEQ ID NO: 23790 - RNA, 9879 nt, Artificial Sequence
  derived and/or modified CDS sequence (opt11) from DENV-1__JQ922546__SS-prME
agcguggcuaugcugcuaauguugcuacccaccgcguuggccuuccaucucaccacccggggcggugaaccccacaugaucgugagcaagcaggaacggggaaagagccugcuguuuaagacguccgccgggguaaauaugugcacacugaucgcaauggaccucggggaauuaugugaggacacuaugacguacaaguggccccgaauaaccgaggcggaacccgacgacguggacugcuggugcaaugccacagacaccugggucacauacgggaccugcucgcagaccggcgaacaccggcgggacaagcgauccguggcucuggcaccccacguaggccugggguuggagacccggacggagacauggaugucaagcgaaggcgccuggaaacagauccagaaggucgaaaccugggcacugcggcaccccggguucaccgugaucgcccuuuuccucgcucacgccauuggcacaucuaucacgcagaaggggaucaucuuuauccugcuaaugcucguaacgcccucuauggccaugcguugugugggcaucgggaaccgggacuucgucgaaggguuaagcggcgccaccuggguggacguggugcuggagcaugguuccugcgugacaaccauggcaaagaacaagccuacucuggauauugaacucuugaagaccgaggucacaaaccccgcuguguuacgcaagcugugcaucgaggccaagauaucaaacacaaccacagacucccggugucccacgcagggcgaagccacacugguggaggagcaggaugccaacuucgucugccgccggacuuuuguggaccgcggcugggguaacggguguggcuuauucggcaaggggucucugcugaccugcgccaaguuuaaaugugugacgaagcucgagggcaagaucguccaguaugagaaccugaaauacucagugaucgugaccguccacaccggcgaccagcaucagguaggcaacgagacuaccgagcacgguaccaucgccaucaucacgccccaggcccccaccucggagauccaguugaccgauuacggggcucucacgcuggacugcagcccccgcaccggcuuagacuuuaacgagaugguccucuuaaccaugaaagagaagucguggcuaguccacaagcagugguuccucgacuuaccgcugcccuggacuuccggggccagcacgagccaggaaaccuggaacagacaggaccuccuagucaccuucaaaacugcacacgccaagaaacaagaggucguaguccugggcucacaggaaggcgcaaugcacacggccuuaaccggggcuacagagauccagaccuccggcaccaccaccaucuucgcggggcaucugaagugucguuuaaagauggacaagcucacccugaagggcauguccuauguuaugugcacggggagcuuuaaacuagagaaggaaguggccgagacccagcacgggaccgugcugguccaggugaaguaugaggggaccgacgcacccugcaagauucccuucuccauucaagaugaaaagggggugacacagaacggccggcucaucacagccaacccgaucgucaccgacaaggagaaacccgugaacaucgagacggagccgccuuuuggggagagcuacauuguagucggcgcuggcgagaaagcacugaagcuguccugguucaagaagggcagcuccauugggaagauguucgaggccacggcccgcggggcccgccgaauggccauucucggagacaccgccugggacuucgggagcauugggggcguguucaccucgguggggaagcuagugcaccagguguucggcaccgccuacgggguccuguucagcggcgucuccuggacgaugaagaucgggauaggaauccuccugaccuggcugggccucaacagccgcuccaccagccuguccaugaccugcaucgccgugggaaugguuacccuguaccucggcgugauggugcaggcugacagugguugcgugauaaacuggaagggacgcgaacugaagugcggguccggcaucuucgucaccaacgaaguccacaccuggacggagcaguacaaguuucaggcugacagccccaagaggcuaagcgccgcaaucggcaaggcaugggaggaggggguaugugguaucagaucagcaacgaggcucgagaacgucauguggaagcaaaucaguaacgaauuaaaccacauccuacuagaaaacgacaugaaguucaccgugguggugggagaugugaacgguauccuggcucaggggaagaagaugauucgcccccagcccauggagcacaaguacagcuggaagucauggggcaaagccaagaucaucggcgccgacauccagaacaccacguucaucauugacgggcccgauacaccggaaugcccagaugaccagcgcgccuggaacaucugggaaguugaggauuacggcuucgggaucuucacaaccaacaucuggcugaaacuucgagauuccuacacccaaguaugcgaucacaggcuuaugagcgcggccaucaaggacuccaaggcggugcacgccgacauggguuacuggauagaaagcgaaaagaacgagaccuggaagcuggcucgcgcguccuucauugaggucaaaacaugcaccuggcccaaaucgcacacccucugguccaacggcguccuggagucagagaugaucauucccaaaaucuacgggggcccuauaucccaacacaacuaccgucccggguauuucacccagacggcuggccccuggcaccuugggaaacuugaguuggacuuugaccuaugcgaagggacuaccgugguaguggacgagcacugcggcaaccgcggaccaagccuccggaccacgacugucaccggcaagauuauccaugaguggugcugccguaguugcacccugccgcccuuacgguucaagggagaagacgguuguugguacgggauggaaauccgccccgugaaagagaaggaagaaaaccucguacggagcaugguuuccgcaggcagcggcgagguagacagcuucaguuuaggucugcuuugcguaagcaucaugaucgaagagguaaugcgcuccagauggagccggaagaugcuaaugacgggcacguuggcuguguucuuucuccuaauuauggggcaguugacguggaacgaucucuuccggcugugcauaauggucggugccaacgcgucagaccgcauggggauggggaccacuuaucucgcccugauggccaccuucaagaugcgcccgauguucgccguagggcugcuguucagacgacucacaucgcgggagguccuacugcucaccaucgggcucucgcuuguggccagcguggagcugcccaauucgcuggaggaacucggcgauggguuagccaugggcauaaugaugcucaagcugcuaacggauuuccagagccaucaguuguggaccaccuugcucagccugaccuucaucaaaacgacuuugagccucgacuacgcauggaaaaccauggccaugguucuguccauugugucguugagcccgcuaugccugagcacuacgucccagaagaccaccuggcugccgguguugcugggcucauucgguugcaaaccccugacgauguuccucauuacggaaaauaagauuuggggccgcaaguccuggccccugaacgaggggaucauggccgucgguaucgugagcauccuacugagcucccuucucaaaaacgacgugccgcucgcgggaccgcugauagcuggcggcaugcugaucgcaugcuacguuaucagcggaucuagcgccgaccucagccuggagaaggccgcggaggugucgugggaggaggaggccgaacacucaggcgccagccacaacauccugguggagguccaggaugaugggaccaugaaaaucaaggacgaggagcgagacgauacacucacuauccugcugaaggcuucccuacuggccgucagcggcguguauccuaugagcauaccugcgacgcuguucgucugguacuucuggcagaagaagaagcaacgaucgggggugcucugggacacaccuagucccccugagguggaacgggccguacuggacgacgguauuuaccgcauacugcagcggggcuugcuagggcggagccaggugggcguugggaucuuccaggacggcgucuuccacaccauguggcaugugacacggggugccguccucauguaccaaggcaagcgccuggagcccuccugggccagugucaagaaagacuugauuuccuacggcggaggguggcgauuucaggggucuuggaacaccggagaagagguccaggugaucgccgucgagcccgggaagaaccccaagaacguccagacgacccccggaauuuuuaagacucccgaaggcgaagugggggcuaucacucuggacuucaagccagggacguccgggagucccaucgucaaccgcgagggcaagaucguaggccuguacgggaacggcguugucaccacgucggggacuuacguauccgccauugcgcaggcuaaggcaagccaggagggaccgcugcccgagauagaggacgagguguuucguaaacgcaaccugacgaucauggaccugcaccccgggagugggaagacccggcgcuaccucccggcgaucgucagggaggccaugaagcgcaagcugcggacucucauacucgcgccuacgcgcguuguagccagcgagauggcggaggcccugaagggcaugcccaucagguaccaaaccacugccgugaaauccgagcacacagggcgggagaucguggaccuuaugugucacgccaccuucacaaugagauuacugucccccgugcgggucccgaacuacaacaugaucauaauggacgaggcccacuucacugaccccgcguccauugccgcacgcggauacauaagcacucggguagggaugggcgaggccgcugcgauuuucaugaccgccaccccuccagguucaguggaggcauuuccgcagagcaacgccguuauccaggacgaggaacgagacaucccugagcggucuuggaacagcggcuacgacuggauaaccgacuuccccggcaagacagugugguucgugccuuccauaaagagcgggaacgacauagccaacugccugcggaagaacggcaagcgggucauucagcucucccgcaaaacuuuugauacggaauaccagaagaccaagaacaacgacugggacuacgucguaacaacagacauaucagagaugggggcgaacuuccgggccgaccgcgucauugacccgagacgaugccugaagccuguuauccugaaggagggccccgagcgugugauccuggccgggccuaugccggugacggucgccuccgcggcccagcgccggggccgcaucggccggaaccagaauaaggagggcgaccaguacguauacauggggcaacccuugaacaacgacgaagaccacgcccacuggaccgaagccaagaugcugcuagaccauauaaacacacccgaggggaucauccccgcacucuucgagccugagagggagaaauccgcggcgaucgacggcgaguaccgguuacgaggggaggcccguaagacguuuguugaacucaugcggcgcggugaccugcccguguggcugagcuacaaagucgcaagcgagggcuuccaguacaccgaccgccgauggugcuucgauggggagcggaacaaucaggugcucgaggagaacauggacguggagaucuggauggaggagggcgaaaagaagaaaauucgaccccggugguuagagaucgagaaauacucggaccccuuggcccuucgcgaguucaaagaguucuccgcuaagcgcaaaagcguccugggggacuuaaagcuggagaucggcaagcugccucagcaccugaccauaaaggcccgcaacgccuuagacaacuuggugaugcugcacaauagugagcagggcggcaaagccuaccggcacgccauggaggagcuccccgacaccauagagacccugaugagauuaggccucauagcagugaugaccggaggggucacccuguucuuccugucugggaaggggcuuggcaagacuuccaacgggcugcucugcgugauggcaagcucggugcucuuauggauggccuccgucgagccgcauuggaucgccgcauccauaauucuggaguucuuccucauggugcugcuuauucccgagccggauaggcagcggacgccccaggauaaccagcucgccuacguugucauugggcuacuuuucaugauucucacgguggccgcuaaugagaugggccugcuugaaacuaccaaaaaggaccucggaaucgggcacgugguggccgaaaaccaccaccacgcgacgaugcuggacguggaccugcaccccgccagcgccuggaccuuguacgccguggcuacgaccaucauaacgccgaugaugagacacaccaucgagaauacgacugccaacauuucacugacugccaucgcuaaccaagccgccauccugaugggccuugacaagggauggcccaucagcaagauggacaucggggucccccuacuggcauuaggcuguuacagccaggugaacccccugacccugacggccgccguguugaugcuggucgcccacuacgccaucaucggcccgggccugcaagcgaaggccacccgcgaggcccagaaacgcaccgcgccccagaucaugaagaaccagaucgucgacgggauaguugccgucgacuuagaucccgucgucuacgacgccaaauucgagaagcagcugggccaaauaaugcuacucauccugugcacuagccagaucuuacucaugcggacgaccugggcuuugugcgagucaaucacccuggccaccggaccccuuacuaccuugugggaggggagcccugggaaguucuggaauaccacuauugccguguccauggccaacauuuuucgggggagcuaccuggccggcgcgggccuggccuucucccucaugaagucccucgggggagggcgccgcgggaccggugcccagggcgaaacccuaggcgagaaguggaagcggcaguugaaccagcugaguaaguccgaguucaauaccuacaagaggucggggaucauggaaguggaccggagcgaggcaaaggaaggccucaagcgcggcgagacaacgaagcaugccgugagcagaggcaccgccaagcugcgcugguucgucgagcggaaucuggucaagccugaaggaaaggugaucgaccucggcuguggccgcgggggcugguccuacuauugcgccgggcugaagaaggucaccgaggugaagggcuacaccaaaggagggcccggucaugaggaaccaaucccgauggccacguacggcuggaaucuggugaagcugcacagcggcaaggacgucuucuucacaccgcccgagaagugcgacacgcuccuaugcgacaucggugaguccagccccaauccgaccaucgaagaaggucggacguuacgagugcucaaaaugguggagcccuggcugcgcgggaaccaguucuguauaaaaauccugaacccauacaugcccuccgucgucgagacccucgagcagaugcagcgcaagcacggcggaaugcuggugcggaauccucugagccgcaacuccacccacgagauguacugggucagcugugggacugggaacaucguguccgcggugaacaugaccagccggaugcuacugaaucgcuucacgauggcucaccggaaacccacguacgaacgcgacguugacuuaggagcugguacccggcacguggccgucgagcccgagguggcgaauuuggauaucaucggccagcgcaucgagaacauuaagaacgagcauaaauccacauggcacuacgacgaggauaaccccuauaaaaccugggccuaccacgggagcuaugagguuaagccguccgguagcgccuccagcauggucaacgggguggugcgccuucugacuaagcccugggaugucauccccaccgugacgcagauugcgaugacugacaccacccccuucggucagcagcgaguguucaaggagaaggucgauacccgcacaccgaaggcgaaacgggggacagcacagaucauggaagugaccgcaaauuggcuuuggggguuccugagccgcaauaagaagccccggaucugcacccgcgaagaguucacgcggaaggugcgauccaacgccgcuauuggagccguguuuguggacgagaaccaguggaacucugcgaaagaggcaguggaggacgagcgguucugggaccugguccaccgcgaacgggagcuucacaagcaggggaagugcgcgacaugcguguacaacaugaugggcaaaagggagaagaagcugggugaguucggcaaagccaagggguccagggccaucugguauauguggcuaggggcgcgcuucuuggaguucgaggcccugggcuucaugaacgaggaucacugguuuucgagggagaacucccugagcggaguggagggcgaggggcuccacaagcugggcuacauccugcgcgacaucucaaagaucccagggggcaauauguacgccgacgacaccgccgggugggacacucggauaacggaggacgaucugcaaaaugaggcgaagaucacggacaucauggagccagagcacgcucugcuagccacuagcaucuucaaguugaccuaucagaacaaagucguccgggugcagcgacccgccaaguccgggacuguuauggacguaauuucacgccgggaucagcgcggcuccgggcaggucggaaccuacggccugaacaccuucaccaacauggaaguccaguuaauccgucagauggagagcgaggggaucuuccuucccagcgagcuggagacgcccaaccuggccgagcgaguacugaauugguuggagaagcacgggguggagcgccugaaacggauggccauuuccggcgaugacugcguugugaagccgaccgacgacagauuugccaccgccuuaaccgcuuugaacgacaugggaaaggugcggaaggacacgccgcagugggagcccucgaaggguuggaacgauuggcagcaggucccauucuguucacaucauuuucaucaacugaucaugaaggacggccgcgagaucgugguaccuugccggaaucaggacgagcucgucggcagggcccgugugagccacggggcgggcuggagccugcgcgagaccgccugccugggcaagagcuacgcgcagauguggcagcugauguacuuccaccggagggaccugcggcuugccgccaacgccaucugcucggccguaccggucgauuggguaccaaccagcaggaccaccuggucgauccacgcccaccaucaguggaugaccaccgaggacauguugagcguguggaaccgggucuggaucgaggaaaauccguggauggaggacaagacucaugugucaaguugggaggacgugccguaucuggguaagcgagaggaccaguggugcgggagcauuaucggcuugaccgcccgggccacgugggcgaccaacauucaggucgccauuaaccagguccgccggcucauaggcaacgagaacuaccuggacuacaugacaagcaugaagcgcuuuaagaacgaguccgauccagagggggcccuaugguga

SEQ ID NO: 23791 - RNA, 9879 nt, Artificial Sequence
  derived and/or modified CDS sequence (opt11) from DENV-1__JQ922545__SS-prME
ucggugaccaugcuguuaaugcugcugccaaccgcauuggcauuccaccugacuacccggggaggggagccacacaugaucgucagcaagcaagagcggggcaagagccuacuguucaagaccucugcuggggugaacaugugcacccugauagcgauggacuugggcgagcuuugugaagacacaaugaccuauaagugcccccgcaucacggaagccgagcccgacgacguagauugcuggugcaacgcgaccgauacgugggugacauacgggaccugcucucaaaccggggaacaucggcgcgauaaacgaagcgucgcucuagcgccacacguuggccucgggcucgaaacgcguaccgagacuuggaugucaagcgagggggcguggcggcaaauccaaaaggucgagaccugggccuuacgccaccccggguucacggugaucgccuuguucuuagcgcauaccaucgguacuagcauuacccagaagggcaucauauuuauucuguugaugacuggggcccccaucauggccaugcggugcgugggcaucggcaaccgcgacuuuguggagggucucagcggcgcucccuggguggacguagucuuagaacacgggagcuguuuaaguaacauggcgaagaauaagccgacccuggacaucgacuucuuuaagacagaggucacuaaccccgcagugcugcgcaagcugugcaucgaggcuaaaaucagcaacacgaccacggauucccgcugccccacgcagggcgaggccacgcucguggaggaacaggaugccaauuucgugugucggcgcaccuucgucgaucgcggauggggcaacgggugcggccuguucgggaagggcucauuauuaacgugcgccaaguucaaaugcgucacgaaacuggagggcaagaucguccaguacgagaaucuaaaguacucugugaucgucaccguccauacgggggaccagcaccagguaggaaaugagacuacagagcacgggacgaucgcgaccaucacgccgcaagccccgaccagcgaaauccaacugaccgacuauggcgcucuaacguuagacuguuccccgcgcaccggacucgacuucaacgagauggucuuacugacaaugaaggagaaguccuggcucguucauaaacaaugguuccuagauuuacccuuaccuuggacauccggggccagcacgucgcaggagacguggaaucggcaagaccuucuugucaccuucaagacggcucacgcgaagaaacaggaggugguuguucucggcucacaggaaggggccaugcacacagcguugacaggugccaccgaaauccaaaugagcgggaccacuaccaucuuugccggccauuuaaagugucgccuuaagauggacaaguuaacguugaagggggugaguuacgucaugugcaccgguagcuucaagcucgagaaagaggucgcugagacgcagcaugguacuguccugguacaggucaaauaugaaggaacggacgcgcccugcaaaaucccguucuccacccaggaugagaaaggcgugacucagaacgggcgguugauaaccgccaaccccauugugacugacaaggagaagcccgucaacaucgagaccgagcccccguuuggcgaaagcuacauuguuaucggcgcgggggaaaaggcguugaagcucuccugguucaagaagggcagcuccauagggaagauguucgaggcgacggcccguggcgcgcggcgcauggccauccugggggacaccgcgugggacuucggcagcauuggcggugucuucaccucagucggaaaacucgugcaccagguguucggaaccgcguauggcgucuuguucagcgggguaucguggacaaugaagaucggaaucggcauucugcugacguggcucggguuaaacagcagauccaccagccuguccaugaccugcauagcggugggcaugguaacgcucuaccugggcgugauggugcaggccgacagcggcugugucaucaauuggaaagggcgggaauuaaagugcggcuccggcaucuucgugaccaacgaagugcacaccuggaccgaacaguauaaauuucaggcugacucuccgaagcgccugagcgcugccaucgguaaggcuugggaagaaggugucugcggcauacggagugccacgugccuagagaacaucauguggaagcaaauuucaaacgagcugaaucacauccuccucgagaacgacaugaaguuuaccgugguggucggcgacgccaacggaauccugacccagggcaagaagaugauacgcccccagccaauggaacacaaguacuccuggaaguccuggggcaaagcgaagaucaucggggccgacauccagaacacgacuuuuaucauugacggaccggauacuccagaauguccggaugaucagcgggcauggaacaucugggaaguggaggauuacggguucgguauauuuaccaccaacaucuggcucaagcuccgcgacuccuacacccaaaugugcgaucaccgguugaugagcgccgcgaucaaagacagcaaagcugugcacgcagacaugggcuacuggaucgagagcgagaagaacgagaccuggaagcuagcucgagcauccuucaucgaggucaagaccugcaucuggccccggagccacacccuuuggagcaacggggugcuugagagcgaaaugaucaucccgaaaaucuacggcgggcccaucucccagcacaacuaccgucccggcuauuucacccagaccgcugggccauggcaccucggcaagcuggagcuugacuucgaccucugcgaggggaccacgguggucguggaugagcacugcgggaaucgaggaccuagccugcgcacuacgaccgugaccggcaagaucauccacgaauggugcugccgaucgugcacccugccuccucugcgcuucaaaggagaggacggaugcugguacgguauggagauccguccugucaaggagaaggaggagaaccucgugcgcucaauggugucugccggcagcggggaaguugauucauuuucccugggacuccugugcguaagcauuaugaucgaagagguuaugcgcucccgcuggucccggaagaugcuaaugacgggcacguuggcugucuucuuuuugcugauaauggggcaacuuaccuggaaugaccugauacgucuguguauuauggugggggcgaacguguccgauaggaugggcauggguacaacguaccuagcccuuauggccaccuucaagaugcguccaauguucgcgguaggguuguuauucagacgucuuaccucgcgcgaggugcuccuccugacgauugggcugucccucguggccucugucgaauugccuaacagccuggaggagcucggggauggacuagccaugggcauuaugaugcugaagcuccuuacugacuuccagagccaccagcuguggaccacccuccucucccugaccuuuauuaaaacaacacucucccuggacuaugccuggaaaaccaucgcaaugguucuguccaucgugagccucuucccacugugccucuccacaacgagucagaagacaaccuggcucccgguucucuugggguccuucgggugcaagccucuuaccauguuucugaucacggagaacaagaucugggggcgaaaaucuuggccccucaacgagggcaucauggccgugggaaucgucucgauccuccugagcucacugcugaagaacgacgucccuuuagccggcccacugauugcgggcgggaugcucauugcaugcuacguuaucucagggucuucugccgaccugagccuggagaaagccgcagaggucuccugggaagaggaggcgcagcacucuggggcaucucacaacauccuuguggaaguacaagacgacggcacuaugaagauuaaggacgaggagcgggacgacacccugacaauauuacugaaagccacgcuccuggccgucagcgggguguaccccauguccauccccgcgacgcucuuugugugguauuucuggcagaagaaaaagcagaggucaggcguguuaugggauacccccucaccgcccgagguggagcgcgccguacuggacgacgguaucuaccgaauccuccagcgcgggcugcugggacggucccaggucgggguaggcguguuucaagacggugucuuucacaccauguggcaugugacccggggcgcgguguuaauguaccaaggcaagcggcucgagcccaguugggcuagcgucaagaaggaccugauuuccuacggcggcggguggagguuccagggcucguggaacaccggugaagagguccaagugauagcgguugagcccgguaaaaacccuaagaaugugcaaacgacccccggcacauuuaagacgcccgagggggaggugggcgccaucgcccuggauuucaagccagggacaucaggcagcccgaucguaaaccgcgaggggaagaucgugggucucuacggcaacggggugguuaccaccuccggcacguacgugucugcgaucgcccaggccaaagcuagccaagaggggccccucccugagauagaagacgaaguauucaaaaagaggaacuuaacaaucauggaccuccacccuggcucugggaagacccggcgcuaccugcccgccauaguccgggaggcgaucaagcgcaaacuucgcacccucauacuggccccgaccagagucgucgccucggaaauggccgaagcgcugaaggggaugccaauccgcuaccagacgacagcugucaaauccgagcacaccggcagagagaucguggaccucaugugccacgccaccuuuacuaugcgccugcugagcccgguuaggguuccaaacuacaauaugaucaucauggacgaagcacacuuuaccgacccugccucgaucgcagcuagagguuacauuagcacacgggugggcaugggggaggccgcagccauauucaugacagcgacgcccccaggaagcguagaggccuucccacaaagcaacgccgugauucaagacgaggagcgggacauuccagagcgguccuggaauagcggcuacgacuggaucacggacuucccagggaagacggugugguucgugccuuccaucaaauccggauccgacauagccacgguccucgagaggucacgcgaaccggugauccaauugucccgcaagacuuucgacaccgaguaccagaagacaaagaacaacgauugggauuacguggucacgaccgacauaagugagaugggcgcuaacuuccgggcagaccgcgugaucgacccccggagaugccugaagcccgugaucccuaaagacggcccagagcgggugauauuggccgggcccaugcccguaacggucgccuccgccgcccagcgccgaggccgaaucggcagaaaccaaaacaaagaaggggaccaauacauauacaugggccaaccgcuaaauaacgaugaagaccacgcccacuggaccgaggccaagaugcuguuggauaacauaaacacgcccgaagggaucauccccgcucuguucgagcccgagcgugaaaaaucagccgcgaucgacggggaguaucgccuuagaggggaggcgcgcaagacauucguggaacugaugcggcgcggagaccugccgguguggcugagcuacaaggucgcgagugagggcuuccaguacagcgacagacgauggugcuuugauggugaacggaacaaucaggugcucgaggaaaauauggacguggagaucuggacaaaggagggcgagaggaaaaagcugcggccccgcuggcuggacgcccguaccuacuccgauccgcuugcacugcgcgaguucaaagaguuugcggccggucgacgcagcgucagcggggaccucauccucgagaucgagaaacucccccagcaccucacgcuccgggcccagaacgcccuggacaaccugguuauguuacacaacagcgagcaaggcggaaaagcauaccgccacgcgauggaggagcugccagacaccaucgagacgcuaaugcuccuagcucugauagccgugcucaccggcggcgugaccuuauuuuuccuguccgggaagggucugggaaagacgagcaucggccuucugugcgugauggcauccagcgugcuccuguggauggcgucaguagagccgcacuggaucgcugccagcaucauccuggaguucauccucaugguccuacugaucccggagccggaccgacagcgcacgccucaggauaaccagcucgccuacgucguaauagggcugcuuuuuaugauccucacgguagcagcgaaugagaugggccugcuggaaacuacgaaaaaggaccuagggaucggccacguuguggcagagaaccaccaucacgcgaccaugcuggacaucgaucuucacccugccuccgccuggacccucuacgcuguggccacgacgauaaucacaccuaugaugcgucacacaauagagaacacgacggcuaacauaucucugaccgccaucgccaaccaggcugcaauacugaugggccuugacaagggcuggccgaucuccaagauggauauuggaguuccguuacuggcuuuaggguguuacucacaagucaauccacucacccuaaccgccgcggugcucaugcucguggcgcacuacgccaucaucgggcccgggcuacaagccaaggccacacgcgaggcgcagaaacggaccgccgcaggcaucaugaagaacccaaccgucgacggcauuguggccaucgaccuggacccuguugucuacgacgcuaaguucgaaaagcagcugggccaaaucaugcugcugauccugugcaccucccagauucuucucaugcgcacuacgugggcgcuuugugagagcaucacacuggccacgggcccucucacaacguuaugggagggauccccuggaaaauucuggaacaccaccaucgcagucagcauggcaaacauauucagaggguccuaccuagccggugcgggccucgccuuuagccugaugaaaucgcucgggggugggcguagagggacgggggcccaaggcgagacccucggugaaaaguggaagcggcaacugaaccagcuguccaaaucugaguucaacacguacaagcgcuccgggauaauggaaguggaccguucggaggccaaggaaggccuuaagcgcggcgaaaccacuaagcacgcugucucccggggcaccgcgaaacugcguugguucguggaacggaaccuuguuaagccagaggggaaggucaucgaccucggaugcgguagaggcggcugguccuacuauugugcgggccugaagaaagucaccgaagugaaggguuacaccaagggcgggccaggacacgaggagcccaucccgauggcuacguauggcuggaaucuaguaaaacuucacuccggaaaagacguguucuucacaccaccggagaaaugugacacccuacuuugugacaucggcgaaagcuccccgaaucccaccaucgaggagggccggacucugcgcgugcuaaagauggucgaaccauggcuucgggggaaccaguucugcauaaagauacugaaccccuauaugcccagcguuguggagacgcucgagcagaugcagcguaaacacgguggcaugcucgugaggaacccucucucccguaauagcacgcacgaaauguacuggguguccugugggacaggcaacaucgugagcgccgucaacaugacaucccggauguuacugaaucgcuucacgauggcgcaccggaaaccaacuuaugagagagacguggacuugggggcaggcacgcgccacguagcagucgagcccgagaucgcgaaccuugacaucaucggccaacguaucgagaacaucaagaucgggcauaaguccacguggcauuacgacgaagacaaccccuacaaaacgugggccuaccacggcuccuacgagguuaagcccucuggguccgcguccuccauggugaacggugucgugcggcuacugacgaagccgugggacguaauacccauggugacccagauagcgaugaccgacacgacccccuucggucagcagcggguuuucaaggaaaaggucgauacucgcaccccgcgacccaaacgcgguacggcccagauuauggagguuaccgccaaguggauguggggcuuccucuuccggaaccggccgccccgcauaugcaccagggacgaguucgcuagaaaggugagaucuucuaccgccaacggcgccgucuucgucgaugaaaaucaguggaacuccgccaaggaagccguggaagacgagcgguuuugggaccugguccaucgagagagagagcugcauaaacagggcaagugcgcgacaugcguguauaauaugauggggaagagagagaaaaagcuaggugaguucgggaaggcgaagggcagcagggccauuugguacauguggcugggcgcccgcuuccuggaguucgaagcauuggguuucaugaacgaggaccacugguucucccgggagaacagccuguccgggguggagggggaaggucuucacaagcucggguacauuuugcgcgacaucucaaagauaccgggcgggaacauguaugcggacgacaccgccgggugggacacccgcauuacggaggaugacucuagcaacgaggccaagauuaucgagcugaugcguccggagcacgcacuccuggccacguccaucuuuaagcugaccuuccagaucucaguugugcgcguccagcguccagccaagagcgguaccgucauggagugcaucagcaggcgggaccagaagcgcagcggacagguggggaccuacggccucaauacauucaccaacauggaggugcagcucauccgucagauggagagcgaagguaucuuuuccccgagcgagauggaaaacagcaaccuggccgaacgcgucuuagacuggcucgagaagcauggaguggagcgacugaaacgcauggccauaagcggggaugauugcgugguuaagccgacugacgaucgguucgcgaccgcucucacggcauugaacgacaugggaaagguccgcaaagacaucccccagugggagcccagcaagggguggaaugacuggcaacaggucccguucuguucccaccacuuccaccagcucaucaugaaagacgggcgggagauugugguucccugccguaaccaggacgaguuggugggccgggcccgcguaucacagggggcaggcuggagucugagggagacggccugcuugggcaaguccuacgcacagauguggcagcugauguacuuccaccgacgagaccugcgccuggcggccaacgccauaugcuccgccguuccuguagacugggugcccacgucgcggacgacuuggucuauccacgcccaucaccaauggaugaccaccgaggacaugcucagcguguggaaccgggucuggaucgaagagaaccccuggauggaggacaagacccacguuucaagcugggaggacgugccguacuuaggcaaacgcgaggaccaguggugugggucccuuaucggccuuaccgcacgggccacgugggccacgaacauccaaguagccaucaaccaaguccgccggcugaucggcaacgaaaacuaucuugauuauaugaccagcaugaagcguuucaagaacgaguccgacccagagggagcgcugugguag

SEQ ID NO: 23792 - RNA, 9879 nt, Artificial Sequence
  derived and/or modified CDS sequence (opt11) from DENV-1__GU131887__SS-prME
agcgugacuauguuacucaugcugaugcccaccgcgcuugccuuucaccuaacuacccgcggcggggagccccacaugauugugucgaaacaggaacgggguaagagcuugcuguucaagacaagcgccggggugaauaugugcacacucaucgccauggaccucggagagcugugcgaggacaccaugaccuacaagugcccccgcaucaccgaggccgagcccgacgacguggacuguuggugcaacgccaccgauacguggguuacauacgggaccugcucacaaacuggcgagcaccggcgcgacaagcgguccguugcgcucgcuccucacguuggucuggggcuggagacgcgcaccgagaccuggaugagcuccgagggcgccuggaagcagauacagcgggucgagaccugggcccuccgucacccgggguucacggugaucgcccuguuccuggcccacgccaucggaaccagcaucacccagaaggggaucauuuucauauuacugaugcuggucacgcccuccauggccaugagaugcgucggcaucggcagccgcgacuucguggaggggcuauccggcgccacguggguugacgucguacuggagcaugggagcugcgugacgacgauggccaaggauaagccuacccucgacaucgaacuccugaaaacggagguaacgaacccagcgauucuacggaagcucugcaucgaggcaaagaucuccaacacgaccacggacucccgcugccccacccaaggagaggcuacccugguggaggagcaggacgcgaacuucgucugccggcgcacguucguggaccguggcugggggaacggaugcggacuguucggcaaggggucucucauaacgugcgccaaauucaaaugcgugaccaagcuggagggcaagauagugcaguacgagaaccugaaauacuccguaaucgucacggugcacacaggcgaccagcaccagguagggaacgagucuacggagcacgggacaaccgcgacaauaacgccucaggcccccacgacugagauacagcucaccgauuacggggcccugacguuggacuguagcccccgcacgggccucgacuucaaugagaugguacugcugacuaugaaggagaagaguuggcucguccauaagcagugguuccuggaucugccccuccccuggaccagcggggccagcaccucccaagagacguggaaccggcaggaccugcuggugaccuucaagacagcccacgcaaagaagcaggagguugucguccucggcagccaggagggcgccaugcauaccgcccugacgggggccacggagauccaaaccagcggcaccacaacgaucuucgccgggcaccugaagugccgccuuaaaauggacaagcugacccugaagggcaugagcuacgugaugugcaccggguccuuuaagcucgagaaagagguggcggagacgcagcacggcaccguguuaguccagauccgguacgaaggcaccgacgcccccugcaagauuccuuucagcacccaagacgagcgcggggugacgcagaacggcaggcuaaucaccgccaacccgaucguuacggacaaagagaagcccgugaacaucgaagccgagccgcccuucggcgaguccuauauugucauuggcgccggggagaaggccuuaaagcucagcugguucaagaagggcuccagcauuggcaagauguucgaagccacugcgcgcggggcucgccggauggcgauccugggugacacggcaugggacuucgggaguauuggcggcguguuuaccagcguagggaagcugguccaccagaucuucggcaccgccuauggaguccucuuuuccggcguauccuggaccaugaagaucgggaucggcguccugcugacguggcuagggcugaauagucgcucuaccuccuuuucaaugaccugcauugcgguugggcuggucacccucuaccugggcgucauggugcaggcggauagcggcugcgugaucaacuggaagggacgggaacugaaaugugggucagguaucuucgucacgaacgaggugcacaccuggaccgagcaguacaaguuccaggcggacagcccuaagcgucucuccgccgcuaucggcaaggccugggaggagggggugugcggcauccggagcgccacccggcuggagaacaucauguggaagcagaucucgaacgaguuaaaccacauccuccuggaaaaugacaugaaguucacggucguggugggagauguggcggguauccuggcccaggggaagaagaugaucaggccccagcccauggaguacaaauacucuuggcgcuccuggggcaaggcuaagaucaucggcgccgacgugcagaacacgaccuucauaaucgacgggcccaacacaccugaaugccccgacgaccagcgggccuggaauaucugggagguugaagacuacggcuucggcauauuuaccaccaacaucuggcucaagcugagagacagcuacacccaagucugcgaccaccgccugauguccgccgccaucaaggacagcaaggccguccacgccgacaugggguauuggaucgaguccgagaagaaugagaccuggaaacuagcucgcgccagcuucaucgaggugaagacaugcauauggccaaagucucacacgcuguggagcaacggcguccuggagagugagaugaucaucccgaagaucuacggggguccuauaagccagcauaacuaccgacccggguacuuuacucagacggccggaccuuggcaucuggggaaguuagagcuggacuucgaucucugcgagggcaccacgguagucgucgacgagcacugcggcaaccgcgggccgagccugcggacaaccaccgugacuggcaaaaucauccacgagugguguugucgcagcugcacccugccgccccuccgguuccggggcgaggacggcugcugguacgggauggagauccgccccgugaaggagaaggaggaaaaccuagucaagaguauggucagcgccggcucgggggagguagauuccuucagccugggguuacugugcaucuccaucaugaucgaggaggugaugcgcagccguuggucccggaagaugcugaugaccggcacucucgccguguucuugcuccucaucauggggcaacugacguggaacgaccucaucaggcugugcaucauggucggcgcgaacgccagugaccggauggggaugggcacuaccuaccuggcccugauggcgaccuucaagaugcgaccgauguucgccguagggcuccuguuccggcgccuaacgucccgggaggugcuccuccucaccauaggguugucccuuguggcguccguagagcugcccaacagccucgaggagcuuggcgacgggcuggccaugggcaucaugauacucaagcugcugacagacuuccagucacaucagcucugggccacccugcugucacucacguuuaucaagaccaccuucucccuacacuaugccuggaagaccauggccaugguucugagcauugucucacuuuucccccugugccugagcacgaccucccagaagaccacauggcuccccgugcuacugggcucacucgggugcaagccccuaacgauguuccucaucgccgaaaacaagaucuggggucgaagauccuggccccucaacgaggguauaauggcggugggcauagucagcauucuguuaagcucccuucugaaaaaugacgugccguuagccgggccccucaucgccggcggcaugcugaucgccugcuacgugaucagcggauccagcgccgacuugagucucgagaaagcggccgaggucuccugggaagaagaggccgagcauaguggcgcgagccacaacauucugguggaggugcaggacgacgguaccaugaagaucaaggaugaggagcgcgacgacacgcugaccauccuccuaaaggcuaccuugcucgcaguaucgggugucuacccucugucuauucccgccacgcuguucgugugguacuucuggcagaagaagaagcagaggagugggguacuaugggacaccccuucuccaccagagguugagagggccgugcuagacgacggcaucuaccggaucaugcaacgcggccugcuggggcggucccaagucgggguugggguguuccaggagaacguauuccacaccauguggcacguaacacgcggcgcggugcuuauguaccagggaaagagacuugagcccagcugggccagugucaagaaggaucugaucucauacggcgguggguggcgccugcagggcuccuggaacacgggggaagaaguccaagugauagccgucgagccuggaaagaaccccaagaacguucagaccgcccccgggaccuucaaaacccccgagggcgaggugggcgccaucgcucuggacuucaagcccgguacaucaggcucccccaucgucaaccgcgaggggaagaucgugggguuguauggaaacgggguagucaccaccagcgggaccuacguguccgccaucgcacaggccaaggcuucccaggaagggccccucccugagaucgaggacgagguuuucagaaagcggaaccugacaaucauggaccugcacccuggcagcgggaagaccaggcgcuaccucccggccaucguccgcgaagccaucaagcgcaaguugcggacccugauccucgcgcccacccgcgugguggcuucggagauggcggaggcucugaagggaaugccaauccgauaucagacgacggccguuaagagcgaacacaccggcaaggagaucguggaccugaugugccacgccaccuucacgaugcgcuugcugucccccguucgcguuccgaacuacaacaugaucaucauggacgaagcgcacuucaccgaccccagcucgaucgcggcacgcggcuacauuaguacccgggugggcaugggugaggccgccgccaucuucaugacagcgacuccgcccggcuccguggaggccuucccgcagagcaacgccgucauccaggacgaggagagggacauacccgagagauccuggaacagcggguaugaguggauaaccgacuuucccggaaagaccgugugguucguccccuccaucaagagugggaacgauaucgccaacugcuuacguaagaacgggaagagagucauccaacucucccgcaagaccuucgacacggaguaccagaagaccaaaaacaacgacugggacuacguggugaccaccgacauuagcgagaugggcgcaaacuuucgggccgaccgcgucauagacccgcgucgcugccugaaacccguuauauugaaggacgggcccgaacgggugauucuugccgggcccaugccugucacgguggcuuccgccgcgcagcgccgagggcguaucggccgcaaccacaacaaggagggcgaccaauacauuuacauggggcaaccccugaauaacgacgaagaccaugcacauuggacagaggccaagaugcugcucgacaauauaaacaccccugaaggaaucaucccugccuuguucgagccugagcgggagaaguccgccgcgaucgauggagaguaccgccugcggggcgaagcccgcaaaacuuucguagaacucaugcggcgcggggaccugcccguguggcuguccuauaagguggccagugaggguuuucaauauagcgaccggcgcugguguuucgacggcgaacggaacaaccagguccuugaagaaaacauggacguggagaucuggacuaaggagggggagcguaaaaaguuacggccccgcuggcuugacgcccggaccuauuccgauccccucgcccugcgcgaguucaaggaguuugcggccgggcgcagaagcguguccggagaucugauccucgagaucggcaagcugccgcagcaccugacucagagagcccagaacgcacucgacaaccugguuaugcugcacaauagcgaacaaggcggccgggcguaccgacacgcgauggaagagcugcccgacaccaucgagacccugauguuauuggcccuuaucgccgcacuaaccggcggggugacccucuucuucuuauccggccgcggguuaggcaagacaucaaucggccucuuaugugugauggcguccagcgugcuucuauggauggccucgguggaaccgcacuggauagccgccaguaucauccuugaguucuuucugaugguguuacuuauccccgagccggaccggcaacggacgccccaagauaaccaguuagcuuacguuguuaucgggcuccuguucaugauucugacgguggcggcuaacgagaugggccuccuggagaccaccaagaaggaccuaggcaucgggcacgucgccgugggaaaucaccaucacgccgccaugcucgauguggaccugcaccccgcuuccgccuggacccuauacgccguggccacgaccauaaucaccccgaugaugcgccauacaaucgaaaacacgaccgccaacauaagccucaccgcgauagccaaucaggccgcuauucugaugggccuggacaaggguuggcccaucuccaagauggacauuggggugccgcuccuggcgcuugggugcuacagucagguuaauccguugacgcugaccgccgccguccugaugcucgucgcccauuaugccaucaucgggccgggccugcaggcgaaggccaccagggaggcccagaagaggacugccgccgguaucaugaagaaccccaccguggacggcaucguggcgauagaccuugaccccgugguauaugacgccaaguucgagaaacagcucggccagauuaugcugcuaauccuuugcacgucccagaucuuacugaugcggaccaccugggccuuaugugagagcaucacccuggccaccgggccauuaaccacacucugggagggcucgccggguaaguucuggaauacgaccauugccgucagcauggcgaacaucuuccgcggcuccuaucuggccggcgcugggcucgcguucagccucaugaagucccuagguggggggcggcgcggcaccggugcgcaaggcgagacacugggcgagaaauggaagcggcagcugaaccagcuguccaagucagaguucaauaccuauaagagguccggcaucauggagguggaccggagugaggcuaaggaaggcuuaaagcgcggugagaucacgaaacacgcagugucccgggggacugccaagcuccgcugguucgucgagcggaaucuggucaagcccgagggcaaggugaucgaccuggguugcggacgcggcggguggagcuacuacugcgcaggccugaagaagguuaccgagguaaaaggauacaccaagggcggcccagggcacgaggagccaaucccgauggcgacguacggcuggaacuuagugaaacugcacuccgggaaggacgucuucuucgucccgccggagaaaugcgacacguuacuuugcgacaucggagagucgucccccaacccgacgauagaggagggccggacccugcgcgugcucaaaauggucgaacccuggcuccggggcaaccaguucugcaucaagauucugaaccccuacaugcccagcgugguggagacgcucgaacagaugcagcgcaagcacggcgggaugcucgugagaaacccgcucagucgaaacagcacccacgagauguauuggguguccuguggcaccgggaacaucgugagcgcugucaacaugaccuccagaaugcugcucaaucgauucaccauggcucacagaaagccuacguacgagcgggacguggaccugggagcuggcacucgccacguggccgucgagcccgagguggccaaccuggacaucaucggucagcggaucgagaacaucaagcacgagcacaagagcaccuggcacuaugacgaagacaacccguacaagacgugggccuaccacggguccuacgaggugaagccgagcgggagugccagcaguauggucaacggggugguaaagcuccuaacgaaacccugggaugugauccccaugguaacccagaucgccaugaccgacacaacgccuuucgggcagcagagggucuucaaggagaagguggauaccaggaccccgaaagccaagcgcggaacggcgcagaucauggaggucacggcuaaguggcuguggggcuuccuaucucggaacaagaagccccgcauauguacccgggaggaguuuaccagaaagguccgaucuaacgccgcgaucggagcgguguuuguagacgagaaccaguggaacuccgccaaggaggccgucgaagacgagcgcuucugggaucuggugcaccgggaacgcgagcugcauaaacaggguaaaugugcuaccugcguauacaacaugauggguaagcgggagaagaagcugggcgaguuugggaaggccaaggggagccgcgcgauuugguacauguggcugggcgcccgguuccuagaauucgaagccuuaggguucaugaacgaggaucauugguucuccagggagaacagucuguccgguguggaaggggaaggccuucacaagcucggguacauccugcgcgacauuagcaagauccccggcggcaacauguacgcggacgauacggccggaugggacacccggauuaccgaggaugaccugcaaaacgaggcccgcaucaccgauaucauggagccggagcaugcccuccuggccaaguccaucuucaagcucacuuaucagaauaagguggugcggguccagcgccccgccaagaacggcacaguaauggacgugauuagccggcgcgaccagcggggguccggccaggucggcaccuacggucuaaacaccuucacgaacauggaggcucagcuaauccgccagauggagagcgagggcauauucucccccagcgaguuggagacccccaaccucgcggagcggguacuggacuggcuggagaaguacgggguggagcgccucaagcggauggccaucuccggcgaugacuguguugugaaaccaaucgaugaccgcuuugccaccgcgcucaccgcccuuaacgauaugggcaagguccggaaggacaucccccagugggagcccagcaaggguuggaacgacuggcagcagguccccuucuguucccaccacuuccaccagcucauuaugaaagacggucgcgagaucguaguaccgugccgaaaucaagaugaacugguugggcgcgcgcgggucagccagggcgccgguuggagccugcgugagacggccugccucggcaaguccuacgcccagauguggcagcugauguacuuccaccggcgcgauuugcgucucgcggccaacgccaucugcagcgcaguucccgucgauuggauccccaccucuagaaccaccuggagcauccacgcccaccaccaguggaugacgacagaagacaugcugucgguguggaaucggguuuggaucgaggagaaccccuggauggaagacaagacccacaucagcuccuggggggacgucccguaccugggcaagcgggaagaucaguggugcggcagcuuaaucgggcugaccgcgagggccacgugggccaccaacauccagguggccauaaaccaggugcggcgccuaaucggcaacgagaauuaccucgacuacaugaccuccaugaagcgguucaagaacgaaagcgaccccgaaggagcccugugguga

SEQ ID NO: 23793 - RNA, 9879 nt, Artificial Sequence
  derived and/or modified CDS sequence (opt11) from DENV-1__GU131888__SS-prME
agcgucaccaugcugcucaugcugaugcccaccgcccuggccuuccacuuaaccacccggggcggggaaccgcacaugauaguuagcaagcaggagcgggguaagucucugcuguuuaagaccagcgcgggggugaacaugugcacccucaucgccauggaccugggugaacugugcgaggacacaaugacguacaagugcccccgaaucaccgaggccgagcccgaugauguggacugcuggugcaaugccaccgauaccugggugaccuaugggacauguagccagaccggcgagcaccggcgcgacaagcgguccgucgcccucgcgccacacgugggcuuggggcuggaaacgcgcaccgagaccuggaugagcuccgaguccgccuggaagcagauacaacgggucgagaccugggcccuccggcacccuggcuucacugugaucgcccuguuccuggcgcacgcgauagggaccuccauuacccagaagggcaucaucuucauacuucuaaugcugguuacccccagcauggccaugcggugcgucggcaucggcagccgcgacuucgucgagggccucucgggcgccacguggguugacgucguucuggagcacggcuccugugugaccacgauggccaaggacaagcccacucuagacaucgagcuccugaaaacggaagugaccaaucccgcgauacugcggaaacucugcaucgaggccaagauuagcaacaccaccacggauuccagaugccccacgcagggggaggccacccugguggaggagcaggacgcaaauuucgugugccggcgcaccuucgucgacaggggcuggggcaacgggugcggccuauucgggaagggcagccucaucacgugugccaaguucaagugcgugaccaagcuggaggggaaaaucgugcaauacgaaaacuugaaguacagugucaucgugaccgugcacaccggcgaccagcaccagguuggcaaugagagcacggagcacgggaccacugcaaccaucacgccgcaggcccccacgaccgagauccaguugaccgacuauggcgcccugacccuggauugcagcccccggacggggcuagacuuuaacgagauggugcugcugacuaugaaggagaaaucauggcucguccacaagcagugguuucuggaccugccgcuucccuggacuagcggcgcguccaccucucaggaaacuuggaaccggcaggaccugcugguuacuuucaagaccgcccacgcgaagaagcaggaggugguagugcucgggucccaggagggcgccaugcacaccgccuuaacaggcgccaccgagauacagacaagcgggacuacgaccaucuucgccggccaccugaaguguaggcucaagauggacaagcugacccugaaggggauguccuacguuaugugcaccggcuccuucaagcucgagaaggaggucgcggagacgcagcaugggaccgugcuggugcagaucaaguacgagggcaccgacgcccccugcaagaucccuuuccugacccaagacgagaagggcguuacgcagaacgggcggcugaucaccgccaacccgaucguaacggacaaggagaagcccguaaacaucgaggccgagccacccuucggcgaguccuacauugucaucggggcuggcgaaaaggcccucaagcugucgugguuuaagaaagguuccagcaucgggaagauguucgaggccaccgcccgcggcgcgcggcgcauggcgaucuugggggacacagggugggacuucggauccauaggcggcguguucaccagcguggguaagcucguccaccagaucuuuggcaccgccuauggagugcuuuucuccggcgucucuuggaccaugaagaucggaaucggcguauugcuuacguggcugggcuugaauucccgcagcaccucacucagcaugaccuguauagcuguggggcuggugacccuguacuuaggcgucaugguacaggcggauuccggcugcgucaucaacuggaagggccgggagcugaagugcgggucaggcaucuucgucacgaaugaggugcacacuuggaccgagcaguacaaguuccaggcugacagcccgaaacgccuguccgcggccaucggcaaggccugggaggagggggugugcggaauccggucugccacccgccucgaaaacaucauguggaaacagauauccaacgaacugaaccauaucuuacucgagaacgauaugaaguucaccgucguggucggggacgucgccgguauccuggcgcaggggaagaagaugauccggccccagcccauggaguauaaguacagcuggaaauccugggguaaggccaagaucaucggcgccgacguccagaacacaaccuucauaaucgacggucccaauaccccggagugccccgacgaucagcgggcuuggaauaucugggaaguggaggacuacggcuucgggaucuuuacaacgaacaucugguuaaagcuccgggauagcuacacccaggucugcgaccaccgccuuauguccgcugccauaaaggacagcaaggccgugcacgccgacaugggcuacuggauugaguccgagaagaacgagacauggaagcuggcccgggcgagcuucaucgaggugaagacgugcaucuggccaaagucccacacucucuggucaaacggcguccuggaguccgaaaugaucauccccaagauauacgggggcccgauaagccagcacaauuaccgccccggauacuucacacagaccgcuggcccuuggcaccuggggaagcucgaacuggacuucgaccuaugugagggcaccacggugguuguagacgagcacugcggaaaccgggggccgagucuccgcaccaccaccgugacgggcaagaucauacacgaguggugcuguagaagcugcacccuaccgccccugcgguuucgcggggaggacggcugcugguacgggauggagauccgccccgugaaagagaaggaagaaaaccucgucaaguccauggugagcgccggcagcggcgagguggacuccuuuagccuggggcugcucugcaucuccaucaugaucgaggaggucaugcggucucgcuggucccguaagaugcucaugaccggaacacuggccguguuccuccuucugaucauggggcaacucacguggaacgaccugauacgccugugcauuauggugggcgcgaacgcgagcgaccgcaugggcaugggaaccaccuaccucgcccugauggcaaccuucaagaugcgaccgauguucgccguagggcuccuguuccgccgucugacgucccgggaggugcugcuccugaccaucgggcugagcuugguggccuccguagagcuacccaacagccuugaggaguugggcgacgggcuggcaaugggcaucaugauccugaagcuccugaccgacuuucagucccaccagcugugggccacccuccugagucugacuuucaucaagaccaccuuuucccuccacuacgccuggaagaccauggcaauggugcugagcaucgucucccuguucccccuuugccugagcacuaccucacagaaaaccaccuggcugcccgugcuccuuggcagccuugggugcaagccacucacgauguuccugaucgcggagaacaagaucugggguagaagauccuggccccuaaacgaggggauuauggccgugggcaucgugagcauccuccugagcucgcuccucaagaacgacgugcccuuggcugggccccucaucgccggcggcaugcucaucgccugcuauguuaucagcggguccagcgcggaccugucucuggagaaggcagccgaagucagcugggaggaggaggccgagcacaguggggccagccacaacauccucguggaggugcaagacgacgggccgaugaaaaucaaggaugaggagcgggacgacacgcugaccaucuugcucaaggcgacccuccuggccgucuccggcguauacccccucagcaucccugccacccuguuugugugguacuucuggcagaagaaaaaacagcgcuccgggguccugugggacacgccuagcccgcccgagguggagcgugccgugcuugacgacggcaucuaccgcaucaugcagcggggccuacuggggcgcucgcaggugggcgucgguguguuccaggagaacgucuuccacaccauguggcacgugacccgaggugccgugcugauguaccagggcaagcgccucgagcccagcugggcgucagucaagaaggaccugaucagcuauggcggaggcuggcggcugcagggcuccuggaacaccggggaggagguccagguuauugccgucgagcccggcaaaaacccgaagaacgugcagacggcccccgggaccuuuaaaacccccgagggcgaggugggcgccaucgccuuagauuucaagccggggaccagcggguccccgaucgucaaccgagaagggaagauagugggccuguacgguaacggggugguuacgacaagugggaccuacguaagcgcgaucgcccaggccaaggccucacaagagggcccccugcccgagaucgaggacgagguguuccggaagagaaaccucaccaucauggaucugcauccaggcagcgggaagacgcggcgauaccugcccgccauuguacgggaggccaucaagcgcaaacuccgcacgcugauccuggcccccacccgggugguagcgagugagauggccgaggcguugaagggcaugccuauccgcuaccagaccacggccgucaagagcgagcacacugguaaggagaucguggaccugaugugucacgccaccuucaccaugcggcugcucucaccggugcgcguccccaacuacaacaugaucaucauggacgaggcccauuucacggaccccucguccauagccgcgcggggguacaucagcacccgcgugggcaugggcgaagccgcagccauuuuuaugaccgccacgccgcccggcuccguggaggcuuucccucagagcaacgcccugauccaggacgaagagcgggacauccccgaacgcuccuggaacucgggguaugaguggaucacggauuuccccggcaagacgguaugguuugugcccuccauuaagagcggcaacgacaucgccaacugucugcgaaagaacgggaaacgagugauccagcucucgagaaagaccuucgacaccgaguaccagaaaacgaagaacaacgacugggacuacgucgugacaaccgacaucagcgagaugggcgccaacuuccgcgcggaccgggugauugacccgcgacguugccugaagccagucauacuaaaggaugggccugagagggugauucucgccgguccgaugcccgugaccguugccuccgccgcccagcggcgagggcggaucggccgcaaccacaacaaagagggcgaccaguacauuuacauggggcagccccugaacaacgacgaggaucacgcgcauuggaccgaggccaaaaugcugcucgauaacaucaacaccccagaaggcaucaucccggcccuguuugagcccgaacgcgagaaguccgccgccauugacggggaguaccggcugcgcggcgaagcgcggaagaccuucguggagcucaugagacgcggggaccugccagucuggcuuaguuacaaaguagccagcgagggcuuccaguacucagaccgccggugguguuucgacggcgagcgaaacaaccagguucucgaggagaacauggacguugagaucuggaccaaggagggggagcggaagaagcugcgcccccgauggcuggacgcccgcacguacuccgacccgcuggcccuacgggaguucaaggaguucgccgcgggccgccguucggugucaggggacuugauacucgaaaucgguaagcugccccagcaccugacacaaagagcccagaacgcccucgacaaccuggugaugcugcacaacagcgagcagggcgggcgggccuaccggcaugcgauggaggagcuccccgauaccaucgagacccugaugcugcucgcccugaucgccguccugacgggcggggugacgcucuucuuccuguccggcagggggcugggcaaaaccagcauugggcuccuguguguuauggccuccucaguccugcucuggauggccucgguggagccccauuggaucgcggccagcaucauccuggaauuuuuccugaugguguuacucaucccugagccggaccgccagcggacgccccaggacaaccagcuggcauacgucgugaucgggcuguuguucaugauccugaccguggccgccaaugagaugggcuuacucgagacgaccaagaaggaccuggggauaggccacgucgcaguggggaaccaccaccaugccgccaugcucgacguggacuugcacccggccuccgccuggacccuguacgcggucgccaccacgauaaucacccccaugaugcgccacaccaucgagaauaccacggccaacaucagccucacagcaaucgcaaaccaggcggcuauucugaugggccuggauaagggguggcccaucuccaagauggacauaggaguccccuugcuggcucugggcuguuacagccaggugaacccgcucacccugaccgcagccguucugaugcucguggcgcacuaugccaucaucgggccaggccugcaggcuaaggccacgagggaggcccagaagcguacagccgccggcaucaugaagaaucccaccguggacggaaucgucgccaucgaccuggaccccgugguguacgacgccaaguucgaaaagcagcucggccagaucaugcugcugauccucugcaccucccagauccugcugaugcgcacgaccugggcccucugcgaaaguaucacucuggccacugggccccugacgacccucugggagggcucccccggcaaguucuggaacaccacuaucgccgucagcauggccaauaucuuccggggaucuuaucuggccggggcaggguuagcuuucucguugaugaagagucuggguggcggccgccgggggacgggcgcccaaggagagacucugggggagaaauggaagcggcaacucaaccagcuguccaagagugaguuuaacacguacaagcggaguggcaucauggagguugaccgcagcgaggcuaaggaggggcugaagcggggagagaccacgaagcaugcggugucccgggggaccgccaagcuucggugguucgucgagcgcaacuugguuaagcccgagggcaaggugauugaucugggcugcgggagaggcgguuggagcuacuacugcgccggucugaaaaagguaaccgaggugaagggguacaccaagggcggaccugggcaugaggagccuaucccuauggccacguacggcuggaaccucgugaaauugcacuccgggaaagacgucuucuucaucccgccggagaagugcgacacucugcucugugacaucggcgagagcucuccgaaccccaccauugaagaggggcgcacccugcggguccugaagaugguggagccguggcuccgugguaaucaguuuugcauuaagauccugaaccccuacaugcccagcgucguggagacccucgagcagaugcagcgaaagcacggcgggaugcucgugcgcaauccucucucccggaacagcacucacgagauguacugggucuccugcggcaccgguaacauagugagcgccgugaacaugaccuccagaauguuacucaaccgguucaccauggcacaccggaaacccacguacgagagagacguugaccugggcgccgguacgcggcacguugccguggagcccgaggucgccaaccuggacaucaucgggcagcgcauugagaacauaaagcacgagcacaagagcaccuggcacuacgacgaggacaacccauacaagaccugggccuaccacggcuccuacgaggugaaaccaagcggguccgcgagcagcaugguaaacggcgucgugaagcuccugacgaagccuugggacgucauccccaugguaacccagauugccaugaccgacacaacgccguucggacagcagcggguuuucaaggagaaggucgauacccgaacccccaaggccaagcggggcaccgcccagaucauggaggugacggcuaaguggcugugggguuuccucucgcgcaacaagaagcccaggaucuguacccgcgaggaguucacccgaaaagugcguagcaacgcggccaucggugccgucuucguggacgagaaccaguggaauuccgccaaggaggcugucgaggacgagagguucugggaucugguucaccgagaacgggagcugcauaagcaggggaagugcgcuaccugcguguacaauaugauggggaagcgcgaaaagaagcucggcgaguucgggaaggccaagggcagcagagccaucugguacauguggcugggcgcgcgcuuccuugaauucgaggcgcucgguuucaugaacgaagaccacugguucucccgggaaaacagucuguccggcguggagggggagggccuacauaagcucggguacauccugcgcgacaucaguaagauuccgggaggcaauauguacgccgacgauacggcagggugggacacccgcaucaccgaggacgaccugcagaacgaggcucgcaucacggacaucauggagcccgagcacgcccucuuagcgaaguccaucuucaaguugaccuaccagaacaaggucgugagggugcagcggcccgccaagaacggcaccgucauggacgugaucucccgcagggaccagcgugguucuggccaggugggcaccuacgggcucaauacguucacuaauauggaggcccagcugauccggcagauggaguccgagggcaucuucucucccagcgaguuggagacccccaacuuggcggagcgcguccuggacugguuggagaaguacgggguggagaggcugaagcgaauggccaucuccggcgacgauugcguggucaagcccaucgacgacagauuugcgaccgccuugaccgcgcucaacgacauggggaaggugcgcaaggauauaccacagugggagccaaguaagggcuggaacgacuggcagcagguaccguucuguagucaccacuuccaccagcucaucaugaaggacggccgggagaucgucguccccugccgcaaccaggacgagcuggugggccgggcccgcgucagccagggcgccggguggagccuacgggagacggcaugccugggcaaguccuacgcccagauguggcaacugauguacuuccaucgacgcgaccugcgcuuggccgcaaacgcgaucugcagcgccgugcccguagacuggauccccaccucccggaccacauggagcauccacgcgcaccaccaguggaugacgaccgaggacaugcuaucugucuggaaccgcguguggaucgaggaaaacccguggauggaggacaagacccacaucagcuccuggggggacgugcccuaccugggcaagagagaggaccaguggugcggcagccucaucggacugaccgcccgagccacgugggcgaccaacauccagguggcuaucaaccaagugcggcggcugaucggcaacgagaacuaucuugacuacaugaccuccaugaaacgcuucaagaacgagucggaccccgagggggcccugugguga

SEQ ID NO: 23794 - RNA, 9879 nt, Artificial Sequence
  derived and/or modified CDS sequence (opt11) from DENV-1__GU131892__SS-prME
ucagugaccaugcugcuuaugcugaugcccaccgcacuggcuuuccaccuuacuacccgcggcggagaaccccauaugaucgugagcaagcaagaaaggggcaagagccugcuguuuaagaccuccgcgggugugaauaugugcaccuugaucgccauggaccucggcgagcugugcgaggauacuaugaccuacaagugcccccggaucaccgaagcugagcccgacgacguggacugcuggugcaacgcaacggacacuugggugaccuacgggacuuguagccaaaccggcgagcaccggcgcgacaaacgauccguggcccucgcuccccauguuggccuugggcuugagacgcggacggaaaccuggaugagcucugagggugccuggaagcagauacagcgcguggagacuugggcucucaggcaccccgguuucacggugaucgcccucuucuuagcgcacgcaauuggcaccagcaucacucagaaggguauuaucuucauccugcugaugcuaguaacccccucaauggccaugcggugcgugggaauagggagccgugacuuuguggagggauuaagcggagcaaccuggguugacgucgugcuggagcacgggucuugcgugacgacgauggccaaggauaagcccacccuggacaucgagcuacugaagacagaggucaccaaccccgccauccugcggaagcugugcaucgaagcaaagaucaguaacaccaccacggacagccgcuguccgacccagggugaggcgacccugguggaggagcaagacgccaacuucgugugccggcgcacauuugucgaccggggaugggggaacggcugcggucuguucgguaagggaucccuuaucaccugcgccaaauucaaaugugugaccaagcucgagggcaagauagugcaguacgaaaaccugaaguauagcgucaucgugacagugcacacgggugaccagcaccaaguagggaaugaauccaccgaacaugguaccacagcgacaaucacuccccaagccccaacgacggagauccagcucaccgacuauggggcgcugacccuugacugcaguccccguacgggucuagauuucaacgagauggugcuacugaccaugaaggagaagucuuggcucguucauaagcaaugguuuuuagacuuaccacuccccuggaccucgggggccucuaccucccaggagacguggaaccgccaggaccugcuggugaccuucaaaaccgcgcacgcgaaaaagcaagaggugguggugcuggggagccaggagggggccaugcauacugcccuuacgggggccacggagauccaaaccuccggcacgacgaccaucuucgccgggcauuugaagugccgucucaagauggacaagcugacacugaagggcaugagcuacguuauguguacaggauccuucaagcucgagaaggagguagcggagacgcagcacggcacuguacuagugcagaucaaguacgaggggacagaugcgcccuguaagauacccuuuucuacccaggacgagaaggguguaacgcagaacgggagacugauuaccgccaacccgaucgugaccgacaaggagaagccugugaauauugaagccgagccucccuucggggaauccuacaucguaaucggagcgggcgagaaggcauuaaagcucuccugguucaagaaaggguccagcaucgggaagauguucgaggcaaccgcccgcggggccaggcguauggcgauccugggggacacagccugggacuuuggcucgaucggcggcguguucaccuccgugggcaagcugguccaccagaucuucggcaccgcguacggggucuuauucucuggggugucauggacgaugaaaauuggcauuggcguauuacugacguggcuuggucuaaauagccgcagcaccagccuuagcaugaccugcaucgccguugggcucgugacccuguaccucggcgucauggugcaggccgacuccggcugcgugaucaauuggaagggccgggagcucaaaugcgggagcggcauauucguuacgaacgaggugcacacuuggaccgagcaguacaaguuccaggcggacucaccgaagcgccuguccgccgccaucggcaaagccugggaggaggggguauguggcauaagaagcgccacccggcuggagaacaucauguggaagcagaucaguaacgagcuaaaccacauccuccuagagaacgauaugaaguucaccgucguggucggagacgucgcgggaauucuagugcaggggaagaagaugaucaggccccagcccauggaguacaaguacagcuggaagucguggggcaaggccaaaauaaucggcgccgacgugcaaaauacgacguucaucaucgaugggccgaacaccccugagugcccugacgaccaacgcgccuggaauaucugggagguggaagacuacggcuucgggaucuucaccaccaacaucuggcucaaauuacgggacucauacacgcaggugugcgaccacagguuaauguccgcugccaucaaggacagcaaggccguucacgccgacaugggcuacuggaucgaguccgagaagaacgagaccuggaagcuggcgcgggccucuuucauugaagucaaaacaugcaucuggcccaagucccauacgcuuuggucgaauggcgugcuggaguccgagaugaucauacccaagauauauggggguccgauuucgcagcacaacuaucgccccggguauuucacccagacugcaggccccuggcacuuggggaagcuggagcucgacuucgaucugugcgaaggcacuacagucgucgucgacgaacacugcggaaaucgggggccgucccugagaaccaccaccgugacgggaaaaauaauucacgaguggugcugccgguccuguacccugccgccccuccgcuuuaggggagaggacggcugcugguacgggauggagauacgcccagucaaggaaaaggaggagaaccugguuaagucuauggucagcgccggguccggggaggucgacuccuuuucuuuaggucuguugugcaucuccaucaugaucgaagaggugaugcgcagucgcuggucccggaagaugcucaugacgggcacccucgccguguuccugcuguugauuauggggcaacuaaccuggaacgaucucauuagguuaugcaucauggucggcgccaacgcaagcgaccgcaugggcaugggcaccacguaccuggcgcucauggcuaccuucaagaugcggccgauguucgcuguggggcuacuguuucggcgccugacgagccgcgaggugcugcugcuuacaaucggguugagucuggucgccaguguggagcuccccaacucacuggaagagcuaggcgacgggcuugcgauggggaucaugauccugaagcuguugaccgacuuucaaucacaucagcuuugggccacccuacucucauuaacuuuuaucaagaccacauucuccuuacacuacgccuggaagacuauggccaugguucucagcaucguuucccuguucccccuaugccucucaacgaccagccagaagaccacguggcugccagugcugcucggcucacuggggugcaagccgcuuacgauguuccucauugcggaaaauaagauuuggggucgacgcagcuggccccugaaugaggggauuauggccgucgggaucgugagcauccugcucagcucccugcugaaaaacgacgugcccuuggccgggccauugaucgccgggggcaugcugaucgccugcuacgucauuucugggucaagcgcggaccucucacuagagaaagcugccgaggugagcugggaggaagaggccgagcacucuggcgccucccacaacauccugguggaggugcaggaugaugggaccaugaagauuaaggacgaggaaagagacgacacccuuaccauccugcugaaggcgacacuuuuagcgguauccggcguguacccgcugagcauacccgccacacucuucgugugguacuucuggcagaagaagaagcagagauccggggugcucugggacaccccgaguccgccagaaguggagcgggccguccucgacgaugguauuuaccgcaucaugcaacggggccuacuggggcgcucccaggugggagugggggucuuucaagagaacguuuuccacaccauguggcaugugacacggggcgccguucugauguaucaggggaagcgccuggagccuagcugggcauccgugaaaaaggaccucaucucuuacggugguggguggcggcuacagggcuccuggaacacgggagaggaagugcaggucaucgccgucgaacccggcaagaacccaaaaaaugugcagacugcuccaggaaccuucaaaacgcccgaaggagaggugggcgccauugcccuggacuucaaaccuggaacgagcggcucucccaucgugaaccgcgaagggaaaaucguaggccuuuauggcaacgggguagugaccaccucgggcacauacgugagcgcgaucgcgcaggccaaggccucgcaggaggggccgcugcccgagauagaggaugaggucuuccggaagcgcaacuuaacaaucauggaucugcacccuggcucugggaagacccggcgcuaccuaccggcgaucgugcgggaggcaauaaaacgcaaguugcgcacucugauccuggcuccaacuaggguggucgccuccgagauggccgaggcgcugaagggaaugccgauccgcuaccagacgaccgccgucaaaagcgagcacacaggaaaggagaucguggaucucaugugccaugccaccuucacgaugagacugcugucaccgguccggguuccgaacuacaacaugaucaucauggaugaagcacacuucacagaccccagcucgaucgccgcgcggggguacaucagcacacgugucgggaugggggaggccgcagccaucuucaugaccgcaacgccccccggcagugucgaggcauucccgcagagcaacgcagugauccaggaugaggaaagggacaucccagagcgcucauggaauucgggguacgaguggaucacagauuucccaggcaagaccgucugguucguucccuccaucaagucuggaaaugacaucgcgaacugcuuacguaagaacgggaagcgcgugauacagcugucacggaagacguucgacacggaguaccagaagacaaagaauaacgacugggacuacguggucaccaccgacaucucagaaaugggcgccaacuuccgcgcggaccgugugaucgacccgcgccggugccugaagccagugauccucaaagaugggccugagagaguuauucucgcaggcccgaugccgguuacgguugcuuccgccgcgcagcggcgcgggaggauuggccgcaaucacaauaaggagggcgaucaguacauauacauggggcagccgcugaauaaugaugaggaccaugcccacuggaccgaagccaagaugcuccuggacaacaucaacaccccggagggcauuauccccgcccuguucgaaccggagcgcgaaaagagcgcggccauagacggcgaguaccggcuccgcggcgaggcgcggaagaccuucguggaauugaugcgccgcggugaccugcccguguggcugucauacaaagucgcuagcgagggcuuccaguacagcgaccgccgguggugcuucgacggagagcgcaacaaccagguguuggaggagaauauggacguggagaucuggacgaaggagggggagcggaagaagcuucgcccccgguggcuggaugccagaaccuacuccgacccccucgcacuacgggaauucaaagaguucgcggcgggccgccggagcgucuccggggacuugaucuuagaaauaggcaagcuaccccaacaccucacccaacgcgcccagaacgcauuagacaaccuggugaugcuucacaacagcgagcaggggggacgggcuuaucgccacgcgauggaggagcugcccgacaccauugagacgcucaugcuacuugcucugaucgccguguuaacuggcggggucacgcuauucuuucugagcgggcggggacucggcaagaccaguauuggccugcugugcgugauggccagcagcguacuccuguggauggcuagcgucgagccccauuggaucgcggccagcauaauccuggaauucuuccucaugguguuguuaauuccggagccggaccgucaacggacgccacaggacaaccagcuugcuuacgucgucauugggcugcuguucaugauccucacaguggcagccaacgagaugggucuucuggagaccacgaaaaaagaccuagggauuggccacguggccgucggaaaccaccaccacgccgcgauguuagacgucgaccugcauccggccucggccuggaccuuauacgccguggccacaacuaucauuaccccuaugaugagacauaccaucgagaauacaaccgcgaacaucagccuaaccgccaucgccaaccaggcggcaauccugaugggccucgauaagggcuggcccaucucuaaaauggacaucggggucccccugcucgcacucggaugcuacagccaaguaaacccccugacucugacagcugcggugcucaugcuggucgcacacuacgccauaauagggccgggccuccaagccaaggccacccgcgaggcacagaagcggaccgcggccgguaucaugaaaaacccuacuguugaugggaucguggccauugaucuugacccggucguguaugaugcuaaauucgagaagcaacugggccagauaaugcugcucaucuuguguacgucucagauccuguuaaugaggacuaccugggcuuugugugaaucaaucaccuuggcgacgggaccccucaccacccugugggagggcaguccgggaaaauucuggaacacaacgauagccguauccauggccaacaucuuucgggguaguuacuuggcaggcgcggggcucgcuuuuagccuaaugaagucgcuaggugggggcagacgggguaccggagcacagggcgagacccucggcgagaaguggaagcgccagcugaaccagcuuaguaaaagcgaguucaacaccuacaagcgguccggcaucauggagguugacagaagcgaagccaaggagggccucaaacgaggcgagaccaccaagcacgcggugucccgcgggaccgccaagcucagaugguuuguggagcgcaacuuggugaagccugagggcaaagugauagaccugggcugugggcggggaggcuggagcuacuacugugcgggccucaagaaggugacagaggugaaggguuacacgaaaggcggacccgggcaugaagagcccauucccauggcaacguacggguggaaccuggugaaacugcauucggggaaggauguauucuucaucccacccgaaaagugcgauacgcuguuaugcgacaucggcgaaagcucacccaauccgaccauugaggagggccgcacgcugcgcgucuugaagaugguggagcccuggcugaggggcaaccaguucugcauuaagauucuuaaucccuacaugcccagcgugguggagacccuugagcagaugcaacggaagcacgguggcaugcuggugcgcaacccgcugucccgcaacuccacccacgagauguacuggguguccugcggcaccgggaacaucgucagugcagugaauaugaccucgcgaaugcuacugaaccgcuucacgauggcucaucggaaacccacauaugagcgugaugucgaccugggcgccggcacgcggcacguagccguagagccagagguagccaauuuagauauuauugggcaacgaaucgagaacaucaagcacgagcacaagagcaccuggcacuacgacgaagacaauccuuauaagacgugggccuaucacggcuccuacgaagucaagccguccggguccgccagcagcauggucaacggcgucguuaaacuccugacuaaaccuugggacgugaucccaauggucacccagaucgccaugacagacacgaccccauuugggcagcagagaguuuuuaaggagaagguggacacccgcacuccgaaggcaaaacggggcacagcccagaucauggaggucaccgccaaguggcucuggggcuuccuguccaggaacaagaagccacguaucuguaccagggaggaguucacuaggaaggugcgcucaaacgcggcuaucggugcaguuuucgucgaugaaaaccaguggaacuccgcaaaggaagcgguggaagaugagcgguuuugggaccuggugcaccgcgagcgugaacugcacaagcagggcaagugcgccacuugugucuacaacaugauggggaaacgcgaaaagaaguugggcgaguuugggaaggccaaaggcucgcgggcaaucugguacauguggcuuggugcccgcuuccucgaguuugaggcgcugggauucaugaacgaggaucacugguucagucgggagaauagcuuguccgguguggagggggagggccuacacaaacugggguacauccugagggauaucagcaaaaucccgggaggcaauauguacgccgacgacaccgcuggaugggacacucgaaucacugaggacgaccuucagaacgaagcccgcaucacggacauaauggagccggagcacgcccugcuggcgaagucuaucuucaagcucaccuaucaaaacaagguggucagggugcagcggcccgccaagaacggaaccgugauggacgucauuagccgcagagaccagcgcgggagcgggcaggucggcacguauggccucaauacuuucacaaacauggaggcccagcugaucaggcagauggagagugaggggauuuuuucccccucggaacucgagacccccaaccuggcagaacgcguauuggauugguuagagaaauacggggucgagcggcugaagaggauggcaauuucuggcgacgacugcgucgugaagccgaucgaugacagauucgcgaccgcacugacagcauuaaacgacauggggaaaguacggaaggauauaccccagugggagccaagcaaaggguggaaugacuggcagcaggucccuuucugcucccaccauuuucaccaguuaaucaugaaggacggccgggaaaucguggucccaugccguaaucaggacgaacuggugggccgggcccgaguaagccaaggcgccggguggagccugcgggagaccgcaugccugggcaaguccuacgcccagauguggcaguugauguacuuucaccgcagggaccuccgccuggcugccaaugccaucuguagcgccguucccguggauuggauucccaccucccggaccaccuggaguauccaugcgcaccaccaauggaugaccacugaggacaugcuguccguguggaaccggguauggauagaagaaaauccguggauggaggacaaaacccacauuagcucguggggugaugugccguacuuaggcaaaagggaggaccaaugguguggcagccuaauugggcuuacggcacgugcaaccugggcgaccaacauacagguagcaauuaaccagguccgacgccucauaggaaaugaaaacuaccuagacuauaugaccuccaugaagcgcuucaagaacgaaagcgacccggagggggcccugugguga

SEQ ID NO: 23795 - RNA, 9879 nt, Artificial Sequence
  derived and/or modified CDS sequence (opt11) from DENV-1__GU131893__SS-prME
agcguaacuaugcuguugauguugaugcccaccgcccucgccuuccaccucaccaccagaggaggggaaccccacaugaucguuuccaagcaggaacggggaaagucacucuuauucaagacgagugccggggugaacauguguacgcuuaucgcuauggaccugggggagcugugcgaggauacuaugaccuacaagugcccacggaucaccgaggcagagccagacgacgucgacugcuggugcaacgccacugacacgugggucaccuacggaaccugcagccagacuggggagcaccggcgagauaagcgguccguggcccuagcgccccaugugggccuggggcuggagacgcgcacagagaccuggaugagcuccgagggcgccuggaagcagauccagcgugucgagacgugggcccuccgccacccgggguucacggugaucgccuuguuccuggcgcacgccauuggcaccagcaucacucagaaggggauuauauucaucuuguuaaugcugguuacccccuccauggcuaugagaugcguaggcaucggcagccgcgacuucguggaggggcucaguggcgccacgugggucgacgucgucuuagagcaugggagcugcgugaccacuauggccaaggacaaaccuacucuggacaucgagcuacugaagacggaggucaccaaccccgcgauccuccgaaaacuuugcaucgaggcaaagauuuccaacaccacgacagacucacgauguccgacgcagggugaagccacucugguagaagaacaggacgcaaacuucgugugucggcgcaccuucgucgaccgggguugggggaauggcugcggguuguucgggaaggggucccugaugacuugugccaaguucaagugcgugaccaaacuggaagggaagaucgugcaguacgagaaccuuaaauacaguguuaucgugacagugcacaccggcgaccagcaccaagucgggaacgaaaguacggagcacgggaccaccgcgaccaucaccccacaggcgccgacaaccgaaauccagcucaccgacuacggggcccugaccuuagacugcagcccccgcacgggccuagacuucaacgagauggugcugcugaccaugaaggagaaaucuuggcucguccacaaacagugguuccuggaccugccgcuacccuggaccagcggggccagcacuucgcaggagaccuggaaccggcaggacuugcuggugaccuuuaagaccgcucacgcgaagaagcaagaggugguaguacuggguagccaagagggcgccaugcacacugccuuaacgggggccaccgagauccagacaaguggcaccacgaccaucuuugccggccaccugaagugcaggcucaagauggacaagcucacccugaaagguaugaguuacgucauguguaccgggaguuucaaguuggaaaaggaagucgcggagacgcaacacgggaccgugcugguucagaucaaguacgagggcaccgacgcccccugcaagaucccuuucuccacccaggacgaaaagggugccacacaaaacggccgucugaucaccgccaacccgaucguaaccgauaaagagaaaccggugaacauugaagcggagccgcccuucggggagagcuacauugugaucggagccggcgagaaagcccugaaacucaguugguuuaagaagggcuccagcaucggaaagauguucgaggccacugcacgcggggcgcggcggauggcaauccugggugacacagccugggacuucggguccauuggugggguauucaccagcguagggaaauugguacaccagaucuuugggaccgccuacgggguccuguucuccgggguguccuggacaaugaaaaucggcuugggcguacuccucacguggcuaggccugaacucccgaagcaccucccucagcaugaccugcaucgcuguagggcuggugacccuguaccucggcgugauggugcaggcggacagugggugcgucaucaacuggaagggccgggaacugaagugcggguccggcaucuuugucacaaaugaggugcacacguggaccgaacaguacaaguuucaagcagacagcccgaagcgccuguccgccgccauagguaaggccugggaggagggggucugcgguauccgguccgcgacgcgccuugagaacaucauguggaagcagaucuccaacgagcugaaccacauccugcuugagaacgauaugaaguucacggugguaguaggcgacguggcaggaauacucgcccaagggaagaagaugauacggccccagcccauggaguacaaauacagcuggaaguccuggggcaaggcgaagaucauuggggcggacguccagaacacgaccuucaucaucgacgguccgaacaccccugaaugccccgacgaucaacgcgccuggaacaucugggagguggaggacuacggauuugggauuuucacaacgaauaucuggcugaagcuccgggacagccacacacaggugugcgaccaucgccugaugagcgcugccaucaaggacagcaaggccgugcacgcagacaugggcuacuggaucgagagugagaagaacgagaccuggaagcuggcccgggccagcuucaucgaggugaaaaccugcauauggccuaagucccacaccuuauggagcaacggagugcuggaguccgaaaugaucauccccaagauauaugggggccccaucagccagcacaacuaccgccccggcuauuucacccaaaccgccgggcccuggcaccuggggaagcucgaacuggacuucgacuugugugagggcacgacgguagucguggacgaacacugcggcaacagagggccuucccuccgcaccacuacuguuacgggcaagaucauucacgaguggugcuguagguccugcacgcuucccccacugcgcuuuagaggagaggacgguugcugguacggaauggagaucagaccagucaaggagaaagaggagaaucuggugaaaucaauggucagcgcgggcagcggagaggucgauuccuucagccugggccuguugugcauaucuaucaugaucgaggaggugaugcgcagccgguggucacggaagaugcugaugacaggaacccuggccguauuccuccugcugaucaugggacagcucacguggaacgaccuuauccgacugugcaucauggugggcgcaaacgcgagugaucgcauggggauggggacuaccuacuuagcccugauggccaccuucaagaugcggccaauguucgccguugggcuccucuuccgccggcuuacgucgcgcgagguccuacucuuaacgaucggccuaagccuugucgcauccguggagcuccccaacagucuugaggaguuaggcgacgggcuggccaugggcaucaugauacugaagcuccuuacagacuuccaaucccaccagcuaugggcaacccuccugucgcugacguucaucaagaccaccuucucccuccacuacgcguggaagaccauggccaugguguugucuaucgugucucuguuuccgcucugccugagcacgaccucucaaaagacgaccugguuacccguccuuuuaggcucucuggggugcaagccacucacaauguuccugaucgccgagaacaagaucugggggcggagauccuggcccuuaaacgaagggaucauggccgugggcauugugucaauccuccuaagcucccuccucaagaacgacgucccccuggcuggcccccugaucgcgggcggcaugcucauugccuguuacgugauuagcggguccucugccgaccuaucauuggagaaggccgcagagguguccugggaggaagaagcggaacacuccggugccagccacaacauacucguggaggugcaggacgacgggaccaugaagaucaaggacgaggaacgggaugauacccuuaccauucuccucaaagccacccugcuugcaguguccggcguuuacccguuaucuauucccgccacucuauuugucugguacuuuuggcagaaaaagaagcaacgcucuggggugcucugggacacccccagcccgccagaggucgagagggcggugcuugacgacggaaucuaucgcaucaugcagcgcggccuccuggggcgcagucaggugggcguuggcguauuccaggagaauguuuuccacacuauguggcacguaaccaggggcgccgugcuaauguaccaaggaaagagacucgagccgagcugggcuuccgugaagaaggaccugaucagcuacgguggcggguggcgccuucaaggauccuggaacacuggggaggagguccaggucaucgccguggagcccggcaagaaccccaagaacguccagaccgcccccgguaccuuuaagacccccgagggagagguaggcgccaucgcccuggauuuuaagcccgggacuucaggcagcccaaucgugaaccgcgaggguaaaauaguaggccuguauggcaacggcguggugaccacgucuggcaccuacguaagcgccauugcccaagcgaaggccucccaagaggggccccugcccgaaauugaggacgagguguuccggaaacgcaaccucacgaucauggaucugcacccuggcagcgggaagacucggcgguauuugccagcaaucgugcgugaggccaucaaacgcaaacuccgcaccuuaauccucgcacccacgcgggucguggcguccgaaauggccgaggcgcucaagggcaugcccauccgguaccagaccaccgccgucaaaagcgagcacaccggcaaagagaucgucgaccugaugugucacgccaccuucaccaugcggcuucucucccccgugcgagugccaaacuacaacaugaucaucauggacgaggcacacuucaccgauccaagcuccaucgccgcccggggauacauuagcacccgcgucggaaugggggaagcggccgcuaucuucaugacagcgacgcccccaggcaguguggaggcuuucccgcagagcaaugccguaauccaggacgaggaacgggauauccccgagcgcaguuggaacagcggguacgaauggaucaccgacuuccccgguaagaccgucugguucgugccaucaauaaagucuggaaacgacaucgcgaacugccugcggaagaacggcaaacgcgucauccagcuuuccagaaaaaccuucgacacggaauaucagaaaaccaaaaauaacgauugggacuacguggugacuaccgacaucagcgagaugggcgccaauuucagggccgaccgugugaucgacccgcgucggugucuuaagcccguaauccuaaaagacgggcccgagcgcgugauuuuggccggacccaugccgguaaccguggcguccgcggcgcaacggcgcgggagaaucggccgcagccacaacaaggaaggcgaccaauacaucuacauggggcagccccucaauaacgacgaggaccacgcccacuggaccgaagccaaaauguugcuggacaacaucaacacuccggagggcauaauucccgcgcuuuucgagccggagcgcgagaaaucggcggccauagacggggaauaccgguugcgcggcgaggcccggaagaccuucgucgagcuaaugcgccgaggggacuugcccgucuggcuuagcuacaagguggccagcgaaggcuuccaauacucggaccggcggugguguuuugacggcgagcgcaacaaccaagugcuggaggagaacauggaugucgaaaucuggaccaaggagggggagaggaagaagcugcgcccccgguggcuggacgcgagaaccuacagcgacccccuggccuuacgggaguucaaggaauuugcggcaggccgccguuccgucagcggagauuuaauccuggagaucgguaagcucccgcagcaccugacucaacgcgcgcagaaugcgcuggauaaccucgucaugcugcacaacuccgagcagggagggcgggcguaccggcacgcgauggaggaacuucccgacaccauugagacgcucaugcugcuggcacucaucgccguccugaccggcggggugaccuuauucuuuuuaagcggccgaggucucggcaagacaagcaucggccuguuaugcguaauggcgagcuccguucuguuauggauggccagcguggagccccacuggauugccgccaguaucauccuggaguucuuccugauggucuuguuaaucccggagccggaccgucagcggacgccucaggacaaccagcuggccuacguagugaucgggcuauuguucaugaucuugacgguggcggccaacgagaugggccugcucgagaccaccaagaaagauuuggggaucggccacgucgccgugggcaaccaccaccaugccgccaugcuggauguggaccuccauccggcgagcgccuggacacuguacgccgucgcaacaaccauuaucaccccgaugaugcgucacacaaucgagaacacgaccgccaacaucagucucaccgcgaucgccaaccaagccgccauccucaugggccuggauaagggcuggcccaucaguaagauggauaucgguguuccccugcucgcgcugggcugcuacucccaagugaauccccugacccugacagccgccguacuaauguuaguggcccauuacgccauaaucgggccugggcuucaggcgaaagccacgcgcgaggcccagaaaagaaccgcggcaggcaucaugaagaaucccaccguggauggcaucgucgccaucgaccuagacccaguagucuacgaugccaaguucgagaagcagcuaggccagauaaugcuccugauccugugcacgucccagauccuauuaaugcgcacgacaugggcccugugcgaauccaucaccuuagccacggguccccugaccacccugugggaagggaguccgggaaaauucuggaauaccacgauugcugucucgauggccaacaucuuccgggggucauaccucgccggcgccggauuagccuucucucugaugaagucccucggcgggggccgucgggggaccggcgcccagggcgagaccuuaggggagaaguggaagcgccagcugaaccagcucucgaaguccgaguucaacaccuacaagcggagcggcaucauggaaguggaccguagcgaggcuaaagaggggcugaaacggggcgagacgaccaagcacgcugucagccgcggaacugcaaagcugcggugguucgucgagagaaaucuggugaagcccgaggguaaggugaucgaccugggcugcgggcgcggcgguuggagcuacuauugcgccggccugaaaaaggucaccgaggugaagggguacacgaagggcggccccgggcacgaggagcccaucccaauggcgacauacggcuggaaccuggucaaacuucacagcgggaaagacgucuucuuuaucccacccgaaaagugcgacacacugcugugcgacaucggagagaguucuccaaacccgaccauugaggagggacgaacguuacggguacugaagaugguagaaccauggcugcgggguaaccaguucugcaucaagauccucaacccuuacaugccguccgucguggaaacguuagaacagaugcagcggaagcacggugggauguuagugcgcaacccgcuuagcagaaacuccacucacgagauguacuggguuuccugcggcaccgggaauaucguguccgcgguaaauaugaccucaagaaugcugcugaacagauuuacgauggcccaccggaagcccaccuacgaacgugacgucgaccucggcgcgggcaccagacacguugccguugagcccgaggucgcgaaccuggacaucaucggacagagaaucgagaacauuaagcaugagcacaaguccaccuggcacuacgaugaagacaaccccuacaaaacgugggccuaccacggcagcuacgaagugaagccauccgggucagcaagcucgauggugaacggcgucguuaagcugcucaccaagcccugggacgucauccccauggugacccagauugcgaugacagauacgacacccuucggucagcagaggguguucaaggagaagguagacacacgcacaccgaaggccaagcggggcacggcgcagauuauggaggugaccgccaaguggcucuggggguuccugucccgcaauaaaaagccccgcauaugcacacgagaggaguucacccggaaggugcgcuccaacgcggccaucggggcagucuucguggacgaaaaccaauggaacucggcgaaggaagccguagaggacgagcgauucugggaccucguccaccgggagcgggagcugcacaagcaaggcaaaugcgccacgugcguauauaacaugauggggaagagagagaagaagcugggggaguucgguaaagcgaagggcucucgggcgaucugguauaugugguugggcgcccgguuccucgaguucgaagccuuaggcuucaugaacgaagaccauugguucagccgggagaacucccucagcggcguggagggugagggccugcacaaacuaggguauauccuccgcgacauuuccaagauccccggcggcaacauguacgccgacgauacggccgggugggauacucggauuaccgaggacgaucugcaaaaugaagcgagaauuacggacauuauggagccagaacacgcccugcuggccaagagcaucuucaaguugaccuaccagaauaaggucgucagagugcagcggcccgccaaaaacggcaccguuauggacguaaucucccgccgggaccagcgcgggagcggccagguaggaaccuacgggcugaacacguucacaaacauggaggcccagcucauccggcagauggagucugaaggcaucuucagccccucugagcuggagacgccaaaucuggcggaacguguccucguuugguuggagaaguacgggguugagcgguuaaaaaggauggccaucagcggcgacgauugcgucguaaaaccgauugacgauagguucgccaccgcccucacggcgcugaacgauauggggaaggugcgcaaggacaucccccagugggagcccuccaaaggcuggaacgacuggcagcaggucccuuucugcagccaucacuuccaccagcugaucaugaaggacggccgugagauaguugugccgugccgcaaccaggacgaguuagucgggcgggcgagaguaagucagggcgccggguggucccugcgggagaccgcgugccuggguaagaguuacgcccagauguggcagcuuauguacuuccaccgaagagaccuacgccuggcggccaaugccaucuguuccgccgugcccgucgacuggauccccaccucgcggacuacgugguccauccacgcacaccaccaguggaugaccaccgaagacaugcucagcguguggaaccgcgucuggaucgaggaaaaccccuggauggaggacaagacccacauuucaucguggggcgacgucccuuaccugggcaaacgcgaggaccaaugguguggcucccucaucgggcucaccgcgagagccaccugggccacuaauauacagguggcuaucaaccaagugcgaagacugaucggcaacgagaacuacuuagacuauaugaccucaaugaaacgcuucaagaacgagagcgaucccgagggggcuuugugguga

SEQ ID NO: 23796 - RNA, 9879 nt, Artificial Sequence
  derived and/or modified CDS sequence (opt11) from DENV-1__GU131894__SS-prME
agcgucacaaugcuacugauguuaaugccgaccgcccuagccuuccaucuaacgaccagagggggagaaccccacaugaucgugagcaaacaagaacgcggaaaaagccuacuguucaaaaccuccgccgguguaaauaugugcaccuugauagcgauggaccucggugaacugugugaagacacgaugaccuacaaaugccccaggaucacugaagccgaaccagacgaugucgauugcuggugcaacgcuacugauacaugggucacguacgguaccuguagccagaccggagaacaucgacgagacaaacggucaguggcccucgcaccacacguaggacucggccuugaaacacgcaccgaaaccuggaugagcucggaaggagcguggaagcaaauccagagaguagaaaccugggcucuacgacaccccggauucacaguaauagcacuguuuuuggcccacgcgaucggcacguccaucacgcagaaagguaucauauucauacuacugaugcuuguaaccccgucaauggcuaugagaugcguagggaucggaucgagggacuucguggagggauugaguggugcgacguggguagauguaguacucgaacacggcuccugcgugacgacaauggcgaaggacaagccgacucuagacauagaacuccugaagacagaggucacaaauccggcgauccuucggaagcuaugcauagaagcgaaaauuagcaacacuacuaccgauuccagaugccccacacagggagaggcaacucuuguagaggaacaagacgcaaacuucguuugcagacggaccuucgucgauagaggaugggguaacgggugcggccucuucgguaagggcagccugauaaccugcgccaaauuuaaguguguuacuaaacucgaaggaaaaauaguacaguacgaaaaucuaaaguacagugucaucgucaccguacauacaggagaccaacaccaggugggaaacgaaucaacugaacacggcaccaccgcaacgauuacaccccaagcgccaacuacugagauccaauuaacagacuauggagcccugacucucgacuguucaccaaggacaggguuagacuucaacgaaauggucuugcucacgaugaaagagaaaaguuggcugguccauaagcaaugguuccucgacuuaccgcugccuuggacgaguggugcuuccaccagccaggaaaccuggaauagacaagaucuccuagugacguucaaaaccgcucacgccaagaagcaagagguggucguacucggcagccaggaaggugcaaugcacacagcgcugacaggcgccacagaaauucaaacaucggggacaaccacaaucuuugcgggccauuuaaaauguagacuaaaaauggacaaauuaacccucaaaggaauguccuacgucaugugcacaggcagcuuuaaauuggaaaaagaaguggccgagacacaacacgguacggugcugguacaaauaaaguacgaggggacggacgcgcccugcaaaauuccguuuagcacacaagacgagaaaggcgugacgcaaaauggacgccucaucacggcaaauccgaucguaacugacaaagagaaacccguaaauauagaagccgagcccccuuucggggagagcuauauaguuaucggcgccggagaaaaagcgcucaaacuuagcugguucaagaaggggucaaguaucggcaaaauguucgaagcgacggcacgaggggcaagacgcauggcgauauuaggcgauacugcaugggacuuuggcaguauaggaggcgucuucaccagcguagguaagcuaguacaccagaucuucgggacagcguauggaguccuauucucugguguaucuuggacuaugaagaucggcaucggcguacuccucaccuggcuaggacuaaauagucgaagcacuagccucuccaugacauguauagcagucggccuagugacccuguaucuagggguaauggugcaggcagacucaggaugcguaaucaauuggaaagggcgggaguuaaaguguggcucaggaaucuucgucaccaacgagguccacacauggaccgagcaguacaaauuccaggccgacucuccaaagcgccucagcgcagcgaucgguaaagccugggaagagggggugugcggcauccgaagugccacgcgccucgaaaacaucauguggaagcaaauaucaaacgagcuaaaucacaucuuacucgagaacgacaugaaauucacugucgucguaggagacguagcaggaauauuggcccagggcaagaaaaugauacgaccccagccaauggaauacaaauauucauggaaauccuggggcaaagccaaaauaaucggagcggacguucaaaacacgacguucauaauagacggccccaacaccccagaaugcccagaugaccagcgggcauggaacaucugggaggucgaggacuauggcuuuggaauauucacaaccaacaucuggcuaaaacuucgagacuccuacacccaaguaugcgaucaccgccuuaugagcgccgccauuaaagacuccaaagcuguccacgcggacaugggguacuggaucgagagugagaagaacgagacauggaagcuagcacgagccucuuucauagaagucaaaaccugcaucuggcccaagucacauacacuguggaguaacggcguacuagaaucagagaugaucauaccaaaaauauacgggggcccaauaucucaacacaacuaccgcccgggcuacuucacccaaacggcagggccuuggcaccuaggaaaacuggaacuugacuuugaccugugcgaaggaaccacgguagucgucgaugaacauugcggcaaccgaggcccaucgcucaggacaacaacagucacaggcaaaauaauccacgaguggugcuguagaagcugcacgcuacccccgcuccgcuuccggggagaagacggcugcugguacggcauggaaauccggccaguaaaggaaaaagaggaaaacuuagugaaguccauggugucagcggggaguggggaaguugacucguucucacuuggacuacuauguauaaguaucaugauagaagaggugaugcggucccgcuggucacgaaagaugcucaugacuggaacacucgcaguuuuucuucugcuuaucaugggacaacuaacguggaacgaccucauuagacuuuguauaaugguaggggcuaaugcgucagacaggaugggcauggggacuacauaccuagcacuaauggcaaccuuuaaaaugcggcccauguucgcgguaggacuacuauuucgcaggcucaccucacgcgaaguuuuacuacuaacaaucggccuaagccugguagcgucaguugaacucccaaacagccuagaggaauuaggggacggccuagccaugggcaucaugauccugaagcuacucacggauuuccagagccaccagcugugggcuacgcuccucucccugaccuucauaaagaccacguucucgcugcacuaugcguggaagaccauggccaugguucucagcaucgugucacuauucccacugugccuuaguacgaccucgcagaaaacuacaugguugccgguccuccucggcagcuuagguuguaaaccgcuaacgauguuccugauagcggaaaacaaaaucuggggacgucgguccuggccccucaacgaggggauaauggcgguugguaucguaagcauacugcuaaguucccuacucaaaaaugacguaccccuggccgggccccugauagcaggcggaaugcugauagccugcuacguaauaagugggagcagugcagaucuaucucuagaaaaagccgcagagguuucaugggaagaggaggcagaacacucuggagcaagccauaacauccucguggaaguacaagacgacgggacuaugaagauuaaagacgaggaacgcgacgacacccugacaauccuacucaaagcaacgcuacuggcgguuucggguguauauccacucagcauccccgcgacucuguuugucugguacuucuggcagaaaaagaaacaacgcuccgggguccucugggacacuccaagcccuccggaaguagaaagggcuguccuagaugacggcauauacagaauaaugcaacgaggccuacucggcagaagccagguaggcguaggcguuuuccaggaaaacguauuccacaccauguggcacgugacacgcggagcaguucuaauguaucaaggcaaacggcuggagccgucaugggccuccgucaagaaagaucucauaaguuacggcggaggguggagacuucaaggcucauggaacaccggagaagagguacaggucaucgccguggagccgggaaagaaccccaagaacgugcaaaccgcucccggcacauucaaaacacccgaaggcgaaguaggggccauagcguuggacuucaaacccggcaccucgggauccccgauuguaaaccgagaggggaaaaucguuggccucuacgguaauggaguggugacuacaaguggcaccuacguaucugccaucgcccaggccaaggcuagccaggaaggcccucuuccggaaauugaggacgaaguauuccgaaaaagaaaccuaacuauuauggaccuccacccaggcuccggcaagacgcggcgauaccucccagccauagugcgggaggcaauuaaaagaaagcucagaacacucauccucgccccgacaagggucgucgcguccgaaauggcagaagcguuaaaaggaaugccgauccgauaccaaacgacagcggucaaauccgagcacacgggaaaagaaauaguagaccucaugugucaugccacauuuaccaugcgucuacuaucaccaguaagagucccaaauuacaacaugauaauaauggaugaagcccacuucacagacccgucgagcauagcagcucgcggauacauaaguacacgcguaggcaugggagaagcggcggcaauauucaugacugccacaccucccggcucagucgaagcguucccccaaagcaacgcugucauccaggacgaggaacgggacauacccgaaaggaguuggaacuccggauacgaguggaucaccgacuuccccggcaagaccgugugguucguuccaucaauuaagagcggaaacgacauagcaaacugccugcgcaaaaaugggaaaagggucauacaacuaagcagaaaaacauucgacaccgaauaccaaaagaccaagaacaacgacugggauuacguagucaccacggauauuagcgagaugggagcuaacuuccgggcggauagaguaaucgacccaagaaggugccuuaagccuguaauccucaaggaugggcccgagcggguaauucuagcagggccgaugccgguaacagucgccucggcggcacaacgccgugggaggaucgggagaaaccacaauaaggaaggagaccaguacauuuacaugggccaaccgcugaacaaugacgaagaccacgcccacuggacagaggccaaaauguuguuggacaacauaaacaccccagaggggaucauacccgcccuauucgagcccgaacgggaaaagucagcggcaauugacggcgaauaccgacucaggggagaggcaagaaaaacauucguagaacucaugaggcgaggagaccuuccagucuggcugucguacaaagucgccagcgaaggauuucaauacagcgaccgacggugguguuucgacggcgagcggaauaaccagguccuagaagagaacauggacguggaaauauggacaaaggaaggagagcgcaagaaacuccgaccacgaugguuggaugcuaggaccuacuccgacccgcuggcgcucagagaguucaaagaguucgccgcgggccggcggagcguaagcggagacuuaauucuggaaaucggaaaacuaccccaacaccuaacacagcgcgcucaaaacgcccuagacaaccuggucaugcugcacaacuccgaacaaggagggcgagcauaccgucaugcgauggaggaacuuccagauacuauagagacacucaugcugcucgcgcugaucgcuguccucacagggggagugacgcuauucuuccucagcggcagagggcuaggcaaaacaagcauaggguuacuuuguguaauggcaagcagcguccuacuguggauggcuucuguggagccacauuggaucgcagcgucgauaauacuggaauuuuuccucaugguauugcuaauaccggagcccgacaggcaaagaaccccacaggauaaccaacuggcauauguaguuaucggacuccucuucaugauccucacugucgcggcaaacgagaugggcuugcuagagacgacuaagaaggauuuggguauugggcacguagccguuggcaaccaccaccaugccgcaaugcuagauguagaccuccaccccgcauccgcauggacccuguacgccguggcuaccacgauaauaacuccuaugaugcgucauaccaucgaaaauaccacagcgaauauaucacugacagccauagccaaccaggcggccauacugaugggcuuggacaagggauggcccaucagcaaaauggauaucggugucccccugcuggcguuagggugcuauucucaggucaauccgcuaacacuaacggcggcaguccucaugcugguggcgcacuacgccaucaucggaccaggacuccaagcaaaggcgaccagagaagcccaaaaacggacagcagcuggcauaaugaagaacccgacagucgauggaauaguggcaauagauuuagaccccguuguauacgaugcaaaguucgagaaacaacucggccaaauaaugcucuugauacuaugcacgagccagauacucuugaugaggaccaccugggcuuugugugaaucaauaacgcucgcaacggggccgcucacaacgcucugggaaggaucaccaggcaaauucuggaacacaaccaucgcagucuccauggcgaacaucuuccgaggaucauaccucgcuggagccggacuagcauucagccugaugaaaagccugggcggcggcaggcggggcaccggagcacagggagaaacgcugggcgagaaguggaagcgccaauuaaaccaauuaagcaaaucagaguucaacaccuacaaacgaagcggcauaauggaaguggauaggagcgaagcaaaagaaggacuaaagagaggcgagaccaccaaacacgccgugagucgaggaacggcaaagcugaggugguucguagagagaaaccuggugaaacccgagggcaaaguaauagaucuaggcugcgggagaggaggcuggaguuacuacugcgcaggacuuaagaaagucacggaagucaaaggcuauacaaaaggcggaccgggacacgaagaaccuauaccaauggccacuuacggguggaaccuuguaaaauugcacagcggcaaagacguauucuucauaccgccagaaaaaugcgacacucuccugugcgacaucggagaaagcucccccaacccgacuauagaggaaggacgaacauuacgcgugcuuaagaugguagagccguggcuccgcggaaaucaguucugcaucaaaauacugaacccauauaugcccucgguagucgaaacccucgaacaaaugcagaggaaacacggcggaaugcugguccgcaaccccuugucgaggaauagcacacaugagauguauugggucuccugcgggaccgggaacaucguuucugcagucaauaugacuagcagaaugcuuuuaaaucgauuuaccauggcacacaggaaaccgacuuaugaacgcgacguugaccucggggcgggcacgcgucacguugcuguggagcccgaaguggcuaaccuagauaucauagggcaacgcaucgaaaacauaaagcacgaacacaaauccaccuggcauuaugaugaagauaacccauacaagacgugggcuuaccauggaucauaugaagucaaaccuagcggaucagcgaguucaauggucaacggcguggugaaacuacucacgaagccgugggacguaaucccaaugguaacccagauugcaaugaccgauaccaccccuuucggccagcagagaguauuuaaagaaaagguggauacacgaacgccgaaagcaaaaaggggaacagcgcaaauuauggaaguuacggcgaagugguuauggggguuucugagucggaacaagaaaccgcgcauaugcacaagggaggaguucaccagaaagguacgaaguaacgccgcaauuggcgcugucuuugucgaugagaaccaauggaacagcgcaaaagaagcggucgaagaugagcgcuucugggaucucguucauaaagagcgggagcuucacaaacaagggaagugcgcgaccugcguauacaacaugaugggaaagagggagaagaaacuuggggaguucggaaaggcuaagggaucacgagcaauuugguauauguggcucggcgcgcgauuucuagaguucgaagcccugggauucaugaacgaagaucauugguuuucgcgcgaaaauucacugucuggaguugaaggcgagggcuuacacaaacuagguuacauucugcgugauaucuccaagaucccugggggcaauauguacgccgacgauacagcaggaugggauacccgaauuacagaggacgaucugcaaaaugaagcuaggauaacagauaucauggagccggagcaugcccuacuagcuaaauccaucuuuaaacucacuuaccagaauaaagucguaagaguacagagacccgcaaagaacggcacgguaauggaugugauaucgcgcagagaccaacgcggaucagggcaagugggaacguacggccucaauaccuuuacaaauauggaggcacaguuaauucgacagauggagucggaaggaauauucaguccaucagagcuagaaacgccuaaccucgccgaacgaguacuugacuggcuagaaaaauauggagucgaacguuuaaaacggauggcaauauccggagaugacuguguaguaaaaccaauagacgaccgcuuugccaccgcccuuacagcgcucaacgacauggguaaggugcgaaaggauauaccacaaugggagcccagcaaagguuggaacgacuggcagcaggucccauucugcagucaccauuuccaccaacugaucaugaaagacggacgggagaucguuguccccugcaggaaccaggacgaacucgucggacgggcacgcgucagccaaggggcagguuggagccucagggagacagccugccuaggaaaaagcuaugcccaaauguggcaacuaauguauuuucaccgucgcgaccuacgacucgcugcaaacgcaauauguagugccguaccaguggacuggacaccaacgucgcgaacgacauggaguauucacgcacaucaucaguggaugaccaccgaggauaugcuauccguguggaauagggucuggauugaagaaaacccguggauggaagacaaaacccauaucucaagcuggggagacguuccauaccucgguaaacgagaagaccaguggugcggcucgcuaauaggcuugacugcccgcgcgacgugggcgaccaacauccaagucgcgaucaaucagguucgccguuuaauagggaacgaaaauuaucuggacuacaugacaucaaugaaacguuucaaaaacgaguccgacccagaaggcgcccugugguaa

SEQ ID NO: 23797 - RNA, 9879 nt, Artificial Sequence
  derived and/or modified CDS sequence (opt11) from DENV-1__GU131895__SS-prME
agcguaaccauguuacucaugcucaugcccacugcccuggccuuccaucucaccacccggggcggggaaccccacaugaucguguccaagcaggagcguggcaagagccugcuguucaagaccagcgccggggugaacaugugcacacucaucgcuauggaccuaggcgagcugugcgaggauaccaugacguacaagugcccccggauuaccgaggccgaacccgaugacguggacugcugguguaacgccaccgacaccugggugacauaugggaccugcagccagaccggcgagcaccggcgcgacaagcgguccguggcacucgcuccccacguuggccucgggcuggagacgcggacggagaccuggaugagcuccgagggcgcuuggaagcagauccagcgggucgagaccugggccuugcgccaccccggguucacggugaucgcccuguuccuggcgcacgccauaggcacaagcauaacccagaagggcauaauauucauucuccugauguuggugacccccucgauggcuaugcggugcgucggcaucggcagcagagacuucgucgaggggcucuccggcgccaccuggguggaugucguccuggaacacgggagcugcguuaccacuauggccaaggacaagcccacucuggacaucgagcuccugaagacugaggucaccaaucccgcgauccuaaggaagcucuguaucgaggcaaaaaucuccaacacaaccacggacucgcgcugcccgacgcagggcgaggccacccugguggaggaacaggacgcgaacuucgugugccggcguacauucgucgaccggggguggggaaacggcugugggcuguucgguaaggggagccucaucaccugcgccaaauucaagugugugacgaagcuggaggggaaaaucgugcaguacgagaaccugaaguauagcgucaucguuaccguacacaccggcgaccagcaccagguagguaacgaguccacggagcacgguaccaccgcgaccaucacgccccaggcccccaccacagagauccagcucaccgacuauggagcccugacccuggacuguuccccccgcacgggccucgacuucaacgagauggugcugcugaccaugaaggaaaagucauggcuuguccauaagcagugguuccuugacuuaccccugccguggaccucuggagccagcaccucccaggaaacguggaaccgccaggaccugcucgugaccuucaaaaccgcccacgcgaagaagcaagaggugguagugcucgggagccaggagggggccaugcacaccgcccugacaggggcaacggagauccagaccuccggcaccacuaccauauucgccgggcaccugaaaugccgacucaagauggacaagcuugcgcugaagggcaugagcuacgugaugugcaccgguucauucaagcuagagaaggagguggcggagacccaacacggaaccgugcugguacaaaucaaguacgagggcaccgaugcacccuguaagauccccuuuagcacccaggacgagaaggggguaacccaaaacggcaggcugaucacagccaacccgaucgugacggacaaggaaaagcccgugaacaucgaggcggagccaccguucggggaguccuauaucgugaucggcgccggcgagaaggcucuuaaguugagcugguucaaaaaggguuccagcaucgguaaaauguuugaagcaaccgcacgcggggcgcggcgcauggccauucugggcgacaccgcuugggauuucgggaguaucggcggcguguucacgagcguuggaaagcugguccaccagaucuucggcaccgcuuacgggguacucuucaguggcgugagcuggaccaugaagaucgggaucggcguccuucugacaugguugggccugaacucccgaagcacaagcuugagcaugaccugcaucgccguggggcucgugacccuguaucugggagucauggugcaggcggacuccgggugcguuaucaacuggaagggccgagaguugaagugcggaagcggcaucuuugucaccaacgaggugcacacuuggacagagcaguacaaauuccaggcugacagcccgaagcgccugucagccgccaucggcaaggccugggaggaaggggucugcgggauccggagcgcgacgcgccuggagaacauuauguggaagcagauuucgaacgagcucaaccauauucugcuggagaacgacaugaaguuuaccgugguggucggggacguggccgggauccucgcgcaggggaagaagaugauucggccccagccuauggaguacaaguacagcuggaagucauggggcaaagccaagaucaucggagcggacguucagaacaccacguucauuauugacgggcccaacaccccggagugcccagacgaccagagagccuggaacaucugggagguggaagacuaugguuucgggaucuucaccaccaacaucuggcugaagcuccgggacagcuauacgcaagucugcgaccaccgccuuauguccgccgccaucaaagacagcaaggccgugcacgcggacaugggguauuggauugaguccgagaaaaacgagaccuggaaacuugcccgggccagcuucaucgagguuaagaccugcaucuggcccaaaagucacaccuuguggagcaacggcguauuggaguccgagaugaucauccccaagauauacgggggcccgaucagccagcacaacuaccgccccggguacuucacgcagacugcaggcccguggcaucuggggaagcuggagcucgacuucgaccuaugcgagggcacuaccgugguggucgacgagcacugcggcaaccgggggccgagucugcgcacgaccaccgugacuggaaagaucauccacgaguggugcugccggagcugcacgcugccuccccucagguuccgcggggaagauggcugcugguacgggauggagauccgcccagugaaggagaaggaggagaaccuagucaaguccauggugucugccggcagcggugagguggacuccuucucccucgggcugcugugcaucuccaucaugaucgaggaggucaugcgcagccgcuggucccggaagaugcucaugacgggcacccuggcgguguuccugcuccugauaauggggcagcugaccuggaacgaccucauccgccugugcauaauggugggagcgaacgccagcgaucgcauggggaugggcacgacuuaccuggccuugauggccaccuucaagaugcggccgauguucgcggucggacugcucuuccgccgccucaccucccgcgaggugcugcuguuaacgaucggacugucccugguggccuccguagaacuccccaauagcuuggaggagcugggcgaugggcuugcuaugggcaucaugauccugaaguugcucaccgacuuucagucccaucagcugugggccacguuguuaagucugaccuucaucaagacgaccuucucccuacacuacgcguggaagacaauggccauggugcugucuauaguuucgcuguucccccugugccuaagcaccacuucgcagaaaacuacuuggcugccagugcugcucggcagccuggggugcaagccgcugaccauguuccucaucgccgagaacaagauauggggccggcgcuccuggccccugaacgaggggauaauggccgugggcaucgucagcaucuuacucagcucccuucugaagaacgaugugccccuagccgggccucugaucgcgggcggcaugcugaucgccugcuacgugaucuccggauccucggccgaccucucccuggagaaggccgccgaggucagcugggaggaggaggcggagcacucaggcgccagccauaacauccugguggaggugcaggacgacgggacgaugaagaucaaagacgaggaacgggacgacacccucaccauucuccugaaagccacacuccuggccgucuccggcguauacccgcugagcaucccugccacccucuucgugugguacuucuggcagaagaaaaagcagcgauccggcguccugugggauacgcccagcccgcccgaaguggagcgagcggugcuggacgacggcaucuaccgcauaaugcagcggggccuucuggggcgcucccagguaggggugggaguguuccaggagaacgucuuccacacgauguggcacgugacccggggggccguguuaauguaccaggggaaaagacuggagccuagcugggccuccgucaagaaggaccucaucagcuacggcggugguuggcggcuccagggcuccuggaacaccggugaagagguccaggugaucgccguugagcccgguaagaaccccaagaacgugcagacggcccccgggaccuucaaaacccccgaaggcgaggugggcgcgaucgcccuggacuucaagcccgggaccagcggaucccccaucgucaaccgcgaggggaagaucgugggccucuauggcaaugggguagucacgaccagcggcacauacgugagcgccaucgcccaggcgaaggccucccaggaggggccccugcccgagauugaggacgaaguguucaggaagcgcaaccugaccaucauggaccuccaccccggcagcgggaagacgcggcgcuacuuaccggccaucgucagagaggccaucaagcgcaagcugcgcacccugauccuggccccaacccggguuguggcgucggagauggccgaggcucugaaggguaugcccauccgcuaucagacgacagccgucaagagcgagcacaccggcaaggagaucguggaccuuaugugccacgccaccuucacgaugcguuuacugucucccgugcgcgucccgaacuacaauaugaucaucauggacgaggcucacuucaccgaccccagcagcaucgccgcccggggguacaucagcaccagagugggaaugggggaggcugcagcgaucuucaugaccgccacgccgcccggcuccguggaggccuucccccagagcaacgccgucauccaggacgaggagcgcgacauacccgagcgcagcuggaacagcggguaugaguggaucaccgauuucccgggcaagaccgugugguucguccccuccaucaagucuggcaacgacauugcgaacugccuucggaagaaugggaaacgggucauccagcuguccagaaagacuuuugacaccgaguaccaaaagacgaagaacaacgacugggacuacguggugaccaccgacaucagcgagaugggcgccaauuuccgcgccgaccgggucaucgacccgcgccggugucugaagcccgugauccucaaggacgggcccgagcgcgugauccuggccggaccgaugcccgucacgguggccuccgcggcccagcggcgugggcggaucggacgcaaccacaauaaggagggcgaccaguacaucuacauggggcagccacugaacaacgacgaggaccacgcccacuggacggaggccaagaugcuauuggacaacaucaacacccccgagggcaucaucccugcccuguucgaaccggagcgcgagaagagugcggccaucgacggggaguacagacuacgaggcgaggcccggaagaccuucgucgagcugaugcgccggggggaccugcccgucuggcucuccuacaaaguggcaagugagggcuuccaguacagcgaccgcagguggugcuucgacggggagcgcaacaaccaggugcuggaggaaaacauggacguugaaauauggacuaaagagggggagcggaagaagcugcgcccccgguggcucgacgcccgcacguacuccgacccccuugcgcugcgggaguucaaggaguucgccgcuggccgccggaguguguccggggaucucauccuggagaucggcaagcugccgcagcaccucacucagcgcgcacagaacgcgcuggacaaccuggucaugcuccacaacagcgagcagggcggacgggccuaccgccacgcgauggaggagcugcccgacaccaucgagacccuaaugcuacuggcccugaucgccgugcucacggggggggucacccucuucuuccuguccggccgggguuuaggcaagaccagcaucggccucuuaugcgucauggccuccagcgugcuccuguggauggccuccguggagccccacuggauagccgcaagcaucauacuggaauucuuccucaugguccuucugauccccgagccugaccgccagaggacgccgcaggacaaccagcucgccuacguggugaucggccuccuguucaugauccucacugucgcggccaacgagaugggcuuguuagagacgaccaagaaggaccucgguaucggccacguugccgugggaaaccaccaccaugccgccaugcuggacguugaucugcauccggcguccgccuggacccuauacgccguggccaccacgauuaucaccccgaugaugcgccacaccaucgagaacaccacggccaacaucagccugaccgcgaucgccaaucaagccgcaauccuaaugggucucgacaagggcuggcccauauccaagauggacauuggugugccccugcuagcgcucggcugcuacagccaggucaacccccugacacugaccgccgccguucuaaugcugguugcgcauuacgcuaucaucgggccuggccugcaagcaaaggcgacgcgcgaggcccagaagcggaccgcagccgggaucaugaagaaccccaccgucgacggaauaguggcgaucgaucuggaccccguuguguacgacgccaaguucgagaaacaacugggccaaaucaugcugcucauucugugcaccucccagauacugcuaaugaggacgaccugggccuuaugcgagagcaucaccuuggcuaccggaccgcucaccacccugugggagggcucgcccggcaaguucuggaauaccacaaucgccguguccauggccaacaucuuccggggcuccuaccuggcgggcgcuggacucgccuucagccugaugaaaagucugggcgguggccgcagagggacgggcgcucagggcgagacccucggggagaaguggaagcgucagcucaaccagcuuuccaaaagcgaguuuaauacuuacaagcgguccggaaucauggagguggaccgcucggaggcuaaggagggacucaagcggggcgagaccacgaagcacgcagucucccgcgggaccgccaagcugcggugguuuguggagcgcaacuuggugaaacccgagggcaaggucaucgaccuaggcugcgggcggggcgggugguccuacuacugugccggucucaagaaggugaccgaggugaaaggguacaccaagggggggcccggccaugaggagccgaucccgauggcgacguacggcuggaaccuggucaagcugcauuccgguaaggauguguucuucaucccgcccgagaagugcgacacucuccugugcgacaucggcgagagcucccccaacccuaccaucgaggaggggcgcacccugcgggugcucaagauggucgagcccuggcugcggggcaaccaguucugcaucaagauccugaaccccuacaugcccucugucguggagacgcucgagcagaugcaacggaagcacggcgggaugcuaguccgaaacccgcugucccggaacuccacgcacgagauguacuggguguccugcggcaccgggaacauugugagcgccgucaacaugaccucccgcaugcuuuugaaccgguucaccauggcgcaccggaagcccacuuacgagcgcgauguggaccuuggcgccggcacaagacacguggcagucgagcccgagguggcgaaccucgacaucaucgggcagcgaaucgagaacaucaagcaugagcacaaaagcacauggcacuacgacgaagacaaccccuacaaaaccugggccuaccacggcuccuacgaggugaagccgucaggguccgcaagcagcaugguuaacggugucgucaaacugcugacgaaacccugggacgugauucccauggugacccagaucgcuaugaccgacacaacgccguuugggcagcagcgggucuucaaagagaaaguggacacccgaacccccaaggccaagcggggcaccgcgcagaucauggaggugacggcuaaguggcucuggggcuuccuaucccggaacaagaagccccggaucugcacccgcgaagaauucacccggaagguccggagcaacgcugccaucggggccguuuuuguggaugagaaucaguggaacuccgccaaggaggccgucgaggacgagcgauucugggaccuggugcacaaggagcgcgagcuccauaagcagggcaagugcgcgacgugcguguacaacaugauggggaagcgggagaagaagcugggagaguuugggaaggcgaagggcagccgcgcgaucugguacauguggcugggugcccguuuccucgaguucgaggcacugggguucaugaaugaggaccacugguucucccgcgagaauagccuguccggcgucgagggggagggcuugcacaagcuuggauacauccugcgggacaucagcaagaucccgggcggcaauauguacgccgaugacacggcagggugggacacccgcaucaccgaggacgaccuccagaacgaagcgaggaucaccgacaucauggaaccggagcacgcccugcuggccaaaagcaucuucaagcucacguaccagaacaaggugguucgcguccagcgcccugccaagaacggcaccgucauggacgugaucagccggagagaccagcggggauccggccaggucggcacguaugggcugaacaccuucacgaacauggaggcccagcuaauuaggcagauggagagcgagggaaucuucuccccaagcgagcucgagacccccaaccuggcggagcgggugcuggacugguuggagaaguacgggguagagcgccugaaaagaauggccaucuccggcgacgacugcgucgucaaaccgauagacgaccgcuucgccaccgccuuaacugccuugaacgacauggggaaaguacggaaggauaucccccaaugggagccauccaaaggcuggaacgauuggcagcaggucccauucugcucccaccacuuccaccagcugaucaugaaggacggccgcgagaucguggugccgugucggaaccaggacgagcuggucggucgcgcccgggucagccagggagcgggguggagcuuacgcgagacggccugccugggcaaauccuacgcccagauguggcagcugauguacuuccaccggcgcgaccuccggcuggcagccaaugcaaucugcucugccgugcccgucgacuggauccccaccucccgaaccaccuggagcauccacgcgcaccaccaguggaugacgaccgaagacaugcugaguguguggaaccggguguggaucgaggagaaccccuggauggaagacaagacccacaucagcuccuggggcgacgucccguaccucggcaagcgcgaggaccaaugguguggcagccugaucgggcugacagcgcgcgccacgugggccaccaacauccagguggccaucaaccaagugcggcgccucauagggaacgagaacuacuuagacuacaugaccuccaugaagcgguucaagaacgagagcgaccccgagggggcccugugguaa

SEQ ID NO: 23798 - RNA, 9879 nt, Artificial Sequence
  derived and/or modified CDS sequence (opt11) from DENV-1__GQ868632__SS-prME
agcgugaccaugcugcucaugcugaugcccacagcccuggccuuccaccucacgacccgggguggggagccacacaugaucgugagcaagcaggagcggggcaagagcuuacuguuuaagacgagcgcgggggugaauaugugcacccucaucgccauggaccugggggagcugugcgaggauaccaugaccuacaagugcccccgaauaaccgaggccgagcccgaugacguggacugcuggugcaacgccacggacacgugggugaccuacgggaccugcucacagaccggcgagcaccggcgcgacaaacgguccguggcucucgcgccccacgugggccuggggcuggagacgcgcacugagaccuggauguccuccgagggcgccuggaagcagauccagcggguggaaacuugggcacuccgccaccccggguucacggugaucgcccuguuucuagcgcacgccaucggcaccagcaucacccagaagggaaucaucuucauccuccugaugcuggugacccccuccauggccaugaggugcgucggcaucggcagccgcgacuucguagaggggcucuccggggccacuuggguggacgucgugcuggagcacgguucgugcguuaccaccauggccaaggacaagcccacccuggacaucgagcuccugaagacugaggucaccaacccagcgauccugcggaagcucugcaucgaggccaagaucucgaauacuaccacugacagccgcuguccgacccagggcgaggccacccugguggaggaacaggacgccaacuucgugugcagacgcaccuuuguagaccggggcugggggaacggcugcgggcuguucggcaaggggucacucaucacgugugccaaguucaagugcgugaccaagcuggagggcaagaucgugcaauacgaaaaccugaaguacagugucauugugaccgugcacaccggcgaccagcaccaggucgggaacgaauccacugagcacggcaccaccgcgaccaucacgccccaggcccccacgacggagauccagcuaaccgacuacggggcccugacccuggauugcagcccgagaaccggccucgacuucaacgagauggugcuccugacuaugaaggagaaguccuggcucguccacaagcagugguuccuggaccugccccuccccuggaccagcggggccagcaccucccaggagacguggaaucggcaggaccugcuggugacguucaagaccgcccacgcgaagaagcaggagguggucgugcucggcagccaggagggcgcgaugcacaccgcccugacaggugccaccgagauacagaccuccggcaccacgaccauuuucgccggccaccugaagugccgccucaagauggacaagcugacccugaagggcguuagcuaugucaugugcaccggguccuucaagcuggagaaggagguggcggagacgcagcacggcaccgugcugguccagaucaaguacgaaggcaccgacgcccccugcaagauccccuucagcacccaggacgagaagggggugacacagaacgggcggcugauaacagccaacccgaucgugaccgacaaggaaaagcccgucaacaucgaggcugagccuccguuuggggaguccuacauagugauaggcgcuggcgagaaagcacugaagcucucgugguucaaaaagggguccagcaucggcaagauguucgaggcuaccgcccgcggggcgcggcgcauggcgauucugggcgacacggccugggacuucggguccaucggcggcguguucaccagcgucgggaagcuggugcaccagaucuucggcaccgccuacgguguccucuuuucgggugucagcuggacaaugaagaucgggaucggcgugcugcugacauggcucggccugaacucccgcagcaccucccugagcaugaccugcauugccgucgggcucguaacucuguaccugggggugauggugcaggccgacuccgggugcgucauaaacuggaaggggcgggagcucaagugcgggagcgggauauucgugacgaacgagguacauaccuggaccgagcaguacaaguuccaggcggacagcccgaagagacuguccgccgccaucggcaaggccugggaggaaggggucugcggcauacggagcgcaacccgccuggagaacauuauguggaaacagaucuccaacgaacucaaccauauccugcuagagaacgacaugaaguucaccgugguggucggggacguggcgggcauucuugcccaggggaagaagaugauccggccccaaccgauggaguacaaguacagcuggaaguccuggggcaaggccaagaucaucggcgccgacguccagaacacgaccuucaucaucgaugggcccaacaccccugagugccccgacgagcagcgcgcguggaacaucugggaggucgaggacuacggcuuugggaucuucaccacgaacaucuggcugaagcugagagacagcuacacccaggugugcgaccaucgccucauguccgcggccaucaaggacagcaaggccgugcacgccgacaugggguacuggaucgaguccgaaaaaaacgagaccuggaagcucgcgagggccagcuucauugaagucaagacgugcaucuggcccaagucccauacgcuguggucgaauggcgugcucgaauccgagaugauaauccccaagaucuacgggggcccaaucagccagcacaacuaccgccccggguacuuuacucagaccgccggucccuggcaucugggaaaacuggagcucgacuuugaccugugcgagggcaccacagugguaguggacgagcacugcggcaaccgggggccaucccugcgcacuaccaccgugacggguaagaucauacacgaguggugcugccggagcugcacccugccgccccuccgcuuccgcggggaggacggcuguugguacgggauggagauccgccccgucaaggagcgggaggagaaccuggugaaguccaugguaagcgcuggcagcggcgaggucgacucguucagccuugggcugcuuugcaucuccaucaugaucgaggaggugaugcgcucaagguggucccgcaaaaugcucaugaccggcacccuggcgguguuccugcuccugaucauggggcaguugacguggaacgaccugauccgccugugcaucauggucggugcgaacgccagcgauaggauggguauggggaccaccuaccuggcccucauggcaaccuucaagaugcgcccgauguucgccgugggacuguuguuccggcgccuuaccucccgcgagguguuacuguuaaccaucgggcugagccuagucgcgucgguggagcucccaaacagccuggaggagcugggcgacgggcucgccauggggaucaugauccugaagcugcucaccgacuuccagucccaccagcuaugggccacccuguugucgcugacguucaucaaaaccaccuucucccugcacuacgccuggaagacuauggcgaugguccuuagcaucguuucccuauucccccucugcuugagcacgaccucccagaagaccaccugguugccugugcugcucggcagccuggggugcaagccgcugacgauguuccucauugccgaaaacaagaucuggggccgccggucguggccccugaacgaagggaucauggccgucggcaucgugagcauccugcucagcuccuucuuaaagaaugacgugccucuggccgggccgcucaucgccgggggcaugcugaucgcgugcuacgucaucagcggauccagcgcagaccucucccuggagaaggccgcugaggugagcugggaggaagaggccgagcacaguggcgccagccacaacauccugguggagguccaggacgacgggaccaugaagaucaaggaugaggaacgcgaugauacccugaccauccuccugaaggccacccuacucgccgugucgggaguguacccgcugucgauccccgcuacgcuauucgucugguacuucuggcaaaagaagaagcaacgguccgggguacucugggacacgcccagcccgcccgagguggagcgcgccguccuggacgacggcaucuaccggauaaugcagcgcggccugcuggggcggucccaggugggcguggggguuuuucaggagaacguuuuccacaccauguggcacgugacacgcggcgcgguccucauguaccaggggaagcggcuggagccuagcugggcuuccguaaagaaggaucugaucagcuacggcggaggguggcgccuccagggcuccuggaacacgggggaggaggugcaggucaucgccguggagcccggcaagaaccccaagaacguacagaccgcucccgggaccuuuaagacccccgaaggcgaggucggcgccaucgcccuggacuucaagcccgguacgagcggcucccccauagugaaccgggaggguaagaucgugggccuguacggcaacggggucgucaccacuagcgguaccuacgugagcgccaucgcucaggcuaaggcgucccaggaggggccgcuccccgagaucgaggacgaggucuuccguaagaggaaccugacgaucauggaccugcaccccggcucggggaagacccgccgguaccucccggcaaucgugcgcgaggccaucaagcgcaaacuacggacccugauccucgccccgacccgcguuguagccuccgagauggcggaggcccuuaaaggcaugccaauccgguaccagacgacggcugucaagucggagcacacaggcaaggagaucguggaccugaugugccacgccaccuucacgaugcggcuccugucgcccguccggguaccgaacuacaacaugaucaucauggacgaggcccauuucaccgaucccagcaguaucgcggcccgcggguacaucaguacccgggugggcaugggagaggccgccgccaucuuuaugaccgccacuccgcccggcuccgucgaggcuuuuccgcagagcaacgccgugauccaagacgaggagcgcgacauccccgagcgguccuggaacagcggguacgaguggaucaccgacuuccccggcaaaaccgugugguucguccccuccaucaagagcggcaacgacaucgccaacugccugcgcaagaacggaaaacgggugauacagcucucccgcaagaccuucgacacggaguaucagaagacaaagaauaacgauugggacuacguagucaccaccgacaucagcgagaugggagcaaacuuccgcgccgaccgagugaucgacccgcggagaugucugaaacccgugauucugaaggacgggccagagcgggucauccucgccggccccaugccggugacggucgccuccgccgcgcagaggcggggacgcaucggccgcaaccacaacaaggagggcgaccaguauaucuacauggggcagccccugaacaacgaugaggaccaugcccacuggaccgaggccaagaugcuguuggacaacaucaacacccccgaaggcauaaucccugcgcuguucgagccggagcgggagaagucggccgcgaucgacggcgaguacaggcuccggggcgaggcccgcaagacuuuuguggagcucaugcggcgcggagaccuuccaguuuggcuguccuacaaggucgccagcgagggcuuucaguacagcgaucggcgcuggugcuucgacggagagaggaacaaccaggugcucgaggagaacauggacguggagaucuggacgaaggagggggagcgcaagaagcugcggccccgguggcuggaugcgagaaccuacuccgacccccucgcacugcgcgaguucaaggaguucgcggccggccggcgcagcgucuccggggaccugauccucgagaucggaaagcuaccgcagcaccugacacagcgggcccagaaugcccucgacaaccuggugaugcugcacaacagcgagcagggcggccgagcguaucggcaugccauggaggagcuccccgacacuaucgagacacugaugcugcucgcgcugaucgccgugcugacuggcggggucacacucuucuuccuguccggccgcggacugggcaagaccagcauuggccuccugugcgugauggccuccagcguacugcucuggauggcguccguagaaccccacuggaucgccgccagcaucauccuggaguucuuccugauggugcuccugauccccgagccggaccggcagcgcaccccccaagacaaccagcuggccuacguugucaucgggcuccuguuuaugauccugacgguggccgcgaacgagaugggccuccuggaaaccaccaagaaggacuugggaaucgggcacguggccgucggaaaucaccaccacgccgccaugcucgauguggaucugcaccccgcaagcgcuuggacucuguaugccguggccacgacaauaaucaccccaaugaugagacacaccaucgagaacacgaccgccaacaucagccuaaccgccaucgcgaaccaggccgccauccugaugggacuggacaagggcuggccuaucucuaagauggacaucggggucccccuccuggcccugggcugcuacagccaggucaacccccucacucugacggcggccgucuuaaugcucgucgcccacuaugccauaaucggcccgggccugcaagcaaaggcaacccgggaggcccagaaacgcaccgccgccgggaucaugaagaaucccaccguggacggaaucguggcuauagaccuggacccugucguguacgacgcgaaguucgagaagcagcucgggcagaucaugcugcugauccucugcacgucccagauccugcugaugcggacuaccugggcccucugcgagagcaucacccuugccacggggcccuugacgacccucugggaaggcuccccgggcaaguucuggaacacgaccaucgccgugagcauggccaacaucuuccgcggauccuaccuggcgggcgccgggcuggcguucagccucaugaagucacugggcggggggcgccgcgggacgggcgcccagggcgagacccugggggagaaauggaaacggcagcucaaccagcuguccaagucagaauucaacaccuauaagcgcuccgguaucauggaggucgaccggucugaggcgaaggaggggcugaagcgcggcgagacgaccaagcacgccgugucccgggggaccgccaagcuccgcugguucguagagcggaaccuggucaagcccgagggcaaggugaucgaccugggcugcgggcgcggcggguggagcuacuacugcgccggccuuaaaaaggugaccgaggucaagggcuacacuaagggcgggcccgggcacgaggagcccaucccgauggccaccuacggcuggaaccuagugaagcugcacucggggaaggacguguucuucaucccccccgagaagugcgacaccuugcucugcgauaucggggaguccucccccaacccgaccaucgaggagggccggacgcugcgaguccugaagauggucgagcccuggcuccggggcaaucaguucugcaucaagauccugaaccccuacaugcccucagucguagagacccuggagcagaugcagcgcaagcacggcgggaugcucgugaggaacccucugucccgcaacagcacccacgagauguacugggucuccugcgggacugggaacaucguaagcgcggugaacaugaccucccgcaugcugcucaaucgauucacuauggcccaccgcaagcccaccuacgaacgggauguggaccuuggcgccggcacccgccacguggccguugaacccgagguggccaacuuggacaucaucgggcagcggaucgaaaacaucaagcacgagcacaagagcaccuggcacuacgaugaggauaacccauacaagacgugggcguaccacggcuccuacgaagucaagccgagcggguccgccagcagcauggugaacggcgucgugaagcuccuaaccaagcccugggacgugauccccauggucacgcagaucgccaugaccgacacgacccccuucggccagcagcgaguguucaaggagaaaguggauacccggaccccgaaggccaagcgcggcacggcacagaucauggaggucaccgcgaaguggcuuuggggcuuccucucccgcaauaagaagcccagaaucugcacacgugaagaguucacccgcaaggugcggagcaacgccgccauuggggcgguguucgucgacgaaaaccaauggaauuccgcgaaggaggccguggaagacgagcgcuucugggaccuggugcacaaagagcgggagcugcacaagcagggcaagugcgcuacgugcgucuacaacaugauggggaagcgcgaaaagaaguuaggugaguucgggaaggcaaagggcagcagagcaaucugguacauguggcugggggcgcgcuuccuggaauucgaggcccucggguucaugaacgaggaccacugguucucccgggagaacagccuguccggcguggaaggggagggacugcacaagcucggguacauccugcgcgacaucagcaagauccccggcggcaacauguacgcggacgacaccgccggaugggacacccguaucaccgaggacgaccugcagaacgaagcccgcaucacagacaucauggagcccgagcacgcacucuuggcuaaauccaucuucaagcugaccuaccagaacaaggugguccgcgugcagaggcccgccaagaacggcaccgugauggaugucaucagccgcagagaccagcgaggguccggucaggugggcaccuacgggcucaacacguucaccaacauggaggcccagcugauccggcagauggagucagaaggaaucuuuucccccagcgagcuugaaacccccaaccuugccgagcgcgugcuggacuggcuggagaaguacggggucgagcggcucaagcgaauggcgaucuccggggacgacuguguggucaagccgaucgacgaccgguucgccaccgccuugacggcgcugaaugauauggggaagguucgcaaggacaucccccagugggagcccagcaaggguuggaacgacuggcagcaggucccguucugcucccaccacuuccaccaguuaauuaugaaggacggccgggagauuguggucccgugccgcaaccaggacgagcuggugggccgggcccgggugagccagggcgcuggguggagccugcgcgagaccgcaugccucgggaagucauacgcccagauguggcaauugauguacuuccaccgcagagaccugcgccucgccgcgaacgccaucugcucagccguccccguugacuggauccccaccucccggacaacauggucgauccacgcccaccaccaguggaugacgaccgaagacaugcuguccguauggaaccgcguuuggaucgaggaaaacccauggauggaagacaagacccacaucagcuccuggggcgacgugccguaccuggguaagcgcgaggaucaguggugcggcucuuugaucgggcugacggcccgagcgaccugggcaaccaacauccagguugcgaucaaccagguccgccggcuaaucgggaacgaaaacuaccuugacuacaugaccucuaugaagagguucaagaacgagagcgacccagagggugcccugugguga

SEQ ID NO: 23799 - RNA, 9879 nt, Artificial Sequence
  derived and/or modified CDS sequence (opt11) from DENV-1__GQ868633__SS-prME
ucaguaaccaugcuacuaaugcuuaugccgacagcccuggcguuccaccugacaacaaggggcggcgaaccccacaugauaguuucgaaacaggaacgggggaaaagccuauuauuuaaaacauccgccggaguaaacauguguacucuaauagccauggaccucggcgaacuaugcgaagacacgaugacguacaagugcccaaggaucaccgaagccgaacccgaugaugucgacuguuggugcaaugcuacugacacuugggucaccuacgguacauguagccagacgggagaacaccgaagggacaaaagaucgguagcgcuugcaccccacguaggccucggacuagaaacacgaacagaaaccuggaugucaucagaaggagccuggaaacagauacagcgugucgaaaccugggcgcuccgacacccaggcuucacagugaucgcacuauuccuugcacacgcgauaggcaccuccauuacccagaaaggaauaauuuuuauacugcuuauguuagucacuccaucuauggcgaugcggugcguaggcaucggaucucgggacuucgucgaagggcuuucaggagcaaccuggguagauguagugcuugaacacggcucgugcguaacgacgauggcaaaggauaagccgaccuuggacaucgagcugcuuaaaacagagguuacuaacccugccauacuccgaaagcuaugcauugaagcuaaaaucucgaacaccacgacggacagccgaugccccacacagggagaggcgacgcucgucgaggaacaagaugccaacuucgucuguagacgaaccuucgucgaccguggauggggaaacggcugugggcuauuuggcaaagggagcuuaauuacaugugcaaaauucaaaugcgugacgaaacuugaagguaaaaucguacaauacgagaauuuaaaauacuccguaaucgucacaguccacacaggggaccagcaccaggucggaaacgagucgacggagcacgggacgacggcaacaauuaccccacaagccccaacgacagagauucaacucacggacuauggggcucuaacauuggacuguaguccacggacaggcuuagacuucaacgaaaugguacugcucacaaugaaagagaaaucauggcuuguacacaagcaaugguuucucgaccuuccguuaccauggacaagcggcgccuccaccucacaagagacguggaacagacaagacuuacuuguaaccuuuaaaaccgcccacgcuaaaaagcaagaaguagucguucuggggucacaggagggggccaugcacacggcgcuaaccggggcgaccgaaauacaaacuagcggcacgacaacgaucuucgccgggcaccuaaagugccgacucaagauggauaagcuaacccucaaaggcaugucauacguaaugugcacaggcuccuucaaacucgagaaggaggucgcugaaacgcaacauggaacagucuuagugcaaauaaaauacgaggguaccgacgcccccugcaagaucccuuuuucuacucaagacgagaaaggaguaacgcagaacggacggcuaauuacagccaaccccaucguaacagacaaggagaaaccaguaaacauagaagcggaaccacccuucggcgaaucauauauuguaauuggagcaggggaaaaagcgcugaaguuaucgugguucaaaaagggcaguagcaucggcaaaauguucgaagcgacagcacggggagcgaggcguauggccauucuaggcgauaccgcgugggacuucggcagcauaggcgggguauucacaucagucggaaaacugguccaucaaauauucgguacagcguaugggguacuguuuaguggcgucagcuggacuaugaaaauaggcauaggaguauuacuuaccugguuaggcuugaacucgcgaagcaccucucugagcaugaccugcauagccgucggacuugucacacucuacuuaggggugaugguucaagccgacuccggcugcgucaucaacuggaaaggaagggagcucaaaugugggagcggaaucuuugugacgaacgaaguucacaccuggacagaacaauauaaguuccaggcggacucgccgaaaagacuuagcgcugccauaggcaaagcaugggaagagggaguuugcggaauccgauccgcaacacgacucgaaaacauuauguggaagcaaauaucuaacgaacugaaccacauccuccuugaaaaugacaugaaauucaccguuguggucggcgacguagcuggaauccucgcucaaggcaagaagaugauacgaccccagccgauggaauauaaguauuccuggaaaucguggggaaaggcgaaaaucaucggagcagaugugcaaaauaccacauucauaaucgacggcccaaauacgccggagugcccggacgaccaacgggcauggaacauaugggaggucgaagauuacggguucgguauuuucacgacgaauauaugguugaaacuucgagacuccuauacccaagucugcgaucaucggcugaugucagcggccaucaaagauagcaaagccguacacgcagauaugggauacuggaucgaaucagagaagaaugagaccuggaaauuggcaagagcaucauucauugaagugaagacguguauauggcccaagucucauacgcucugguccaacgggguacucgaguccgaaaugauaaucccaaaaauauacggggguccaauaagucaacacaauuacagaccaggauacuucacacaaaccgccggacccuggcaucuggguaaacuugaacuggacuuugauuuaugcgagggcacgacagucguaguggacgagcacugcgggaaccggggacccagucuaaggacaacaacgguaacgggcaaaauaauccacgaauggugcugccguucaugcacccucccaccccuaagguuucgaggugaggacggcugcugguacggaauggaaauccgcccaguaaaggagaaagaagaaaaccucguuaaguccauggucagcgcaggcucaggcgaaguggauuccuuuagcuuagggcuccugugcaucucgauaaugauagaggagguaaugcgcagccgcuggucccgaaaaaugcucaugacaggcacccuugcaguauucuuacugcucaucaugggccaacuaaccuggaaugaccugauucggcuaugcaucauggugggagcaaacgcaagcgaccgaaugggcaugggaacgacauacuuagcccucauggccacauuuaaaaugagaccgauguuugccguuggacuuuuguuuagacgccucaccucgcgagaggugcugcuccugacaauaggucuaagucuagucgcaagcgucgagcuucccaacucgcuagaggaguuaggcgauggccuagcgauggggaucaugauccuaaagcuccuuaccgacuuccaaucacaccagcugugggcgacauuacucagccuaacuuucaucaaaacuaccuucagccuucacuacgccuggaagaccauggcaaugguccucagcauagugucacuguucccacuaugucucagcacaacaucccagaaaaccaccuggcuaccaguacuccuuggcucccucggcuguaagccacuaacgauguuccuuaucgcagagaacaaaaucuggggcaggaggagcuggccucuaaacgaaggcaucauggcugucggaauagucucuauucuauugagcagcuugcucaaaaacgacguuccacucgccgguccacugauagccggcggaaugcuaauugccugcuacgugauaucagggaguagcgccgaccuaucccuggaaaaagcggcagagguaagcugggaagaagaggcagaacauagcggcgcgagccacaauauccuagucgaagugcaagacgacggcacgaugaaaauaaaggacgaagagagggaugacacacuaaccaucuuacucaaagcgacccucuuggcaguuagcggaguguacccucucucaauacccgccacccuguucguaugguauuucuggcagaagaaaaagcaacggaguggcguccuaugggauaccccgaguccacccgaaguagaaagggcaguccuggaugacggcauauaccgcauaaugcagcgcggacuucuaggaaggucccaagugggcgucggcguauuccaagaaaacgucuuccacacaauguggcacguaacgcggggagcaguccucauguaucaagggaaacggcuugagccgagcugggcaagcgucaagaaagacuuaaucucguacggcgguggcuggagacuccaagguucauggaacaccggagaagagguccaagucauagcaguugaacccgggaaaaacccgaaaaauguacagacagcuccaggcaccuucaaaacaccugagggggagguaggcgcaaucgcgcuagacuucaaaccaggaacgucaggaagccccaucgucaaccgagaagggaaaauugucggacuauacggaaacgguguaguaacaaccucggggaccuacguaagcgcaauagcucaggcgaaggccagccaagagggcccccuuccggagaucgaagacgagguuuucagaaagcgaaaccuuaccaucauggaccugcacccaggaagcggaaaaacaaggcgauaucugccugccauuguucgggaggcgaucaaaagaaaauugagaaccuuaauucucgcaccuacuagagucguagcgagcgagauggccgaagccuuaaaagggaugccaaucagauaucaaacuaccgccgugaaaagugagcacacaggcaaagagauuguagaccugaugugccaugccacauucaccaugcgacugcugagccccguccguguaccgaacuacaacaugauaaucauggacgaggcucacuuuacagaccccagcagcauagcagcacguggcuacauaagcacuagaguagguaugggcgaagcagcggcgauauucaugaccgcaacgccgcccggaucaguagaggcauuuccgcaauccaacgcagugauacaagacgaagagagagacauucccgagcguuccuggaauagcggauaugaguggauuacagauuuucccggcaaaacuguaugguucguaccaucaaucaaaucgggaaacgacauugccaacugccuucgcaaaaacggaaagcgcgucauccagcugucuaggaagacauucgacaccgaguaucaaaagacuaagaacaacgacugggacuauguagugacgaccgacauaagcgaaaugggcgccaacuucagagccgauagggucaucgacccccgucguugcuuaaagccagucauccuaaaagacggcccagaacgcguaauacucgcaggcccgaugcccgucacgguagccuccgcggcacagcgccggggacguauaggcagaaaccacaacaaagaaggagaccaguauaucuacaugggacagccacuaaacaacgacgaggaccacgcccacuggaccgaagccaagaugcugcuagacaacaucaacacuccagaaggcaucauuccagccuuauucgaaccagagcgcgagaaaagcgccgcaaucgacggcgaauaccgauuaaggggcgaggcacgaaagaccuuugucgaacugaugcgacgaggugaucugcccgucuggcuaaguuacaaagucgcaagcgaaggcuuucaauauucugaccgucgcugguguuuugacggugaacguaacaaucaaguccucgaggaaaacauggauguugagauauggacaaaggaaggggaaagaaagaaacuacgaccacgcuggcucgacgcuaggaccuauucagacccacuggccuuaagagaguucaaagaguucgccgcugggagacgcucagucagcggagaccuuauacuagaaauaggaaaacucccgcaacaccugacccaaagggcacaaaacgcacucgauaaccuugucaugcugcacaauagcgaacagggaggcagggcauacaggcaugccauggaagaacuaccugacaccaucgagacucuaauguuacucgcccuaauagccguccucacuggaggaguaacccuauucuuucuguccggccgaggacucggcaagacaucuauaggccuacugugcguuauggcaucgagcguacugcuauggauggcaagcgucgagccgcacuggaucgcggccagcaucauccuugaguucuuccuaauggugcuccuaauaccugaacccgacagacaaagaacgccccaagacaaccaacuagcuuacguaguuaucggucuccucuucaugauacuaacaguugcagcgaaugaaaugggacuccucgaaacaacuaaaaaggaucuaggcaucggccauguagcaguaggcaaccaccaccacgcugccaugcuggacguagacuuacaucccgcaagcgccuggacacuauacgcaguugccacgacgaucaucaccccgaugaugaggcacacaauagaaaacacgaccgcaaacaucucccucacggccaucgccaaccaagccgccauauuaaugggguuggacaagggauggccuauaagcaaaauggacaucgguguaccacuucuugcccuuggcugcuacucccagguaaauccauuaacacuuacagcugcggugcuuaugcucguagcucacuacgcuauaauaggcccuggguugcaagcgaaagccacccgggaggcacaaaaacgaacagcagcaggaaucaugaagaacccuacugucgacgggauaguugccaucgaccucgaccccgugguguacgacgccaaauucgaaaaacagcucggacaaauaaugcuacucauccuuuguacgagucaaauccuauugaugcgcacgacaugggcccugugugaaucaaucacacuugcaacagguccccucaccaccuugugggaagggucgccaggaaaauucuggaauacuacgauagcgguuucuauggcgaacauauuuagggggucauaccuggcaggagcgggacucgcuuuuucacuuaugaagucacuaggagggggacgcagagggaccggugcccaaggcgaaacucuaggugaaaaauggaagagacaacuaaaucagcuaucaaaaagcgaauuuaauacguacaaaagaucaggcauaauggagguugacaggagugaggcuaaagaggguuuaaaacggggcgaagcaaccaaacacgcagugagccgaggacccgccaaauugcggugguucguugaacgcaaccucguaaacccagagggaaaaguuauagauuuaggcuguggccgcggcggguggagcuacuacugugcaggacucaagaaaguuaccgaggugaaaggauacacgaaaggugggcccgggcacgaagaaccaauccccauggccacguacgguuggaaccucguaaaacuccacucgggaaaagauguauucuucaucccaccugaaaagugcgacacccugcugugcgauauaggagaaucauccccaaacccaacuauagaggaaggacgaacacuucgcguacuaaaaauggucgagccauggcuacgcggaaaccaguucugcauaaaaauacuaaaucccuacaugccgucugucguugagacucuggaacagaugcaacggaagcauggagggaugcucgucagaaacccacucagccgcaauaguacacacgaaauguauuggguaagcugcggaaccggcaacauagucuccgcugucaacaugaccagccgcaugcuacucaaccgcuuuacuauggcucaccgcaaaccaacauacgagcgugacguggaccuaggcgccgggacacgacacguggcgguggaaccggaaguggccaacuuagacauaaucggacagcgcauagagaacauaaaacacgaacacaaaagcacuuggcacuaugacgaagacaaccccuauaaaaccugggcauaccacggaagcuaugaggucaagccaucaggaucagcgagcucaauggugaacggaguaguaaaauugcuaaccaaacccugggacgucauccccauggugacacagauagccaugacggauaccacaccguucgggcaacaaagagucuuuaaggaaaagguagauacccgaacgccaaaggcgaaaagaggaacugcacaaaucauggaaguaacggcaaaauggcuguggggauuccucucucguaacaagaaaccucgaauaugcacgagggaagaguucacucgaaaagucaggagcaacgccgcuaucggggccgucuuuguggacgagaaccaauggaacagugcaaaagaagccguagaggacgaaagguucugggaccuagugcacaaggaaagggaacuucauaagcaagguaaaugugcgacgugcguguacaacaugaugggcaaacgugaaaagaagcucggcgaguucggcaaagcaaaagguagcagagccaucugguacaugugguugggggcccgcuuccuggaguucgaagcauuaggcuucaugaaugaggaccauugggucagccgagagaacagccuuucuggaguagaaggcgagggacuacacaagcucggcuacauacucagggauauaucgaaaauaccagguggcaacauguacgcugacgacacagcgggaugggauacuagaaucacugaggacgaccuccagaacgaggcacgaaucacagacauaauggagcccgaacaugcacuccucgcgaagaguaucuucaaacuuaccuaucagaacaaggugguccgaguccaaagaccagccaaaaauggaacgguaauggacgucauauccagaagggaccaacgcggcagcgggcaggucgguacauacggacugaacacauucaccaacauggaagcacagcuaauucggcagauggaaagcgagggcaucuucagccccucagagcucgagaccccaaaccuggcggagcgcgugcuggacugguuagaaaaauacggaguggaaaggcucaagcguauggcaauaucgggagacgacuguguuguaaagccaauagacgaccgauucgcuaccgcccucacagcgcuaaaugacauggggaagguucguaaggacaucccccaaugggaaccauccaagggguggaaugacuggcaacaagucccauucuggagccaccauuuccaccagcuaaucaugaaagacgggagggagaucgucguccccugucgcaaccaggaugagcugguaggccgugcgagggugagccaaggcgcgggauggucacuacgagaaacggccugcuuagggaaaucguacgcucagauguggcaacuaauguacuuucaccgacgagaucuuaggcuugcggccaacgcaaucugcucggcugucccgguggacuggaucccgaccucucgcacuacguggucgauucaugcccaucaccaauggaugacaacagaggacaugcuuucuguauggaaccgaguauggaucgaagagaacccuuggauggaggacaaaacacacauaucgagcuggggagacgucccuuaccuugggaagcgagaggaccaauggugcgggucucuuauaggccuaaccgcacgggccaccugggccacgaauauccaaguggcuauaaaccagguacgcaggcucaucgggaaugagaacuaccuggauuauaugacaucuaugaaaagguucaaaaacgagucagacccugagggggcccuaugguag

SEQ ID NO: 23800 - RNA, 9879 nt, Artificial Sequence
  derived and/or modified CDS sequence (opt11) from DENV-1__GU131919__SS-prME
ucaguaacuaugcuccugaugcugaugcccacggcccuggccuuucacuuaaccacgagaggaggggaaccccacaugauaguguccaaacaagaacgagggaaaagccuacucuucaaaaccagcgccgggguaaacaugugcacccugaucgcgauggaucuuggugaacuuugcgaagacaccaugacauacaaaugcccaaggaucacagaagccgaaccagaugacguugacugcugguguaacgcgacagauacaugggucacauacgguaccugcucacaaacgggggaacacagacgcgacaagaggaguguagcacucgcgccgcacgugggguuagggcuggaaacgcggaccgaaaccuggaugucgucagaaggggcuuggaaacagauacagcgggucgaaacgugggcacucagacacccgggguucacaguuauugccuuguuucucgcccaugcaaucggaacgucgauaacgcagaaagggauuauauucauacugcuaauguuaguaacgccaucuauggccaugcgcugcguugggaucgguagucgcgauuuuguugaagggcuaucgggagcaaccugggucgaugucgucuuagagcacggaagcugcgucacaaccauggcaaaagacaaaccgacacuggacaucgagcuucuaaaaaccgaagugaccaacccugcaauccucagaaaacuaugcaucgaagcgaaaauaucaaacacaacaaccgauucccgaugcccaacccagggagaagcgacacuggucgaagaacaagacgcgaacuuuguaugccgccguaccuuuguagaccgcggcugggguaauggcugcggacucuucgggaaaggcagcuuaaucacgugcgcgaaauucaagugcguaacgaaacuugagggaaagauuguacaauaugaaaaccucaaauacagcgucauaguuacaguucauacuggagaccagcaccaaguaggcaaugagucaaccgaacacggcaccacugcaacuaucacaccucaggcaccaacaacggaaauacagcucacagauuauggggcccuaaccuuggacugcaguccgcggacaggucuggacuuuaaugaaaugguccuccucacgaugaaggagaaguccuggcucguacacaagcaaugguuccucgaccucccacuaccauggacaagcggcgccuccaccucccaggaaacguggaacagacaggaucugcugguaaccuucaagacagcacaugcaaagaagcaagaagucguaguccucggaucgcaggagggagcuaugcauacagcccugaccggagccacggagauacagaccucggggaccaccacgauauucgcaggucaccugaaaugccguuuaaagauggacaagcuaacccucaagggaaugucauacguuauguguacaggcuccuucaagcuagagaaggaagucgccgagacacaacacggaacggugcuaguacaaaucaaguacgaaggaaccgaugccccaugcaaaauaccguuccugacccaagaugaaaagggugucacacagaaugggcgccuuaucacggcgaacccgaucgugacggauaaagaaaaaccagugaacaucgaggcagagcccccauucggggaaagcuacauaguaauuggagcuggcgagaaagcccuuaaauugagcugguuuaagaaaggaagcucuaucggcaaaauguucgaagccacggcccgaggugcaagacggauggccauacucggggacacggcaugggacuuuggcucgaucggcggugucuucaccucgguaggcaagcugauccaccaaaucuuugggacggcguacggcguccuguucuccggcguauccuggacaaugaagaucggaaucggaguccuacugaccuggcuggggcucaacucacgaagcaccucgcugagcaugacuugcaucgcaguagggcucgugacccucuaccuaggcguaaugguacaagcugacuccggguguguuauuaacuggaaaggacgagaguuaaaaugcggcagcgggaucuuugucacuaaugagguacauaccuggaccgaacaguauaaauuucaagcggacucucccaagaggcucagcgccgccaucggaaaggcgugggaggagggcgucuguggaauacguagugcaacgaggcuggagaacauaauguggaaacaaauaucaaacgaacuaaaccacauccuguuagaaaacgauaugaaauucaccguggucguaggcgacguagcgggcauccucgcgcaaggcaagaaaaugaucagaccccaaccaauggaauacaaguauagcuggaaaucguggggaaaagcaaaaaucauaggggcagacguccaaaacaccacguucauaaucgacgggcccaauacacccgaaugcccagacgaccagagggcauggaacauaugggaagucgaggacuauggcuuuggaauauucaccacaaauauuugguuaaaacuacgggacucguacacacagguuugcgaucaucgacuaaugucagcagcgaucaaagauucaaaagccgugcaugcggacaugggauacuggaucgaaagcgagaaaaaugagaccuggaaacuagcacgagccagcuuuauagaaguaaaaaccugcauauggccaaagagccauacccuauggucaaacggcguacucgaguccgaaaugaucauaccaaagauauaugguggaccaaucucacagcacaacuaucgcccaggauauuuuacucaaacggcuggaccguggcaccugggaaaacuagaacuugacuuugacuugugcgagggaaccacagucgugguggaugaacacugcggaaaucgcggcccuucccugcguacgacgacggucaccggcaagaucauucacgaguggugcugccgauccugcacacuuccgcccuugagguucagaggagaggauggcugcugguacggcauggaaauaaggccagugaaagagaaagaggaaaaucucguaaagucaaugguuagcgcgggaucaggugaaguagacagcuucagccucggccuccuuugcaucucgauuaugaucgaagaaguuaugcgaagcagauggaguagaaagaugcucaugacugggacccucgcaguuuuccugcuauugauaaugggacagcucaccuggaacgaccuuauccggcucugcauaaugguaggcgcaaacgccugugaucgcaugggcaugggaacgacauacuuggcccugauggcaacguucaagaugcgcccaauguucgcagucgggcucuuguuccgacgauugacaucgcgcgaaguccuacugcuuaccaucggacucagucugguggcuagcguggagcuacccaacucccucgaggaacuaggagacgggcuagccaugggcaucaugauauugaagcugcucaccgacuuucaaucauaccaacugugggcuacccuccugagucugaccuuuauaaaaaccaccuuuagccuacauuacgccuggaagacaauggcaauggugcuaucuaucgugucacuauucccucugugccucuccaccacaagccagaagaccacauggcuucccguacugcuagggagcuuaggcugcaagccacucaccauguuccuaauugcagaaaauaaaauauggggaagaagaagcuggccacugaacgaagguauuauggcagucgguauaguaucuauccuccuaucgucacuguuaaagaaugacgucccgcuggcgggcccgcuaauagcagggggaaugcuaaucgcgugcuacgucauuagcggaagcagcgccgaccuaagccuggaaaaggcugcagaggugucaugggaagaggaggcggaacacuccggcgcgagccacaauauccugguugaagugcaggacgacggaaccaugaaaauaaaggacgaagaacgugaugauacauugacuauccuauuaaaagcaacacucuuggccgucucggggguguacccgcugucgauccccgcaacucuuuucgucugguauuucuggcagaaaaagaaacaaagauccggcguacucugggacaccccuucaccaccggagguggaaagggcgguccuagacgacgggauuuaucgcaucaugcaaagaggccuccucggucguagccaaguaggcguagggguauuccaagagaacgucuuccauaccauguggcaugucacgcgcggugcagucuuaauguaucaaggcaagcgucuagaacccucuugggcaucaguuaagaaagaccucaucucguauggaggaggauggcgauuacaggggucuuggaacacaggcgaagaagugcaagugauagcaguugagccaggcaaaaaucccaaaaacguccaaacugcgccagggacauuuaaaaccccagaaggggaaguaggggcaauagcucucgauuucaaacccgguacgagcgggucgcccauagugaaccgggaaggaaagauaguaggacucuacgggaacggagugguaaccacaagcggcacauacguuagcgcgauagcgcaggcaaaagcuagccaagaagggccgcucccagaaauagaggacgaggucuuucggaaaaggaauuugacgaucauggacuugcaccccggcaguggcaagaccagacgauaucugcccgccaucguuagagaagcuaucaaaaggaagcugcgaacgcucauacuugcgccgaccagaguggucgcaagcgaaauggcggaggcccucaaaggcaugcccauccgauaucaaacaacggcaguaaagucagaacauaccggcaaggaaauagucgaccucaugugccacgcuacguucaccaugcgccuucucaguccggugcguguacccaacuacaacaugaucauaauggaugaagcucauuucaccgauccgagcucgauagccgcccgaggauauaucagcacgcggguaggaaugggagaggcugcugcaaucuucaugacggcaacaccgcccggaagcguagaagcguucccgcaaucuaacgcagugauacaagacgaggaaagggacauccccgagcguaguuggaacuccggauacgaauggauaacagacuucccagggaaaaccguaugguuugugcccucgaucaagucgggaaaugacaucgcaaauugccuacggaaaaacggcaaaagggugauccagcuaagccgcaaaacuuucgacacagaguaccagaaaacgaagaauaacgauugggauuacguagucacgaccgauauauccgagaugggugccaacuuuagagcagacagagugauugacccuaggcggugccugaaacccgucauccugaaggacggcccagagcgcguaauacuggcgggcccaaugccagucacgguggcuagugcagcucaacgacgaggccggauuggacgaaaccacaacaaagagggcgaccaauauauauacaugggucaaccacugaacaaugacgaagaccacgcacacuggaccgaagcaaagauguugcuagauaauaucaacacccccgaaggcaucaucccagcgcuauucgagccagaacgcgagaaaagcgcggcaauugacggcgaauaccggcuaagaggagaagccagaaaaacguuuguugagcuaaugagacgaggcgaccuccccguguggcuaaguuacaagguagcgagugaaggguuccaguacucagaccgcagauggugcuuugauggcgaaaggaacaaccagguacuggaagagaacauggacguagaaauauggacaaaagaaggcgaacgcaagaaacugcgaccgagguggcucgaugcgcguaccuacagcgacccacuggcccuacgcgaguucaaagaguucgcggcagggcgacgaucggucucgggagaccugauacuagagaucggaaaguuaccacaacaucuaacgcaacgggcgcagaacgcccucgacaaucuggucaugcuucauaauagcgagcagggcggcagagcuuaccgccacgcgauggaggaacuccccgauacaaucgaaacccuaauguugcuugcccuaaucgcagugcuaacaggaggggugacuuuguucuuuuuguccgggcgcggacuuggaaagacgagcaucgggcuauugugcguaauggcuagcucaguccuacuguggauggcaucaguggagccucacuggaucgcugcgucaaucauucuagaguucuuccucauggugcugcuaaucccagaaccggaccggcagcgcaccccacaggacaaccagcucgccuacguagugaucgggcuacucuucaugauacugacaguagcggccaacgaaaugggccugcuagaaacaacuaaaaaggaccuaggaaucggccacguagcaguggggaaucaccaccacgccgcaauguuagacguagaccuacauccagcauccgccuggacccuauacgccguggcaaccacaauaauuaccccuaugaugagacacaccaucgaaaacaccacggcuaacaucagucuaacagcaauagcaaaccaggcggcaaucuuaaugggacuggacaaaggguggccgauaagcaaaauggacaucggagugccauugcuugcgcuggguuguuacagccaagugaauccucuaacgcuaaccgcagcgguccucaugcucgucgcgcauuacgcgauaaucggaccaggccuccaagcgaaggcaacaagggaagcccaaaagcgcaccgcggcuggaaucaugaaaaauccaaccgucgauggaauagucgcgauagacuuggaccccguuguguacgacgcaaaauucgagaaacagcucggacaaaucaugcugcugauucugugcacgucccagauacugcuuaugcguacaaccugggcuuuaugcgaaucgauaacacuagccaccggaccccucaccacacucugggagggaucuccaggaaaguucuggaacacaacaauagcugucucgauggcaaauauauucagaggcagcuauuuagcgggagccgggcuagccuuuucgcuuaugaaaucauuggguggagggcgucgcggcacuggcgcgcagggcgaaacccuuggagagaaguggaagcgucaguuaaaucaacuaagcaaaagcgaguucaacacauacaaacgcucgggcaucauggaagucgacagauccgaggccaaagaaggccuaaaaagaggugaaacaaccaaacacgcaguaucgaggggcaccgccaaguugcggugguuuguggaacgaaaccuagugaagccugaagggaaaguaauagaccuaggaugcggacgaggaggguggaguuacuacugcgcuggacuaaagaaagucacagaaguuaaaggcuauacaaaagguggacccggccacgaggagcccauaccaauggcaacuuacggcuggaaccuagucaaacuccacucaggaaaggacguauuuuucauaccgcccgagaaaugcgacaccuuguuaugugacauaggugagagcaguccgaacccgacuauagaagagggacgaacgcucagaguucucaagauggucgagccguggcugagaggcaaccaauucuguauaaaaauccuaaacccguacaugccuagugucgucgagacauuagaacaaaugcagaggaaacacggagggaugcucgucaggaauccccuuucccgcaauucaacccacgagauguacugggugucaugcggcacgggcaauaucguaagcgcaguaaacaugaccagucgcauguuguugaaccgcuuuacaauggcccacagaaagccaacuuacgaacgggauguagaccucggggccggaacccggcacguugcugucgaacccgaaguggccaaccuggacauaaucggccaaagaaucgagaacauaaaacaugagcacaaauccacguggcacuacgacgaagacaaccccuauaaaaccugggccuaccacggaagcuaugaagucaaaccgucaggaagugcaagcuccaugguaaacggaguggucaaacugcuuaccaaaccaugggaugugauccccauggucacgcaaaucgcgaugacggauacgacacccuuuggacaacaacgcgucuucaaagaaaagguggauacaaggacgccaaaagcaaaacgggggacagcccagaucauggaggugacggcgaaaugguuauggggauuccucaguagaaacaagaaaccccgaauaugcacgcgcgaagaguucacgagaaagguaagaagcaacgcagccauaggggcgguguucguagaugaaaaccaauggaacucagcgaaggaggcggucgaagacgaaagauuuugggaccucguccaccgagaacgagagcugcacaaacaggggaagugcgcgacgugcgucuacaacaugauggggaaacgcgagaagaaacugggcgaguucggaaaggcaaagggcagccgagccaucugguauauguggcugggugcccgcuuccuagaguucgaggcccucggcuucaugaacgaggaccacugguucagucgagagaacagccucagcggcguggaaggggaaggacugcacaaacugggguacauccuacgcgauauaagcaagauccccggcgggaauauguaugcagaugacaccgcuggaugggacacgcguaucacagaagacgaccuucaaaacgaagcgcggaucacggauaucauggaaccagagcaugcacuacuugcgaaaagcaucuuuaaacugacauaccaaaacaaggucgugcguguccagcgaccugccaagaacggcacagugauggacgucauuucgcgucgugaccaaaggggcucgggucaggugggaaccuauggacuaaacaccuuuaccaacauggaagcccaacucauaaggcagauggaaucggaggggauauucucacccagugaacuugaaacgccuaaccucgcagaacgaguacuagacuggcuagaaaaauacgguguugagaggcuuaagcgcauggcuauuaguggagacgacuguguagucaaaccaauugacgauagauucgccacagcguuaacagcuuugaacgauauggggaagguacgcaaagacauaccgcaaugggagccaagcaaaggguggaacgacuggcagcagguuccguucugcucacaccacuuccaccaacuaauaaugaaggacgggcgcgaaauaguaguccccugccgaaaucaggacgaacuuguaggcagggcgcgcgucucacaaggggccggguggucccugcgcgaaacggcgugcuuagggaaaagcuaugcccaaauguggcaacucauguacuuccaccgccgagacuugcgccuagcugcgaaugccaucugcagcgcaguaccgguggauuggauuccaacaagucgcacgacauggucgauacacgcccaccaccaauggaugacaaccgaggacaugcugucgguuuggaauagggucuggaucgaggagaauccuuggauggaagacaagacccacaucagcagcuggggcgacguaccguaccuaggcaagcgagaagaccaguggugcggcagucucauagguuuaaccgcaagagcuacgugggcaaccaauauccaagucgcuaucaaccagguacgucgauuaauaggcaacgagaauuaucucgacuacaugaccucgaugaagagauuuaaaaacgaaagcgaccccgaaggggccuuaugguga

SEQ ID NO: 23801 - RNA, 9879 nt, Artificial Sequence
  derived and/or modified CDS sequence (opt11) from DENV-1__GU131920__SS-prME
agcgucaccaugcugcucaugcugaugcccaccgcccuggccuuccaccucaccaccagaggcggugaaccucauaugaucgucagcaagcaggagagggggaagagccugcuguucaagaccagcgccggggugaacaugugcacacuuaucgccauggaccugggcgaacugugcgaagacacgaugaccuacaagugccccaggaucaccgaggcugaacccgacgacgucgacugcuggugcaacgcaaccgauacgugggugaccuacgggacuugcucccagacaggggagcaccggcgcgacaagcgcuccguggccuuggcgccacauguggggcuggggcuggagacgcgcacugagacauggauguccagcgagggcgccuggaagcagauccagcgggucgagacaugggcccuccgacaccccggguucaccgugaucgcccuguuccuggcgcacgccaucggcaccagcaucacccagaagggaauuauauucauccuauugaugcugguuacccccuccauggccaugcggugcgucggaaucgguagcagggauuucguggaaggacucuccggugccacauggguggacguaguguuggagcaugggagcugcgugaccacgauggccaaagacaaacccacacuagacaucgaacuccuuaagacggaggucaccaacccugcuauccugaggaaguugugcauugaggccaagaucuccaacaccaccaccgauucucgcugccccacacagggcgaggccacccuuguggaggagcaggacgccaacuuugugugccggcgcacauucgucgaccggggaugggggaacggcugcggacuguucgggaaggggagucucauuacgugugccaaguucaagugcgugacgaagcuugagggcaagaucgugcaguaugagaauuuaaaauauagcgucauugugaccgugcacaccggagaucagcaccaagucggcaacgagucgacggagcacggcacaaccgcgaccaucacgccacaggcucccacgacagagauccagcucaccgacuacggugcccugaccuuggacugcagcccccguacgggcuuagauuucaaugagauggugcuccugaccaugaaggagaaguccuggcugguucacaagcagugguuccuugaucugccccucccguggaccuccggugcgagcaccucccaggagacguggaaucggcaagaccugcucgugaccuucaaaacugcccacgcgaagaagcaagagguggucguccucggaagccaggagggcgcuaugcacaccgcccugacgggggcuacugaaauucagaccuccggcaccacgaccaucuucgccgggcaccucaagugccgccucaagauggacaaacuaacccugaagggcaugagcuacgugauguguaccggauccuucaagcucgagaaggaagucgcggagacgcagcacggcacuguccuggugcagauaaaguacgagggcaccgacgccccuugcaagauccccuucucaacacaggacgagaagggggucacgcaaaaugggcggcuaaucaccgccaacccgaucgugaccgaccgcgagaagcccgugaacauugaggccgagccgcccuucggagaguccuauauaguuaucggcgcgggcgagaaggcccuuaaacucagcugguuuaagaaggggaguagcauugggaagauguucgaggccacagcccgcggggcacgucgcauggccauccuuggcgacaccgccugggauuucggcuccaucggcggcguguucaccucaguggggaagcugguccaccagaucuucgguacggcguacgggguacuguucuccggcgugagcuggaccaugaaaaucggaaucggcguccugcugacuuggcucggcuuaaauucccggagcaccucccugagcaugaccugcauugccguggggcucguuacauuauaucugggcgucauggugcaggccgacuccgggugcguuauaaacuggaaaggccgcgagcucaagugcgggucgggcaucuuugucaccaacgagguacauaccuggaccgagcaguacaaguuccaggcugauaguccaaagcggcuguccgccgccauaggcaaagcgugggaggagggagugugcggcauucgcagcgcuacccggcuggagaacaucauguggaagcagauuuccaacgagcucaaccacaucuugcuggagaacgacaugaaguucaccguugugguuggggacguagcgggcauccuggcccaggggaagaagaugauccggccacagccgauggaguacaaguacuccuggaaguccuggggcaaagcaaagaucaucggcgcugacgugcaaaacacgaccuucaucauugacggccccaacaccccggagugccccgacgaccagcgggcguggaacaucugggagguggaggacuacggcuucgggaucuucacaacgaauaucuggcuuaagcugcgagacagcuacacccaggucugcgaccaccggcucauguccgccgccaucaaagauucuaaagccgugcacgcggacaugggguauuggaucgaaucagagaagaacgagaccuggaagcuggcgcgcgcgagcuucaucgaggugaagaccugcaucuggccgaaaagucacacgcuguggagcaacggcguccucgaauccgagaugauuauccccaagaucuacgggggcccgaucagccaacauaacuaccggcccggcuacuucacccagaccgccggacccuggcaccuugggaaacuggagcucgacuucgaccugugcgagggcaccacggugguugucgacgagcacugcgggaaccgcgguccgucccugcggaccaccaccgugacgggcaagaucauccaugaguggugcugcagaaguugcacuuugccaccccuccgguuccgcggggaggauggcugcugguacgggauggagauucggcccgugaaagaaaaggaggagaaccuggucaaguccauggugagcgccggcagcggagagguagacaguuucagucucggauuacugugcaucagcaucaugaucgaggaggucaugcgcagccgguggagccgcaagaugcucaugaccggcacccuggcaguguuucuacuccugaucauggggcagcugacguggaacgaccuaauccgccuguguaucauggugggcgcgaacgccagugaccggauggggaugggcacaacauaucuggcccucauggcaaccuuuaagaugcgcccgauguucgccguagggcugcuguuucggagacucacaucccgggagguccugcuacucacuaucgggcugaguuuaguggcguccguugagcugcccaauagccuggaggagcugggagacgguuuagccaugggcauaaugauccugaagcugcucaccgacuuucagucccaccagcugugggcgacccuccucagccugacguucauaaagaccaccuucucgcugcacuacgcguggaaaaccauggcgauggugcucagcauagucucccuguucccccugugccugucaacaaccagucagaagaccaccuggcugcccguucugcucggcagccugggcugcaagccucugacgauguuccuaaucgcugaaaacaagauauggggccgccgaucauggccacucaacgaggggaucauggccgugggaaucgucagcauccugcucucgucgcuucugaagaaugacgugccccuagccgggccccucaucgccggcggcaugcuuauugcuuguuacgugauaagcgguuccagcgccgaccucucccuugagaaggccgccgaggucagcugggaggaggaggccgagcacaguggcgcgucacacaauauucuuguggagguccaggacgaugggacuaugaagaucaaggacgaggagcgggacgacacccucaccauccugcucaaggcgacccuccuggccgucuccggcguguauccgcugucaauccccgccacccuguucgugugguacuucuggcagaagaaaaagcagcgcuccgggguccugugggacacucccagcccgccggagguggagcgcgcagugcuggacgacggcaucuaccggaucaugcagcgcggccugcucgggcggucccagguaggcguggggguauuccaagaaaacgucuuccacaccauguggcacguuacgcgcggcgcggugcugauguaccaggggaagcgacuggagcccagcugggcuuccgucaagaaggaccucaucucuuacggagggggcuggagauugcagggguccuggaacacgggugaggaaguccaggucauagccgucgagccagguaagaaccccaagaacgugcaaacggcccccgggaccuucaaaacucccgagggagaggugggagcuauagcucuggacuuuaagcccgggacgucaggcucccccaucgucaaccgggagggaaagaucguggggcucuacggcaacggggucgucaccaccagcggcaccuacgugagcgccaucgcccaggccaaggcgagucaggaggggccucugcccgagaucgaagaugagguguuccgaaagcggaaucugacaaucauggaccuucaccccggcucugggaagacccgccgguaccugccggcuaucguccgcgaggccaucaagcgcagacugaggacccucauccuggcccccacacggguaguagccucggagauggcggaagcacugaagggcaugcccauccgcuaccagacgacagccgugaagagcgagcacaccggcaaggagaucguggauuugaugugccacgcuaccuucacgaugcguuuacugucccccguacgcgucccaaauuauaauaugaucaucauggaugaagcacacuucacggaccccagcuccaucgccgcccggggguauaucucgacccgcgugggaaugggggaagcugcggccaucuuuaugacggcuacgccgccuggcagcguagaggccuucccccaauccaacgccgucauacaggacgaggaacgcgacaucccagagcgcucuuggaacucgggguacgaguggaucaccgauuuccccggcaagaccgugugguucgugccuuccaucaagagcggcaacgacaucgccaacugcuugcggaagaacgggaaacgcgugauccagcugucccggaagaccuucgauacggaguaccagaagaccaagaacaacgacugggacuauguggugaccaccgacaucagcgagaugggagcgaauuuucgcgccgaccgggugauugacccucgccggugucugaagcccgugauccucaaggaugggcccgagcgcguuauccuggccggccccaugccggugaccguggccucagccgcgcagcggcgcgggcgcauuggccggaaccacaacaaggaaggcgaccaguauaucuacauggggcagccucugaacaaugacgaggaucaugcccacuggaccgaggccaagaugcuccuggauaacaucaauacccccgagggcaucauacccgcucuguuugagccggagcgagagaaauccgccgcgauugacggcgaguaccgccuccgcggcgaggcacgaaagacguucguggaacugaugcgacgcggggaccugcccguguggcucucuuauaagguggccagcgagggcuuccaauacagcgaccgccgguggugcuucgacggcgagagaaacaaccaaguacuggaggagaauauggauguggagaucuggacuaaggagggggagcggaagaaacugcggccccgaugguuggacgcccguaccuacuccgacccccuggcccugcgggaguucaaggaguucgcagccggcagacggagcgucagcggggaccucauccuggagaucggcaagcugccgcagcacuuaacacagagagcccagaaugcucuagacaaccucgugaugcuccacaacagcgaacaaggcgggcgggcguaccgccacgccauggaggaacuucccgacaccaucgagacgcucaugcugcuggcccuuaucgccguacucaccggcggcgugacgcuguucuuccuguccggccggggccucggcaagacaagcaucgggcugcugugugucauggccucuucggugcuccuguggauggcgagcguggagccccacuggauugccgccagcaucaucuuagaguucuuccucaugguccuucugauccccgagccggaccgccagcgcacgccccaggacaaucaacucgccuacguagugaucggucugcuuuucaugaucuugaccguggccgcgaacgagaugggccuucuggaaaccaccaagaaggacuuagggaucggccacguggcuguggggaaccaccaccacgcagccauguuggacgucgacuugcaccccgccucugcguggaccuuauacgcuguggccacgaccaucaucaccccgaugaugcggcacaccaucgaaaauacgaccgcaaacauaagccugaccgccaucgccaaccaggccgccauccugaugggccucgauaagggcuggcccaucuccaagauggacauuggggugccuuugcuagccuugggcugcuacagccaagucaacccacugacgcugaccgcggccguucucaugcuaguggcucauuaugccaucaucgggccgggccugcaggccaaggccacacgcgaagcccagaagcggacagccgccggaaucaugaagaaucccacggucgacggaaucguugccaucgaccuugacccuguagucuaugacgcgaaguucgagaagcaacugggccagaucauguugcucauccugugcacgagucagaucuuacucaugaggaccaccugggcucugugcgagagcauuacccuagccacggguccccuaaccacccugugggaaggcuccccggggaaguuuuggaacaccacgaucgccgugagcauggcaaacaucuuccggggcuccuaccucgcuggcgccggucucgccuucucucugaugaagucucuaggcggggggagaagagggaccggcgcccagggcgagacucucggggagaaguggaagcgacaguugaaccaacuguccaagagcgaguucaacacguacaagcgguccggcaucauggagguggaccgcucggaagcgaaggaggggcucaagagaggcgagacgaccaaacacgccgucucccgcgggacugccaaacugcggugguucguugagcguaaccuggucaagccugagggcaaggucauagaccugggcugcgggaggggcggcuggucguacuacugcgcgggcuuaaagaaggugacggaggugaaaggguacacgaagggcgggcccgggcaugaggagcccaucccgauggcgacguacggcuggaaccuggucaagcugcacuccggaaaagacguuuuuuucaucccgcccgagaagugugacacccuccugugcgacaucggcgagagcuccccgaacccgacgaucgaggagggccgcacgcuacggguguuaaagauggucgagccuuggcuacgaggcaaccaguucugcaucaagauauugaaccccuacaugccuaguguaguggagacacucgagcagaugcaacggaaacacggcgggaugcugguacgcaacccucugagccgaaacagcacccacgagauguacuggguguccugcggcaccgggaauaucgugagcgcggucaacaugaccucacggaugcuccugaaccgcuucaccauggcucaccgaaaaccgaccuaugagagagauguggaccugggcgccggcacccgucacguggcggucgagcccgagguugcaaaccucgacaucaucgggcagcgcaucgagaacauaaaacacgagcauaagucuacguggcacuacgacgaagacaacccuuacaagacgugggcguaccacggcucguacgaggugaaaccgagcggcucugcgagcagcauggucaacggcguagucaagcugcugaccaagcccugggacgugauucccaugguuacucagaucgcuaugaccgacacuacccccuuugggcagcagcgaguuuucaaggaaaagguggacacccgcaccccgaaggccaagcgggggacggcccagauaauggaagucaccgcuaagugguuauggggauucuugagccgcaacaaaaagccccggaucuguacucgcgaggaguucacccguaaggugcgcagcaacgccgccaucggggccguguuuguggaugagaaucaguggaacuccgcuaaggaggccguugaggacgagcgguuuugggaucucgugcauaaggagcgcgaguuacacaaacaggggaagugcgccacgugcguguacaacaugauggggaagcgggagaagaagcugggcgaguucgggaaggcuaagggcagccgcgccaucugguacaugugguuaggcgcgagguucuuagaguuugaggcccugggguucaugaacgaggaucacugguucucccgugagaauagccuguccggcgucgagggggagggccuccacaagcugggguacauccugagggacaucucgaaaaucccuggcgggaacauguacgcggacgacacagccgggugggacacccguaucaccgaagaugaccuucagaacgaggcgcgcaucacggacaucauggaaccggagcacgcgcugcucgcgaaauccaucuucaagcuaaccuaucagaauaaggucgugcggguccaacgcccagccaagaacggcaccgucauggacgugauuagccggcgcgaccagcgggguagcggccaggucggcacuuacgggcugaauacguucacuaacauggaggcccaacugauucgccagauggagagugaggggauauucagcccuuccgagcucgagacgccgaaccuagccgagcgugugcuggacuggcuggaaaaguacgggguggagcgucugaaacggauggcgaucuccggugaugacugcgucgugaagccgaucgaugacagauuugccaccgcccugacggcccuuaacgacauggggaaggugcggaaagauaucccucagugggaaccaagcaaaggcuggaacgacuggcagcagguccccuucugcucccaccacuuccaucaacugaucaugaaggacgguagagagaucguggugcccugccggaaucaggaugagcugguuggacgcgcgcgggugucucagggugcgggguggucccuccgugagaccgcuugccugggcaaguccuaugcucagauguggcagcugauguacuuucaccggcgcgaccuucggcuggcugcgaacgccaucuguucagccgugccagucgacuggauucccacaucccgcaccaccuggucaauccacgcucaccaccaguggaugaccaccgaggacaugcugaguguguggaacagagucuggaucgaggagaaccccuggauggaggacaagacucacaucagcaguuggggcgacgucccguaccucggcaagcgggaggaccaguggugcggcagccuuauagggcugacggcacgugcgaccugggccaccaauauacaaguggccaucaaccaagugcggcgccuuaucggaaacgagaacuaccuggacuacaugaccuccaugaagcgguuuaaaaacgagagcgaccccgagggggcccugugguag

SEQ ID NO: 23802 - RNA, 9879 nt, Artificial Sequence
  derived and/or modified CDS sequence (opt11) from DENV-1__GU131921__SS-prME
agcguuacuaugcugcucaugcugaugcccaccgcacuggcguuucaccugacuacacggggcggagaaccccacaugauagugagcaagcaagagcggggcaagagccugcuguucaagacaagcgccggggucaauauguguaccuuaauugccauggaccugggcgagcugugcgaagacacgaugaccuacaaaugccccaggaucaccgaagcugagccagacgacguggacuguuggugcaaugccaccgauaccugggugaccuaugguaccuguucgcaaaccggcgaacaucggagagacaaacguagcguggcgcucgcuccccacgucgggcuuggccuggagacgcgcacagagaccuggaugagcagugaaggcgcauggaagcagauacaacgggucgagacgugggcucuccgccacccuggguucacggugauggcccuguuccuggcgcaugccaucggcacgucuaucacccagaaggggaucaucuucaucuugcugauguuagugacccccuccauggccaugaggugcgugggcaucggcucgcgcgauuuuguggagggucucuccggagccacguggguagacgucgugcuggagcacggcuccugcgugacgaccauggcuaaagacaagcccacauuggacauagagcuccugaagacagaagugacuaacccggcgauccugcggaagcucugcauugaggccaagaucucaaacaccaccacggauucucgcugcccgacccagggcgaggcuacccugguggaagagcaggacgcuaacuuugucugccggcgcacuuucgucgaccguggcuggggcaacggcugcgggcuguuuggcaaagggucacucauuacgugcgccaaguucaagugcgugacaaaauuggagggcaaaauuguacaguacgagaaccugaaauacucggucaucgugaccguucacacaggcgaccagcaccaggucgggaacgaguccacggagcauggcacgaccgcgaccaucacgccccaggcccccaugaccgagauccagcucaccgacuacggagcguugacgcuggauugcagcccccgcacaggguuagacuucaacgagaugguucuacugaccaugaaggagaaauccuggcucguacacaaacagugguucuuagaccugccauugccuuggaccagcggggcuagcaccagccaggagaccuggaaccggcaggaccuacugguaacguucaagaccgcucacgcgaagaagcaagaagugguugugcugggcagccaggagggggcgaugcacaccgcccuuacgggggcaacugagauccagaccagcgggaccacgacgaucuucgccgggcaucuaaagugccggcucaagauggacaagcugacccugaagggcaugagcuacgugaugugcacuggguccuuuaaacuagagaaggagguggcggaaacacagcacggcacgguucuggugcagaucaaguacgagggcacggacgcccccugcaagaucccuuucuccacccaggacgagaagggggugacccaaaacggccggcugaucaccgcaaauccuaucgugaccgauaaagagaagcccguaaauaucgaggccgaaccucccuucggggaguccuacaucguaaucggagcgggcgagaaggcacugaagcucaguugguucaagaaggggaguagcaucggcaagauguucgaggccaccgcccgcggggcacggcgaauggccauccuaggcgacacagccugggacuucgguagcaucggcgguguguuuacgucagucgggaagcuggugcaccaaaucuucggcgccgccuacgggguccucuucuccggcgugucauggaccaugaagaucgggaucggaguccugcugaccuggcugggacugaacucccggucuaccucccuuucuaugacgugcaucgcaguagggcucguuacccuguaucucggcgucauggugcaagcggacuccgggugcguuaucaacuggaaaggccgggagcucaaguguggaagcggcauuuucgugacaaacgagguucacaccuggacggaacaauacaaguuccaagccgauucccccaagcgccucuccgccgccaucggcaaggccugggaggaaggggugugcggcauacggagcgcuacccgccuggagaauaucauguggaagcagauuucaaacgaguuaaaucacauccugcuggaaaacgacaugaaguucaccgucgucguuggggacgucgcaggcauacucgcacaggggaagaaaaugaucagaccacagccuauggaguacaaguacagcuggaaguccuggggcaaagcgaagaucauuggugcggacguucagaacaccacguucaucauugaugggcccaacacaccggagugccccgacgaccagcgcgcguggaacaucugggaaguggaagauuauggcuucgggauuuuuaccacgaauaucuggcugaaacugcgggacagcuacacccaagucugcgaucauaggcucauguccgccgccaucaaagauagcaaggccgugcacgcggacaugggcuacuggaucgaguccgagaagaaugaaacguggaagcuggcgcgggccagcuucaucgaagugaagacguguaucuggcccaaaucccacacccuuuggagcaacggcguccucgaauccgagaugauuaucccuaagaucuacgggggcccgauaagccagcacaacuaccgccccggcuacuucacccagacggcagggcccuggcaccuggggaagcuggagcucgacuucgaucucugcgaaggcaccacugugguggucgaugagcacugcggcaaccggggaccgucccugcgcaccacgaccgugacggggaagauaauucacgaguggugcugccggagcugcacccucccgccccuccgcuuccguggggaggacgggugcugguacggcauggagauucgccccgugaaggagaaagaggagaacuuggucaagucgauggugagcgccggcagcggggaggucgacuccuucagccuugggcugcugugcaucuccaucaugauugaggagguaaugcggucuagguggagucggaagaugcucaugacaggcacgcuggcuguguuccugcuccugaucauggggcagcugaccuggaacgaccucauacgacugugcaucaugguaggugccaacgcaagcgaucgcauggggaugggcaccacguaccuggccuuaauggccaccuucaagaugaggccaauguuugcggucggacuccuguuccgucggcugacuucuagggaggugcuacugcugaccaucggacuaagcuuaguugcauccgucgagcugccuaacagcuuagaagagcuaggcgacgggcuagccaugggcaucaugaucuuaaaacugcugacggauuuccagucccaucaauugugggccacccugcucagucugaccuucaucaaaaccacguuuucccugcacuacgcguggaagaccauggccauggugcucagcauugucucccuguucccacucugccucagcaccacaucccaaaagacgaccugguugcccguucugcucggcucgcuaggguguaaaccacuuaccauguuccucaucgcggagaauaaaaucuggggccggcgcucauggccccugaacgaggggaucauggccguaggcauagucagcaucuuacucagcucccugcugaagaacgacgugccccucgccgggccccucaucgccggaggcaugcugaucgcgugcuacgucaucuccgggaguagcgcggaccugucccuggagaaagccgccgaggucagcugggaggaggaggcagaacauuccggcgcuagccacaacauccugguggaggugcaggacgacggaaccaugaagauaaaggacgaagagcgggacgacacgcucaccauauuacugaaggccacucucuuggccgucuccggcguguauccgcugagcauccccgcgacacuuuucgugugguacuuuuggcagaagaagaagcaacgguccggaguccugugggacacacccagcccgcccgaagucgagaaagcgguucucgacgacggaaucuaucggaucaugcaaagaggacugcucggccggucccaggucggcguaggaguguuucaggagaauguauuucacacgauguggcaugugacucgcggcgccgugcucauguaccaggggaagcgccuggagccaagcugggcguccgucaagaaagaucuaauaagcuacggaggcgguuggcgccugcagggcuccuggaauaccggggaggaaguccaggugaucgcaguugagcccggcaaaaaccccaagaaugugcagacagcuccggggacguucaagacccccgaaggcgaggugggggcgaucgccuuggacuucaaaccggguacuuccggcucccccaucgucaaccgagaggggaagaucgugggccucuacggcaacgggguggucaccacgucgggcaccuacgugagcgccaucgcccaagcgaaggccucccaggaggggccgcugcccgaaauugaggacgaggucuuucgcaagagaaaucugaccauaauggaccuccacccgggaucggggaagacucgccgguaccugccggccaucguccgcgaggcgaucaagcggaaguugcgcacguugauccucgcaccuacccgcguaguggcuuccgagauggcagaggcgcuaaagggaaugccgaucagauaccagacgacugcugucaagagugagcacacgggcaaggagaucguggaccugaugugccacgccaccuuuaccaugcgccugcugucacccgugcgggucccgaauuacaauaugaucaucauggacgaggcgcacuuuaccgacccuucuagcaucgcagcccgcggguacaucagcacccgggugggcaugggggaagcggccgcgaucuucaugacugccacgccgcccggcuccguggaggccuucccgcagagcaacgcggucauacaggacgaggagagggacauaccagagcggucauggaauagcggguacgaguggaucaccgacuucccaggcaaaacgguaugguucguacccuccaucaagagcggcaacgacauagcgaacugccuccgcaagaacggcaagcgcguuauccagcugagccguaaaaccuucgacaccgaguaccaaaagaccaagaacaacgacugggacuacguggugaccaccgacaucuccgaaaugggcgcaaauuuuagagcagaucgggucaucgacccgcgacgcugucugaagcccgucauccucaaggacgggcccgagcgcgugauccuggccggccccaugccggucacaguagccuccgcagcccagcgccgggggaggaucggccggaaccauaacaaggagggagaccaguacaucuauauggggcagccgcugaacaaugacgaagaccacgcucacuggaccgaggccaagaugcuccuugacaacaucaacaccccagaggguauuauccccgcgcucuucgagccggagagggagaagucggcggcuaucgacggugaguaucgccuucggggugaggcccgcaaaaccuuugucgagcuaaugcgccgcggggaccuccccguguggcucucauacaagguggcaagcgaaggauuccaguacagcgaccggagguggugcuucgacggugagcggaauaaccagguccuggaggagaauauggacgucgagauuuggaccaaggagggcgagcgcaagaagcugcggccccgcuggcucgacgcccggaccuacuccgacccccuggcgcugcgcgaguucaaagaauucgcggcaggcagacgcucgguauccggcgaccucauccuggagaucggcaaacugccacagcaccucacccagagggcccagaaugcguuagauaauuuagucaugcuccacaacagcgagcaggguggccgcgcauaccggcacgccauggaggaguugccggacaccaucgagacauuaaugcuccuagcccugaucgccgugcuaacaggcggaguaacucuguucuuucugucgggccgcgggcucgguaaaaccagcaucgguuuacugugcguuauggcgaguagcgugcuccuguggauggccaguguugagccccacuggaucgccgccagcauuauacuugaguucuucuugaugguacugcugauccccgagccggauagacagcgcacaccccaggacaaucagcucgccuacguggugaucgggcuucuguucaugauccucaccguugcagcgaacgaaaugggccuucuugagaccacgaagaaagaccucgggauuggccacguggcggucgggaaccaucaccacgccgccaugcuggacgucgaccugcauccugcaagcgccuggacccucuacgccguggccaccaccaucaucaccccgaugaugcggcacaccaucgaaaacacgacugccaacaucagccugacggcgaucgccaaccaggccgccauccuaaugggacucgauaagggcuggcccauauccaagauggauauaggcgugccccuguuggcgcucgguuguuacucucaggucaacccccugacgcuaaccgccgccgugcucaugcugguggcucacuacgccaucauagggccaggucugcaggcuaaagccacccgcgaggcgcagaaaaggacugcagcaggaaucaugaagaacccaaccguggacggcaucgucgcuauagauuuggacccagugguguaugacgccaaguucgaaaagcagcugggccagaucaugcugcugaucuuaugcacuucccagauucugcucaugcggaccacaugggccuuaugcgagagcauaacccuagccaccgggcccuuaaccacccugugggagggcucccccgggaaguuuuggaacaccacaaucgccgugagcauggccaacaucuucagaggcucguacuuagcuggcgccgggcucgcauucagccuuaugaagucccugggggggggccgccgcgggaccggcgcgcagggcgagacgcuuggggaaaaguggaagaggcagcuuaaucagcugucgaagagcgaguucaacaccuacaagcgcucgggaaucauggagguggaccggagcgaggcuaaggaggggcucaagcgcggcgagacgaccaagcacgcagucucccgggggacggccaagcugcgcugguucguugagagaaaccuggugaagcccgagggcaaggucaucgaccugggcugcgggcgcggcggguggagcuauuacugcgccggguugaagaaagugaccgaagugaagggguacacgaagggcggccccgggcaugaggagcccauucccauggcgaccuauggcuggaacuuggucaaguugcacagugggaaggacguguucuucaucccgcccgagaagugcgacacgcuccugugcgauaucggcgagagcucucccaacccgaccaucgaggagggucggacccugcgcgugcucaaaauggucgagcccuggcugcgggggaaccaguucugcaucaagauccugaaccccuauaugcccagcgugguagagaccuuagaacagaugcagcgcaagcacggcgggaugcugguccggaacccucugucccgcaacucgacccaugagauguauuggguguccugcggcaccgguaacauaguaagcgccgucaacaugaccucccggauguuacugaaccgcuucacgauggcccaccgcaagcccaccuacgaacgggauguggaucuuggagccgguacccgccauguagccgucgagcccgagguagcgaaccucgacaucaucgggcagcggauagagaacaucaagcacgaacacaagucgaccuggcacuaugacgaagauaaccccuacaaaaccugggccuaccacgguuccuacgaggugaagccgucaggcuccgcgaguagcauggucaacgguguagucaagcugcugacaaaaccuugggaugucaucccaauggugacccagauagcgaugaccgauacgaccccguucgggcagcagcgcguauucaaggagaagguggacacacggaccccgaaagccaagcgcggcacugcgcaaauuauggaggucaccgcgaaguggcucuggggcuuccuguccagaaacaaaaagccucgcauuuguacgcgggaggaguucacgaggaaaguccggagcaaugcugccauaggcgcgguauucguggaugagaaccaguggaacucagccaaggaggccgucgaggacgagagauucugggaccucgugcaccgggagcgcgagcuccacaaacaaggcaaaugugcuacgugcguguacaacaugauggggaagcgggagaagaagcuaggcgaguucgguaaggcgaaagguucgcgggcgaucugguacauguggcugggcgcgagguucuuagaguucgaagcccucggguucaugaacgaggaccacugguucucccgcgagaacagccuauccggcgucgaaggggaggggcugcauaagcugggguauauccugcgggacauuagcaagaucccugggggaaacauguacgccgacgacaccgccgguugggacacgcgcauaaccgaggacgaccugcaaaaugaagcgcggaucaccgacaucauggaaccagagcacgccuuguuggcaaagagcauuuucaagcucaccuaccagaacaagguggugcgcguccagcgccccgccaagaacggcacgguaauggacguuauaucccgucgcgaccagcggggguccggccaggucggcaccuacgguuugaacaccuucaccaacauggaagcccagcugauccggcagauggagagcgagggcauauucuccccaucagagcucgaaacgcccaacuuggcggagcggguacucgauuggcuggagaaguauggggucgagcgccucaagcggauggccaucuccggcgacgacugcgucgugaagccgaucgacgaccgcuuugcaaccgcccuaacagcccucaacgauauggguaaggugcggaaagauaucccgcaaugggagcccuccaaaggcuggaacgacuggcagcagguccccuucugcucccaccauuuccaccagcugaucaugaaggauggccgcgaaaucguggucccgugcagaaaucaggacgaguuggucgggcgagcccgggugagccagggcgccggguggagccuccgcgagaccgcaugcuugggcaaguccuacgcucagauguggcagcugauguacuuccaucgccgcgaccuacggcuggcggccaaugccaucugcucagccgugccugucgacuggauccccacguccaggaccacauggagcauccacgcacaccaccaguggaugaccacagaggacaugcuguccguauggaaucggguguggaucgaggagaacccuuggauggaggacaagacccacaucaguucuuggggcgacgugccguaccucgguaagcgugaggaccaguggugcggaagccuaauagggcugacggcccgcgccaccugggcaacaaacauccaaguggcaaucaaccaggugcggcgacucaucggcaacgaaaacuaccuggauuauaugaccucaaugaagcgguucaagaacgagagcgauccggaaggggcucugugguga

SEQ ID NO: 23803 - RNA, 9879 nt, Artificial Sequence
  derived and/or modified CDS sequence (opt11) from DENV-1__GQ868635__SS-prME
agcgucaccaugcugcucaugcugaugcccaccgcccuggcauuccaccucaccacccgggggggggaaccccacaugaucguaagcaagcaggagcggggcaagucgcugcuguucaagaccagcgccggagucaacaugugcaccuugauugcaauggaucugggcgaauuaugcgaggacaccaugacauacaagugcccgagaaucaccgaggccgagcccgacgacguggacugcuggugcaacgccaccgacaccugggucaccuacgggaccuguagccagaccggcgagcaccggagggacaaacgguccguggcccucgcgccccacgugggccuggggcuggagacgcgcaccgagaccuggaugagcuccgaaggcgccuggaagcagauccaacgggucgagaccugggcccuacgccaccccggguucacggugauggcgcuguucuuagcucacgccaucggcaccagcaucacccagaagggaaucaucuucauacuccugaugcuaguaacccccuccauggccaugcggugcgugggcaucggcagccgcgauuucguggagggccucucgggcgccacguggguggacgucguucuagagcacgggagcugcgugaccaccauggccaaggacaagcccacccuggauauugaacuccugaagacagaggucaccaacccugcgauccugcgaaagcucugcaucgaggccaagaucuccaacaccaccacggacagcagaugcccgacgcagggcgaggcgacgcuggucgaggagcaggacgccaacuucguaugcagaaggacuuucgucgaccgcggcugggggaauggcugugggcuguucgggaaggggagucucaucacgugcgcaaaguucaagugcgugaccaagcuggagggcaagaucgugcaguacgagaaccugaaauacagcgucaucguuaccgugcauaccggcgaccagcaccaggucgggaacgaguccacggagcacggcaccaccgcaacuauuacgccccaggcucccacgacugaaauccagcucaccgacuacggggcccugaccuuggacugcagccccagaacgggccucgacuucaacgaaauggugcugcucaccaugaaggagaaguccuggcuaguccacaagcagugguuccuggaccugccccuccccuggaccagcggggcuagcaccucccaggaaacguggaaccggcaggaccugcuggucaccuucaagaccgcccacgcgaagaagcaggagguggucgugcucgguagccaggagggcgccaugcacaccgcccucacgggggcaaccgagauccagaccuccgggaccacgaccauauucgccgggcaccugaagugccggcugaagauggauaaacugaccuugaagggcaugagcuacgugaugugcaccggguccuucaaguuagaaaaggagguagcggagacacagcacggcaccguacuggugcagaucaaguacgagggcaccgacgcccccugcaagauacccuucagcacgcaagacgagaaggggguuacgcagaacggccggcugaucaccgcgaacccgaucgugaccgacaaggaaaagcccgugaacaucgaggccgagccgcccuucggggaguccuacaucgucauuggcgcuggcgagaaggcccugaagcucaguugguucaagaagggguccagcaucggcaagauguucgaggccaccgcccgcggggcccggcgcauggcgauccugggcgauacugccugggacuucggguccaucgguggcguguucacaagcguugggaagcugguccaccagaucuucggcgccgcguacggggugcuguucuccggcgugagcuggaccaugaagaucgggaucggcguccuucuaacguggcucggucugaacucccgaagcacgucacugagcaugaccuguaucgcaguggggcucgugacccuguaccuggguguuauggugcaggcggacuccgggugcgugaucaacuggaagggucgggagcucaagugcgggagcggcaucuucgucacgaacgaggugcacacguggaccgagcaguacaaauuccaggccgacagcccgaagcgcuuguccgccgccauagggaaggccugggaagaggggguguguggcauccggagcgcgacccgccuggagaacaucauguggaagcagaucuccaacgaguugaaccacauccugcuggagaacgauaugaaguucaccgugguggugggggacgucgccggcauccucgcccaagggaaaaagaugauacggccucagcccauggaguacaaguacagcuggaaguccuggggcaaggccaaaaucaucggcgcggacgugcagaacaccaccuuuaucaucgacggucccaacaccccggaaugccccgacgaccagcgcgccuggaacauaugggaaguagaggacuacggcuucgggaucuuuaccacgaacaucuggcugaagcugagggacucguacacgcaagucugcgaccaccgccucauguccgccgccaucaaggacucuaaggccgugcaugcggacaugggcuacuggaucgaaucugaaaagaacgaaaccuggaagcuggcccgggccagcuucaucgagguaaagaccugcaucuggccaaagucccacacccuuuggagcaacggcguccucgaguccgagaugaucaucccgaagaucuacggggguccgaucagccagcacaacuaccgccccggguauuucacgcagaccgccggccccuggcacuuagggaagcuggagcucgacuucgaccugugcgaggguaccaccgucguggucgacgagcacugcggcaaccgggggccgucccugcgcacgaccaccgugaccgguaagaucauccacgaguggugcugccggagcugcacguuaccgccccuccgguuucgcggggaggacggcugcugguacgggauggagaucaggcccgugaaggaaaaggaggagaaccuggucaaguccauggugagcgccggcagcggugagguggacuccuucagccucgggcuguuguguaucuccaucaugauagaggaggucaugcgcagccgcuggucccggaagaugcucaugaccggcacccuggcgguauuccugcuacugaucauggggcaacugacguggaacgaucucauccgccugugcaucauggugggcgccaacgcaucggaccgcauggggaugggcacgacauaccuggcccucauggccaccuucaaaaugcggccgauguucgccgucgggcugcuguuccgccgguuaaccucccgcgaggugcuccuguuaacaaucgggcugagccugguggcuuccgucgagcuccccaacagccuggaggagcucggcgacgggcucgccaugggcaucaugauccugaagcugcucaccgauuuccagucccaccagcugugggccacccugcucagcuugaccuucauuaagacuaccuucucccuccacuacgcguggaagaccauggccauggugcucagcaucgucucccuguucccgcugugccucucgacuacgucccagaagaccaccuggcugcccguguuacuaggcucacuggggugcaagccgcugaccauguuccucauugccgagaauaaaaucuggggccggcgcuccuggccccugaacgaggggaucauggccgugggcaucgucagcauacugcucagcucccugcugaagaaugacgugcccuuggccgggccacuuauugcgggcgguaugcugaucgccugcuacgugauuagcgguuccucggccgaccucucgcuggagaaggccgccgaagucagcugggaggaggaggcggaacacuccggagccucccacaacauccuggucgaggugcaggacgacggaacgaugaagaucaaggacgaggagcgggacgacacccucaccauccugcugaaggcgacccuccuggcaguauccggaguguacccgcugagcauccccgccacccucuucgugugguacuuuuggcagaagaagaagcaaagauccgggguccugugggacacgcccagcccucccgaaguggagaaggcggugcuggacgacgggaucuaccggaucaugcagcgcggccugcucgggcggucccaggucggcguggggguguuccaggagaaugucuuccacaccauguggcacgugacccggggcgccguccugauguaccaggggaagcggcuggagcccagcugggccucggucaagaaggaccucaucagcuacgggggcggguggcgccuccaaggguccuggaacaccggggaggagguccaaguaaucgccguugagcccgggaagaaccccaagaacguacagacggcgcccgggaccuucaagacccccgaaggagaggucggcgcgaucgcccuggacuucaagcccgggaccagcggaucccccaucgucaacagagaaggcaagaucgugggccucuacggcaacgggguggucacgaccaguggcaccuacgugagugcuaucgcccaggcgaaggccucccaggaggggccgcugcccgaaaucgaggacgaaguguuccgcaaacggaaccugaccaucauggaccuccaccccggcucagggaagacgcgucgguaucuuccggccaucguacgcgaggccaucaaacggaagcugcguacccugauccuggcccccacccgggugguggcguccgagauggccgaggcccugaagggcaugcccauccgauaccagacgacggcgguuaagucugagcacaccggcaaggagaucguggaccucaugugccacgccaccuucaccaugcgacugcugucccccgugcgggucccgaacuacaacaugaucaucauggacgaggcgcacuucacggaccccagcuccauugccgcgcgcgguuacaucagcacccgggugggcaugggggaggccgccgcgauuuuuaugaccgccacgccgcccggcuccguggaagccuucccgcagagcaacgccgucauccaggacgaagagcgcgacauccccgagcgguccuggaacagcggguacgaguggaucacggacuuccccggcaagaccgugugguucgugcccucaauuaagucaggcaacgacaucgcgaacugccuccgaaagaacgggaagcgggucauccagcugucccgcaagacauucgacaccgaguaccagaagacgaagaacaacgacugggacuacguggugaccaccgacaucagugagaugggcgccaacuuccgugccgaccgcgucaucgacccgcggcgcugccuuaagccggugaucuuaaaagacgggcccgagcgggugauccuggccggucccaugccggugaccguggccuccgcugcgcagcgccgggggcgcaucggccggaaccacaacaaggagggugaccaguacauuuacaugggacagccccugaacaaugacgaggaccaugcccacuggacggaggcuaaaaugcuccuggacaacaucaacacccccgagggcaucauucccgcuuuguucgaaccggagcgcgagaaauccgcggccaucgacggggaguaccgccuccggggcgaggcccgcaagaccuucguagaacugaugcggcgcggggaccugcccguguggcucuccuauaagguggccagcgaggguuuccaguacagcgaccggcgcuggugcuucgacggcgaacggaauaaccaaguccuggaggagaacauggacguggaaaucuggaccaaggagggggaacgcaagaagcugagaccucgcuggcucgaugcccggacauacuccgaccccuuagcgcugcgggaguuuaaggaguucgccgccggucggcgcucagugucuggggaccucauccuggagaucggcaagcugccccagcaccugacccaacgggcccagaacgcacuggacaaccuggucaugcuccacaacucggagcagggcgggcgcgccuaccggcacgccauggaggagcugccagacaccaucgagacccugaugcuccuggcccugauugccgugcucacgggcgggguaacccuguucuuccuguccggccgcggguuggguaagaccucuaucggucugcuaugcgucauggcguccagcgugcuccuguggauggccucuguggagccgcacuggauugccgccagcaucauucuggaauuuuuccucaugguccugcucauccccgagccggaccggcagcgcacgccccaggacaaucagcucgccuacguggugaucgggcuccuguucaugauccucaccgucgcggccaacgagaugggccugcuggagacgaccaagaaagaccucgguaucggccacguggccgugggaaaccaccaucacgccgccaugcuggacguagaucugcaccccgcauccgccuggaccuuguacgccguggccacuacgaucaucaccccgaugaugcggcacaccaucgagaauaccacggcgaacaucagccugaccgcgaucgccaaccaggccgcuauccugaugggccucgacaagggcuggcccauauccaagauggacaucggggugccccugcucgcccucggcuguuacucgcaggucaauccgcugacacucaccgcugccgugcucauguuaguggcccacuacgccaucaucgggccgggccugcaggcgaaggccacgcgcgaggcccaaaagcgcaccgccgccgggaucaugaagaacccuaccgucgacggcaucguggcgaucgaccucgaccccguggucuacgaugccaaguucgagaagcagcugggccagaucaugcugcugauccugugcaccucccaaauccugcucaugcggacaaccugggcucugugugaguccaucacccuggccaccgggccccucacgacccugugggagggcuccccggguaaguucuggaauaccaccauagccgugagcauggcgaacaucuuccgcggauccuaccuggccggcgccggucucgccuucagccugaugaagucccugggcggcgggcggcgcgggacgggcgcgcaaggcgagacccucggggagaaguggaagcggcaacuaaaccagcugucgaaguccgaguucaacaccuacaaacgcuccgguaucauggagguggaccggagcgaggcuaaggaaggccucaagcgcggggagaccacgaagcaugccgucucccgggggaccgccaaguugcgcugguucguggagcggaaucugguuaagcccgagggcaaggucaucgaccugggcugcgggcgcggcggauggagcuacuauugcgcaggacucaagaagguaaccgaagugaagggguacaccaagggcggccccggacacgaggaacccauccccauggcuaccuacggcuggaaccuggucaagcugcauuccgggaaggacguguucuucaucccgcccgagaagugcgauacacuccuaugcgacaucggcgagagcucccccaacccaaccaucgaagaaggacggacccugcgggugcucaagaugguagaacccuggcugcggggcaaccaguucuguaucaagauccugaaucccuacaugcccagcgugguggagacgcucgagcaaaugcagcggaagcacggcgggauguuaguccggaacccgcugucccgcaacagcacccacgagauguacuggguguccugcggcaccgggaauauuguaagcgccguaaacaugaccucccggaugcugcuuaaccgcuucaccauggcgcaucgcaagcccacguacgagcgggacguugaccucggcgccgggacccgccacguggccgucgagcccgagguggcaaacuuagacauuaucgggcagcggaucgagaacaucaagcacgagcacaaguccacguggcacuacgaugaggacaaccccuauaagaccugggccuaccacggcucauacgaaguaaagccgagcggcuccgccagcagcauggucaauggcgugguuaagcuccugacgaagcccugggacguaauccccauggugacccagaucgccaugacggacacuacgcccuucgggcagcaacgcgucuuuaaggagaagguagacacccgcacuccgaaggccaagcgcggcaccgcgcagauuauggaggugacggccaaguggcucuggggcuuccugucccggaacaagaagccccgcaucugcacccgggaagaguucacacgcaagguccggagcaacgccgccaucggggcggucuucguggacgagaaccaguggaacuccgccaaggaggcuguagaggacgagagauuuugggaucuggugcaccgggagagagaauugcacaagcagggcaagugugcgacgugcguguacaacaugauggggaagcgagagaagaagcugggcgaguucgggaaggccaagggcagccgcgcgaucugguacauguggcucggcgcccgguuccuugaguucgaggcccugggguucaugaacgaggaccacugguucucccgcgagaacucacuguccggcgucgaaggggagggucuccacaaguuaggguacauccugcgggacaucagcaaaauacccgggggcaacauguacgcugacgacacggcagggugggacacccguaucaccgaggacgaccuccagaacgaggccaggaucaccgacauaauggaaccugagcacgcucugcuggccaaguccaucuucaaacucacguaccagaacaaaguagugcgcguccagcgccccgccaagaacggcacagucauggacgugauaagccgucgcgaccagcgcggguccggccaggucggcaccuacgggcuuaacaccuucacaaacauggaggcccagcugauccgccagauggagucggagggcaucuucucccccagcgagcucgagaccccaaaccuggcggagcgggugcuugacuggcucgagaaguacgggguggagcgccugaagcggauggcaaucuccggcgacgacugcgucguaaagccgaucgaugaccgguucgccaccgccuugacggcccucaacgauauggggaaggugcggaaggacaucccccagugggagcccagcaagggcuggaacgacuggcaacaaguccccuucuguucccaccacuuccaccaacugaucaugaaggacggccgcgagaucgugguuccgugccgaaaccaggacgagcugguggggcgcgcgcgggugucgcaaggcgccggguggucccugcgugagacggcaugccuuggcaaguccuacgcccagauguggcagcuuauguacuuccaccggcgcgaccucagacuggcggccaacgccaucuguagcgcggugcccgucgauuggauccccaccucccgaaccaccuggucgauccacgcccaccaccaauggaugacgacugaggacaugcuguccguguggaaccggguguggauagaggagaacccuuggauggaggacaaaacccacaucagcuccuggggcgacgucccguaccucggcaaacgcgaggaccaguggugcgggagccuuaucgggcugaccgcgcgcgccacgugggccaccaacauccagguggccauaaaucaggugcggcgucucaucggcaacgaaaacuaccucgacuacaugaccuccaugaagagauucaagaaugagagcgaccccgagggugcccugugguga

SEQ ID NO: 23804 - RNA, 9879 nt, Artificial Sequence
  derived and/or modified CDS sequence (opt11) from DENV-1__GQ868636__SS-prME
agcgugaccaugcugcuaaugcugaugccgaccgcccuugccuuccaucuaaccacccggggcggagagccccacaugauagugaccaagcaagagcgggggaagucgcuguuguuuaaaaccagcgcgggagugaacaugugcacccucaucgcaauggaccugggugaauugugcgaggacaccaugaccuacaaaugcccgcggaucaccgaagccgagccggacgacgucgauugcuggugcaacgccaccgauacaugggucaccuacgggacuugcucccagaccggcgaacacaggagagacaagcggagcgucgccuuggcaccccacguggggcugggacuggagacccgcacugagaccuggauguccagcgagggcgcauggaagcaaauacagcgggucgagacaugggcccucaggcaccccggguuuacaguuaucgcccuguuccuggcucacgcaaucggcaccuccaucacacaaaaggggaucaucuucauccucuuaaugcuggugacgccgucgauggccaugcgaugcgugggcaucggcucccgcgacuucgucgaaggguugagcggcgccacauggguggacgucgugcuggagcacggguccugcguaacgaccauggccaaggauaagcccacuuuagacaucgagcuccugaagaccgaagucacuaacccugcggugcuucgcaaacuuugcaucgaggccaagaucagcaacacuacgaccgauucgcggugccccacccagggcgaagccaccuuaauggaagaacaggacgcgaacuuugugugccggagaacguucgucgaccggggcugggggaacggcugcgggcuguucggaaaggggagccucaucacgugcgcaaaguucaagugcgugaccaagcucgagggcaagauaguucaguaugagaaccucaaguacucgguaaucguuaccguucacacaggcgaccagcaccaggucgguaacgaaagcaccgagcacggaaccaccgcgaccaucacgccgcaggcccccacuuccgaaauucagcucaccgauuauggggcccugaccuuggacuguucuccccgcacgggacucgauuuuaacgaaaugguuuugcugacuaugaaagaaaaguccuggcucguacacaagcagugguucuuggaccugccgcucccauggaccagcggggcaucuaccucgcaggaaacguggaaucgccaagaucugcucgugaccuucaagaccgcacacgcaaagaagcaggaaguggucguccucgguagccaagagggcgcaaugcacaccgcccugacgggggccaccgagauccagaccuccggaaccacgacgauauucgccgggcacuugaagugucgacucaagauggauaagcugacccugaaaggcaugagcuacgugaugugcaccggguccuucaagcucgaaaaggaagucgcggaaacgcagcacgggacugugcuaguccagaucaaguacgaaggcaccgacgccccguguaagauccccuucaguacucaagacgagaagggagucacgcaaaacgggcggcuaaucaccgccaacccgaucgugacugacaaggagaagcccgugaacaucgaggccgaaccucccuucggggagucauacaucgucaucggcgcgggcgagaaggcccugaaguuaagcugguucaagaaaggguccagcaucggcaagauguuugaagccaccgcccguggggcccggaggauggcaauucugggcgacacugccugggacuuuggguccaucggcggaguguucaccaguguagggaagcugguccaucagaucuucggaaccgccuacggaguguuguuuuccggcgucagcuggaccaugaagaucgggauuggcguacuguuaaccuggcucggucugaacucccgaaguaccucccuguccaugaccugcaucgcgguagggcucgugacacuuuaccugggcgucauggugcaggcggacuccgguugcguuaucaacuggaagggccgggagcuuaagugcgggagcggcaucuuugucacuaaugaggugcacaccuggaccgagcaguacaaguuccaggcagacucgcccaagcgacuuuccgccgccaucggaaaggccugggaggagggggugugcgggauccggagugcuacccgccuugagaauaucauguggaagcagaucuccaaugaauugaaccauauccugcuggagaacgacaugaaguucaccguggugguuggggacgucgugggcauccuggcgcaggggaagaagaugauccggccccaaccuauggagcacaaguauucguggaaguccugggguaaggccaagaucaucggcgcagacgugcagaacacgaccuucaucaucgacgggcccaacacaccggagugccccgacgaccagcgcgcauggaacaucugggaggucgaggacuauggcuucgggaucuucaccacgaacaucuggcugaaacugcgggacagcuacacccaagugugcgaccaccgccucauguccgcggccaucaaggacagcaaggccguccacgccgacauggguuacuggaucgaauccgaaaaaaacgaaacuuggaaacucgcgcgggcguccuucaucgaggucaagacgugcaucuggcccaagucucacacucuguggagcaacggggugcucgagucggagaugaucauucccaagaucuacggcggcccgaucagccagcacaacuaccgcccuggauauuucacccagacggccggccccuggcaccuggguaagcuggagcucgacuuugaccuuugcgaagguacgacgguggucguugacgagcauugcggcaaccgggggccgucccugcguacaaccacggugacugguaagaucauccacgaguggugcugccggagcugcacgcugccgccucucagauucaagggggaggauggcugcugguaugggauggagauacggcccgucaaggagaaggaggagaaccuggugaaguccauggugagcgcgggccucggcgaggucgacagcuucucccuugggcuucucugcaucagcaucaugauugaggaggugaugcgcucucgguggagccgcaagaugcugauggcgggcacccuggcaguguuccucuugcugaucauggggcaguuaacuuggaaugaccugauacggcugugcaucauggucggcgcgaacgccuccgaccgcauggggaugggcacgaccuaucucgcccugauggccaccuucaaaaugcguccuauguucgccguggggcucuuguuccggcggcuuaccucucgggaggugcugcuccugacuauagggcugucccucgucgcgaguguggagcuacccaacucccuggaggagcucggcgacggguuggccaugggcaucaugauacugaagcuacugaccgauuuccagagccaccagcugugggccacgcucuuaucccuaacauucaucaagacgacccucagccugcaccacgccuggaaaacuauggcgaugguccucaguauagugagccucuucccccugugccuguccaccacgagccagaaaaccaccuggcuccccgugcugcugggcucccucggguguaagccccugaccauguuccugaucgccgagaacaagaucuggggucgcaagagcuggccccucaacgagggaaucauggccguagggguaguguccaucuugcuguccucacuccugaagaacgacgucccccucgccgggcccuugauagccggcggcaugcugaucgcgugcuacgugaucuccggguccuccgccgaccugucgcucgagaaggccgccgagguuuccugggaggaggaggccgagcacuccggcgcgucccacaacauccuggucgagguacaggacgacgguacgaugaagauuaaggaugaggagcgagaugacacccugaccauccuccugaaggccacccuccucgcgaucagcggcgucuacccguuauccauccccgccacccuguucgucugguacuucuggcagaagaagaagcagcgcucugggguucugugggacacgcccagcccuccggagguggagcgggccguacucgacgacggcauuuaccgcaucaugcagcggggccuccucgggagaagccaggugggcguuggagucuuccaggagaacguguuucacaccauguggcacguuacucggggcgcgguccucauguaucaagggaagcgcuuagagcccucaugggcuucugugaagaaagaccucaucuccuacggcgguggguggcggcuccagggcucauggaacacaggagaggaggugcaggucaucgccguggagccuggcaagaaucccaagaacguccagacagcucccgggaccuucaagacaccagagggggagguaggagccaucgcguuggauuucaagccuggaaccuccggcucccccaucgugaaccgcgaagggaaaaucgucggccuguacggcaacggugucgugacuaccagcgguaccuacgugagcgccaucgcacaggccaaggcgagccaggaggggccgcuccccgagaucgaagacgaggucuuccggaagcgcaaccuaaccaucauggaccugcaccccggcuccgggaagacgcggcgcuacuuaccggcaaucguacgggaggccauaaagcgcaaguugcgaacccuaauccucgccccaacccgcguggucgccagcgagauggcggaagcucugaagggcaugcccauccgcuaccaaaccacggcugugaagucagagcacaccggcaaggagaucguggaccugaugugucacgccaccuucacgaugagacugcugagccccgucagggugccgaacuauaacaugaucaucauggacgaggcccacuucacugaccccuccagcaucgcggcacggggguacauuuccacccgcgugggcaugggggaagcugcugccaucuucaugaccgcaacgccaccaggcagcgucgaggcauucccgcaguccaacgccgugauacaagacgaagagagagacaucccugagaggagcuggaacagcggguaugaguggaucacggacuucccuggcaagaccgugugguucguccccagcaucaaauccggcaacgacauugccaacugccugcgcaagaacgguaagcgcgugauccagcucagccgaaagaccuucgacaccgaauaccagaagacgaagaacaacgacugggacuacguagugaccacugacauauccgaaaugggcgccaacuuccgcgccgaccgggugauugacccgaggagaugccugaagccuguaaucuuaaaagauggucccgaacgcgucaucuuagccggccccaugccggugaccguagccucggccgcacagcggagggggcggauuggccgcaaccauaacaaggagggugaccaauacaucuauauggggcagccccugaacaacgacgaggaccacgcacacuggacugaggccaagaugcugcucgacaacaucaacacccccgagggcauuauccccgcccuguuugaaccggagcgggagaagagugccgccaucgacggagaguaccgacugcgcggcgaagcccggaagaccuuuguggagcucaugcggcgcggggaccugccuguguggcugucuuauaaggucgccuccgagggcuuccaguacuccgaucgccgguggugcuuugauggcgagcgcaacaaucaagugcucgaggaaaacauggauguugagauuuggaccaaagagggggagcggaagaaacuacgcccgcgguggcuagacgcccggacauauagugacccccucgcccugagggaguucaaagaguuugcggccggcaggcgguccguaaguggggaccugauccucgagauaggaaagcugccacagcaccugacacagcgagcacaaaaugccuuggacaacuuagugaugcugcacaacuccgagcaagguggacgcgcguacaggcaugccauggaggagcuccccgacacaaucgagacccuuaugcugcucgcgcugaucgccgugcugacgggcggggucaccuuauuuuuccugagcggccgggggcuggguaaaaccucuaucggucuccugugugugauggcaucuuccgugcugcucuggauggcgagcgucgagccccacuggaucgccgcauccauuauccuggaguuuuuccugauggugcuccugauccccgagccggacagacaaagaacaccccaggacaaccagcuagccuacgugguuaucgggcuccuguucaugauccugaccguugccgcaaacgagaugggccuccuggagacgaccaagaaagaccuggguaucggucauguugccgucgagaaccaccaccacgccaccaugcucgacguggaccuucaccccgccagcgccuggacccuguacgcaguugcaacgacuaucaucaccccgaugaugcgccacaccaucgagaacacaaccgcuaacauaucacucacggcgauagccaaccaagcugcaauccugaugggccuggacaagggcuggcccaucagcaagauggauaucggcgucccccuuuuagcccuggggugcuacagucaggucaacccccucacgcugacagccgcggugcuuaugcuugucgcccauuacgccauuauuggcccugggcugcaggccaaggccacccgggaggcgcagaagcgaaccgccgccggcaucaugaaaaaccccaccguggacggcauugucgccaucgaccuggaucccgucguguacgacgccaaguucgagaagcagcucggccagaucaugcugcugauccucugcaccagccagauccugcugaugcgcaccacaugggcgcuaugcgaguccaucacccuggcaacgggcccccugaccaccuuaugggaagggagcccgggcaaguucuggaacaccacgaucgccgugucgauggcaaacaucuuccgggggagcuaccuggccggcgcugguuuagccuucucccucaugaagagccuggggggcgggcgacgggggaccggggcccagggcgagacccugggcgagaaguggaagcgccaacucaaccagcugagcaaguccgaguucaacaucuacaagcggagcgggaucauggagguagaccgcucugaggcaaaggagggucugaagcgcggugagaccacgcgccacgcggugagccggggcaccgcaaagcugcgcugguucguggagcggaaucucgucaagccugagggaaaggugaucgaccuuggcugcggucgcgggggcugguccuacuacugcgccgggcugaagaagguaacggaggucaagggcuacaccaagggcgggcccggccacgaggagcccaucccuauggccacguacggcuggaaccucguaaagcuacauuccgguaaggacguguuuuucacuccgccagagaggugcgacacccugcucugcgacauaggggaguccagcccuaacccgacgaucgaggagggacgcacacugaggguacugaagaugguggagccauggcuccgggggaaccaguuuuguaucaagauccugaaccccuacaugccauccgugguugaaacccuggagcagaugcagcguaaacacggcggcaugcucgugcgcaauccgcugagccggaacuccacucaugagauguacugggugaguugugggacgggcaacaucguguccgcagugaacaugacaagccgcaugcugcucaaccgcuuuaccauggcgcaccggaagcccaccuacgagcgagacguggaccugggggcgggcacaagacauguggccguggagcccgagguggccaacuuagacauaaucggccagcgcauagaaaacaucaagcaugaacauaaguccaccuggcacuacgacgaggacaaccccuauaagacgugggccuaccacgggagcuacgaggugaagccuuccggcagcgcgagcucuauggugaauggggucgugaagcuacugacuaagcccugggauguuauccccauggucacccagauagccaugacagacacgaccccuuucggccagcagcggguguucaaggagaagguggacacccggaccccgaaggccaaacggggcacugcccagauaauggaggucaccgcacgcuggcucuggggcuuccucucgcggaauaagaaaccccgcaucugcacccgggaggaguucacgcgcaaggugcggagcaacgcggcgaucggcgcgguguuugucgacgagaaccaguggaacucugccaaggaggcgguggaggacgagcgcuucugggaucugguccagaaagaacgcgaacuacauaagcaggggaaaugcgccacgugcgucuacaacaugaugggcaaacgcgaaaagaaacuuggagaguuuggcaaggcgaagggguccagggcaaucugguacauguggcugggugccagauuccuugaauucgaagcgcucggcuucaugaacgaggaccauugguucagccgggaaaacucccuaucagggguggagggcgaggggcugcauaagcucggcuacauccuucgcgauaucuccaagauccccgggggcaacauguacgccgacgacaccgccggcugggacacccgaaucaccgaggacgaccugcagaacgaggccaaaaucacggacaucauggagccggaacacgcucuuuuggcgaccuccaucuucaagcugaccuaccagaauaaggugguccgcguccagcgcccagcuaagaacgggaccguaauggacgucaucucucggcgcgaccagcggggcagcggccagguuggcacguauggcuuaaauaccuuuaccaacauggaggcucagcuuauccgccagauggaguccgaagggaucuuccucccgucugagcucgagacucccaaccuggccgaacgcguucuggacuggcuggagaagcacggcguugagcgcuugaaacguauggccaucucgggggacgacugcguggugaagccgauugacgaccgcuucgcgacggcucugacagcucuuaacgacaugggcaaggugcggaaagacaucccucagugggagcccagcaaaggguggaacgacuggcagcagguccccuucugcucccaccauuuccaccagcugaucaugaaggacggccgcgagaucguggucccgugccggaaccaggacgagcuugugggucgcgcacgggugagccaaggugccggcuggagccuccgcgagaccgcuugccugggcaagucguaugcgcagauguggcagcuaauguacuuucaccggcgcgaccucagacuggccgccaacgcgaucugcagcgccguccccguggauugggugcccaccucucguacgaccuggagcauccacgcccaccaucaguggaugacaacagaggauaugcuguccguguggaaccggguguggauagaggaaaacccauggauggaggacaagacgcacgugagcuccuggggagacgucccguaucucggcaagcgcgaggaccaguggugcggcagucugauuggccugaccgcucgcgcaaccugggcauccaauauccaaguggccaucaaccaggugcggcgccucaucgggaacgagaacuaccuggacuacaugaccagcaugaagcgauucaagaacgaaggcgaccccgagggggcccugugguag

SEQ ID NO: 23805 - RNA, 9879 nt, Artificial Sequence
  derived and/or modified CDS sequence (opt11) from DENV-1__GU131922__SS-prME
agcgugaucaugcugcucaugcugaugcccaccgccuuagcauuccaucucacuacacgugguggggaaccccacaugauuguguccaagcaggaacggggaaagagccuuuuguuuaagaccucggccggggugaauauguguacccugaucgccauggaucugggcgagcugugcgaagacaccaugaccuauaagugcccccggaucaccgaggcggagccggacgacguugacugcuggugcaacgccaccgauaccuggguaacauacgggaccuguucgcaaaccggcgagcaccggcgcgauaagcgcuccguggccuuggcaccccacgucggucugggguuagagacccgcaccgaaaccuggaugagcucagagggugcauggaagcagauccagaggguugagaccugggcgcucaggcaccccggauucaccgugaucgcguuguuccuggcacaugccaucggcacgagcaucacccaaaaggguauaaucuucauccuccugaugcuugugacgccauccauggcgaugcggugcguagguauuggaagccgcgacuuuguggagggucucucgggggccaccuggguggacgugguauuagagcaugguagcugcgugacgacuauggccaaggacaagcccaccuuggacaucgagcuccugaagaccgaagucacuaaccccgcuauccugcgcaagcucugcaucgaagcuaagaucaguaacacaaccaccgacagccgcugcccgacgcagggcgaggccacucugguggaggagcaggaugccaacuucguuugccggcggaccuucgucgaucgggggugggggaacggcugcggccuguucgggaaggguucacucauuaccugcgccaaguucaagugcgucacgaagcucgaaggcaaaauagugcaguacgagaaucugaaauacucagucaucguuaccgugcacaccggcgaccagcaucagguagggaaugaaagcaccgaacauggcacgaccgcgacuaucacgccccaggcacccaccacggagauccagcugaccgauuacggcgcccugacauuagauugcagcccucggacuggacucgacuucaaugagauggugcugcugacgaugaaggagaaguccuggcuuguccauaaacagugguuccuggaccugccccucccuuggaccagcggggccucaacuucacaggagaccuggaaucggcaggacuuacuggugacguucaagacggcccacgcgaagaagcaggaggugguugugcuaggaagccaagagggagccaugcacaccgccuuaaccggggccacggaaauccaaaccucuggcaccaccacgauauucgccgggcaccugaagugccgccucaagauggacaagcugacccugaaggguauguccuacgugaugugcaccggcucguuuaagcucgagaaggaggucgcagaaacccaacauggcacagugcuggugcaaaucaaguaugagggcaccgaugcccccugcaagauacccuuuagcacccaggacgagaagggggucacccaaaacggccggcugaucacggccaacccgaucgucaccgacaaagagaagcccgugaacauugaagccgagccgcccuucggggaguccuacauugucauaggcgcgggcgagaaggccuugaagcucaguugguucaagaaggggucaucgauuggcaagauguucgaggcgacagcacgcggggccaggagaauggcgauucucggcgauaccgccugggacuucggauccauuggaggcguguucacuagcguggggaaacugguacaccagaucuucggcaccgccuacgggguccuguuuucaggagugucuuggaccaugaaaaucggcauaggcguacugcugacguggcugggcuugaacucccgcucuacauccuugagcaugacuugcaucgccgucgggcucgugacccuuuaccugggagugaugguucaggccgacuccgggugcgugaucaacuggaagggacgggagcucaagugcgguagcggcaucuucguaaccaacgaagugcacacuuggaccgagcaguacaaguuccaggcggacagcccgaagcgccuauccgccgcuaucgguaaggcuugggaggaagggguguguggcauucggagcgccaccagacuugagaacauuauguggaagcagaucuccaacgagcuuaaccacauccugcuggaaaacgacaugaaguucacaguagucgugggggacgucgcggguauccucgcgcaggggaagaagaugauccgcccucagcccauggaguacaaguacucguggaaaucauggggcaaggccaaaaucaucggcgccgauguccagaacaccacguucaucaucgacgggccuaacacuccggagugcccagacgaccaacgcgcguggaacauaugggagguggaggacuacgguuuugggauauucacuacgaacaucuggcugaaacugcgagacucguacacgcaggucugcgaccaccgccucauguccgccgcgaucaaagauagcaaggccgugcacgcggacaugggcuacuggaucgagagugagaagaacgagaccuggaagcuggcgcgggcaaguuucaucgaggugaagaccugcaucuggcccaaaucccacacccuguggagcaaugguguccucgaguccgagaugaucauccccaaaaucuacggaggucccaucagccagcacaacuaucgcccgggguacuucacgcagaccgccggccccuggcaccugggcaagcuggagcucgacuucgacuugugugagggcacaaccguaguagucgaugagcacugcggcaaccgggggccgagucugcguacgaccaccgucaccgguaagaucauccacgaauggugcugccggagcugcacgcucccgccacuacgcuucagaggcgaagacggauguugguacggaauggaaauccggccuguuaaggaaaaagaggagaaccuggucaaguccauggugagcgcuggcagcggcgagguggacuccuucagccuagggcugcugugcaucuccaucaugaucgaggaggucaugcggaguagguggucccggaagaugcucaugaccggcacgcuggcuguguuccucuuguugaucauggggcagcugacauggaacgauuuaauccgacugugcaucauggugggcgcgaacgccagcgaccgcauggggaugggcacgaccuaucuagcucucauggcgaccuucaagaugcgaccgauguucgccguugggcugcuguuccgccggcuuaccuccagggaggugcuguuacucacaauugggcugagccugguggcguccguagagcuccccaacagccucgaggaauugggcgauggguuagccaugggcaucaugauccugaaguuguuaaccgacuuccagucccaccaacugugggccacccugcuuagcuugacuuucaucaagacgaccuucucucugcauuacgcuuggaagacgauggcgauggugcucagcauugucucucuguucccccugugccuuuccaccacgagccagaagaccaccuggcuccccgugcugcucggcucucuggggugcaagccgcugaccauguucuuaauugccgagaauaagauaugggguaggagauccuggccccucaacgaggggaucauggccguggggauagucagcauacugcugagcucucuauugaaaaacgacgugccccucgcggggccccugaucgcgggcgguaugcugaucgccugcuacgugaucagcggaucgagcgcagaucuuucccuggaaaaggccgccgaggucagcugggaggaggaggcagagcacuccggcgcgagccacaauauuuugguggagguucaagacgaugggacgaugaaaauuaaggacgaggagcgggacgacacccucaccauccugcugaaggccacccuccuggccguuuccggcguguacccguuaagcauccccgccacacucuuugucugguacuucuggcagaagaagaagcagcgcagcgggguccugugggauacuccaagcccgcccgagguggagagagccguucucgacgacggcaucuaccgcaucaugcagcguggccugcucggccggucccaggucggcgugggggucuuucaggagaacguguuccacacgauguggcacgugacacggggcgcggugcugauguaccaggggaagcggcuggagcccaguugggccuccguaaagaaggaucucaucuccuauggcggcggauggcgguugcaggguaguuggaacacgggggaggagguccagguaauagccgucgagccgggcaagaauccgaagaacgugcagaccgccccugggaccuucaagacccccgagggcgaggucggggccauugcacuggacuucaagccggggacgagcggauccccuaucguaaaccgcgagggaaagaucgugggccucuacggcaacgggguggucacgaccaguggcaccuacgugucagccauugcccaggcaaaagcgucccaggaggggccgcugccggagaucgaagaugaggucuuucggaagcgcaaccugacgauaauggaccuccaccccggcagcgggaagacuagacgauaccugccggccaucgucagagaagccaucaagcgcaaacugcggacccuaauccuugcuccaacgcggguuguggccagcgagauggcggaagccuuaaagggcaugcccauccgcuaccagaccacggccgucaagagcgagcacaccggaaaggagauugucgaucucaugugccacgccaccuuuaccaugcgccugcugagccccgugcgcgucccgaacuacaacaugauuaucauggacgaagcccacuuuaccgaccccagcuccauugcugcccguggauacaucagcacccgcgucggaaugggugaggcugccgccaucuuuaugaccgcgacgccaccuggauccguggaggccuucccgcagagcaacgccgucauccaggacgaggagcgugacauacccgagcggagcuggaacagcggcuaugaguggaucacggacuuucccggcaagaccgugugguucguccccuccaucaaguccggcaacgacaucgccaacugccuccggaagaaugggaagcguguaauccaacugucccgcaagacuuucgacacugaauaucagaagacaaagaacaacgacugggacuacguggugaccaccgacauaagcgaaaugggcgcgaacuuccgcgccgaucggguaaucgauccccguaggugccugaagcccgucauacucaaggacggucccgagcgcgugauucuggcuggcccaaugcccgucacgguggccucggccgcgcagcggcgcgggcggaucggacgaaaucacaacaaggagggcgaccaguacauauacaugggucagcccuuaaacaacgacgaggaucacgcucacuggacagaggccaagaugcuccucgacaacaucaacaccccggaaggcauuauacccgcauuguucgagcccgagcgcgagaaguccgccgcgaucgauggggaguaucggcuccggggcgaggcccggaagaccuucgucgaacuaaugcgccgcggggaccugccaguguggcucucauacaagguggccucagaagguuuccaauauagcgacagacgguggugcuuugacggcgagcgcaauaaccaagucuuagaggagaauauggacguggagaucuggacaaaggagggggagcggaagaagcugcggccccgcuggcucgacgccaggacguauucggacccccuggcauugcgggaguucaaagaguuugcugcgggccgccggagcguguccggggaccucauccuggagaucggcaagcugccacagcaccucacccagagagcccagaacgcccuggacaacuuagugauguuacacaauagcgagcagggcgggcgggcguaccgccacgccauggaggagcugccggacacuauagaaacacugaugcugcuggcacuuauagccguccucaccggcggagugacucucuucuuccugagcggccggggguuaggcaagaccagcauuggcuuacugugcguuauggccagcagcgugcuacuguggauggcgucaguggagccccauuggaucgccgcaagcaucaucuuggaguucuuccucauggucuuacuaaucccugagccggaucgccagcgaacgccccaggacaaccaacucgcguacgugguuauuggccugcuuuucaugauccucaccguagcggcgaacgagaugggccugcucgaaacaaccaagaaggacuuagggaucggccauguggccguugggaaucaccaucacgcagcuaugcuggacgucgaccugcaccccgcguccgcguggacccucuacgccguggcgaccacgaucaucaccccgaugaugcgccacaccaucgagaacacuacggcuaacaucucgcucaccgccaucgccaaccaagccgcgaucuugaugggcuuagacaaaggguggccgaucagcaagauggacaucggggugccccugcuagccuuaggauguuacagccagguaaacccgcugacccugacugcagccguguuaaugcugguggcucacuacgccaucauugguccgggccugcaggcuaaagcgacgagagaggcacaaaaacggaccgccgcgggcauuaugaagaaccccaccgucgacggaaucguggccaucgauuuagacccugucgucuacgacgcgaaguucgaaaaacaacuggggcagauuaugcuccucauccuauguacaucucaaauccugcuuaugcgcacgacuugggcucugugugagagcauuacacuggccaccgggccacucacgacucugugggagggcuccccggggaaguucuggaacaccaccaucgcugugucuauggccaacaucuuucggggcuccuaccuggcgggcgccggucucgcuuucagccugaugaagucccuaggagggggccgccgugggacuggggcccagggagagacccucggggagaaguggaagcgccagcugaaccagcugagcaaauccgaguucaauaccuacaagcggagcggaaucauggaagucgaccgcagcgaggcuaaagaagggcugaagagaggggaaaccacuaagcaugccguuucccgcgggacagccaaguugcgcugguuuguagaacgcaacuuggugaaacccgagggcaagguaauagaucuggggugcggucgggguggcuggagcuacuacugcgcgggccucaaaaaggucaccgaggucaaaggguauaccaaagguggccccgggcacgaggagccuauacccauggcuacguacggcuggaaccuggucaaacugcauucugguaaagacgucuuuuucauacccccugagaagugugacacccuccugugcgacaucggcgaaagcucccccaacccgacuaucgaggaggggcgcacccuucgcgugcucaagauggucgagcccuggcugcgcggcaaucaguucugcauuaagaucuugaaccccuacaugcccagcgugguggagacgcucgagcagaugcaacggaagcacggugggaugcucguaaggaacccgcugucucggaacagcacccacgagauguacuggguguccugcggcacugggaacaucguguccgcagucaauaugacaucccgcaugcuucugaaccgcuucaccauggcccaccggaaacccacguacgagagggacguggaccugggcgcgggcacgcgacacguggcagucgagcccgagguggccaaccucgauaucauaggucagcgcauagagaacaucaagcacgaacacaaguccacguggcacuacgacgaggacaaucccuacaaaaccugggcguaccacggcucauacgaagugaagccgucaggguccgccagcagcaugguuaacggcguugugaagcugcugacgaagcccugggacgugauccccauggugacccagaucgccaugacugauacaacgccauucggccagcagcgggucuuuaaggaaaagguggacacccgcacuccgaaggcgaaaagaggaaccgcacagaucauggaggugaccgcaaaguggcucuggggauuccugucgagaaacaaaaagccccgaaucugcacccgcgaggaguucacccggaagguccgcagcaacgccgccauaggugccguguucguggacgagaaucaguggaacuccgcgaaggaggccgucgaagaugagcgguucugggaccucguacacaaggaacgcgagcuccauaagcaggggaagugcgcuaccugcgucuacaauaugauggggaagcgggagaagaagcugggcgaauuugguaaggcuaagggcucccgcgcgaucugguacauguggcuaggcgcuagauuccucgaguuugaggcccugggguuuaugaacgaggaccacugguucucccgcgagaacagccuguccggcguagagggcgagggccuccacaaacuuggguacauacugcgggacaucuccaagaucccaggcggcaacauguacgcagaugauacggccgggugggauaccaggaucacggaggacgaccugcagaacgaggcccgaaucaccgacaucauggagccggagcacgcucuccuagccaaguccauuuucaagcucacguaccagaacaaggugguucgcguccaacgcccugccaagaacggcaccguaauggacgugauuagccguagggaccagcggggcuccgggcaggucggcacuuacgggcugaacaccuucacgaacauggaggcccagcuuauccgccagauggagagugagggaaucuucagccccucggaguuagagacucccaauuuagcagagagaguguuagauuggcucgagaaguacgguguggagcgacucaagcgaauggcgaucuccggggacgacugcgucgugaagccgaucgaugaccgcuucgcaaccgcccugaccgcccuaaacgacauggggaaaguucggaaggacauaccacagugggagcccucuaagggcuggaacgacuggcagcaaguacccuuuuguucccaccacuuccaccaguuaauaaugaaggacggccgcgagaucguggugccgugccgcaaucaggaugagcugguggggagggcccgggugagccagggugcgggguggucacuacgcgagacggccugccugggcaaguccuaugcccagauguggcagcugauguacuuccaucgcagagaccugagacuugcggcaaaugcaaucugcagcgccguucccgucgacuggauucccaccucccgcacgaccuggucaauccacgcccaucaccaguggaugacaaccgaggacauguugucgguauggaaccggguguggaucgaagaaaaucccuggauggaggacaagacucacauaucauccuggggcgacguccccuaccuggguaagcgcgaggaccaguggugcggcagccugaucggguuaacagcucgcgcuaccugggccacuaacauccaaguggcuaucaaucaggugcggcgccucaucgguaacgagaauuauuuagacuacaugaccuccaugaagcgguucaagaacgagagcgaccccgagggagcccugugguga

SEQ ID NO: 23806 - RNA, 9879 nt, Artificial Sequence
  derived and/or modified CDS sequence (opt11) from DENV-1__GU131923__SS-prME
agcgugaccaugcugcuuaugcugaugcccaccgcccuggccuuucaccucaccacccggggcggggagccgcacaugaucgugagcaagcaggaacggggcaaaagucugcuguucaagaccagcgccggggugaauaugugcacccucaucgccauggaccugggggaacugugugaggacacaaugacauacaagugcccccgcaucaccgaagccgagcccgacgacguggacugcuggugcaacgccaccgacacgugggugaccuacgguaccugcagccaaaccggcgagcaccggcgagacaagcgguccguggcgcuagcuccccacguaggccugggccuggagacgcgcaccgagaccuggauguccagcgagggcgcguggaagcagauccagaggguggaaaccugggcacuucgccaccccgguuuuacagugaucgcccuguuccucgcgcaugccaucggcaccucuaucacccagaaggggaucaucuucauccuccugaugcucgugacccccagcauggccaugcggugcgucggcaucggcucgcgcgacuucguggagggacucuccggcgcuacguggguugaugucgugcuugagcacgggucuugcgugaccaccauggccaaggauaaacccaccuuagacaucgagcuacugaagacggaggucaccaaccccgcuauccugcgaaagcucuguaucgaggccaagauuuccaacacuaccacugauagccgcugcccgacccagggcgaggccacgcugguggaggagcaggacgccaacuucgugugccggcgcacugucguggaccggggcuggggcaacggcugugggcuguucggcaaggggagucucaucacuugcgccaaguucaagugcgugacgaagcuggagggcaagaucgugcaauacgagaaccugaaguacagcgugauugugacugugcacaccggcgaccagcaucagguggggaaugaguccacggagcacggcacgaccgccaccaucacgccccaggcacccacaaccgagauccaacucacggacuacggagcccugacccuggacugcagcccccggacgggccucgacuuuaaugaaaugguccuguuaaccaugaaggagaaguccuggcucgugcacaagcagugguuucuggaucugccccuccccuggaccagcggagcgagcaccucacaggagacguggaacagacaggaccugcucgugaccuucaagacagcccacgcaaagaagcaggaggucguaguguugggcagccaggagggcgcuaugcacaccgcccugaccggggccaccgaaauccaaaccuccgguaccacaaccaucuucgccgggcaccugaaaugccgccuuaagauggacaagcuaacacugaagggcaugagcuacgucauguguaccggguccuuuaaguuagagaaggagguggcggagacgcagcauggcaccguguuaguccagaucaaguacgaaggcacugacgccccauguaagaucccuuucagcacccaggacgaaaaggggauuacgcagaacggccgccugaucacggcuaauccgaucguaaccgauaaggagaagcccgugaacaucgaggccgagccuccguucggggaguccuacauugucaucggcgccggcgagaaagcccugaaacucagcugguucaagaagggguccagcauaggcaagauguucgaggccaccgcccgcggggccagacgcauggcgauacugggggauacggcgugggauuuuggguccaucgggggcguuuuuaccaguguggggaagcuggugcaucaaaucuucggaaccgccuacgggguccucuucuccggcgugagcuggaccaugaagaucggcaucggcguccugcugacguggcucggcuuaaacucccgaaguaccucccucucgaugaccugcauagccguagggcucgugacccuguaccugggcgucauggugcaggccgacuccgggugcgugauuaacuggaagggccgggagcucaagugcgggagcggcauuuucgucacgaacgaggugcacaccuggaccgagcaguacaaguuccaagcggacagcccgaagcgccuguccgccgcaaucggcaaggccugggaggaaggggugugcggcauccggagcgcuacgaggcuggagaacaucauguggaaacagaucucuaacgagcucaaccacauucugcuggaaaacgacaugaaauuuaccgucguggugggagacgucgcgggcauccucgcccaaggaaagaagaugaucagaccccagcccauggaauacaaguacagcuggaaguccuggggcaaggccaagaucauaggcgcagaugugcagaacacgaccuuuaucauugacggacccaacaccccggagugccccgaugaccaacgcgcguggaacaucugggagguggaggauuauggcuucgggaucuucaccacgaacaucugguuaaaacugcgggacagcuacacccaggucugcgaccaccgccucaugucagcugcgaucaaggacaguaaggcuguacaugccgacaugggcuacuggauugaguccgaaaagaacgaaaccuggaaacuggcacgggccagcuucaucgaggugaaaaccugcauauggcccaagucgcauacgcuguggagcaacggcguccucgaguccgagaugauuauccccaagaucuacgguggcccgaucagccagcacaacuaccgcccuggguauuucacccagacagccggccccuggcaccugggcaagcuggagcucgacuucgaccugugugaggguaccacaguggugguugacgagcacugcggcaaccggggcccgucccuccgcaccaccaccgugacaggcaaaauuauucacgaauggugcugccggagcugcaccuugccgcccuuacgguuccgcggggaggacggcugcugguacgggauggagauacgccccgugaaggagaaggaggagaacuuggucaagucgauggugagcgccggcagcggcgagguugacuccuucagccucgggcuacucugcaucuccaucaugaucgaggaggucaugcguagccgcuggucucggaaaaugcucaugaccggcacacuggccguguuccugcuccugauuaugggccaacugacguggaacgaucucauccgccugugcaucauggugggcgcaaacgccagcgaucgcauggggaugggcaccaccuaccuggcgcucauggccaccuuuaagaugcggccaauguucgcagucgggcugcuguuccgccggcucacgucccgcgaagugcugcuucucacaaucggccugagccugguugcgucggucgagcucccaaacagccucgaggagcugggcgaugggcucgccaugggcaucaugauccugaagcuccugaccgacuuccagucucaccagcuuugggccacccugcucucgcugacuuucauuaagaccaccuucucccugcacuaugccuggaagaccauggcgauggugcuaagcaucgucucccuguucccccugugccucagcaccaccucacagaagaccaccuggcugccaguguugcucggcagccuggguugcaagccgcugacgauguuccucaucgccgaaaauaagaucuggggcaaacgguccuggccccugaacgaggggauuauggccgugggcaucgucagcaucuugcuuagcucccugcugaagaacgaugugccccucgcugggccauugauugcuggcgggaugcuuaucgcgugcuacgugaucagcggguccagcgccgaccucucccuggagaaggccgccgaggugaguugggaggaggaggccgagcacuccggcgcuucucacaauaucuuaguggaggugcaggacgacgguaccaugaagauaaaggacgaggagcgagaugacacccucaccauacugcugaaggccacccuccuagcagucuccggcgucuacccgcugagcauccccgccacccuguucguaugguacuucuggcagaagaagaagcagcgguccgggguccuuugggacacccccagcccgcccgagguggaacgcgccgugcuugacgacggcauauaccggaucaugcagcgcggccuguuagggcggucccaggucggaguagggguguuucaggaaaacgucuuucacaccauguggcacgugacccgcggagcugugcugauguaccaggggaagcggcuggagccuagcugggccagugucaagaaggaccucaucagcuacggcggcggguggaggcugcagggcuccuggaacacgggugaggagguccaggugaucgccgucgagccggguaagaaccccaagaacgugcagaccgcgcccgggaccuucaagaccccugagggcgaagugggcgccauugcgcuggacuucaagcccgggacgucggggucccccauuguaaaccgggagggaaagaucgugggccuguacggaaacgggguggucaccaccagcggcaccuacgugagugccaucgcccaagccaaggcgagucaggaagggccgcugcccgagauagaggacgagguauuccgcaagcggaaccugacgaucauggaucuccacccuggcagcgggaagacccgccgguaccucccggccauuguacgcgaggcuauuaaaaggaagcugagaacacucauccuggcccccacccgcguuguggccuccgagauggcggaggcccuaaagggaaugccuauccgguaccagacgaccgccgucaagucagagcacaccggcaaggaaauuguggaccucaugugccacgcuaccuucacuaugcgccugcuuucccccgugcggguuccgaacuacaauaugaucauaauggacgaggcccacuucacugacccaucuuccaucgcggcccgcgguuacaucagcacccgggugggcaugggcgaggcugccgccaucuucaugaccgcgacgccgcccggcagcgucgaggccuucccucagagcaacgccgucauccaggaugaggagcgcgacauccccgaacgguccuggaacucuggguacgaguggaucaccgacuuucccggcaagaccguuugguucgugccauccaucaagagcggcaacgacaucgccaacugucuccgcaagaacggaaaacgggucauccaguuauccaggaaaacauucgacacggaauaccagaagaccaagaauaacgacugggauuacguggugaccaccgacaucucggagaugggcgcgaacuuccgggcagaccgcgucaucgacccgcggcgcugccugaagcccgugauacucaaggaugguccagagcggguuauccuggccggcccaaugccggucacgguggcguccgccgcgcagcgccgggggcgcaucggccguaaccacaacaaggagggcgaccaguacaucuacauggggcagccucugaacaaugacgaagaccaugcacacuggaccgaggccaagaugcugcuggacaacauaaacaccccugagggcaucauccccgcccucuucgaaccggagagggagaaguccgccgcgaucgacggggaauaccgccuccggggugaggcccgcaagaccuucgucgagcugaugagacgcggggaccuaccaguguggcuguccuacaaggucgcguccgaggguuuccaguacagcgaccggcgcuggugcuucgacggcgagcguaacaaccagguccuggaggagaacauggacguggagaucuggacaaaggaaggggagcgcaagaagcugcggccacgguggcuugacgcgcggaccuacuccgaccccuuggcccugcgcgaguucaaggaguuugcagccggccggcgcagugugucuggggaccuaauccuagagauuggcaagcugccacagcaccucacccagcgggcgcagaacgcuuuagacaacuuagucaugcuucacaacagcgagcagggcgggcgcgcguaccggcacgccauggaggagcugcccgauaccaucgagacgcuuaugcuccuggcccugaucgccgugcucaccggcggugugacccuguucuuucuguccggccgcgggcucggcaagaccagcaucggccugcugugcgucauggccucgagcguguugcuguggauggcguccguggagccccacuggaucgccgccagcaucauacuugaguucuucuuaaugguccugcugauccccgaaccggaccggcagcgcacgccccaggacaaucagcucgccuacgugguaaucgggcugcuguucaugauucucacaguggccgcgaacgagaugggccuguuggagaccaccaagaaggaucuagggaucggucacgaggccguggggaaccaccaccacgcagccaugcuggauguagaccugcaccccgccuccgcuuggacccuauacgccgucgccacgaccauuauuaccccgaugaugagacacacuauugaaaacacgaccgccaacaucagccugaccgccaucgcgaaucaggccgccauccuaaugggccucgacaagggcuggcccaucuccaagauggacaucggagucccccuguuagcccuaggcugcuacagccagguuaauccucugaccuuaaccgcggccguccucaugcuaguggcccacuacgccaucaucggaccgggucuccaggcaaaggcuacccgggaggcccagaagcgcaccgccgcugggaucaugaagaaccccacaguggacgggaucguagccaucgaucuugauccugucguauacgacgcgaaguucgagaagcaguuaggacaaaucauguuauuaauccucugcacgucccagauccuucugaugcggaccacgugggcccucugcgagagcaucacccuggccacggggcccuugacuacccugugggaaggcucuccggggaaguucuggaacaccacgaucgcuguaucuauggccaacaucuucagaggcuccuaccuggcgggggccgggcucgccuucagccugaugaaaucucugggcgggggccggagagggacaggggcacagggcgagacccucggggaaaaguggaagaggcaguugaaccagcugucaaagagcgaguucaacaccuacaagcgcuccggcaucauggagguggaccggagcgaggcgaaggaggggcucaagagaggcgagacgaccaagcaugccguuagucgggggacggcaaagcugagaugguucgucgagcggaaccuagugaagccugaaggaaaagugaucgaccugggaugcgggcgcggcggauggucguacuacugcgccggccucaagaagguaacugaagugaagggguacaccaagggcggccccgggcacgaggagccgaucccgauggccaccuauggcuggaaccugguaaagcugcacuccgggaaggacgucuucuucaucccucccgagaaaugugacacccuccugugcgacauuggcgaaagcucccccaacccgaccaucgaggaggggcggacgcugcgcgugcucaaaaugguggagcccuggcugcggggcaaccaguuuugcaucaagauccugaaccccuacaugccuucagucguugagacccucgagcaaaugcagcgaaagcacggcgggaugcuggugaggaacccgcucucccgcaacucgacccacgagauguauugggucucuugcggcaccggcaacaucgugagcgcggugaauaugaccucccggaugcuccugaaccgcuucacgauggcccaccgaaaaccgaccuacgagcgggacgucgaccugggagccggcacgcgccacguggcaguugagcccgaggucgccaacuuagacaucaucgggcaacggaucgagaacauaaagcacgagcacaagagcaccuggcacuaugacgaggacaaccccuacaagaccugggcguaccauggcuccuacgaagugaagccuucugggucagccagcagcauggugaacggcgucgugaaguuacugaccaaacccugggaugucauacccauggugacccagaucgcuaugacagacacgacccccuucgggcagcagcgcguauucaaagagaaggucgacacccggaccccgaaggccaagcgcgguacagcgcagaucauggagguaaccgcgaaguggcucugggguuuccugucccggaacaaaaaaccucgcauuuguacccgggaagaguucacccgcaaggugcggagcaacgccgccauuggggcugucuucguggaugagaaccaguggaacuccgcgaaggaggcaguggaggaugagcgcuucugggaucugguccacagggagcgcgagcuccacaagcagggcaagugcgcgacguguguguacaacaugaugggcaagcgggagaagaagcugggcgaguucggcaaggcuaagggcagccgugccaucugguauauguggcugggcgcccgguuccucgaguucgaggcccugggguucaugaacgaggaccacugguucucacgcgagaacagccugagcggcguugaaggggagggucuccacaagcugggguacauccuucgggacauaucuaagaucccaggcggcaacauguacgcagacgacaccgccgggugggacacccgcaucaccgaggacgaccuucagaaugaggcccggaucacggacaucauggagccggagcacgcgcugcuggccaagucuaucuucaagcucacguaccagaacaaagucgugcgggugcagcgaccggccaaaaacggcaccgucauggacgugaucagccggcgagaccagcggggguccggccaggucgggacauaugggcugaacacguucacuaacauggaggcccagcugaucagacagauggagagcgagggcaucuucagucccagcgaacucgagaccccuaaccuggccgagcggguccuagacuggcucgagaaguacgggguggagcgccugaagcggauggcuauauccggggacgacugcguugucaagccuaucgacgaccgcuucgccaccgcccugacggcccucaacgacauggggaaggugcggaaggacaucccccagugggaacccagcaagggguggaacgacuggcagcagguccccuucugcucccaccauuuucaccagcuaaucaugaaggauggccgcgagauaguggugccuugccggaaccaggaugagcugguggggagagcccgggucucccagggagccggguggagccugcgcgaaaccgccugccugggcaaguccuacgcccagauguggcagcugauguacuuucaccgacgcgaucuccggcuggccgcgaaugccaucuguagcgccgugcccguggacuggauccccaccucucgcaccacauggagcauccacgcccaccaccaguggaugacgaccgaggacaugcugagugucuggaaccgggucuggaucgaggagaaccccuggauggaggacaagacccacaucagcucuuggggcgaugugccguaccuuggcaaacgcgaggaccaguggugcggcagcuuaauagggcucacggcacgugcgacaugggccaccaacauccagguggccaucaaccaggugcgaagacugauaggcaacgagaacuaucuggacuacaugaccuccaugaagcgguuuaagaacgagagcgaccccgaaggggcccugugguga

SEQ ID NO: 23807 - RNA, 9879 nt, Artificial Sequence
  derived and/or modified CDS sequence (opt11) from DENV-1__GQ868637__SS-prME
agcguuaccaugcugcuuaugcuuaugcccacugcccuggccuuccaccuuacuacccgcggaggggaaccgcacaugaucgugaguaaacaggagcgaggcaaaucucuccuguucaaaacgucugccggggugaauaugugcacgcuaaucgccauggaucugggagagcugugcgaggacaccaugaccuacaaaugcccgcggauaacugaaguagagcccgacgacguggacugcuggugcaacaccacggacacaugggugaccuacgguaccuguucccaaacaggcgagcacagaagggacaagagguccgucgccuuggcgccccacgucggccugggccuagagacccgcgccgagaccuggaugagcuccgagggcgcuuggaagcaaauacagcggguggagaccugggcccuccgccacccaggguuuacggugaucgcccuguuccuggcgcacgcgauagggaccucaaucacccagaaggggaucaucuucauccuccugaugcuggucacccccuccauggccaugcggugugugggcaucgguagccgcgacuucguggaggggcuuuccggcgcaacuuggguagacguugugcuggagcacgggagcugcguuaccaccauggcaaaggacaagcccacccuggacaucgagcuccucaagacugaaguaaccaaucccgccguucuucgaaagcucugcaucgaggcgaagauuuccaacaccacgacagauagccgcugcccuacccagggugaggccacccuggucgaggagcaagacgcgaacuucgugugucgccgcaccuucguggaucgcggcugggggaacggguguggucuuuucggcaaggggucccuaaucacgugcgcaaaguucaaaugcgucaccaagcuggaggggaagaucguacaguacgagaaccucaaauacagcguuaucguuaccguacacaccggugaccagcaucaagucggcaacgagucgacggagcacggcacaacggcaaccauuacaccccaggcgccgacgagcgagauucaacucaccgacuacggggcacugacccuggacugcagcccccggaccgggcucgauuucaaugagauggugcugcugacgaugaaagagaaguccuggcucgugcauaaacagugguuccuggaccugccccuccccuggaccagcggcgccagcacuucucaggagaccuggaaccggcaggaucuccuggugacguuuaagacugcccacgcgaaaaagcaagagguggugguacucggcucccaggagggcgcgaugcacaccgcccugaccggagccacggagauucagaccucuggcacaaccacgauuuucgccgggcaccugaagugucgacucaagauggacaagcugacucugaagggcaugucauacgugaugugcaccgggagcuucaagcucgagaaagaaguagcugagacccagcacggcacgguccucgugcagaucaaguacgagggaaccgaugcgcccugcaaaauccccuucuccacccaggacgagaagggagugacgcagaauggucgacuuauuacggccaacccgauugugacagacaaggagaagcccgucaacaucgaggccgagccgcccuucggagagucauacaucguaaucggcgcaggcgagaaggcgcugaaacuuagcugguucaaaaaggggagcagcaucggcaagauguuugaggcaaccgcucgcggcgcucggcggauggccauccugggcgacacagcuugggauuucggaucgaucgguggcgucuucacguccguuggcaagcugguacaccagauuuucggcacggccuacggaguccucuucaguggcgugucguggaccaugaagaucgggaucggugugcugcugaccugguuaggccugaacagccgcagcacgagccugaguaugaccugcaucgcuguuggccucgugacccuguaccugggagugaugguccaagcugacagcgggugcguuauaaacuggaaagggcgcgagcugaagugcgggucuggcaucuucgugacaaacgagguccacacguggaccgagcaguauaaguuccaggccgacuccccgaagcgccuuuccgcggccaucgguaaggcuugggaggagggugucugcggcauacguuccgcuacccggcuggagaacauuauguggcggcagaucaguaacgagcucaaccacauccugcuggagaacgacaugaaguucaccgugguugugggggauguugucggcauccucgcccaagguaagaagaugauccggccccagcccauggagcacaaauacuccuggaaaagcuggggaaaggcaaaaaucaucggugccgacgugcagaacaccacguucaucaucgacggccccaauaccccggagugcccagaugaucagcgugccuggaacaucugggagguggaggacuacggauucgggauauuuaccacgaacaucuggcugaagcugagggauuccuacacgcaagucugcgaccaccgccucaugagcgcugccauuaaggacuccaaggccguacacgccgacaugggcuauuggauagagagcgagaagaacgagacauggaaacuggcgcgcgccuccuucaucgagguaaagaccugcaucuggcccaagagccacacucugugguccaacggaguucucgagagcgagaugaucaucccgaagauuuacggcggcccgaucucccaacacaacuaccgaccgggguacuucacccaaacugcaggaccauggcacuuggggaaacuggaguuagacuucgaccucugcgaggguacuacgguuguuguugacgagcacugcgguaaccgcgggccaagccuccguacuaccacggugaccggaaagauuauccacgagugguguugccgcuccugcacguuaccaccccuccgguuuaagggugaggaugggugcugguacgggauggagauucgccccgugaaggagcgggaagagaaccuggucaagagcaugguuagugccggcucaggcgaaguggacagcuucagucucggguuguugugcauaagcaucaugauagaggaggucaugcgcucccgcuggucucgcaaaaugcucaugaccggcacccuugccgucuuuuuccugcucaucauggggcagcugacguggaaugaccugauccgccucugcaucaugguuggcgccaaugcguccgaccggaugggaauggggacgacuuaucuagcacugauggccacuuucaagaugcgaccuauguuugccgucggccugcuguuccgccgccucaccagccgcgaggugcuccugcugacgaucgggcucucgcuggucgcgaguguggagcugcccaauucccucgaggaacugggcgauggccuagcaaugggcauuaugauccucaagcuccugaccgacuuccagagccaucaacucugggcgacccuacugucgcugaccuucaucaagacgaccuuuucccugcacuaugccuggaaaacgauggccauggugcucagcaucgucagucuccucccccuaugccucuccaccacgagccagaagacuacguggcuccccgugcugcucggcucccuggggugcaagccguuaacuauguuccucaucgcggagaacaaaauauggggccgcaagucuuggccgcugaacgaagggaucauggcggugggcaucgucucaaucuugcucuccucgcugcucaaaaacgaugugccacucgcagggccccuuaucgccggcggaauguuaauagccugcuacgugaucuccgggagcuccgccgaucugucccuggaaaaggcggcugaagucaguugggaagaggaggcggagcauucaggcgccucccauaacauccugguggaggugcaggaugacgggacaaugaagauuaaggacgaggagcgagacgauacccucaccauccuucuuaaggccaccuuacuggcggucagcggcguauacccgcuguccauccccgcaacgcuguucgugugguacuucuggcagaagaagaagcaacgcagcggcgugcugugggacacgcccucaccaccggagguugaacgggcagugcuggacgacgguaucuaccgcauuaugcagcggggccuguuaggccgcagccaggucggcgugggcguguuucaggagaauguauuccacaccauguggcacgugacccgaggcgcaguucugauguaccaagggaagcgccuggagccguccugggccucggucaagaaagaccucaucucauacggcggcggguggcggcugcaggguucguggaauaccggggaggaaguacaggugaucgcggucgaacccggcaagaaccccaagaacgugcaaacggcccccgggaccuucaagacucccgaaggugaggugggggccaucgcccuggauuucaagccuggaaccuccggcucgccaaucgucaaccgcgaggguaagaucguggguuuauacggaaacggaguagucacgaccaguggcaccuacguuuccgccauugcacaagccaaggccucgcaggaagggccgcuacccgagaucgaggacgagguguuccggaaacgcaaucugaccaucauggaccuucacccgggcuccgggaagacgaggcgcuaccugccggccaucguccgggaagcuaucaagcgcaagcugcgcacccucauccuugcucccacccgggugguggccagcgagauggcagaggcccugaagggcaugccaauacgcuaccagaccacggcggucaaguccgagcauacaggccgggaaaucguggaccucaugugucaugcaaccuucacgaugcgcuuguugagccccguacgugugccgaacuacaauaugaucaucauggacgaggcacacuucacagaccccuccagcauagccgcccgcggauacaucucuacccgggugggcaugggggaagcggccgccaucuucaugaccgcaacaccgcccgggaguguugaagccuucccgcaguccaacgcggucauccaagacgaggagcgcgacauuccggagagaagcuggaacucgggguaugaguggaucacggacuuccccggcaagaccguaugguucgugccgucgauuaaguccggcaacgacaucgccaacugccuccgcaagaauggcaagcgugucauucagcuuagccguaagaccuucgacacggaguaucagaagacgaagaacaacgacugggacuauguggucaccaccgacaucucagaaaugggagcuaacuuccgggcugaccgcgugaucgauccgcggcgcugccugaagcccgugauccugaaggaugggccggagagggucauccuggcuggcccgaugccgguaaccguggcgagcgccgcccagcgccgggggcgcaucggacgcaaucauaacaaggagggcgaccaauauaucuauauggggcagcccuugaauaacgacgaagaccacgcacacuggacugaagcgaagaugcuccuggacaacauuaauaccccggagggcaucauccccgcgcuuuuugaaccagagcgggagaaguccgccgccaucgacggcgaguaccgccuccggggcgaagcccgcaagaccuucgucgagcugaugcggaggggagaucugcccguauggcuuucauacaagguggccagcgaggguuuccaauacuccgaccgacgcuggugcuucgauggcgagcggaacaaccagguccuugaggagaacauggacguggagaucuggacgaaagagggugaacgaaagaaacuccguccucgcuggcucgacgcccggacguacagcgacccccuggcccuuagagaguucaaggaguucgcagccggccggagauccguuagcggggaccucauucuggagaucgguaaguugccgcagcauuugacccagcgggcgcagaacgcguuggacaaucuggucaugcuccacaacagugagcagggugggcgggccuaccggcacgccauggaggagcugcccgauacuauugagacguugaugcucuuagcgcugaucgcagugcucacaggaggggugacgcuguucuuucugaguggacgaggacucggcaagacauccauuggccugcuguguguuauggcgaguucagcccuccuguggauggccucgguggagccccacuggauugcggccuccaucauucuggaguucuuccuaauggugcuguugaucccggagcccgaccggcaacgcacgccccaggacaaccaguuggccuaugucgugaucggucuucuguucaugauccucaccguagccgcgaacgagaugggccugcuggagacgacuaaaaaggaccucgggauuggccacguggcuguggaaaaccaccaucacgccaccaugcuggacguggaccuccacccugccagcgccuggacucucuacgcugucgcgacgaccauuaucacccccaugaugcgucacacaauugaaaacacgaccgcgaacaucucccuaacugcaaucgccaaccaggccgcgaucuugauggggcucgacaaaggguggcccaucagcaagauggacaucggcgugccccuccuggcccucggcuguuacucucaggugaacccacucacccuuaucgccgccguccuuaugcugguggcgcacuaugccauuaucggcccggggcugcaagccaaggcaacgcgggaagcgcagaaacggaccgcggccggcauaaugaagaaccccacuguggauggcaucguagccaucgaccuugaccccgugguguaugacgcgaaguucgaaaagcaacugggccagaucaugcugcucauauuaugcacuagccagauacuucucaugcggacgaccugggcccuuugugaguccaucacccuggcgacgggcccccucacgacccuuugggaggguucaccuggcaaauucuggaacaccacuaucgccgugucuauggcuaauaucuuccgcgggaguuaccuggccggagccggccucgcguucucgcugaugaagucccucggagggggccggcgcgggacuggcgcucagggcgaaacccuaggcgagaaguggaagaggcagcugaaccaacugagcaagagugaguucaacaccuacaaacgcagcggcauuauggagguggaccguucugaggccaaggaggggcugcgccgaggcgaaaccacgaaacacgcagucagccgcgguaccgcgaaacugaggugguucgucgagcgcaacuuagugaagcccgaagggaaggugaucgaccuggguugcggaaggggcggguggucuuacuacugugccgggcucaagaaggucacugaggugaagggguacacaaagggagguccgggacacgaggagccuaucccgauggccacuuacggguggaaucugguaaaacugcacagugggaaggacguauucuuuaucccgcccgagaagugcgauacgcuauuaugcgauaucggcgaguccucccccaacccgaccauugaggagggcagaacccugcgugugcugaagaugguggaacccuggcugcgcggcaaucaguuuugcauuaagauccugaaccccuacaugccauccguaguugaaacgcucgagcagaugcagcggaagcauggaggcaugcugguucgcaacccccugagccgcaacuccacccacgagauguacugggucaguugcgggaccggcaacaucguguccgcagugaacaugaccucgcguauguugcugaaccgcuuuaccauggcccaucgcaagccuacauacgagcgugacguagaccugggggccggcacccggcauguagcugucgagccggaaguagccaaucuagacaucaucggacagcgcauugaaaauauaaagcacgagcacaaguccacauggcacuaugacgaagacaaccccuacaagaccugggcuuaucacggguccuaugaagugaagcccuccggcucagcaagcaguauggucaacggaguggugaaacugcucacgaagccuugggacguaaucccaaugguaacucaaaucgcgaugacggauaccacgcccuucggacagcagcggguuuucaaggagaaggucgauacccgcaccccgaaagcaaagcgggguaccgcccagaucauggaggugacagcccgcuggcucuggggguuccugaguagaaauaagaaacccagaauuugcacccgggaggaguucacgcgcaaggugcggagcaaugcugcgauaggugccgucuucguagacgagaaccaauggaacucggccaaggaggccguggaggaugagcgauucugggaccugguucacagggaacgcgagcuccacaagcagggaaagugcgcgaccugcguuuacaacaugaugggcaagcgggagaagaagcugggugaguucggcaaagccaaggggucccgugccauuugguauauguggcugggcgcucgguuccuggaguucgaggcccugggcuuuaugaacgaggaccacugguuuagcagagagaacucccucaguggggucgaaggggaggggcuccacaagcuaggcuacauucugcgcgacaucucgaagauccccggggguaauauguacgcugaugacacggccgguugggacacccggauuacugaggacgaccuccaaaacgaggccaaaaucaccgacauuauggagccggagcacgccuuguuagccaccagcaucuuuaagcucaccuaccagaauaaaguggugcgcgugcagagacccgcgaagaacgggaccguuauggacguaauaucacgccgagaucagagaggcagcggccagguggggaccuauggccugaacacguucaccaacauggaagcccaauuaauucggcagauggaauccgaggguaucuucucccccuccgagcuugagacucccaaccuugccgagcgcguccuggacuggcucgaaaaguaugguguggagcggcugaagcgcauggccaucagcggcgacgacugcguggucaagccgaucgaugaccgguucgccaccgcguuaacagcccugaacgacauggggaaggugcgcaaggacaucccccagugggaacccuccaagggguggaacgacuggcagcagguccccuucugcucacaccauuuccaccagcugaucaugaaggacggucgggagaucguugugccgugccgcaaccaggacgaauuagucgggcgggcccgcgucucacagggcgccgguuggucccugcgagaaaccgccugccugggcaagagcuaugcgcagauguggcagcucauguacuuccaucgccgagaccuucgacuggccgccaacgcgaucugcagcgcggugccaguagauuggguccccaccagccgcacgacgugguccauucacgcccaccaccaguggaugaccaccgaggacaugcugucgguuuggaaccggguguggaucgaugagaaccccuggauggaggacaagacccacaucucgagcuggggcgacgucccguaucucggaaagcgggaggaccaauggugcggcucccugauuggccugacggccagagcuaccugggccaccaacauucagguggccaucaaccaagugcgacggcucaucgguaacgagaacuaccuugauuacaugaccagcaugaagcgcuucaaaaacgaguccgaucccgagggagcccugugguga

SEQ ID NO: 23808 - RNA, 9879 nt, Artificial Sequence
  derived and/or modified CDS sequence (opt11) from DENV-1__GQ868639__SS-prME
agcgugaccaugcuguugaugcugaugcccacagcucuggccuuccaccucaccacccggggcggggagccccacaugaucguaagcaagcaggaacgcggcaagucccuguuauucaagaccucugccgggguaaauauguguacccucaucgccauggaucugggcgaauucugugaggacaccaugaccuacaaguguccucggaucuccgaggccgagcccgacgauguggauugcuggugcaacgccacggacaccugggucacguacgggaccuguagccagacuggcgagcacagacgcgacaaacggucuguagccuuggcaccccacguggggcucggacuggaaacccggacggagaccuggauguccagcgagggcgccuggaagcaaauccagcgagucgaaaccugggcccugcgccacccaggguucaccgugaucgcccuuuuccuugcacacgccaucgguacgucgaucacgcagaaggggauuaucuucauucugcucaugcuagucacccccagcauggccaugcggugcgucggcauaggcucccgcgacuucguggaggggcuaucgggcgccaccuggguugaugucguucuagaacacggguccugcgugacgaccauggcgaaggacaagccaacccucgauauagagcuccucaagaccgaggucacgaaccccgcggugcuacggaagcuguguaucgaagccaagauuagcaacaccaccaccgacucccgaugcccgacucagggcgaggccacccucguggaggagcaggacgccaauuucgugugccggcggacauucguggaccgggguugggggaacggaugcgggcuguucggcaaagggucauuaaucacgugcgcuaaguucaaaugcgugacuaagcucgaaggcaagauuguccaguacgagaaccugaaguacuccgugauugugaccguccacaccggcgaccagcaucaaguggggaacgagagcacugagcauggcacgaccgcgaccaucacgccccaggccccauccaccgagauacagcucacggacuacggagcccucacucuggacugcagcccacggaccggccuggacuucaaugaaaugguucuacugaccaugaaagagaagucauggcugguucauaaacagugguuccucgacuugccgcugccguggacguccggggccagcaccucccaggagaccuggaaccggcaggaccuccuggugaccuuuaagacagcccacgcgaaaaagcaggaggucguggugcugggcagccaggagggcgccaugcacaccgcccucaccggggccaccgaaauccagacguccgguaccaccaccaucuucgccgggcaucugaagugccgccugaaaauggauaagcucacacugaaagguaugagcuacguuaugugcaccggguccuucaagcuggagaaggaaguagccgaaacccaacacggcaccguguuaguccagaucaaguacgagggcacggacgcccccuguaagaucccguucaguacccaggaugagaagggggucacccagaacggccggcugaucaccgccaacccuauaguuacggacaaagagaagccagucaacaucgaagccgagccccccuucggggaguccuacaucgugaucggcgcgggcgaaaaagcccugaagcuaucgugguucaagaaaggguccagcauaggcaagauguucgaggccacggcucgcggagcccggcgcauggccauccuaggcgacacagccugggacuucggguccaucggcggcguguucacuagcgucggcaagcuggugcaccagauauucggcaccgccuacggcgugcuguucuccggcgucucauggaccaugaagaucgggauuggcgugcuccugacuuggcugggucucaacuccaggagcaccucacugagcaugacaugcauugcaguugggcuggucacccucuaccuuggcgugauggugcaggccgacuccgggugcguuaucaacuggaaggguagagaguugaaaugcggcuccggcaucuucgugaccaacgaagugcacacuuggacggagcaguacaaauuccaggcggacagcccgaagcgccucucagcagcuauagguaaggccugggaggagggggucugcgguauccggagcgccacuagauuggagaacaucauguggaaacagaucucuaaugagcugaaccauauccuccuggagaaugacaugaaguuuaccgucguagucggggacguugcugggauccuggcccaggggaagaagaugauccggccccagccuauggaguauaaguacagcuggaagucauggggcaaggcuaagauuaucggugccgacgugcagaacaccaccuucauuaucgaugggccuaacacgcccgagugccccgaugaccagcgagcguggaacauaugggaggucgaggacuacggcuucgggaucuucaccaccaacaucuggcuuaagcugcgggauuccuacacccaggugugcgaucaucgccugauguccgcugcaaucaaggacagcaaggccgugcacgccgauaugggcuauuggaucgagucagagaagaacgaaacguggaagcucgcgcgugcaucuuucauagaggucaagacaugcaucuggcccaagucccacacucuguggagcaacggcgugcuggaguccgagaugaucauccccaagaucuacgggggcccaaucucacagcauaacuaccgccccggauacuucacccaaacggccggccccuggcaccucggaaagcuggagcuggacuucgauuugugcgagggaaccaccguggucguggacgaacacugcggcaaccgggggccgucacugcgcaccacaacagugacuggcaaaaucauccacgaguggugcugucggagcuguacucugccgccacugcgcuucaagggggaggacgggugcugguaugguauggagauacggcccgucaaagagaaggaggagaaccugguuaagagcauggugucugccggcucuggcgaagucgacucuuucucacuggggcuccuuuguaucuccauaaugauagaggaggugaugcggagucgguggucccguaagauguuaaugacggguacgcucgccgucuuuuuccugcuuaucauggggcaguugaccuggaacgaucugauccgguugugcaucauggucggcgcgaacgccagcgaucgcaugggcauggguaugacauaccucgcccuuauggccacauucaagaugcgcccgauguuugccguaggccuccuguucagaagacugacaucccgggaggugcuguuauugaccaucgggcugagccuggucgcguccguagagcugccaaacagucuggaagagcucggcgacgggcuggccaugggcaucaugauucugaagcuucucgcggacuuucagucccaucagcugugggccacccuccucagccucacuuucaucaaaaccaccuucucccuccacuacgcguggaagaccauggccaugguccugagcaucgugagucuguucccacucugccugagcaccaccagucaaaagaccacuuggcugccugugcuccugggcagcuuagggugcaagccgcucacuauguuccugaucgcugagaacaagaucuggggccgcaagucuuggccgcugaaugaggggaucauggcuguuggcaucgugucgauccucuuaucgucgcuguugaaaaacgacgugccccuugcugggccuuugaucgcuggcggcauguuaaucgccugcuacgucaucagcggguccagcgccgaccucucacuggaaaaggccgccgaggugagcugggaggaggaggcugagcacuccggagccagccacaacauccucguagagguccaagacgacgggacuaugaagauaaaagaugaggagcgggacgacacucugacuauccugcucaaggccacacugcuggccgugaguggcgucuacccacuuagcauccccgccacccuguuuguaugguacuucuggcagaagaagaagcagagguccggagugcuaugggacacgccaagcccgcccgagguggaaagagcgguccucgaugacggcaucuaccguaucaugcagcguggccuguuagggcguucucaaguaggagugggggucuuccaggagaacguguuccacaccauguggcacgugacccggggagccgugcugauguaccaggguaagcgcuuggagcccuccugggccuccgugaagaaagaucugaucucuuacgguggcggguggaggcugcagggcuccuggaacacgggggaggaggugcaggucaucgccguugagcccggcaagaaccccaagaacguccagaccgcucccgggacguucaagaccagcgaaggcgagguuggggcgauugcccucgacuuuaagccagguacgagcggaucccccaucguaaaccgcgaggggaagaucgugggccuguacggcaacggggucgugaccaccagcgggaccuauguauccgcaaucgcccaggcgaaagcgagccaggaggggccccugccggagaucgaggacgagguguuccggaagcgcaaccucacuaucauggacuugcaccccggcuccgggaagacccggcgcuaccuucccgccauaguccgggaagccaucaaaaggaaacuccggacccugauccuggcaccgacacgggugguugcgagugagauggcagaggcacucaagggcaugcccauccgcuaccagacgaccgccguuaagucagagcacacggggaaagaaauaguggacuugaugugucaugcaaccuucacgaugcgguuguuaagcccgguccgcgugcccaauuacaacaugauaaucauggacgaggcucacuuuaccgacccgaguagcauugcugcccguggguacaucuccacccgcgugggaaugggggaggcggccgcgaucuucaugaccgccacgccgcccgguagcgccgaggccuucccccagucaaacgccgucauccaggacgaggagcgggacauccccgagcgcucauggaacaguggguacgaguggauaaccgacuuccccggcaagacagugugguucgucccgagcaucaaguccggcaacgacaucgcaaacugcuugcggaagaacgggaagagagucauacagcugagccggaagacauucgacacggaguaccagaaaacuaaaaacaaugacugggacuacguaguaaccacggacaucuccgaaaugggcgccaacuucagagccgacagggucaucgacccgagacggugucucaagccagugauccuuaaggacgggcccgagcgcgugauucuggccggccccaugcccgucacgguggcgucggccgcccagcgucgagggaggaucggccguaaucauaacaaggaaggcgaccaauauaucuacauggggcagccgcucaacaacgacgaagaucacgcccauuggaccgaggccaagaugcugcuggacaacauaaauacccccgagggcaucauccccgcccuguucgaacccgagcgggagaaguccgccgcaauagauggcgaguauagacugcgcggagaggcucggaagaccuuuguugaacugaugcgccgcggcgaccuaccggucuggcuguccuacaaggucgccucggaagguuuccaguacuccgaccgccgcugguguuucgacggcgagagaaauaaccaggugcucgaggagaacauggauguggaaaucuggacgaaggagggggagcggaagaagcuccggccccgguggcuugacgcgcgcaccuauagcgacccucuggcccuccgggaguucaaggaauucgccgccggccggcgaucgguguccggggaccugauccucgagaucggcaagcucccucagcaccugacgcagagggcgcagaacgcucuggacaaccucgucaugcugcacaacagugagcaagggggucgggccuacagacacgccauggaggaguuaccggacacgaucgagacgcugaugcugcuggcccuaaucgccguucugaccggcgggguuacccuguucuucuugagcggacguggucugggcaagaccucaaucgggcugcucugcgucauggccagcuccgugcugcuguggauggccagcguggagccccacuggaucgcggccuccaucaucuuagaguucuuccugaugguccuacucauccccgaacccgaucggcagcgcacaccgcaagacaaccagcuagcguacguugugauuggccucuuguucaugauccugaccgucgccgccaacgagaugggccugcucgagaccaccaagaaagacuuggggauaggccacgucgccguggagaaucaucaccaugccgcgaugcuggacgucgaccuccaccccgccuccgccuggacacuuuacgccguugccacgaccaucauuaccccuaugaugaggcacaccaucgagaacacgacugcuaacaucagucugaccgcgaucgccaaccaggccgccauccugaugggucuggacaaaggauggccuauaagcaagauggauaucggcgugccccugcucgcccugggguguuacagucaggucaauccccugacccucacggccgccguuuugaugcugguggcccauuacgcgaucauaggcccggggcuccaggcgaaggccacccgggaggcccagaagcgaaccgccgcggggaucaugaagaaccccacaguggacgggaucgucgccaucgaucuggacccaguagucuacgacgccaaguucgaaaagcaguuaggucagaucaugcuccugauccucugcacgagccagauccuacugaugaggaccaccugggcuuugugugaauccauaacccucgcaacgggccccuuaaccacccugugggaggggagcccgggcaaguucuggaacaccacuaucgcggugucaauggccaacaucuuccggggguccuaccucgccggcgccgggcuggccuucagucugaugaaaucccucgggggcgggcgucggggcaccggggcccagggcgagacccuuggcgagaaguggaaacgccagcugaaccagcucagcaaauccgaguucaacaccuacaaacguagcggcauaauggaaguggaucgcuccgaggccaaggaaggccugaagagaggagagacgaccaagcaugccgucagccgcggaaccgccaagcugcggugguucguggaacgcaaccucgugaagccggaagggaagguaaucgaucugggcugcggucgcggggggugguccuacuauugcgcggggcugaagaaggugaccgaggugaagggguacacgaaaggcgggcccggccacgaggagcccauccccauggcaaccuauggauggaaccugguaaagcuccacagcgggaaggacguuuucuuugugccgccagagaagugcgacacccuacugugcgacaucggggagucgagccccaaccccacaauugaggagggccgcacguuacggguccuuaagaugguugagccguggcugcgcgguaaccaauucugcaucaagauccucaaccccuacaugcccuccgugguggagacccuggaacagaugcagcggaaacacggcggcaugcuggugagaaacccccucucucggaacaguacccacgagauguacugggucagcugcgggaccgguaauaucguaagcgccgugaacaugacgagccgcaugcuacugaaccgguucaccauggcacaucgcaagccgaccuacgaacgagacgucgaccucggcgccggcaccagacacgucgcgguggagcccgagguugcuaaccuggauaucauuggccagagaaucgagaacauuaagcaugagcacaaguccacguggcacuacgaugaagacaaccccuacaagacgugggccuaucacgggucauacgaggucaagcccucuggcuccgcuagcuccauggugaacggggucgugaagcugcucaccaagccgugggacgugauuccaaugguuacccagaucgccaugacugacaccaccccguucggccagcagcguguuuucaaggaaaaaguggacacacgcaccccuaaggcgaagcgugggacugcccagaucauggagguaaccgcaaaauggcucuggggcuuccugucucgcaacaaaaagccgcggauuugcacccgcgaggaauucacccggaaggugagaagcaacgcugcgaucggcgcgguuuucgucgaugagaaccaguggaauagcgccaaagaagccguggaggacgagcgguucugggaccucgugcaccgcgagcgggagcuucacaagcaggggaagugcgccacgugugucuacaacaugaugggaaagcgcgagaagaaauugggggaguucggcaaagcgaaagguucccgggcgauaugguauaugugguugggcgccagguuccuggaguuugaggcccugggcuucaugaacgaggaccacugguuuagcagggagaacucccucagcggcguggagggcgaagggcugcacaagcugggcuauaucuuacgcgacaucuccaagaucagcgggggcaacauguacgccgacgauaccgcaggcugggacacccguauaacugaggacgacuuacagaacgaggcaaagaucacugacauaauggagcccgagcacgcccuccucgcaaaauccauuuucaagcuaaccuaucagaacaaggugguccgcgugcagcggcccgccaagaacgggaccgugauggaugucaucagccgcagggaccagcggggcuccggccagguagggaccuacggacugaacacguucaccaauauggaggcgcagcugauccggcagauggagucggaagggauauucucaccgucagagcuggagacccccaaucuggccgagcgggcucuugacuggcuagagaaacaugguguggaacgccugaagcggauggccauuagcggggaugacugcgucgucaagcccauagacgacagguucgccacagcgcucacggcacugaacgacaugggaaagguacggaaggauaucccccagugggagcccuccaagggguggaacgacuggcagcagguacccuuuuguagccaucacuuccaccagcugaucaugaaggacggcagagagaucguggugcccugccggaaccaggacgagcucgucggacgugcgcgggugucucagggggccgguuggucauuaagagagaccgcuugccuggggaagucuuacgcccagauguggcaacucauguacuuccacaggcgggauuugcggcuggccgcgaacgcaaucugcagcgcggugcccgucgauuggguuccgaccagcaggaccaccuggucgauccacgcccaucaccaguggaugacgaccgaggacaugcucucaguauggaaccgggucuggaucgaggagaaccccuggauggaggauaagacccacaucucaucuugggaggacguaccuuaccuuggcaagagagaggaccaguggugcgggagccuaaucggccucacggcccgggccaccugggcuaccaacauacaaguugccauuaaccagguccgccgccuuaucggcaacgagaacuaccuggacuacaugaccagcaugaagcgguucaagaaugaaucggaucccgagggugcccucugguga

SEQ ID NO: 23809 - RNA, 9879 nt, Artificial Sequence
  derived and/or modified CDS sequence (opt11) from DENV-1__GU131925__SS-prME
agcguaaccaugcugcucaugcugaugccgacugcccuggccuuccaccugaccaccaggggcggggagccgcacaugauugucagcaagcaggagcggggcaagagccuguuguucaagaccagcgcggggguuaacaugugcacccucaucgcaauggaccugggcgaacuuugcgaggauacgaugaccuacaaguguccgcgcauuaccgaggccgaacccgacgacguggauugcuggugcaacgcgaccgacacuugggugacguaugggaccugcagucagacgggugagcaccggcgcgacaagcgguccguggcccucgcgccccaugugggccucgggcuggagacccgcaccgaaacguggaugagcuccgagggugcguggaagcaaauccaacgggucgagacuugggcgcuccggcaucccggguucaccgucauagcccuguucuuggcgcacgcaaucggcacgagcaucacccagaaggggauuauauucauccucuuaaugcuggugaccccuucaauggccaugagaugcgucggcaucggcucucgcgacuucguagagggguuguccggagccacuuggguggacgucgugcuagagcacgggagcuguguuaccaccauggcaaaagacaagccgacccuggacaucgagcuccugaagacggagguuaccaaccccgcgaucuuacggaagcucugcaucgaggccaagaucuccaacacuacuacggacucacgcugcccgacccaaggagaggccacucugguggaggaacaggacgccaacuucgugugucggcgcaccuuuguggaccggggcugggggaacggaugcgggcuguucggcaaggggucccucaucacgugugccaaguucaagugugugacuaagcuagagggcaagaucgugcaguacgagaaccucaaauacagcgucaucguuaccguacauacuggcgaccagcaccaggugggaaacgagucgacggagcacggcacuaccgcgaccaucaccccccaggccccgacaaccgagauccagcugaccgauuacggcgcccugacccuggacugcucgccccgcacgggccucgacuucaacgagauggugcugcucaccaugaaagagaagucauggcuuguccauaagcagugguuccuagacuuaccuuuacccuggaccagcggagcaucaaccucccaggagaccuggaaccggcaggaccucuugguaacguucaagaccgcccacgccaagaagcaagagguggucgugcucggaagccaggagggagccaugcacacggcccuaacuggagccaccgagauccagaccuccgggaccacgaccaucuucgccggccaccugaagugucgcuugaaaauggacaaacugacccugaaaggcaugagcuacgugauguguaccggguccuuuaagcucgagaaggaggucgcggagacacagcacgggaccgugcuagugcaaaucaaguacgagggcaccgacgccccaugcaagauucccuucagcacgcaggacgagaagggcgucacucagaacggacgccugauaaccgccaacccgaucguaaccgauaaggagaagcccgucaacauugaagcugaaccgcccuucggggagucuuauaucgucauuggagcgggcgagaaggcuuuaaaacucagcugguucaagaagggaagcuccaucggcaaaauguucgaggccacugcgcgcggugcccggcguauggcuauccugggcgacacugccugggacuucggcuccaucggaggcguguucaccagcgucgguaaacugguucaccagaucuucggcaccgccuacggaguacucuuuuccggcguaagcuggaccaugaaaaucgggaucggcgugcuauuaacauggcucggccugaacucccgaucaacaucccugagcaugacaugcaucgccgugggucucguaacgcuguaucugggaguuaugguccaggccgacucugggugugugaucaauuggaagggcagggaacucaaauguggcucugggaucuucgucacgaaugaaguacacacauggacagagcaauacaaguuccaagcggacucaccgaagcgccuauccgccgcuaucggcaaggccugggaggaggggguaugcggcauccggagcgccacacgacuggagaacaucauguggaagcagaucagcaacgagcuuaaccauauucugcuggagaaugauaugaaguucaccgucguggugggggauguagcgggcauccucgcccagggaaagaagaugauccggccccagccaauggaguauaaguauagcuggaagucauggggcaaggcaaagaucaucggcgcugacgugcaaaacacgaccuucaucauugacgggcccaauacucccgaaugucccgacgaccaacgcgcguggaacaucugggagguugaagacuacggcuucggcauuuucaccacgaacaucuggcucaagcugagggacagcuacacucaggucugcgaucaucgccuuauguccgccgccaucaaggacagcaaggcugugcacgccgauaugggcuauuggaucgagagugaaaaaaaugagaccuggaaacuggcgcgagcuagcuucaucgagguuaaaacgugcaucuggcccaagucgcacacgcuguggucaaacggcgugcucgaguccgagaugaucaucccgaagauauaugggggcccgaucagccagcacaauuaucggcccggguacuuuacgcaaaccgccggaccuuggcaccuggggaaacuggagcucgacuucgaccugugugagggcaccaccguagugguugaugaacacugcggcaaccgggggccgucccugcgcacgaccaccgugacggggaagaucauccacgaguggugcugucggagcugcaccuugccgccauuacgauuccgcggggaggacggcuguugguauggcauggagaucaggcccguaaaggagaaggaggagaaccuggugaaguccaugguuucugccggauccggcgaggucgacucauucagccucgggcuacugugcaucuccauuaugauugaagaggucaugagaagccgguggucccguaagaugcucaugaccggcaccuuggcaguguuucugcuccugaucaugggucagcugacauggaacgaccucauccgccucugcauaaugguaggugcgaaugcgucugaccgcauggggaugggaaccaccuaccuggcccucauggccacauucaaaaugcgcccgauguuugcagucggucugcuguuccgcagacuaacgucccgcgagguuuuguugcuuaccaucgggcucucguugguggcguccgucgagcuccccaacucacuugaagaacugggcgacggguuagcuaugggcaucaugauccuaaagcugcucacugacuuccagagucaccagcugugggccacgcugcuaagccucaccuuuaucaagacgaccuucucccugcauuacgcuuggaagaccauggcaaugguacucagcaucgucucccuguucccacuuuguuugaguacgacuucccaaaagaccacauggcugcccguguugcuaggcagccuggggugcaagccgcugaccauguuucucaucgccgagaacaagaucugggggcggcgcucguggccccugaaugagggcaucauggccgugggaaucgucagcauccuccucagcagucugcugaaaaacgacgugccccucgccggaccccugaucgcgggcgguaugcugaucgcaugcuacguaaucagugguuccagcgccgaccugagccuggaaaaggccgccgaagucagcugggaggaggaggcggaacacuccggggcaucccacaacauccugguagaaguucaagaugacgggaccaugaagauuaaggaugaagagcgcgacgacacccucaccauccuacugaaggccaccuugcuagcagucuccgggguauauccccugagcauccccgccaccuuauucgugugguauuuuuggcagaaaaagaagcagcgcucuggcguacuuugggacacucccagcccgcccgagguggagcgggccgugcuggacgacggcaucuacaggaucaugcagcggggauuacucggccgcucccaggucgggguggggguuuuccaagagaacgucuuccauacuauguggcaugugacacgcggcgcggugcucauguaccaggggaagcgccucgagcccagcugggccuccguuaagaaagaucucaucagcuacggcggcggguggcgguuacagggcuccuggaacacgggagaggagguccaggugauagcuguugagcccggcaagaaccccaaaaacguacagaccgcgcccgggacguuuaagacccccgaaggcgaggugggcgcgauagcgcuggacuucaaaccggguacaagcggaucccccauagugaaccgcgaggggaaaaucgucggguuguacggaaacgggguuguuaccaccagcgguaccuaugugagcgccaucgcucaggccaaggcgucccaggaggggccccugcccgaaaucgaggaugagguguuccggaagcggaaccugacgaucauggaccuacaucccggaucggggaagacgcggcgauaucucccggccaucguaagagaggccaucaagcguaagcugagaacccucauccuggcccccacccgggucguggccuccgagauggccgaggcccugaagggcaugcccauccgcuaccagacaaccgccgucaagagcgagcauacugguaaggagauuguggacuuaaugugccacgcuaccuucacgaugcggcugcugucccccgugcgcgugccgaacuacaauaugauuaucauggacgaagcgcacuucacugacccaagcuccauugcggcuaggggguacauaagcacccgcgugggcaugggggaggccgccgcuaucuucaugaccgcgacgccuccgggguccguggaagccuucccacagucuaacgcggucauacaggacgaggagcgggacauuccugaacgcagcuggaacagcggauacgaguggaucacugauuucccuggcaagacuguuugguuugugccuucaaucaagagcgggaacgacaucgccaacugccuaagaaaaaacgggaaacgugucauccagcugagucggaaaaccuucgacacggaguaccagaagacgaagaacaacgacugggauuacguggugaccaccgacaucucagagaugggcgcgaacuuuagagcggaucggguaauagacccacgccgaugccugaaacccgugauucucaaggacgggcccgagcgcgugauccuagccggucccaugccggucacggucgccuccgccgcgcagcggagggggcggauaggacgcaaccacaacaaggaaggcgaccaguauaucuacauggggcagccucugaacaacgacgaagaccaugcccacuggaccgaagccaaaaugcugcuggauaacauaaacacgccugaaggcauuauccccgcacuguucgagccggagcgggagaaauccgcugcgaucgauggggaguaccgccuccgcggcgaggcccggaaaaccuucgucgagcugaugcggcgaggggaucuucccgugugguuaagcuacaaaguggccuccgaaggcuuccaauacucagaccguagguggugcuuugacggugaacgaaauaaucaggugcuggaggagaacauggacguggagauauggaccaaggaaggcgagcggaagaaacugcgccccagauggcuugacgcgcgcacuuauuccgauccccuggcccugcgggaguucaaagaguucgcggccggccgccguagcguuucaggcgaccucauccuggagauaggcaagcugccccagcaccucacccaacgugcacaaaacgcacuggacaaccuggucauguuacauaauagcgagcagggcgggcgagccuaccgccacgccauggaggagcucccagacaccaucgaaacuuugaugcuccuggcauugaucgcggugcucaccggaggcgugacccuguucuuucuuuccggccggggauugggcaaaacuagcaucgggcuucugugcgucauggcauccagcgugcuccuguggauggcguccguggaaccccacuggaucgccgccagcaucauacuggaauucuuccucaugguucugcuuauccccgagccggaccgccaacggacgccccaggauaaccagcuggccuacguggugaucggccugcuguucaugauucucacggucgccgccaacgagauggggcugcuugagacgacgaagaaggaccuugggauaggccacguugccguggggaaccaccaccaugccgcaaugcuagacguagacuugcauccugcuuccgcguggacucuuuaugccguggccacgaccaucauaaccccuaugaugcgccacacaaucgaaaauacuaccgccaacaucagccugaccgccaucgcaaaccaagcagccauccuaaugggacuugacaaaggcuggcccaucuccaagauggauaucggugugcccuugcuugcccucggguguuacagucaggucaauccgcugacccugaccgcggcagugcucaugcuuguggcacacuacgccaucaucgguccgggccugcaggcuaaggcgacccgugaggcccagaagcggaccgcggcggggaucaugaagaacccaacagucgacgguaucguagccaucgacuuggaccccguuguuuacgacgcgaaauucgagaaacaguuagggcagauaaugcugcucauccuaugcacgagucaaauccuacucaugaggaccaccugggcacugugcgagagcaucacguuggccacggggccccucacuacccugugggaaggaagcccggguaaguucuggaacacaaccauugccgucucaauggccaacaucuuucgggguucuuaccuggccggagcagggcucgcauucagccucaugaagagccugggcgggggccggcgggggacgggggcccagggcgagacccuaggggagaaguggaagagacaacugaaccagcugagcaagagcgaguucaacacguauaagcgguccggaaucauggaaguggaccgcucggaggcgaaagaagggcuaaagcggggcgagacgacgaagcacgcggugucccgcgggaccgccaagcugaggugguucguggagcgcaaucuggucaaaccagagggcaagguuaucgaccuugggugugggcggggcggcuggagcuauuacugugcuggccucaaaaaggugacagaagugaagggguacacgaaaggcgggcccggccacgaagagccgauuccuauggccaccuacggauggaaccuggucaagcugcacuccgguaaggacguguucuucauuccgcccgagaagugcgauacccucuugugcgacaucggagagagcagucccaacccgaccauagaggagggucgcacucugcggguacucaagauggucgagccgugguugaggggcaaccaauucugcaucaagauccugaacccguacaugccaagcgugguggaaacccuugagcagaugcaacguaagcacggcggaaugcucguccgcaauccuuugucccggaacagcacccacgagauguauugggucuccugcggcaccggaaacaucgugagcgccguuaacaugacgucuaggaugcucuuaaaccgcuucacgauggcacaucggaagccaacauacgagcgcgacguagaccugggugccggcacacgucacguggccguagagccugaaguagccaaccuugacaucaucggacaacgcaucgagaauauaaagcacgaacacaagucaaccuggcauuacgacgaggauaaccccuacaagacgugggcguaucauggcuccuaugaggucaagccaagcggcuccgccuccagcauggucaacggcguggucaagcuguugaccaagccgugggacgucauccccauggugacccagaucgcaaugacugauacgacuccauucgggcagcagaggguuuuuaaggaaaaaguggauacccgcaccccgaaggcaaagcggggcacggcgcaaauuauggaggugaccgcgaaguggcucuggggcuuccugucacguaacaagaagccccggaucuguacgcgcgaggaguuuacccguaaaguucguuccaacgcugcuaucggggccguuuuuguagacgagaaccaguggaacuccgccaaagaagccgucgaggaugagcgguuuugggaccuggugcauagagagagagagcuucacaaacaaggcaagugugcuacgugcguguacaauaugauggggaagcgggagaaaaagcugggcgaguucgggaaggccaagggcucacgcgccaucugguacauguggcugggggcgcgguuccucgaguucgaggcccugggcuuuaugaacgaggaucauugguucucccgggagaacagccugucgggcgucgagggggagggucuccacaagcugggguauauccugcgcgauaucagcaagauacccggcggcaacauguacgcugaugauaccgcggggugggacaccagaauaaccgaagaugaccuccagaaugaggcgaggaucacggacauuauggaaccggaacacgcgcugcuagcgaaguccaucuucaagcucaccuaucaaaauaagguggugagaguccagcgcccugcgaagaacggaaccgucauggauguaaucagccggcgcgaccaaagggggucgggccaagucggcaccuacgggcugaacacauucacaaacauggaggcucagcuuauccgccagauggagagcgaagggaucuucucccccagcgaacucgaaaccccaaaccuggccgagcgcguguuagacuggcucgaaaaguacggggucgagcggcugaagcgcauggcgaucuccggcgaugacugugucguaaagccgaucgacgacagauucgcgaccgcccucacugcacucaacgacaugggaaaggugaggaaggacauaccccaaugggagccuaguaagggcuggaacgauuggcagcaaguccccuuuuguucccaccauuuccaccaauugaucaugaaagacggccgggaaaucguggugccgugccggaaccaggaugagcugguugggcgugcccgcgugagccagggcgcuggguggucguugcgugagaccgccugccugggcaaauccuaugcccagauguggcagcucauguacuuucacaggcgggaccuccgauuggccgcuaacgccauuuguagcgccgugcccgucgacuggaucccuacgucccggaccaccuggagcauccacgcccaccaccaguggaugaccaccgaggacaugcuguccguguggaaccgcguguggaucgaggagaauccuuggauggaagacaagacccacaucaguuccuggggagacguccccuaccucggcaagcgcgaggaucaguggugcggcucucugaucggccugacggcuagagcgacgugggcaaccaacauucagguagccauaaaccaagugcgccgguuaaucggcaacgagaauuaccuggauuacaugaccucaaugaagagguucaagaaugagagugaucccgagggagcccugugguga

SEQ ID NO: 23810 - RNA, 9879 nt, Artificial Sequence
  derived and/or modified CDS sequence (opt11) from DENV-1__GU131926__SS-prME
aguguaacuaugcuucugaugcucaugcccaccgcccuugccuuucaccuuacuacccggggcggggaaccccauaugaucguuagcaagcaggaacggggcaagucacuccucuucaagacuagcgccggggugaacauguguacccucauugccauggaccugggugaguucugcgaggacaccaugaccuauaagugcccccggaucagcgaggccgagccggaugacguagauugcuggugcaacgccacggacaccuggguaacguacgguaccugcagucaaaccggcgagcaccggcgcgacaagcggagcguggcccuggcgccccacgugggccucgggcuggagacccggacugagaccuggauguccagcgagggcgccuggaagcagauccagagaguagagaccugggcucugcgccaccccggguucaccgugaucgcccucuuccuggcgcacgcgauagggacguccaucacgcagaaggguauaaucuucauccugcuaaugcuggugacccccagcauggccaugcggugcgucggcaucggcucucgcgacuucguggaggggcugagcggggccaccuggguggacgucgugcucgagcacgggaguugcgugacgaccauggcuaaggacaagcccacccuggacauugaguugcucaagacagaggucacgaaccccgcgguguuacggaagcugugcauugaagcuaagauuagcaauacuaccaccgacucccgcugcccgacgcagggcgaggccacccucguggaggagcaggacgcgaacuucgucugccggcgcacauucguggaucggggcugggggaacgguugcggucuguucgguaaggggagccugaucacgugcgccaaguucaagugugugacgaagcuagaaggaaagauaguccaguacgagaaucugaaguacuccguaaucguaaccguccacaccggcgaccagcaccagguggggaacgagucaaccgagcacggcacgaccgcaaccaucacgccacaagcccccucaaccgagauccagcuuacggacuauggggcccuuacccuggauugcucgccacgcaccggccuggacuuuaacgagaugguucuccugacgaugaaggagaaguccuggcuggugcacaagcagugguuccucgaccucccgcugcccuggacuuccggggccagcaccucccaggagaccuggaaccggcaggaccucuuagucacguucaagacugcccaugcgaagaagcaggaggucgugguguuggggucucaggagggagccaugcacaccgcccucaccggcgccaccgagauccagacguccggcaccaccaccaucuucgccggucacuugaagugccggcugaagauggacaaacuuacgcugaagggcaugagcuacgucauguguaccggguccuucaagcuggagaaagagguggcggagacgcagcacggcaccguacuuguccagaucaaguacgagggcacggaugcgcccugcaagauucccuucagcacccaggacgagaaaggggugacccagaacggccgcuugaucaccgccaacccgaucgugacggacaaggagaagcccgucaacaucgaagccgagccgccguucggggaguccuauaucgugaucggugccggcgagaaggcucugaagcugagcugguucaagaaggguuccagcaucggcaagauguucgaagccaccgcccggggcgcccggcggauggcgauccucggcgacacugccugggacuucggguccaucggcggcguguucaccagcgucgggaagcuggugcaccagauuuucggcacggccuacggagugcuguucuccggcgucagcuggaccaugaagaucgggaucggcgugcuccugacauggcuaggcguuaacucccgcucuacgucucucagcaugacgugcaucgcgguugggcucgucacccuguaccugggcguuaugguccaggcugacucugggugcgugaucaauuggaagggccgggaguuaaagugcggcaguggcaucuuugugaccaacgagguccacaccuggacagagcaguacaaguuccaggcagacucuccgaagcgacuguccgcggccaucgggaaggcgugggaggaagggguuugcggcauccggagcgccacccgccucgagaacaucauguggaagcagaucuccaacgagcugaaccacauccugcucgagaacgacaugaaguucaccguggucgugggggacguggcgggcauccuggcccaggggaagaagaugauccggccgcagccgauggaguacaaguauucguggaaguccuggggcaaggcgaagaucaucggcgcggacguccaaaacaccaccuucaucauugacgggcccaacaccccggaaugccccgacgaccagagagcguggaauaucugggagguggaggacuaugguuucgggauauucaccaccaacaucuggcuuaagcugcgggacucuuacacccaggugugcgaccaccgccugaugagcgccgccaucaaggacagcaaggcaguccacgccgacaugggguauuggaucgaguccgagaagaacgagacguggaaacuugcgcgggccagcuucaucgagguuaagacauguaucuggcccaagucccacacucucuggagcaacggcguccucgagucggaaaugauaauccccaagaucuaugggggcccgaucagccagcacaacuaccgccccggguauuucacccaaacggccggccccuggcaccugggaaagcuagaacuggacuucgaucugugcgagggcaccaccguggugguggacgaacacugcggcaaccgggggccguccuuacgcacuacgaccgucacugggaagauaauucacgaguggugcugucggagcuguacucugccgccccugcgcuucaagggagaggauggcugcugguacgguauggagauccggccugugaaagagaaggaggagaaccucgucaagucgaugguuuccgccggcagcggugagguggacuccuucagccuuggucuucucugcaucuccaucaugaucgaggagguuaugcggagucgcuggucccgcaagaugcugaugacgggcacccuggcagucuuuuuccuccugaucauggggcagcugaccuggaaugaccucauccgucugugcaucauggugggcgcgaacgcgagcgaccgcaugggaaugggcaugaccuaccuagcacucauggccacauucaagaugcgcccgauguucgccgugggccugcuguuccgucgccucaccucccgggagguccugcuacuaacuaucgggcugucccuuguagcguccgucgagcucccaaacagccuggaggagcuaggcgacggacuagccaugggcaucaugauccugaagcugcuuaccgacuuccagucccaccagcugugggccacgcuccucagccugaccuucaucaagaccaccuuuucccugcauuaugcuuggaaaacgauggcuauggugcucucaaucguaucccuguucccgcugugcuugagcaccaccucccagaaaaccacguggcugcccguccugcucggcagucuggggugcaagccgcucaccauguuccugaucgccgaaaacaagaucuggggccgcaagucauggccccugaacgaggggaucauggccguagggaucguguccauccuacucagcagcuuacugaagaacgacgucccccucgcagggccucugaucgccggcggaauguugauugccugcuaugugaucagcgguucaagcgccgaccucagccuggagaaggcggccgaagugagcugggaagaggaggccgagcacucgggggcuagccacaauauccucgucgaggugcaggacgacgggacgaugaagauaaaggacgaggagcgggaugacacccucacuauccuccugaaagccacacuacuggccgugucuggcgucuauccacugagcauccccgccacccuuuucguuugguauuuuuggcaaaagaaaaagcagagguccgggguguuaugggacacccccucgccgccagaggucgagcgggccguccuggacgacgggaucuaccgcaucaugcagcggggccuccuggggcgcucccaggugggaguugggguauuccaggagaaugucuuccacaccauguggcacgucacgcggggcgcgguucuuauguaucaggggaagcgccuggaaccuucaugggccuccgugaagaaggacuugaucagcuacggcggcggcuggcgacugcaggggucuuggaacaccggcgaggagguucaggugauagccguggaacccggcaagaacccuaagaacguacagaccgcccccgggaccuucaagacgagcgagggcgaggucggggccaucgcccuggauuuuaagcccgggaccagcggcucccccaucgugaaucgcgaggggaagaucgucggcuuauacggcaacgggguagucaccaccuccggcacguacgucuccgccaucgcccaggccaaggcaagccaggaggggcccuugccggagaucgaggacgagguguuccggaaaaggaaccugacuaucauggaccuccaccccggcuccgggaagacccgacguuaucugccggcuaucgugcgggaggccaucaagcgcaagcugcgcacccucauccuggccccgacgcgcgucguggccagcgagauggcggaggcccuaaagggcaugccaauucgcuaccagaccaccgccgugaaguccgagcacacgggcaaggagaucgucgaccucaugugucaugccacguuuaccaugcggcugcugagccccgugcgcguccccaacuacaacaugaucaucauggacgaggcccacuucaccgauccuuccucgaucgcggcccggggauacaucuccacgcgcgucggcaugggggaggcggcugccaucuuuaugacggcaacuccgcccggcagcgccgaggccuucccccaguccaaugccgugauccaggacgaggagcgggacaucccggagcgaagcuggaacuccggguacgaguggaucaccgacuuucccgggaaaaccgugugguucguuccaucuauuaaguccggcaacgacauagcaaacugccuccggaaaaacgggaagcgcgugauccagcuuagccggaagacguucgacaccgaguaccagaagaccaaaaacaaugauugggacuacguggugaccacggacaucuccgagaugggcgccaacuuccgcgcggaccgggugaucgacccgagacggugccugaagccggucauccucaaggacgggccagagagggucaucuuggccggccccaugcccgugaccguagcuagcgccgcccaacggcgcgggcggaucggccguaaucacaacaaggagggcgaucaguacaucuauaugggacagccgcugaauaaugacgaggaccacgcccacuggaccgaggccaagaugcuccuggacaacaucaauacccccgagggcaucauccccgcccuuuucgagccugagcgggagaaauccgcggccauugacggcgaguaccgccuccgcggcgaggcccguaagacguuuguggaauugaugcgucgcggcgaccuaccgguguggcucuccuauaagguugccagcgaggguuuccaguacucagaucgccgguggugcuucgauggcgaacgcaacaaccaagugcuggaggaaaacauggacguggagauauggaccaaggaaggggagcggaagaaacuacgcccccguuggcucgacgcccgcacauacagcgacccccuggcucugcgggaguucaaggaguucgccgccggacgcagaucagucagcggggaucucauccuggagaucggcaagcugccccaacaccucacccagcgcgcccagaaugcucuggauaaucuggugaugcuacacaacuccgaacagggugggcgcgcauauaggcaugccauggaggagcugccggacacgauugagacccugaugcuccuggcacugauugcgguguuaacuggcggugucacccuguucuuucuaucaggccgggggcucggcaagacguccaucggccuucugugcgugauggcgagcuccguacuucuauggauggccagcgucgaaccccacuggauugccgccuccauaauccuggaguucuuccucaugguucugcugauccccgagcccgaccgccagcgcacaccccaggacaaccagcucgccuacgugguuaucgggcugcuguucaugauccucaccgucgcggccaacgagaugggccugcuggaaaccaccaaaaaggaucucggaaucggccacguggccgucgagaaccaccaccacgccgcaaugcuggacguggaccugcaucccgccagcgcauggacgcucuacgccguggccaccaccauaaucacccccaugaugcgccacacgaucgagaacaccaccgccaacaucagucuuaccgcgaucgccaaccaggccgcgauccugaugggguuagacaagggauggccgaucagcaagauggacaucggcgucccccugcuggcgcucgggugcuacucccaggugaacccacugacgcugaccgccgccgugcuaaugcugguagcccacuacgccaucaucggccccggucuacaggcgaaagcuacccgggaggcccaaaaacgcaccgccgcugguaucaugaagaacccaaccguggacgggaucguggcgaucgaccucgaccccgucguguacgacgccaaauucgaaaagcaacugggccagauuaugcugcucauccuguguaccagccagauccugcucaugcguaccaccugggcccugugugaauccaucacgcuggccaccggccccuuaaccacccugugggaggggagccccggcaaguucuggaacacuacaauagcagugucgauggcgaacaucuucagaggguccuaucuggccggagccggccucgcguucagccugaugaagagucucgguggcgggcgccgagggaccggugcgcagggugagacgcucggcgagaaguggaagcgccagcugaaccaacugucaaaguccgaguucaacacguacaaaaggagcgggaucauggaggucgaccgauccgaggccaaggagggccucaagcgcggagagaccacuaagcacgccgugagccgcggcacugccaagcugcgcugguucguggagcgcaacuuaguuaagccugaggggaaggugaucgaccucggcuguggucgcggagggugguccuacuacugcgccgggcucaagaaggugacagaggucaagggguacaccaagggcggccccggucacgaggagcccauaccuauggcaaccuacggguggaaccuggugaagcuccacagcgguaaggacguguucuucgucccucccgagaagugcgacacccuccugugcgacauaggggaguccagcccgaaccccacgaucgaggaaggccgcacacugcggguccucaaaaugguggagccgugguuaagaggcaaccaguucugcaucaagauccugaaucccuacaugcccuccgucgucgagacccucgagcaaaugcagcggaaacacggcggcaugcugguacgcaacccacucagcagaaacuccacccacgagauguacugggucucuugcgggacuggcaacaucgucuccgccgugaacaugacaagcaggaugcuccugaaccgguucacaauggcccaccgcaaaccgaccuacgagcgugacgucgaucugggggccggaacccggcacguggccguggagccugaggucgcgaaccucgacaucaucggccagcgcaucgagaacaucaagcacgagcacaaguccacguggcacuacgacgaggacaaccccuacaagaccugggcguaucacgggagcuacgaagugaagcccagcggcuccgccaguuccauggucaacgggguggugaagcugcugaccaagccgugggacgucauuccuauggugacucaaaucgccaugacggacaccacgcccuucgggcagcagcggguguucaaggagaagguugacacuaggacgcccaaggccaagcggggaaccgcgcagaucauggaggugaccgccaaguggcucuggggcuuccugagccgcaacaaaaagccccggaucugcacccgcgaggaauuuacgcguaaaguucgcucuaacgcugccaucggcgcggucuucguggacgagaaccaguggaauagcgcuaaggaggcaguugaggacgagcgguucugggaccugguccaccgggagcgggaacuucacaagcaggggaagugcgcgaccugcguguacaacaugaugggcaaacgcgagaagaagcugggagaguucggcaaggccaaggggucucgggcgauaugguacauguggcugggcgcucgcuuucuggaguucgaggcauuaggcuucaugaacgaggaccauugguuuagccgggaaaauucccugagcgggguugagggugaggggcuccacaagcugggcuacauccuuagggacaucuccaagaucagcgggggcaacauguacgccgacgacaccgccggcugggacacccguauuacggaggacgacuugcagaacgaggcgaagaucaccgauaucauggagcccgagcacgcgcuacuggccaagagcaucuuuaagcuaaccuaccagaacaaagucgugcgcgugcagcgucccgccaagaacgggaccgugauggacgugauaucucgccgagaccagcggggcuccggccaggugggcacguacggccugaacacauucaccaacauggaggcacagcugauccgccagauggaaagcgaggggaucuucagcccgucggagcucgaaacccccaaccucgcggagcgggcccuggacuggcucgagaaacauggagucgaacgccugaagcggauggcuaucaguggggacgacugcguggucaagcccaucgacgaucgcuucgccacggcacugacggcgcucaacgauaugggcaagguccggaaggauauuccccagugggagccguccaagggauggaacgacuggcagcaggucccuuuuugcagccaccauuuccaccagcugaucaugaaggacggccgcgagaucgugguccccugccggaaccaggacgagcuggugggccgugcgcgggugucacagggggccggcuggagucuucgcgagaccgccugccuggggaaauccuacgcgcagauguggcagcugauguacuuccaccgucgcgaccuucggcuggcugccaacgcgaucugcagcgcggugcccguggacugggugccgaccucccgcacgaccuggucuauccaugcccaccaccaguggaugaccaccgaagacaugcuguccgucuggaaccggguguggauagaggagaaccccuggauggaggacaaaacgcacaucuccuccugggaggacguccccuaccucggcaaacgcgaggaccaguggugcgggagccugauaggccugaccgcccgggccaccugggcaaccaacauccaggucgccaucaaccaggugcgccgccuaauuggcaacgagaacuaccucgacuacaugacuuccaugaaacgguucaagaacgagagcgaucccgagggggcacugugguga

SEQ ID NO: 23811 - RNA, 9879 nt, Artificial Sequence
  derived and/or modified CDS sequence (opt11) from DENV-1__FJ639669__SS-prME
agcgugaccaugcugcucaugcuuaugccuacggcccuggccuuccaccucaccacccggggcggggaaccccauaugaucgugucaaagcaggaacggggcaagagccugcuguuuaaaaccuccgcgggggugaacaugugcacacucaucgcgauggaccugggcgaacugugcgaggacacuaugaccuacaaauguccccgcaucaccgaggccgagccugacgacguggacugcuggugcaaugcgacagacacuugggucacauacgggaccuguagucaaaccggcgagcaccggcgugacaagcggucaguggcgcucgcaccccacguuggccucggucuggagacucggacagagacauggaugagcucagaaggcgccuggaagcagauccagagaguggagacgugggccuugcgccaccccggguucacggugauagccuuauuccuggcgcacgcaauuggcaccucuauaacccagaagggcaucaucuucauccuacugaugcuagugaccccuagcauggcaaugcggugcgucggcaucggcucucgggacuuuguagaagggcuaucaggcgccacguggguggacgucgugcuggagcacgggagcugcgugaccaccauggccaaagacaagcccacgcucgacaucgagcugcugaagacggaggucacaaaucccgccgugcugcggaagcucugcaucgaggccaagaucuccaacacuaccacagauagccgcugccccacccagggggaggccacccuggucgaggagcaggacgcaaacuuugugugucgacgcaccuucguggaucggggcugggggaacggcugcgggcuguucggaaaggggucccucaucacgugcgcaaaauuuaagugcguuaccaaguuagagggcaagaucguacaguacgagaauuuaaaguacagcguaaucgugaccguucacaccggggaucagcaccagguggggaaugaguccacggaacacgguaccaccgcgaccaucacgccccaagcuccuacgaccgagauccaacucaccgauuacggcgcccuaacccuggacuguagcccccgcacgggccucgacuucaaugagaugguccuacuuaccaugaaggagaaguccugguuggugcauaaacagugguuuuuggaccugccccuacccuggacgagcggggcgagcaccucacaggagacguggaacagacaggaccugcuggugaccuucaagaccgcccacgcgaagaaacaggaggucguuguucucggcagucaagagggcgccaugcacaccgcccuuacgggggcgaccgagauccaaaccuccggaaccacgaccauauucgccgggcaccugaagugccgccucaagauggacaagcugacccuaaagggcaugucuuacgucauguguaccggguccuuuaagcucgagaaggagguggcggagacacagcacggaacugugcugguacagaucaaguaugagggcaccgacgcccccugcaagauccccuucagcacccaagacgagaaaggggugacgcagaacggucggcugauuaccgccaacccgaucgugaccgacaaggagaaaccggucaacauugaggccgagccacccuucggggaauccuacaucgugauaggagcgggcgagaaggcccugaaacuuagcugguucaagaagggauccucaauuggcaagauguuugaagcgaccgcccgaggugcccggcgcauggcgauccugggagacaccgccugggauuucgggucaaucggcggcgucuuuaccuccgucgggaagcugguacaucagaucuucgggaccgccuacgggguauuauuuucaggggucagcuggaccaugaagauagguaucggggugcugcugacguggcuaggacuaaauucgcgcagcaccuccuugucaaugaccugcaucgcgguggggcuggucaccuuauaccugggcgugaugguccaggcagacuccggcugcgucaucaacuggaagggccgggaguugaagugugggagcggcaucuucguuacaaacgagguacacaccuggacggaacaguacaaguuccaggcggacucgccgaagcgccugucugcugcuaucggcaaggccugggaggagggggucuguggcauacggucugccaccagacuugagaacauuauguggaaacagauuuccaacgagcucaaccacauccuuuuagagaacgacaugaagcugaccguuguggucggggacguggcaggcauacuggcccagggaaagaaaaugauccgcccccagcccauggaauacaaauauagcuggaaaucauggggcaaagcuaagaucaucggugccgacguucagaacacaaccuuuaucauagacgggcccaacaccccggagugcccugacgaccagcgcgcguggaacauuugggaggucgaagacuacggauucgggaucuuuaccacgaacaucuggcugaaguuacgggauuccuacacccaggucugcgaucaucgacugauguccgccgccaucaaggacucaaaggccgugcacgccgacauggguuacuggaucgagucugagaagaacgagacguggaagcuggcccgggccaguuuuauagaagucaagaccuguauauggccgaagucccacacucucuggagcaacggcgugcuggaguccgagaugauaauccccaagaucuacgggggcccgauaagccagcacaauuaccgccccgguuacuucacccagacggccgggcccuggcaccuggggaaauuagagcuggacuuugaccuaugcgagggaaccacggugguuguggacgaacauugcggaaaucgggggccgagucuccgcaccaccaccgugacgggcaagauuauccaugaaugguguugcaggagcuguacuuuaccgccccuucgcuuccgcggggaggacggcugcugguaugggauggagauacgccccgucaaggagaaggaagaaaaucucgugaaguccaugguuagcgccggaucgggcgagguugauuccuucagcuuagggcugcucuguaucuccauuaugaucgaagaagucaugcggucucgauggucgagaaagaugcugaugaccggcacacuagcgguuuucuuccugcugauuauggggcaacuuacguggaacgaccuaauccgcuuauguaucaugguaggcgcgaacgccucugaccgcauggggaugggcaccacuuaccuggcgcuaauggccacauucaagaugcggcccauguucgccguggggcuucuguuccgccgccucaccucccgcgaggugcugcucuugacgauaggucugagccuggucgcguccguggaacuccccaauagccuugaggagcugggcgacggucucgccaugggcauaaugauccugaaacuacucaccgacuuccagucccaucaacugugggcuacccugcucagccuaacguucauuaagaccaccuucucccugcacuacgccuggaagacuauggccaugguccucagcaucgugagucuguucccccugugccugagcacgacaucccagaagaccaccugguuacccgugcuacucgguagccugggaugcaagccgcuaacgauguuccuaaucgccgagaacaagauuuggggccggaagucuuggccccucaacgagggcaucauggcggucgggauagugagcauacuccuaucaagucuccugaagaacgacgugccccucgcugggccgcugauugcuggcggcaugcugaucgcuugcuacgucaucagcggauccuccgccgacuugucccuagagaaggccgcggaggucucaugggaggaggaggccgaacacucuggcgcuagccacaauauuuugguggagguccaagacgacgggaccaugaagaucaaggacgaggagcgcgacgauaccuugacaauucugcugaaggccacccucuuggcgguguccggaguuuauccccuuucuaucccugccacccucuuugucugguacuucuggcagaaaaagaaacagcgguccggggugcugugggacacucccagcccgcccgagguggagcgcgccguccuggaugacggcaucuaccgcaucaugcaacgaggguugcucggccguucccaggugggggugggggucuuccaagagaacguauuccauaccauguggcacguaacccgcggcgcaguccugauguaccaggggaagcggcuggaacccagcugggcgucugucaagaaggaccucaucagcuauggcggaggguggcgucuccaaggcucauggaacacgggggaagagguacaggucauugccgucgagccaggcaagaaccccaaaaacguucagacagccccugggaccuucaaaacccccgagggcgaggucggagccaucgcgcuggacuucaaacccgggacgucagguucccccaucguaaaccgggagggaaaaaucguggggcucuauggcaauggcguaguaaccaccucuggcacauacguguccgccaucgcccaggcuaaagccucccaagagggcccccuaccagagaucgaagaugagguuuuuaggaagcggaacuuaacaauaauggaucuccaccccggcagcgggaaaacccgccgguaucugccagccauagugcgcgaggccauaaagcggaagcucaggacccucauccuggcccccaccagggucguggccuccgagauggcagaggcgcugaaggggaugccuauccgguaccaaacaaccgccgucaagucggagcacacuggcaaggagaucguugaucucaugugucacgccaccuucacgaugcgauuacugagcccuguccgggugccgaacuacaauaugaucaucauggacgaggcccauuucacagaccccagcuccaucgcggcccguggguauauaagcacgcggguugggaugggggaggcggcagcuaucuucaugacagcgacaccgcccggguccguugaggccuuuccgcaaagcaacgcagugauccaagacgaggagcgcgacauacccgaacguaguuggaacaguggguacgaguggaucaccgauuuccccgggaagaccgucugguuuguccccagcaucaagucgggcaacgacaucgcaaacugucuccgcaagaacgggaagcgagugauucaacugucucgcaagaccuucgacacugaguaucagaagacuaagaacaaugacugggacuacgugguaaccacugauaucucugagaugggcgcgaacuuccgugccgaucgcgugaucgacccgcggagaugcuugaaaccggugauccucaaggaugggcccgaacgggugauccuggccgggcccaugccggugacgguugccagcgccgcacagcgccgggggcgcauaggcaggaaccacaacaaggagggggaccaguacaucuacaugggacagccacuuaacaacgacgaagaccacgcccacuggaccgaggccaaaaugcucuuagacaacaucaacacccccgagggcaucauccccgcacucuucgaaccggaacgcgagaagucagcugcgaucgacggggaauaccgccuccggggcgaagcccgaaagacuuuuguggaauugaugaggcgcggggaccuccccguuugguuauccuacaaggucgccucugagggcuuccaguacagugaccggcgcuggugcuucgacggcgagcggaacaaccaaguauuagaagagaacauggacguggaaaucuggacgaaggagggcgagcguaagaaacugcggccacgcuggcuugacgccagaaccuacucugauccccuagcccugcgcgaguucaaagaguucgcggccggacggcgaucugucucuggggaucucauccucgagauagguaagcugccgcagcaccucacgcaacgggcgcaaaaugcucucgacaaccugguaaugcuccacaacagcgagcagggcgggcgcgcauaccggcacgccauggaggagcugccugauacgaucgagaccuugaugcugcuggcacuaaucgccgugcucaccggcggggucacacuguuuuuccugaguggccgcgggcucgguaagacgagcaucggacugcugugugugauggccucuagcguacuccuguggauggcgucgguagagccccacuggaucgcugccucuaucaucuuagaguucuuccucauggugcuucuaaucccggagccggaucggcagcgaacaccccaagauaaccagcucgccuacgugguaaucgggcugcuguucaugaucuuaacuguggcugcgaacgaaaugggccuguuagaaaccaccaagaaggaccucgggaucggccacguggccgucgagaaccaccaucacgccgccaugcuagacguugaccugcaccccgcuucggcuuggacccuuuacgcugucgccaccaccaucaucaccccgaugaugcggcacaccaucgagaacacaaccgccaacaucagccugaccgcuaucgcgaaucaagccgcgaucuugauggguuuagauaagggcuggcccaucuccaagauggacaucggcgucccccuacuugcccuugggugcuauagccaagugaacccgcugacccugacugcugccgugcucauguuagucgcucauuacgccauaaucgguccggggcugcaggccaaggcgacccgggaggcgcaaaagcggacggcagcaggcaucaugaagaacccuaccguggauggcaucguggccauugaccuggaccccguaguguacgacgcgaaguucgagaagcagcuggggcaaaucaugcugcucauccugugcacuucccaaauucugcucaugcgaaccaccugggcccuaugcgagucaaucacccuggccacuggcccccuaaccacgcugugggagggguccccgggcaaguucuggaacaccacgaucgccgugagcauggccaacauauuccgcggguccuaccuagcgggggccggucucgccuucagccugaugaagucccuaggaggugggcgucgcgggaccggcgcccagggcgagacccugggcgagaaguggaagcgacagcugaaccagcuguccaagagcgaguucaacaccuacaagcgcagcgggaucauggaaguagaccggagcgaggcgaaggagggccuaaaacgcggggagacuaccaaacacgcugugucccggggcaccgcuaaacugaggugguucguggaacggaaucuggucaagcccgagggaaagguaaucgaccugggaugcggccgcgggggcuggucuuacuauugcgcagggcucaagaagguuaccgaggucaagggcuacacgaagggagggccaggccacgaagaacccaucccuauggcuaccuacggcuggaaccuggucaaauuacauuccggcaaggacguguucuucaucccgcccgagaagugcgauacccuccugugcgacauuggggagagcuccccgaacccgacuauagaggagggacggacgcuccgcguacucaaaaugguggagcccuggcugcgggggaaucaauuuugcaucaaaauacugaaccccuacaugcccaguguggucgagacgcucgagcagaugcagcgcaaacacgggggcaugcugguacggaacccgcugagccgcaacaguacccaugagauguacuggguuuccugcgggaccggcaacauagucagcgccgugaacaugacuucccggaugcuacugaacagauucacgauggcccaccgcaagcccaccuacgaacgggauguugauuuagggaccggcacccgccacgucgccguggagcccgaaguggccaaucuugacaucaucggacagcggauugaaaacauuaaacaugagcacaagagcacguggcacuaugacgaggacaacccuuacaagaccugggccuaccacggguccuaugaagucaagccgagcgguuccgccagcagcauggugaacgggguagugaagcugcugaccaaaccaugggaugucauccccaugguuacacaaaucgcaaugacggacacaacccccuucgggcagcagcguguguucaaagagaaaguggauacccggacgccgaaagccaagcgaggcacugcccagaucauggaggucacggcacgguggcucuggggguuccuguccaggaacaaaaagccccggaucugcacgcgcgaggaguucacgcggaaggugcgcucaaacgcggccauuggggccgucuucgucgacgagaaccaguggaacucugcaaaggaagcgguagaggacgagcgguucugggaucuggugcaccgcgagcgggagcuucacaagcaggggaagugcgcgaccugugucuacaauaugaugggcaagcgcgaaaagaaguuaggggaguucggcaaggcuaaagguagccgggcuaucugguacauguggcugggcgcccgcuuucucgaguucgaggcgcugggguuuaugaacgaggaccacugguucucccgggagaacagccuguccgggguugaaggggagggacuccacaaacuuggcuacauccugcgcgacaucucuaagauccccgggggcaacauguacgccgaugauaccgccggcugggauacucggaucacggaggacgaccuccagaacgaggcaaagauaaccgacaucauggagccggaacacgcccugcuggcaaaggccaucuuuaaacucacauaccagaacaaaguaguccgcgugcaacgcccagcgaagaacgggaccgucauggaugucauuucacggagagaccagcggggcagcggccaggugggaacauacggccugaauacuuucaccaacauggaggcccagcugauccgccagauggaguccgaggggaucuucagccccuccgagcucgagacccccaaccuggcagagcgggcguuggacuggcucgagaaguacggcguggaacggcugaagcggauggcuaucagcggggacgacugcguagugaagcccaucgacgaccgauucgccacggcccugaccgcccucaacgacaugggaaaggugaggaaggauaucccccagugggaaccuucuaaggguuggaacgacuggcagcagguccccuucugcagccaccacuuccaccagcuaaucaugaaagacggccgcgaaaucgugguaccgugccggaaucaagacgagcugguaggccgggcucgggugucccagggggccggcuggagccuccgggagaccgcaugucugggcaaaagcuacgcccagauguggcagcugauguacuuccaccggcgggaccuacggcuggcggccaacgccaucugcagugccgugccagucgacuggguucccaccagccgcacgacguggucuauccacgcucaccaucaguggaugacgacggaagacaugcuuagcguguggaaccgcgucuggauagaggagaaccccuggauggaggacaagacacacaucuccucuugggaagaugugccguaccucgguaagcgcgaggaccaauggugcgggucacugauaggccugacagcucgcgccaccugggccacgaauauccagguggccaucaaccagguucggagacucaucggaaacgagaacuaccuggacuacaugacgagcaugaagcgcuucaagaaugaguccgaccccgaaggggccuuaugguga

SEQ ID NO: 23812 - RNA, 9882 nt, Artificial Sequence
  derived and/or modified CDS sequence (opt11) from DENV-1__FJ639670__SS-prME
ucagugacuaugcuucucaugcugaugccgaccgcccuggccuuccaccucaccacucggggcggcgagccccacaugauaguaucaaagcaggaacgggggaagucccugcuguucaagaccuccgcgggcgugaauaugugcacccuaaucgccauggaccugggugaguuaugcgaagacacgaugaccuacaagugcccgcgcauuacugaggcagagcccgacgacguugacuguuggugcaacgccaccgauacuugggucaccuaugguacaugcagccagaccggcgaacaccgccgcgauaagcggucuguggcccucgcgccacacgucggucuggggcuggagacaagaaccgaaacauggaugaguuccgagggggccuggaaacagauccagcggguugagaccugggcccuccgccaccccggguucacggugauagcccuguucuuagcgcacgcgauaggcaccucuaucacucaaaaggggaucauuuuuauccuccugauguuggugacgcccuccauggccaugaggugcguagggaucggcagccgggacuucguggagggucucuccggcgccacguggguggacgucguacucgaacacgguaguugugugaccacuauggcuaaggacaaacccaccuuggacauugagcuguugaagacggaagucaccaacccagccguacugcggaagcucugcaucgaggccaaaaucuccaacaccaccacugacucgaggugcccuacccagggugaagccacccugguggaggagcaggaugcuaacuucgucugccggcgcaccuuuguggaccgagggugggggaacggcugcggucuguuuggcaaggggagucucaucacgugugccaaguucaaaugcgugaccaagcuggaggggaagauuguacaguacgaaaaccuaaaguacucggugaucgugaccguccacacgggagaccagcaccaaguggggaaugaguccacggaacacgguaccaccgcaaccaucacgccccaggccccuacgacugaaauccagcucacagauuacggggcucugacucuggauugcucuccgagaacgggccucgauuucaacgaaaugguccugcugaccaugaaggagaagucguggcugguucacaaacaaugguuccuggacuuaccccuccccuggaccucgggggccagcaccucccaggagaccuggaacagacaggaucuccuggugaccuucaagacugcccacgcgaagaagcaagaggucgugguucucggcagccaggagggcgccaugcacaccgcccugacaggggcaaccgaaauccagaccuccggcaccaccacaaucuucgccgggcaccugaaguguaggcucaagauggacaaguugacccucaagggaauguccuacgucaugugcaccgggaguuuuaagcucgagaaagagguugcggagacgcaacacggcaccgugcuggugcagaucaaguacgaaggcacagaugcccccugcaaaauacccuucagcacccaggaugaaaaggggguaacgcagaacggccggcucaucaccgccaauccaaucguuaccgacaaggagaagcccguuaacauugaggccgaaccucccuucggugagucauacaucguaaucggcgcaggggagaaagcccugaaacuuagcugguucaagaaaggguccagcauaggaaagauguucgaggccacugcccgcggcgcccggcgcauggccauccugggcgauacagcuugggacuucggguccaucggcggcgucuucaccagcguagggaagcugguucaccaaauauucgguacugccuacggggugcuguucuccggcgucucuuggacgaugaagaucgggauuggcguccuccuaacauggcuuggccuaaacagucgauccaccuccuuaagcaugacuugcauagcaguagggcucgucaccuuauaucugggaguuaugguccaggccgacucaggcugcgucaucaacuggaagggaagagaguuaaagugcgguagcggcaucuucgugacaaacgaaguccauacuuggaccgagcaguacaaauuccaggccgacuccccgaagagguuguccgccgccaucggcaaggcuugggaggagggggucugcggcauccggagcgcaacacgcuuggaaaacaucauguggaaacagauuuccaaugagcucaaccauauccugcuggagaacgacaugaagcuaaccgucgugguuggggacguggcugggauccuugcccagggcaaaaagaugauccggccccagcccauggaguacaaauacagcuggaaguccuggggcaaagcuaagauuaucggcgccgacgcucagaacacgaccuucauaaucgacgguccaaauacaccggaaugcccagacgaccagcgcgcguggaacaucugggaggucgaagacuacggcuuugggaucuucacaacgaacauaugguuaaaguuacgcgacagcuacacucaggugugugaucaccgccuaauguccgcggcaaucaaggauagcaaagcuguacaugcggacaugggauacuggaucgaguccgagaagaacgagaccuggaagcuggcccgggccagcuucaucgaggugaagacauguaucuggcccaagucucacacgcuuuggagcaacggcguacuggaguccgaaaugaucauccccaagaucuacggcggaccgaucucucaacacaauuacaggcccgguuacuuuacgcaaaccgcaggucccuggcaucugggaaagcucgagcuggacuucgaccugugcgagggcaccacaguuguugucgacgaacacugcggcaaccgcgggcccuccuugcgcacgaccaccgugacgggcaaaaucauccacgagugguguugccgguccugcacccuacccccccugcgguuccgcggggaggacggcugcugguacgggauggagauccgcccggugaaggaaaaagaggagaaccucgucaaauccauggugucugccggcucgggugagguagauagcuucagccuggggcuacucugcaucuccauuaugaucgaggaggucaugcggucucgcuggucccggaagaugcugaugaccgggacccuggcaguguucuuccuccugaucauggggcaguugacauggaacgaucucauccgcuuauguaucauggugggcgcaaaugccagcgaccgcauggguaugggcacuaccuaccuugcccucauggcgaccuucaaaaugcgcccgauguucgcggucggccuucuguuucgacgucugacuucacgcgagguacugcugcuaaccauagggcugagccucguggcaagcguugaauuacccaacagccuggaagaacugggcgaugggcucgccaugggcauaaugaucuugaaguugcuuaccgacuuccagucacaccaacugugggccacgcugcuuagccugacguucaucaagacgacauucagucuacacuacgcguggaagaccauggcuauggugcucagcaucgugagccuguuuccacugugccuuagcacgacgucccagaagacgaccuggcugcccgugcuacucggcucguugggaugcaaaccgcucacgauguuccuaaucgcagagaacaagauuuggggcagaaaguccuggccccugaacgaggggaucauggcaguuggcauagucagcauccuccuuucuucccuucuuaagaacgacguuccauuagccgggccccugauagcgggaggcaugcugaucgccuguuacgugaucuccggcuccucagcagaccucucccuggagaaggccgccgaggucagcugggaggaagaggccgaacacucaggggcgucacacaauauccucguggaagugcaggacgacgggaccaugaagaucaaggacgaggagcgcgacgacacccuuaccauacugcugaaagccacccuuuuagccgucagcggcgucuacccacugucaauccccgcuacacuuuucgugugguacuucuggcagaagaaaaagcaacggucugggguucugugggacacccccagcccgccugagguggagcgcgcggugcuggaugacggcauauaccggaucaugcagcggggccugcucggacgaagccaggugggaguugggguguuccaagagaaugucuuccacaccauguggcacguaacucguggcgcugugcugauguaccaggggaagcggcuggagccuaguugggcgagcgucaagaaagaucucaucagcuacggaggcggguggcgccugcagggcucauggaacacgggcgaggaaguccaggugauagccguggagcccgguaagaauccgaagaacgugcagacugccccggggaccuucaagacccccgagggcgaggugggcgccauugcccuggauuuuaagcccgggaccagcggaagcccaaucgucaaccgggaggggaaaaucguaggccuguauggaaaugggguggucaccaccucuggcaccuaugugucggccaucgcacaagcgaaggccucccaagaagggccacugccagagauugaggacgaaguauuucgcaagcggaaccuaacgaucauggaccuccacccagggucagguaaaacgaggagauacuuaccggcaauuguccgugaagccauuaagcggaagcugcgcacccucauccuugcccccacccgcgugguggcguccgagauggcugaggcgcucaaaggcaugccuauccgguaccaaacgaccgccgucaaauccgaacacacugguaaggaaauaguggaccucaugugccacgccaccuucaccaugagacuacugucccccgugcggguccccaauuacaauaugauuaucauggacgaggcgcacuucaccgacccgagcagcaucgccgcccgcggguauauaucgaccagagugggcaugggagaggccgcugcgaucuucaugaccgccacgccgccaggcagcguggaggccuucccgcagucaaacgcugucauccaggacgaggagcgcgauauccccgaaaggaguuggaacagcggguacgaguggaucacggauuuccccggcaagaccguuugguuuguacccucgaucaagagcggcaacgauaucgcgaacuguuugcgcaagaacggcaaaagagucauacagcuguccagaaaaacuuucgacacggaguaucaaaagacuaaaaauaacgacugggauuacgucguuaccacagauauuagcgagaugggcgccaauuuccgggcggaccgcguuaucgacccccggcgcuguuuaaaacccgugauccucaaggacggucccgaacgggugauacuggccggccccaugccggucacgguugccuccgcggcacaacgcagagggcgcaucggccguaaccacaacaaggagggcgaucaauacaucuauauggggcaaccccugaacaacgacgaggaccacgcgcacuggacugaggccaaaaugcuccuggauaauaucaacaccccagaaggcaucauucccgcccuguucgagccggagagggagaagucagcugccauugacggggaauaucgccuaaggggugaggcccgcaagaccuucgucgagcucaugcggcgaggggaucuaccgguguggcucaguuacaagguagccucagagggcuuccaguacucugaccggagauggugcuucgauggcgaacguaauaaucaggugcuggaagaaaacauggacguugagaucuggacgaaggaagggguuagucggaagaaccugcgaccccgauggcuugacgcucgaaccuauagcgauccccuggcgcuucgcgaauuuaaagaauucgccgcaggccggagguccgucucgggggaccucauccuggagaucggcaaacugccgcagcaccuaacccaacgggcccagaacgcccuggacaacuuagugaugcuacacaacucggagcaagguggucgugccuaccggcacgcaauggaggagcuuccggacaccaucgagacgcugaugcuacuggcacugaucgccgugcuuaccgguggggucacccuauuuuuucuuagcggccgcggacugggcaagaccuccaucggcuuacuuugcgucauggcuucgucaguguugcuguggaucgccagcgucgagccccacuggaucgcagccuccauuauccucgaguucuuccucauggugcugcugauacccgagcccgaccgccagcgcacgccgcaggacaaccagcucgccuacguggucauagggcuucuguucaugauccugacgguggcggccaaugagaugggccugcuggagaccaccaagaaggaccuagggauuggacacguagccgucgaaaaccaccaccacgccgccaugcuugauguggacuugcaccccgccagcgccuggacccuauacgccguggccacgaccaucaucacgccaaugaugcgacacacgaucgagaacacgacggccaacaucucacugaccgccauagcaaaccaggcugccauccugauggggcucgacaagggcuggcccaucucaaagauggacaucgguguccccuuacuggcgcucgggugcuacucucagguuaacccacugacccuuacggcggccgugcucaugcuggucgcccacuacgcaaucaucggaccggggcuucaagcgaaagccaccagagaggcccagaagcgcaccgccgccgggaucaugaaaaaccccacuguagacggaauagucgcuauugacuuggaccccgucguguaugacgccaaguucgaaaagcagcugggucagauuaugcuccucauccugugcacgagccaaauccuucucaugcggacuaccugggcccucugcgaguccaucacccuagcuacgggaccccucacaacccugugggaagggaguccgggcaaguuuuggaauaccacuaucgcuguauccauggcgaacauuuuccgcgggagcuacuuagccggcgccggccucgccuucagccugaugaagucccucgggggcgggcggcgggggacgggggcgcagggggagacccucggcgaaaaguggaaacggcagcugaaucagcugucuaaguccgaguuuaacacauacaagcggucugggaucauggaggucgacagaagugaggcaaaggagggucucaagcguggggagacgaccaagcacgccguaucgcggggcacggccaagcugcguugguucguggaacggaacuuagucaagcccgagggcaaggugaucgaccugggcugcggccgcgggggcugguccuacuacugcgcuggucucaagaaggugacggaggucaagggcuacacgaagggcgggccuggccacgaagagcccaucccgauggcuacuuacggguggaaccuggucaagcugcacuccgggaaggacguguuuuucaucccacccgagaagugugauacccuccugugugacauuggcgaauccagcucaaaucccaccauugaagagggccguacgcugcgcguacucaagauggucgagccguggcuccggggaaaccaguucugcauaaagauccugaaucccuacaugccaagcgugguagaaacccucgaacagaugcagcgaaagcacggcggcaugcugguucggaauccgcugucacgcaacucgacacaugagauguacuggguguccuguggcaccgguaacaucgugagcgcggugaacaugacuucccggaugcuucugaaccgcuucacgauggcccacagaaagccaaccuacgagcgggacguggaccuggggaccggcacccgccacguagccguggagcccgagguagcuaaccucgacaucauuggccaacguaucgagaauauuaagcacgagcacaagucgacauggcacuacgacgaggauaacccuuacaaaaccugggcuuaccaugguucauacgaggugaagccgucaggcagugccuccagcauggugaacgggguagugaaguugcugaccaagccgugggacgugaucccuaugguuacccaaaucgcgaugaccgacaccacuccguucggccaacagcgcguguuuaaggaaaagguagauacccggacgcccaaggccaagcgcggaaccgcacagaucauggagguuaccgcacgguggcucuggggcuuccugucucgcaauaagaaaccgcgaaucugcacccgagaggaauucaccaggaagguucgcagcaaugcggccauuggcgccguguucgucgacgaaaaccaguggaacuccgcgaaagaagcggucgaggacgagcgauucugggacuuaguucaccgcgaacgggaguugcacaaacaggggaaaugcgcgacaugcgucuacaacaugaugggcaagcgcgagaagaagcugggggaauucgggaaggcgaaggguucccgagccauaugguacaugugguuaggcgcacgcuuccuggaguucgaggccuuggguuucaugaacgaggaucacugguucucgagggagaauagcuuauccgggguagagggcgaggggcuccauaagcuuggcuacauccugcgcgacauaagcaagaucccagggggcaacauguacgccgacgauacggcaggcugggacacccggaucacggaggacgaccuccagaaugaggccaagaucacugauaucauggagcccgaacacgcgcugcuggccaaggcgaucuucaagcuuaccuaucagaauaagguggugcgcgugcagcguccugcaaagaacgggaccgugauggacguuaucucgcgccgcgaccagcggggcagcggccaagucgggacauacggucuuaacaccuuuaccaacauggaggcccagcugauucgccagauggaauccgaagggaucuucagccccucagagcucgagacccccaaccuagcagagagagcucucgacuggcucgaaaaguacggugucgagagguugaagcggauggccaucagcggcgacgacugcguagugaagccaaucgacgaccgcuucgcaacugcacugaccgcucucaacgacaugggcaagguacggaaggacaucccacagugggagccgucaaagggguggaaugauuggcagcaaguccccuuuugcagccaucacuuccaccagcugauuaugaaggauggccgagagaucguugugcccugccggaaccaggaugaacuggucggaagagcccgcgugucgcagggggccgguuggucccucagggagaccgcaugccuggggaaguccuaugcccagauguggcagcuuauguauuuccaccggcgcgaccuccgguuagccgccaacgcaauaugcucagccgugccggucgacuggguuccuacgucgcguacuacauggucgauccacgcgcaccaccaauggaugaccacggaggacaugcugucuguguggaaccgggucuggaucgaggagaacccauggauggaggacaaaacacauaucagcuccugggaagacgucccguaccucgguaagcgcgaggaccaauggugcgggucccuuauaggcuuaaccgcgcgagcgaccugggcgacgaauauccagguagccaucaaucagguccgucgcuuaauagggaacgagaacuaccuggacuacaugaccucgaugaagcgguucaaaaaugaguccgaccccgagggggccuuaugguga

SEQ ID NO: 23813 - RNA, 9879 nt, Artificial Sequence
  derived and/or modified CDS sequence (opt11) from DENV-1__FJ639671__SS-prME
agcguuaccaugcugcucaugcucaugcccacugcucuggccuuccaccuaacgacccguggcggggaaccccacaugauagugagcaagcaagagcgcggcaagagccugcuguucaagaccucagccggggugaacauguguacccucaucgcaauggaccugggcgagcugugcgaagacacccucaccuacaaaugcccgcgcaucaccgagguggaacccgaugauguggacugcuggugcaauacuacggacaccugggugaccuacgggaccugcagccagaccggcgagcacagacgcgauaaacggucgguagcucuggcaccccacgugggccuuggguuagagacccgcgccgagacauggaugagcagcgagggcgcguggaagcaaauacagagaguggagacuugggcccugcgacacccuggauucacagugauagccuuguuccuagcgcacgcgaucggcacuagcaucacacagaaggggaucaucuucauucugcugaugcucgucacgcccucaauggccaugcggugugugggcauugggagccgcgacuucguggaggggcuguccggcgccacgugggucgacguggugcuggagcacgggagcugcgucaccaccauggcgaaggacaagcccacccucgacaucgagcugcuuaagacggagguaaccaacccggccguguugcggaaguugugcaucgaggcuaagaucuccaacaccaccacggacagccgcugcccgacgcagggggaggcgacccuggucgaggaacaggacgcuaauuucgugugccggcggaccuucguggaccggggcuggggcaaugguugcggccuuuucggcaaaggguccuuaaucacuugugccaaguucaagugcgucaccaagcuggaggguaagauugugcaguacgaaaaccucaaauacagcgugaucgucaccgugcacaccggggaccagcaccaggucgggaacgaauccacagagcacgguaccaccgccaccauaacgccccaggcgcccaccagcgagauccaacugacggauuauggggccuuaaccuuagacugcagccccagaaccggccuagacuucaacgagaugguguuacucacaaugaaggagaagucaugguuaguccacaagcagugguuccuagauuuaccgcuucccuggacgagcggugccuccaccucgcaggagaccuggaaccggcaggaccugcucgucacguucaagaccgcccacgcaaagaagcaagagguggugguccugggcucccaggagggcgcgaugcacaccgcccugaccggggccacggagauccagaccuccggcaccaccacgauauucgcuggucaccugaaaugccgccuaaagauggacaaacugacccucaaaggcauguccuacgugaugugcaccgguaguuuuaagcuggagaaagaaguggcagagacgcagcaugguacgguccucguccagaucaaauacgaggguaccgacgccccuugcaagauaccguucuccacccaagacgggaagggcgugacccagaacgggcggcugaucacggccaacccgaucgucacggacaaggaaaaaccggugaauauagaggcggagccgcccuucggggagucauacaucgugaucggcgccggggagaaggcgcucaaguugagcugguuuaaaaagggcucaucuaucgggaagauguucgaggcaacagcccgaggcgcccggcgcauggccauacugggggacaccgcgugggacuucggcagcgucggugggguguuuaccuccgugggcaagcucguccaccagaucuucggcacggcuuauggcgugcuguucuccggagugagcuggaccaugaagaucgguauagggguucugcucaccuggcuggggcugaauagccgcuccacgagcuuaucaaugaccuguaucgcaguaggccuaguuacccuguaucucggggucauggugcaggcagacuccgguugcgugaucaauuggaaggggcgugaacugaagugcggcucgggaauuuucgucacgaacgaggugcacacguggacugagcaguauaaguuccaggccgauuccccuaagcgguugagcgccgccaucgggaaagccugggaggagggcgugugugggauucgcuccgccacaagacucgaaaauguaauguggcggcaaauuagcaaugaacugaaccacaucuuacucgagaacgauaugaaguucaccgugguggucggcgacgucguagggauccuugcgcagggcaaaaagaugauccgcccgcaacccauggagcacaaguacuccuggaagaguuggggcaaggcuaaaaucaucggggccgauguccagaacaccacguucauaauagacggcccgaacaccagugagugcccggacgaccagcgggccuggaacaucugggagguggaggacuauggguucgggauauuuaccacuaacauauggcugaaacuccgcgacagcuauacccaggugugcgaccaccggcugauguccgccgcgaucaaagacagucgcgcgguccacgccgacaugggcuacuggaucgaguccgagaagaaugagaccuggaaacuugcacgggcuuccuucaucgaggugaagacuugcaucuggccuaagucgcacacccuguggucaaacggggugcuggaguccgaaaugaucauccccaagauauacggcggccccauuagccaacacaacuaccguccgggcuacuucacacagacugcgggccccuggcaccugggcaaguuagagcuggacuuugaccugugcgaggguaccacggucguuguggaugagcacugcgggaaccgagggcccucccuccgcacgacgaccgucaccgguaagaucauccacgaguggugcugccgaucuugcacgcugccgccgcugcgcuucaaaggcgaagacgggugcugguacggcauggagauccggccggugaaggaaaaggaggagaaccucgugaaaagcaugguuuccgccgggucgggugaggucgacucauuuagcuuaggacugcucugcaucagcauuaugaucgaagaagugaugagaagccgguggagucgcaagaugcugaugacagggacucuggcggucuuuuuccuccuuauaaugggacagcugacuuggaacgacuugauacgccugugcauuaugguuggggcaaacgcaagcgaucggauggguauggggacgacauaccuggccuugauggccacauucaagaugcgcccgauguuugcagucgggcugcuguuccggcggcucaccucccgcgagguacugcugcucacuaucgggcugucauuaguggccuccgucgagcuaccaaauucccucgaggagcucggcgacggccucgcgaugggcauaaugauacuuaagcugcugaccgacuuccaguccuaccagcugugggcgacccugcuuagccugaccuucaucaagacgaccuucucacugcauuacgccuggaagaccauggccauggugcucuccaucgucucguuacugccacucugccuaagcacuacuucccagaagaccaccuggcuacccguccuccuggguucgcuuggcugcaagcccuuaaccauguuccugauugccgaaaacaagaucugggggcgcaagucuuggccguugaacgaaggcaucauggcgguggggauagugucuauccuucuuucaucccugcucaagaacgacgucccccuggccggccccuugaucgccggcgggaugcucaucgccugcuaugugaucagcgguuccagcgccgaccugucccuggagaaggcggcagaagugucuugggaggaggaggccgagcacuccggggccagccacaacauucuaguggaggugcaggaugacggcacgaugaagauaaaggacgaggagcgggacgauacccugacaauacuacucaaggccacgcugcuugccguguccggcgucuacccccuaucuaucccggccacgcuauucgugugguacuucuggcagaaaaagaagcaacgcuccggggugcuaugggauacccccuccccgcccgaaguagagcgggccguacucgacgacggaauauaccguaucaugcagcgggggcuguuaggacgaagccaaguuggggucggcguauuccaggagaauguguuccacaccauguggcacgucacccgcggagcugugcugauguaucaaggcaagcgccucgagccuagcugggcuuccgugaagaaggaucuaaucagcuacggagggggauggcggcugcagggcuccuggaacacaggcgaagagguccaggugauagccguggagcccgggaagaacccgaaaaauguucaaacggcuccugggaccuuuaagaccccggagggagagguaggggcuaucgcccucgacuucaagcccggcacuagcggcucgcccauugucaaccgcgaaggaaaaaucgucggccuguacgguaacggcguggugacgaccucagggacauacgucucagccaucgcccaagccaaagccucccaagaaggcccccugccggagauagaggacgagguguuccggaagcguaacuuaaccaucauggacuugcacccggggagcgguaagacgcgucgguaccugcccgccauaguaagagaagccaucaaacgcaagcuacgcacccugauccuggcuccgacccgggucguggcuuccgagauggccgaggcccucaaaggaaugcccauacgcuaucagacgacggcgguaaagagcgagcacaccgggcgggaaaucguggaucugaugugccaugccaccuucacaaugagacuccucucccccgugcgagugcccaacuacaacaugauaauaauggaugaagcacauuucaccgauccgagcuccaucgccgcccgcggcuacaucagcacacgggucggaaugggcgaggcggccgccaucuucaugaccgccacgccgcccgggucgguagaagccuucccccaguccaacgccgugauccaggacgaggagcgcgauaucccggagcggucauggaacagcggcuacgaguggaucacugacuuccccggcaaaacggucugguucgugccuuccaucaaaagcgggaacgacauagccaacugccuaagaaagaacggcaaacggguuauucaacuaucccgcaagaccuucgacaccgaauaucagaagacgaagaacaaugacugggacuacgucguaaccacugacauaagcgagaugggggcaaauuuucgggcggaccgggucaucgacccgcggcgcuguuuaaaaccggucauccugaaggacggucccgagcgagugauacuggcggggcccaugcccgugaccguggcuuccgccgcccagcgcagaggccgcaucggccguaaucacaacaaggaaggggaccaguacauuuacaugggccaaccauuaaacaaugacgaagaccaugcccacuggacggaagcgaagauguugcuugacaacaucaacaccccagaggggaucauaccugcacucuucgagcccgagcgggaaaaauccgccgccaucgacggagaguaccgccugcgaggugaggccaggaagacguucgucgagcugaugcggcgcggcgaccucccggucugguuauccuacaagguggcgagcgagggcuuccaguacagcgaccggcgcugguguuucgacggugagaggaacaaccaggugcuggaggagaacauggacgucgaaauuuggacaaaagagggagagaggaagaaacuccggccccgcuggcuggacgcccggacguacuccgacccgcuggcccuccgcgaauuuaaggaguucgcagccggccgccgaucgguauccggcgaccucauucuggagaucggaaagcucccccagcaccugacgcagcgggcgcagaacgcgcuggacaacuuggugauguugcauaacuccgagcagggcgguagggcauaccggcaugcaauggaggaacugccggagacaauugagaccuugauguuacuggcgcucaucgccguccugacugguggggugacccuguucuuccucuccggucgcgggcugggcaaaaccagcaucggccuacucugugucauggccuccagcgcccuacuauggauggccuccgucgagccucacuggaucgcagccagcaucauccuugaguucuuccugauggugcuucucauccccgagccagaccggcagcgcacaccgcaggauaaccaacuggccuacguagucauuggccucuuauuuaugauacugaccguugccgcaaacgagauggggcugcuugagacgacgaagaaggaccucgguaucgggcacguggcagucgagaaccaucaucacgcuaccaugcucgacguggaccuccaccccgccagcgccuggacccucuaugccguggcgacgacuaucaucaccccuaugaugcgccauacaaucgagaacacgaccgcgaacaucagccugaccgccaucgcaaaccaggcggcuaucuuaauggggcuagauaagggcuggccgauuuccaagauggacauaggugucccccuguuagcccugggcuguuacagccaggugaacccccugacccugacggccgccguccugaugcuggucgcgcauuacgccaucaucgggcccggcuugcaggccaaggccaccagagaggcccagaagcgcaccgcggccgggaucaugaagaauccgaccguggacggcauuguugcuaucgaccuggacccggucguguacgacgccaaguucgagaagcagcugggccagaucaugcuccugauccuaugcacgucucagauacuccuaaugcggacaaccugggccuuaugcgagucgaucacccucgcaacggggccccuaaccacccugugggagggcagucccgggaaguucuggaacaccacgaucgccgugaguauggcaaacaucuuucgcggcucuuaccucgccggcgccgggcucgcguucucccugaugaagucccuaggcggcggccgucgcgggaccggggcccagggggagacucugggggagaaauggaagcggcaacuaaaccaacuuaguaagagcgaguucaacaccuacaagcgcuccggcaucauggagguggaccggucagaggccaaggaggggcugcgccggggcgagacaaccaagcacgccguuucccgcgggaccgcgaagcugaggugguucguugaacgcaaucuggucaagccggagggcaaggugauagaccucggcugcgggagaggcggguggaguuacuacugugccggccugaagaaaguuaccgaggucaagggguauacgaagggcggccccggccaugaggagcccauucccauggcaaccuacggcuggaaucucguaaagcuccacucggguaaagacguguuuuucaucccgcccgagaagugcgauacccugcugugcgauaucggcgaaagcucuccaaaccccaccaucgaggaggggaggacguugcggguccugaagaugguggagccguggcuucggggcaaccaguuuugcaucaagauucucaaccccuacaugcccagcguagucgagacccucgagcagaugcagcggaaacacggcgggaugcuggugaggaauccccucucacggaacucaacccacgaaauguacuggguuuccugcggcaccgggaacauugucucugccgugaacaugacuagccgcauguugcugaaccgcuuuacgauggcucaccgcaagccgacauaugagagagacguggaccugggcgcgggcacccggcacguugccgucgaacccgagguagcuaaccuggacauaauuggucaacgcauagaaaacauaaagcacgagcacaagagcaccuggcacuacgaugaggacaaccccuacaagacuugggccuaccacggcuccuacgagguaaagcccagcgggucugccuccuccauggugaacggcgucgugaagcugcuaaccaagccgugggacguuaucccaauggucacucaaaucgcgaugacggacacuacucccuucgggcagcagaggguguucaaggaaaagguggacacacgaacccccaaggcgaagagaggaacggcucaaaucauggaggucaccgcccggugguuauggggcuuccugucccggaacaagaaaccgcgcaucuguacgcgcgaggaguucacccgcaaggugcggagcaacgccgcgaucggggccguguucgucgacgagaaccaguggaacuccgcgaaggaggcgguggaggacgaacgcuucugggaccucguucacagagaacgugagcugcacaaacaaggaaagugcgcgacgugcgucuauaacaugaugggaaagagagagaagaaacugggcgaguucgguaaggccaaaggcagccgcgccaucugguacaugugguuaggcgccagguuccuggaguucgaggcgcuugguuuuaugaaugaggaccacugguucagccgcgagaacagccuaaguggcguggagggugagggacuucacaagcugggguacauucuucgcgacauuagcaaaauccccggcgguaacauguaugcagacgacaccgccgggugggacaccaggauaaccgaggacgaccuccagaacgaggccaaaaucacggacauuauggagcccgagcacgcacugcucgccaccucaaucuuuaaacugaccuaccagaacaaggugguccggguucaacgcccggcgaagaacgguaccgugauggacgucauuucccggcgcgaccagcgcggcucaggccagguuggcaccuaugggcugaauaccuucacuaacauggaggcucagcucaucaggcagauggagagcgagggcauuuucucccccagcgaacuggagacuccuaaccuggcugagagggugcuggauugguuagagaaguacggggucgagcggcugaaacgcauggccauaaguggcgacgauugcguugucaagcccauagacgaccguuucgccacggcccucaccgcucugaacgacauggggaagguccgcaaagacauaccgcaaugggaaccuagcaaggguuggaacgacuggcagcagguccccuucugcucacaccacuuccaccaacuaaucaugaaggacggucgagagauuguaguaccuugccgcaaucaagaugagcucguggggcgggcccgcgugagucagggugccggguggagccugcgggagaccgccugccuaggcaaguccuacgcacaaauguggcagcucauguacuuccauagacgggaucugcgccuggcggccaacgccaucugcagugcagucccgguggacuggguccccacgagucgaacaacguggagcauccacgcccaccaccaauggaugacuacugaagacaugcucuccgucuggaaccgcguguggaucgaagagaaucccuggauggaggauaagacgcauauaagcuccuggggcgacgugcccuaccuuggaaagcgcgaggaucaguggugcggcagcuugaucgggcucacagcgcgggccaccugggccaccaacauccaggucgcgaucaaccaggugcgacggcugauaggcaacgagaacuaucuugacuacaugaccucuaugaagcgcuucaagaaugagagcgacccggagggugcccucugguag

SEQ ID NO: 23814 - RNA, 9879 nt, Artificial Sequence
  derived and/or modified CDS sequence (opt11) from DENV-1__JN819423__SS-prME
agcguaaccaugcugcucaugcugaugccuaccgcccuggcguuccaucucacaacgcgagggggagaaccccacaugauuguuucgaagcaagaacgcggcaaaagccuccucuucaagacgagcgccggggugaauaugugcacacucaucgccauggacuuaggcgagcugugugaggacacucucacguauaagugcccccgcauaacugaaguggagcccgacgauguggauugcugguguaauaccacagauaccugggugaccuacgggaccuguagccagacaggcgagcaccggcgcgacaagcggagcguugcccuggcgccgcaugugggauuaggucucgagacccgggcugagaccuggauguccagcgagggcgcguggaagcagauacaacggguggagaccugggcccugcggcaccccggauuuaccgugauagccuuguuccucgcucacgccaucggcaccucgauaacccagaaggggauaaucuucauccugcucauguuagugacacccaguauggcuaugaggugcgugggcaucggcucccgcgacuucguggaagggcuguccggggcgaccugggucgacguggugcuugaacacgggagcugcgucaccacaauggccaaggacaagccuacgcucgacauagagcuucugaagaccgaaguaacgaaccccgccgugcuccggaagcugugcaucgaagcgaaaaucuccaacacgaccaccgacagccgcugccccacgcaaggagaggcaacacugguggaggagcaagacgccaacuuugugugccggcgcaccuuuguugaccggggcugggggaaugguuguggccucuuuggcaagggaagccugauuacgugcgccaaauucaaaugcgucacaaagcuggaaggcaagaucguucaauacgagaaccucaaguacucugugaucgucaccguccacaccggcgaccagcaccaggugggcaacgaguccacggaacacggaaccaccgcuacuaucacuccccaggcgccuaccagcgagauacagcuaacggacuacggugcucugacccucgacugcagcccaaggacuggccuggacuucaacgagauggugcuguuaacgaugaaggagaaguccuggcuaguacacaagcagugguuucuggaucucccguuaccuuggaccagcggggccucaaccagccaggagaccuggaaccggcaggaccuguuagucacguucaaaaccgcacacgcgaagaagcaggaggugguggugcuuggcucccaagagggggcgaugcauacugcacugacgggagcuacggagauacagaccagcggaacgaccacaaucuuugccgggcaccugaagugccgccugaagauggauaagcugacccucaagggcauguccuauguaaugugcaccggaucuuucaaauuggaaaaagagguggcggagacccagcacgguaccguccucguacagaucaaguacgaagggacggaugcgcccugcaaaauccccuuuuccacccaggacgggaagggcgugacccaaaacggucgccuaaucacggccaacccgauagucaccgacaaggagaagcccgugaacaucgaggcggaaccgccguucggcgagagcuauaucgugaucggugccggggaaaaggcccucaaacugucuugguucaaaaagggaagcucuaucgguaagauguucgaagcuaccgcccgcggugcucggcgcauggccauccuaggggacaccgcgugggacuucgguagcgucggcgggguguucacuuccgugggcaagcucguacaccaaauauucgggacggccuacggcguacucuucagcggggugucguggacaaugaaaaucgggaucggcguacuucucacauggcuggggcugaacagucgcuccacgagucucucgaugaccuguaucgccgugggccugguaacccuguauuugggaguuauggugcaggcggacagcggaugcgugauaaauuggaaagggcgugagcugaagugcggcagcggcaucuucgucacuaacgagguucacacguggaccgaacaguacaaauuccaggcggacuccccgaagcgccugagugccgccaucgggaaggccugggaggaggggguguguggcauccggagcgcaacccgcuuggagaaugucauguggcggcagaucuccaacgagcugaaccauauccucuuagaaaacgacaugaaguucaccgugguggucggugacguugugggcauccuggcgcagggcaagaagaugauccgcccccagcccauggagcauaaguauuccuggaagaguuggggcaaggcgaagaucaucggggccgacguucagaauaccaccuucaucauagauggccccaacaccuccgagugcccagacgaccaacgagccuggaauauuugggaaguggaagacuaugguuucggcaucuucacuaccaacaucuggcucaagcuccgcgacagcuacacccagguuugcgaucaccgguugauguccgccgcgaucaaggacucuagggcggugcacgccgacaugggcuacuggaucgaauccgagaagaacgagaccuggaaguuggcccgggcuaguuucaucgaggucaaaaccugcaucuggcccaagagucacacacuauggagcaacggggugcuggaguccgagaugaucauacccaagauauacggcggacccaucagccagcacaauuacaggccgggcuacuucacccagacggcgggucccuggcaccugggcaaguuagagcuggauuucgaucucugcgaggguaccaccgucgucguggacgagcacugcgggaaccgcggcccuuccuuacgaacgacuacgguuacagggaagaucauccacgaguggugcugccggagcugcacacugccgccccugcgauuuaagggagaggacggcugcugguacggcauggagaucagacccguaaaggagaaggaggaaaaccucgucaagucgaugguuucggcaggcucuggggagguggauucuuuuucccugggccugcucuguauuuccauuaugaucgaggaggugaugaggucacguuggucccgaaagaugcugaugacggggacccuggccgucuucuuucuccugaucauggggcagcuaacguggaaugauuugaucaggcuguguauaauggugggcgccaaugccagugaccggauggggaugggcacgacguacuuggcgcucauggccaccuucaagaugcgccccauguucgccgucgggcuccuguuccggcgccucaccucaagggaaguucuguuacuuacgaucgggcugagccuuguggccuccgucgaguuaccuaacagccuggaagaguugggggacggucuggccauggguaucaugauacugaagcuguuaacugacuuccaauccuaucagcugugggcgacccugcucagccugaccuuuauuaagacuaccuucucgcugcacuacgccuggaaaacgauggccauggugcucagcaucgucucccuccucccguuaugccuaucaacgaccucccagaagaccaccuggcugcccguccuucuugggucucugggcuguaaaccccucacgauguuucugaucgccgagaacaaaauuuggggacgaaagucauggccgcugaacgagggcauuauggcggugggaauagugucaauuuuacuaagcucccugcuuaaaaaugaugucccccuagcaggcccccugaucgccggcgggaugcucaucgccugcuacguuaucagcggaucgagcgccgaccugucgcuggagaaagcggccgagguuagcugggaagaggaggcugagcacuccggugccagccauaacauuuuggucgaggugcaagacgauggcaccaugaagauuaaggacgaggagcgggaugacacgcugacaauccuauugaaagccacgcuguuagcggucuccggggucuacccucuuagcauaccggcaacccuuuucgucugguacuuuuggcagaagaagaagcaacgguccggugugcuaugggacacgccuuccccgcccgaggucgagcgggcgguacuggacgacggaaucuaccgcauuaugcaaagagggcucuuaggccgcucccaggugggggugggcguauuccaggaaaacguguuccacacaauguggcacgucacgagaggggccgugcugauguaucaggguaagcgccucgagccgagcugggccuccgucaagaaagaccugauuagcuacggugggggcuggcgucugcagggcuccuggaauaccggcgaggagguccaggugaucgcgguggagccggggaaaaaccccaagaauguccagacagcgcccgggaccuuuaagaccccggagggcgaggugggagccaucgcacucgacuucaagccaggcaccagcggcagucccauugugaaccgugagggcaagaucgucggccuguacgguaacggaguggugacgaccuccgggaccuacgucuccgcgaucgcgcaggcuaaggccagccaggagggaccgcugccggagauagaggacgaaguguuccggaaacgcaaccugacuaucauggaccuacaccccgggagcggaaagacgcggagauaccugccggccaucgugcgggaagccauuaagaggaaacugcgcacacugauacuagcaccgacccgggucguggccucagagauggcggaggccuugaagggcaugcccauacgcuaccagaccacggcgguaaagagcgagcacaccgggagggagauagucgacuuaaugugucaugcgacguuuaccaugcgccuacugucucccgugagggugcccaacuacaauaugauaauaauggacgaggcgcacuucacggauccgagcagcaucgcagcucgcgguuacauuuccacacgugucgggaugggagaggcggccgccaucuucaugaccgccacgcccccaggauccguugaagccuuuccccagucuaacgcggugauccaggacgaggagagagacaucccugagcgguccuggaacucuggcuacgaguggauuaccgacuuccccgguaagacuguuugguucgugcccucgaucaagagcggcaacgacaucgccaauugccugcgcaagaacggcaaacgggugauccagcuuucgcgcaagaccuucgacaccgaguaccagaagacgaagaacaacgauugggacuacgucgugaccaccgauaucagcgagaugggggccaacuuccgugccgaucgggucaucgauccccggagaugcuugaaaccggugaucuugaaggauggccccgaacgggugauccuggcggggcccaugccugucaccguugccuccgccgcccagcggcguggccgaaucggccgaaaucacaauaaagagggggaccaguacauauacaugggacagccgcucaacaacgacgaggaccaugcucacuggacggaggcuaaaaugcugcucgauaacaucaacacaccagaggggauuauccccgcucuuuucgagccugagcgggagaaguccgccgccaucgacggcgaguaucgccugagaggggaagcccgcaagaccuucgucgaauugaugcgccgcggcgaccucccgguuuggcugagcuacaaaguggcguccgagggcuuccaguacagcgaccggcgcuggugcuucgacggggaacggaacaaccaagugcuggaggagaacauggacguggaaaucuggaccaaggaaggagagcgcaagaagcuccggccccgcuggcuggacgcccguaccuauucagauccccuagcacugcgcgaguucaaggaguuugcugcugggcggcgcagcgugagcggggaccugauccuggaaaucggcaaguuaccgcagcaccugacgcagcgggcgcaaaacgcucuggacaaccuggugaugcuucacaacagugagcagggcgggcgcgcauaccggcacgccauggaagaacucccggaaacaauagagacccuaaugcugcuagcguuaauugccguccuaacgggcgggguuacccuguucuuccucuccgggagaggucugggcaagaccucaaucggacugcuaugugugauggcuucgucggcgcuccucuggauggccuccgucgagccccacuggaucgcagcgagcaucauccuggaguucuuucugauggucuuacucauccccgagcccgaccggcagcgcaccccacaggacaaccagcuggccuacguggucaucggccuucuuuucaugauccugaccguugccgccaaugagauggggcuguuagagacgaccaagaaggaccugggcauagggcacguggcgguagaaaaucaccaccaugccacgaugcuagacgucgaccugcaucccgccuccgccuggacccuguacgcgguggcgacgacaaucauaacccccaugaugcgccacacuaucgaaaacacaacagcgaacaucagucugacggccauagccaaccaggcagcgauccugaugggcuuagacaaaggauggccgaucucuaaaauggacaucgguguuccucugcucgcccugggcugcuauagucaggugaauccccugacccuaacggcagcugugcuaaugcuaguagcucauuacgccaucauaggucccggcuugcaagccaaagccacccgggaggcgcagaagcgcaccgcggccgggaucaugaagaauccaaccgucgacggaauagucgccauagacuuggaccccgucguauaugacgccaaauucgagaagcaacuagggcagauuaugcuccugauuuugugcacaucccagauacugcugaugaggacgaccugggcccugugcgagaguaucacccucgcaacuggaccgcugaccaccuugugggagggcucccccggaaaauucuggaauaccacgaucgcuguuuccauggccaacaucuuccgcgguucuuaccucgcaggagccggguuagcguucucucuaaugaagucccucggcggagggcggagagggaccggcgcacaaggagagacccugggcgaaaaguggaagcgacaguugaaucaacuguccaagucagaguuuaacaccuauaaacgguccggcaucauggaaguagacaggucugaggccaaagaggggcuucgccggggugagacaaccaagcacgccgucucccgcgggacagcgaaacugcgcugguucguggagcgcaaccuggugaaaccggaaggcaaggugaucgaccucggcugcgggcggggaggguggagcuauuauugcgccggcuugaagaaagugaccgaggucaaaggguacacgaagggcgggcccgggcacgaggagcccauccccauggcuacguacggauggaaccuggugaagcuccacucggggaaggacguguuuuucaucccgcccgagaagugcgacaccuuacugugcgacaucggcgagucgaguccuaaccccacaaucgaagaggggcgcacgcuucggguccugaaaaugguggagccguggcuucgcgggaaccaguucugcaucaagauccucaacccuuacaugccgucgguggucgagacccuggagcagaugcaacggaagcacggugggauguuaguccguaacccacugucacgcaacagcacccacgagauguauuggguuaguugcggcaccggaaacaucgucucugcgguaaauaugaccucacguauguuacugaaucgcuucacgauggcucaccggaagccaaccuaugagcgcgacguggaucuaggcgcgggcacccggcauguagccguggagcccgaagucgccaacuuggacauaauagggcagcgaaucgaaaacauuaagcacgagcacaaaucaaccuggcacuacgacgaggauaaccccuacaagacgugggccuaccacggcuccuacgaagugaagccuagcgggagcgccuccagcauggugaacggggucgugaagcugcucaccaagccgugggaugucauccccauggugacccagaucgcuaugaccgacacaacucccuucggacaacagagggucuucaaggaaaagguggacacccgcacaccgaaggccaagcggggaaccgcccagauuauggaaguuaccgcccgcuggcuguggggauucuuaucgcggaauaagaaaccgcgcaucugcacccgggaagaguucacccgcaaaguccgaagcaaugcagcgauuggggccguauucgucgacgagaaucaguggaacuccgccaaggaggccguggaggacgagcgcuucugggaccucgugcaccgggagcgugagcugcacaagcagggcaagugcgcgacgugugucuacaacaugauggggaagcgcgagaagaaacugggugaguucggaaaggccaagggcagcagagccaucugguauauguggcucggugcccgguuucuagaguucgaggcccuaggguucaugaaugaggaucacugguucucucgcgagaacucucucuccggcguggagggggagggccuacacaagcuaggguacauccuccgcgacauaagcaagauccccggcgguaacauguaugccgacgacaccgccgggugggacacacggauaaccgaggacgaucugcaaaacgaggccaaaauuacggacaucauggagccagagcaugcgcuccucgccaccuccauuuucaaacugacuuaccagaauaaggugguccgcguucagcggccggcuaagaacgggacagugauggacgucaucagccggcgggaccaacgcggguccggccaggugggcacguacgggcugaacaccuucaccaacauggaggcccaacucaucaggcagauggagagugagggcauauucuccccaagcgagcuggagaccccgaaccuggcugagcgcgugcucgauuggcuggaaaaguacggaguagagcggcuuaagagaauggcaaucuccggagacgacuguguuguuaagccgaucgacgaccgauucgccacggcgcucaccgcucugaacgacaugggaaaagucaggaaggauaucccccaaugggaaccuagcaagggcuggaaugacuggcagcaagugcccuucuguagccaccauuuucaucaacuuauuaugaaggacggccgggagaucguggucccaugccggaaccaggacgagcucguggggcgggcucgcgugucccaaggcgcaggguggagccuccgggagacugccugccugggcaaaucauacgcgcaaauguggcaacugauguacuuccaccgccgagaccugcgccucgccgccaacgccauuugcagugcggucccaguugacugggugcccaccuccagaacgaccuggagcauccacgcucaccaacaguggaugaccaccgaagauaugcucuccgucuggaaccggguguggaucgaggagaaccccuggauggaggacaaaacucacaucagcuccuggggcgaugugccuuaccuggguaagcgcgaggaccaauggugcggaagccugaucggacucaccgcccgcgccaccugggccaccaauauccagguggcgaucaaccaagugcggcggcugaucggcaacgagaacuaccuagacuacaugaccuccaugaagcgcuucaagaaugagagcgacccagagggggcguuaugguag

SEQ ID NO: 23815 - RNA, 9879 nt, Artificial Sequence
  derived and/or modified CDS sequence (opt11) from DENV-1__FJ639672__SS-prME
agcgucacaaugcugcucaugcugaugccgaccgcccuggccuuccaccucaccacaagggguggagagccccacaugauagugucgaagcaggagcggggcaagagccugcuguucaaaaccucugcaggggugaacaugugcacccuaaucgccauggaccugggggagcugugcgaggacacaaugaccuacaaguguccccgcaucacagaggccgagcccgacgacguggacugcuggugcaacgccaccgacacgugggugaccuacgguacuugcagccagaccggcgaacaccggcgcgacaagcgguccguggcccucgcaccccacgugggccugggguuggagacgcgcaccgagaccuggaugucgucagagggagcauggaaacagauccagcggguggagaccugggcccuccgccacccgggguucacagugaucgcgcuguuccuugcgcacgccauugggaccagcaucacccaaaaggggauaauuuucauucucuuaauguuggugacuccuuccauggcuaugcggugcgucggcaucagcucccgcgacuucguggagggccucagcggggccacguggguggacgucguguuggagcacggcuccugcgugaccaccauggcgaaggacaagccuacccuggauaucgagcuccugaagaccgaggucacuaaccccgcggugcugcggaagcucugcaucgaggccaagaucagcaacaccaccacggacucccgcugcccgacccagggggaggccacccugguggaagagcaggacgccaacuucgucugccggcgcaccuucguggaccggggcuggggcaacgggugcggccuguucgggaagggcagcuugaucacgugugccaaguucaagugcgugaccaagcuggaggggaagauuguucaguacgagaaccugaaguacuccgugaucgugacaguccacaccggugaccaacaccaggugggcaaugaaaguacggagcacgggaccaccgccacuaucacgccccaagcccccacgaccgagauccagcucacagacuauggcgcccugacccuggacugcaguccccggacggggcucgacuuuaacgagaugguccugcugaccaugaaggagaaguccuggcucgugcacaagcagugguuccuugaccugccccuccccuggaccagcggggccucaaccagccaggagacauggaaccggcaggaccugcuggugacuuucaagaccgcccacgcgaagaagcaggaggucguggugcuggggucccaggagggcgcuaugcauacagcccugacgggcgcaaccgaaauccagaccagcggcaccacgaccaucuucgccggccaccugaaaugccgacucaagauggacaaacuuacccugaaggggauguccuacgucaugugcaccgggucguucaagcucgaaaaagagguggcggagacgcagcacgggaccgugcugguacaaaucaaguacgagggcaccgacgcccccugcaagauacccuucuccacacaggacgagaagggcgugacgcagaaugggcggcugauuaccgccaacccgaucgugaccgauaaagaaaagcccgucaacauugaggccgagccgcccuucggcgaguccuacaucgugaucggggcgggcgagaaggcccugaaacucuccugguucaagaagggcagcuccaucgggaagauguucgaggcgaccgcucguggcgcccggcgcauggcgaucuugggggauacggccugggauuucgggagcaucgggggcguuuucacuucggucggaaagcugguacaccaaaucuuuggcacagccuacgggguccucuucuccggggucuccuggaccaugaagaucgguaucggggugcuacugacguggcuuggccucaacagccgcuccaccagccuguccaugaccugcaucgccgugggccucgucacccuguaccugggugugauggugcaggccgacucaggcugcgucaucaacuggaaggggcgagagcucaagugcggcagcgggaucuucgugacuaacgaggugcacacauggaccgagcaguacaaguuucaggcggacuccccgaaacgccugagcgccgccaucggcaaggccugggaggaaggcgucugcgggaucagaucugcaacccgccuggagaacaucauguggaaacagaucucaaacgagcucaaucacauccugcuggaaaacgacaugaagcucaccgugguggucggcgacguagcggggauccuggcccagggcaagaagaugauccggccccagcccauggaguacaaguacuccuggaaaagcugggggaaggccaagaucaucggcgccgacgugcagaacacgaccuucaucauagacggccccaacacccccgagugccccgacgaccaacgcgccuggaacaucugggaggucgaggauuacggguucggcaucuucaccacuaacaucuggcuuaagcucagggacuccuacacccaggugugcgaccaccgccugaugagcgccgccaucaaggauuccaaggccgugcaugccgacaugggguacuggaucgagagcgagaaaaacgagacuuggaagcuggcccgugccuccuucauugaagucaagaccugcaucuggccaaagagccacacgcucugguccaacggcguccuggaaagcgagaugaucauccccaagauuuacggaggcccgaucucccagcacaauuaccgccccggcuauuucacccagaccgccggacccuggcaccugggcaagcuugagcuggacuucgacuugugcgaggggaccacgguggucguugacgagcacugcggcaaccggggcccaucgcuccgcaccaccaccgugacggggaagaucauccacgaguggugcugccgguccuguacccuaccgccccugcgcuuucggggagaggacgggugcugguacggaauggagauccgccccgucaaggaaaaagaggagaaccucgucaagagcauggugagcgccggguccggcgaggucgacagcuucucccugggccugcucugcaucucuauaaugaucgaggaggugaugcggucccgcuggagccggaagaugcugaugaccgggacccuggcgguguuuuuccucuuaaucaugggccagcugacguggaacgacuugauccgguugugcauuauggucggggcgaacgccuccgaccgcaugggaauggggaccacauaccuggccuuaauggccaccuucaagaugcggccgauguucgccgugggacugcuguuuaggcggcucacgagccgcgaggugcugcugcugaccaucggccuuucccuugucgccucaguggagcuccccaauucacuggaggagcugggugacggccuggccauggggaucaugauuuuaaagcugcucaccgacuuucaaucucaccaacugugggccacccugcugucccucacguucaucaagaccacauucagccuccacuacgccuggaaaacuauggcuaugguccucuccaucgugagccuguucccccuaugcuuguccacgaccagccagaagaccaccuggcugcccguacuguugggcucccugggcugcaagccguugacgauguuccuaaucgccgaaaacaagaucuggggacgcaagucauggccccugaacgagggcaucauggccgucgggaucgugagcauccugcucuccucacugcugaagaacgaugugccccuggcgggcccccuaaucgcagggggcaugcugaucgccugcuacgucaucuccggcucuuccgccgaccucagcuuggagaaggccgccgagguguccugggaggaggaggccgagcacagcggcgcgucccacaacauacugguggagguccaggacgacggcaccaugaagaucaaggaugaggagcgcgacgacacccucaccaucuugcugaaggccacccuccuggccgugagugggguguacccgcuauccauccccgccacccucuuugucugguacuucuggcagaagaaaaagcagcgaagcggcgugcugugggauacccccagcccgcccgagguggagcgcgcuguccuggacgacgggauauaccggaucaugcagcgcggccugcucgggcgaucccaggugggggugggcgucuuccaggagaacguauuccacaccauguggcacgugacgcgcggggcgguccugauguaccagggcaagcgguuggagcccuccugggccagcgugaagaaggaccucauuuccuacgggggcggcuggcgccuccagggaagcuggaacacgggcgaggaggugcaggucaucgccgucgagcccgggaagaaccccaagaacgugcagaccgcgccgggcaccuucaagacccccgagggggaggucggagccaucgcgcucgacuucaagccgggcacguccggcagccccaucgugaaccgagagggcaagaucgugggguuguacggcaauggcgucgugacuaccagugggaccuacguguccgccaucgcucaggccaaggcgagccaggagggcccgcugcccgagauagaggacgaggucuucaggaaacggaaccugacgaucauggaccuccaccccggguccggcaagacccgccgguaccugccggcgaucgugcgcgaggccaucaagcggaagcugcgcacccuuauccuggcccccacccgcgugguugccagugagauggcggaagcccugaaggggaugcccauccgguaccaaacgacugccguuaaguccgagcauaccggaaaggagaucguagaccugaugugccaugccaccuuuacgaugaggcugcugagccccguccgggugccgaacuacaacaugaucaucauggacgaggcucacuucaccgaccccuccagcaucgcagcccgcggcuacaucuccacccgcgugggcaugggggaggccgccgccaucuuuaugaccgcgacgccacccgggagcgucgaggcauucccgcaguccaacgcugugauucaggacgaggagcgcgacauccccgagaggagcuggaacucaggcuacgaguggaucacggacuuccccgggaagaccgugugguucgugcccagcaucaaguccggcaacgacaucgcgaacugccuccgcaagaacggcaagcgggugauccagcugagcagaaagaccuucgacacggaguaccagaagacgaagaacaacgacugggacuacguggucaccaccgacaucuccgagaugggggcgaacuuccgggccgaccgcgugaucgacccgcggaggugucuuaagcccgugauccucaaggacggccccgagagggucauccuggccggacccaugccggugacggucgccagcgccgcccagaggcggggccggaucggccggaaccacaacaaggagggcgaccaguacaucuacaugggccagccccugaacaaugacgaggaccacgcccacuggacagaggccaagaugcuccuggauaacaucaacacccccgaggguauaauccccgcccuguucgaaccggagcgcgagaaguccgccgcgauagacggggaauaccgccuccgcggggaggcccgcaagacauucguggagcugaugaggcgcggcgaucugcccguguggcucagcuacaaggucgccagcgagggguuccaguacuccgaccggcgcugguguuucgacggcgagcggaauaaucaggugcuggaggaaaacauggacguggagaucuggacgaaggagggcgaacgaaagaagcugcggccccgcuggcucgacgcccggaccuacagcgacccccuggcccugcgggaguucaaggaguucgcggccgggcgucgcuccguuagcggcgacuuaauccuggagaucgggaagcugccucagcaccucacucagagagcccagaacgcccuggacaaccugguuaugcuccacaacucggaacagggcggcagagcguaccgccacgccauggaggagcugcccgacaccaucgagacccugaugcuccuggcccugaucgccgugcucacgggcggcgucacccuguucuuccucagcgggagaggccucgggaagacauccaucggccugcugugcguuauggccuccuccguccuacuguggauggcaagcgucgagccucacuggaucgcggccuccaucauccuggaguucuuccucauggugcugcugauccccgagccggaccggcagcgcacgccccaggacaaccaacuagccuaugucgucaucggccugcuguucaugauccucacgguagccgcgaacgagaugggacuucuggagaccaccaaaaaagacuugggcaucggacacguggccgucgagaaucaccaucacgccgccaugcuggacguggaccugcacccggccagcgccuggacccuauacgccguggccacgaccaucaucaccccaaugaugcgccacacaaucgagaacacgacagccaauauaucacugaccgccaucgcgaaccaggccgccauccugaugggccucgacaagggguggcccaucagcaagauggacaucgguguaccacugcuggcccucggcugcuacucccaggugaacccgcugacccugacggcggccgugcucaugcugguugcccacuacgccaucaucggaccgggccugcaggccaaagcaacccgcgaggcccagaagagaaccgccgccgggaucaugaagaaccccaccguggacggcaucguggccaucgaccucgacccggugguguacgacgcaaaguuugagaagcagcuggggcagaucaugcuguuaauucuuugcaccagccaaauccugcucaugcggaccaccugggcacugugcgaguccaucacccuggccacaggcccccucaccacccugugggaggggagcccggggaaguucuggaacacaacgaucgcuguuuccauggccaacauauuucgcggcagcuaccuggcgggggccggccucgcguucagucugaugaagucgcugggcggaggccggcgcgggaccggcgcccagggagaaacccucggcgagaaguggaagcggcaacugaaccagcugagcaaguccgaguucaacaccuacaagcgcagcggcaucauggaggucgaccgguccgaggccaaggaggggcucaagcgcggcgagacgaccaagcacgcagugucucgggggacggccaagcugcgaugguucguggagcggaaccugguuaagcccgaggggaaggugaucgaccuggggugcggccgaggcgggugguccuacuauugcgccggccucaagaaggugaccgaagucaagggguauacgaagggcggccccggacacgaggagcccaucccgauggccaccuauggcuggaaccuggugaaacugcacagcgggaaggacgcauucuucaucccacccgagaagugcgacacgcuccugugcgacaucggcgaguccucgcccaacccuaccauagaagaggggcggacgcugcgcgugcucaagaugguugagcccugguuacggggcaaccaguucugcaucaaaauccugaaccccuacaugcccuccgugguugagaccuuggagcagaugcagcgcaagcacggggguaugcugguaagaaauccgcuaucuaggaacuccacccacgagauguauugggugagcugcggcaccgggaacaucguguccgcggucaacaugaccagccggauguugcugaacagguuuacgauggcccaccgcaagcccaccuaugagagagacguggaccugggcaccgggacucgccacguggccgucgagcccgagguggcuaaccuagacauuaucgggcagcggaucgagaacaucaagcacgaacacaagucuacuuggcacuacgacgaggacaaccccuacaagaccugggcguaccacggcagcuacgaggugaagccguccgggagcgcgagcuccauggucaacggcgugguaaagcugcugaccaagccuugggacgugauccccauggugacccagauugccaugacggacaccaccccauucgggcagcagcgcgucuucaaggagaagguggacacccggacgccgaaggccaagcgcggcaccgcccagaucauggaagugacggcgcgguggcucuggggguuccuuagccggaacaagaagccccggauaugcacccgggaggaguucacacgaaagguucgcuccaacgccgccaucggcgccguguucguggacgagaaccaguggaacagcgcuaaggaagcagucgaggacgagagauucugggaccuggugcaccgcgagcgggagcuccauaagcagggcaagugcgcgaccugcguauacaauaugauggggaagcgcgagaagaagcugggcgaguucgguaaggccaagggcucccgggccauuugguacauguggcugggggcgagauuccuagaguucgaggcccugggcuucaugaacgaggaccacugguucucgcgggagaacucccugucaggcguugagggcgagggccuccacaaacugggguacauccugcgcgacauuuccaagauccccggcggcaacauguacgccgacgacaccgccggcugggacacccgcaucacggaggaugaccuccagaaugaagccaagauuaccgacaucauggagccggagcacgcgcuacuggcuaaggccaucuucaagcucaccuaccagaacaagguggugcgcguccagcgacccgccaagaacggcaccgugauggacgugaucagccggcgcgaccagagaggguccggucaggucgggacguacgggcugaacacuuucacgaacauggaggcgcagcugauccgccagauggaaagcgaaggcaucuucucccccagcgagcucgagacccccaaucucgcggagcgcgcccuugacuggcucgaaaaguaugggguggaacgccugaagagaauggcaaucagcggcgacgacugcguugucaagccgaucgacgauagguucgcgacggcccugaccgcguugaacgacauggggaaggugcggaaggauaucccccagugggagcccucgaagggcuggaaugacuggcagcagguccccuucugcucccaccacuuucaccaguuaauuaugaaggacgggcgcgagaucgucgugccgugccggaaucaggacgaauuggucggccgcgcgcggguaagccagggcgccggguggucucuccgcgagaccgccugccugggcaagucuuacgcgcagauguggcagcugauguacuuccaccggcgcgaccuccggcuggccgcuaacgccaucugcagcgccgugccuguagacuggguccccaccucccgcacuaccuggagcauccaugcgcaccaccaguggaugaccaccgaggacaugcucuccgucuggaaucggguguggaucgaggagaaccccuggauggaggacaaaacgcacauuagcuccugggaggacguaccguaccucgggaagcgcgaggaccaguggugcggcagcuuaaucgggcugaccgcccgagcgaccugggccaccaauauccaggucgccaucaaccagguucggcggcucaucgggaacgaaaacuacuuagacuacaugaccuccaugaagcgguucaaaaacgagagcgacccugagggcgcgcugugguga

SEQ ID NO: 23816 - RNA, 9879 nt, Artificial Sequence
  derived and/or modified CDS sequence (opt11) from DENV-1__FJ639673__SS-prME
agcgucaccaugcuccugaugcugaugcccaccgcucuggccuuccaccugaccaccagaggaggggaaccccacaugauugugagcaaacaggagcggggcaaaucgcuguuauucaagacgucugcgggggugaauaugugcacccucauugccauggaccugggcgagcugugcgaagacacaaugaccuacaagugcccccgcaucaccgaaguggagccggacgacguagacuguuggugcaacacaaccgacaccugggugaccuacgggaccugcucgcagacgggcgagcaucggagagacaagcggucggucgcccuagcgccccauguggggcugggccuggagacacgugccgagacuuggaugagcuccgagggcgcguggaagcagauacagcggguggagaccugggcccuccggcauccgggguucaccguaauugcccuguuccuggcccaugcuaucggcaccagcaucacccagaaagggaucaucuucauccuccugauguuagucaccccuuccauggccaugcguugcgugggcaucggcagcagggacuucgucgaggggcucagcggagcuaccuggguagaugugguacucgagcaugggagcugcgucacaaccauggccaaagauaagcccacccuggacaucgagcuccugaagacggaggugaccaaucccgccgugcugaggaaguugugcaucgaggcgaagaucucgaacaccaccacagacagccgcugcccaacccagggcgaggcgaccuugguugaggaacaggacgccaacuucguuugccgucgcaccuucguggaccggggcugggggaacggaugcgggcuguucggcaaggggucccuaaucacgugcgcgaaguucaagugcgucaccaagcucgagggcaagauugugcaguacgagaaccugaaguacagcgugaucgucaccgugcacaccggggaccagcaccagguaggaaacgagucaacggagcacgggaccaccgcuacgaucacgccucaggcgcccacgagcgaaauccagcugacggacuacggggcgcugacccuggacugcaguccccggaccgggcucgacuucaacgagauggugcugcugacaaugaaggaaaaauccuggcuagugcacaagcagugguuccuggaccugccgcuccccuggacaagcggugcguccaccagccaagagaccuggaaccggcaggaccuguuaguuacguucaagaccgcccacgccaaaaagcaagagguggugguccucggcucccaggagggcgcgaugcauaccgcccugaccggggccaccgagauccagaccagcggaaccaccacgauauuugcgggucaccugaagugccgccuuaaaauggacaaguuaacccugaaaggaauguccuaugugaugugcaccgggagcuuuaaacuugagaaggaggucgccgaaacucagcacggcacuguccuggugcagaucaaguacgaaggaaccgacgcccccugcaagauccccuucuccacccaggacgaaaagggcguuacacagaacggccggcugaucacagccaacccgauugucaccgacaaggagaagcccgugaacaucgaggccgagccacccuucggugagaguuacauagugaucggcgccggugagaaagcgcugaagcuaaguugguuuaaaaaggguuccuccaucgguaaaauguucgaagccaccgcgcgcggggcccgucgcauggcaauacuaggcgacaccgcuugggacuucggguccauagggggcgucuucacauccguggguaaauuagugcaccagauuuucggcacggccuacggaguccuguucagcgggguguccuggaccaugaaaaucgggaucggagugcuguuaacguggcucggccugaauagccguuccacgucucuguccaugaccugcauagccgucggguuggugacccuguaccugggggugauggugcaggcggacucagggugugugaucaacuggaagggccgggaguuaaaaugcgggucgggcaucuucgugaccaacgaaguacacacguggacggagcaguauaaguuccaggccgauuccccgaagagacugagcgcagccaucggcaaggcuugggaggagggaguaugcggcauccgguccgccacccgccuggagaauaucauguggcggcagaucuccaacgagcucaaccacauccugcuggaaaacgacaugaaguucaccguugucguaggggacgugguggguaucuuggcccaggggaagaagaugauccgcccacagcccauggaacacaaguacucguggaaguccuggggaaaagccaagaucaucggagccgaugugcagaacaccaccuuuauaaucgaugggcccaacacccccgagugccccgacgaccaacgggccuggaacaucugggagguugaggauuacgguuucgggaucuucaccaccaacaucuggcugaagcugcgcgacuccuacacgcaagucugcgaccaccguuugauguccgccgcgaucaaggauuccaaggccguucacgccgacaugggcuacuggaucgagagcgagaagaacgaaaccuggaaacuggcccgcgcguccuucaucgaagugaagaccugcaucuggcccaagucgcacacacuuuggucuaacggcguucucgagagcgagaugaucauccccaagaucuacggcgggcccaucucccaacacaauuaccggcccggguacuucacgcagaccgcggguccguggcaccugggcaagcuggagcucgauuucgaccuuugcgagggcaccaccguggucgucgacgagcacuguggcaaccgcgggccgagccugcggacgaccaccgugaccggcaagaucauccacgaguggugcuguagaucaugcacccugccuccccuacgauucaagggggaagacggcugcugguacgggauggagauccgccccgugaaggagaaagaggagaaccuggugaaguccaugguaucugcuggcuccggcgaagucgacucuuuuucgcucggccugcuuugcaucuccaucaugaucgaggaggucaugcggucccgcuggucacggaaaaugcucaugaccggcacucuggccguuuucuuucuguuaaucauggggcagcugaccuggaacgaccuuauccgaagcugcaucauggugggcgccaacgccagcgaccgcauggggaugggcacgaccuaccucgcgcugauggccaccuucaagaugcggccgauguucgcaguaggccuccuguuccgacgguuaaccagucgcgaggugcuccuccugacgaucgggcugagccucguugccagcguggaguugcccaacagccuggaggaacucggcgacgggcuggcuaugggcaucaugauacuuaaguuacugaccgacuuccaguccuaccaguugugggcgacccuccugagccugaccuucauaaagacaaccuucuccuuacacuacgcauggaagacaauggccauggugcugaguaucgucucucugcucccccugugucugagcaccacaucccagaaaaccacuuggcuuccagugcugcugggcuccuuggggugcaagccgcugacaauguucuuaauagccgagaacaaaaucuggggucgaaagucguggcccuugaacgaagggauaauggcgguuggcauagucuccauccugcucagcucccuccugaagaacgaugugccccuggcugggccgcucaucgcaggcggcaugcuaauagcgugcuacgugaucagcggaucuuccgccgaccugucucuagagaaggcagccgucguaagcugggaggaggaagccgagcacuccggcgccagccacaauauccugguggagguccaggacgacgguaccaugaagaucaaggacgaggagcgcgacgacacccugaccauacuccugaaggccacucuacucgccguguccggcguuuacccguugucuauccccgccacccuguucgucugguauuucuggcagaaaaagaaacagcgguccgggguucucugggacacgcccagcccgccggagguggagcgcgcaguacuugacgacggcaucuacaggaucaugcagcgcggccuacuggggcguagucaagugggcgugggugucuuccaggagaacguguuccacacaauguggcacgugacccgcggcgccguccucauguaccaggggaagcggcuggagccuagcugggcuucagugaagaaagaccuuauuagcuacggcggcggguggcgccuccaggguuccuggaacacaggggaggaggugcaagugaucgcgguugagccugguaagaacccaaagaauguacagacggcccccgggacuuucaagacccccgagggcgagguaggugccaucgcccuggacuucaagcccgggaccagcggcagcccaaucgugaaccgagaggggaagaucguaggacuguauggcaauggggucgugaccaccuccggcaccuacgucagcgccaucgcccaagccaaggccucccaggaagguccgcuccccgagauagaggacgaggucuuccguaagcggaaccugacuaucauggaccugcaccccggcucuggaaagacccgccgguaucucccggccaucgugcgugaggcgaucaagcggaagcugcgcacccugauccucgcccccacgagaguggucgcuagcgagauggcugaggcccucaagggaaugcccauacgcuaccagacgacggcggucaagagcgagcacaccggccgugagaucguggacuuaaugugccaugccacauucacuaugcggcuccugagccccguccgcgucccgaacuacaauaugauuaucauggacgaggcccacuucacagaccccagcaguaucgcggcccggggguacauaagcacucgcgugggcaugggggaggcggccgccaucuucaugaccgccacgccgcccggcaguguagaggcuuucccgcagagcaacgcgguuauccaggacgaggagcgggacauccccgagcgcucguggaacagcggguacgaguggaucacggacuuccccggaaagacugugugguucguucccuccaucaagucaggcaacgacaucgccaacugccugcgcaagaacggaaagcgugugauccaguuaagucggaaaaccuucgacacugaguaccaaaagacgaaaaacaaugacugggacuacguggucaccaccgacaucucugaaaugggcgccaacuuccgcgcggaccgggugaucgacccgcggcggugucucaagcccgucauccuaaaggacgggcccgagcgcgugauccucgcgggucccaugccggugaccgucgcaucugcggcccagcggcgagggcggaucggccgcaaccacaauaaagagggagaccaguacauuuacaugggccaaccccugaacaaugaugaggaccacgcccacuggacggaggcgaagaugcugcucgauaacaucaacacccccgaggggaucauccccgcccuguucgagccggaacgagaaaaguccgcggcuaucgacggggaguacaggcugagaggcgaagcgcggaaaacauuuguggaacucaugcgccggggcgaucugcccguguggcucagcuacaaagucgcguccgaaggcuuucaguacagugacaggcgguggugcuucgacggugaacgcaacaaccaggugcucgaggaaaacauggacguggagaucuggaccaaggagggagagcggaagaaacugcgcccacgguggcuggacgcgcguacguauucugacccgcucgcccugcgggaguuuaaggaguucgccgccggacgacggagugucaguggggaccugauucucgagaucggcaagcugccgcagcaucugacccagcgcgcgcagaacgcuuuagacaaucuggugaugcugcacaauagcgagcagggcggucgggccuacagacaugccauggaggagcuccccgacaccaucgagacccugauguugcuugcucugaucgccguccugacgggcgggguaacuuuauucuuccugucgggccggggucugggcaagaccagcauaggcuugcuaugcgugauggccuccagugcacugcucuggauggcguccgucgaaccccacuggaucgcggccagcaucauccuggaguuuuuccugaugguccuccugauccccgagccggacaggcagcggacuccccaggauaaucagcuggcuuacguggugaucgggcuccuguucaugauccugaccguagcagcuaaugaaaugggccuacuggaaacuacuaagaaggaccugggcaucggacauguagcgguggagaaccaccaucacgcaacgaugcucgacgucgacuuacaucccgccucagccuggacucuguacgccguggcgacgacaaucaucacuccuaugaugcgucauaccaucgagaacacgaccgccaacaucucacucaccgccauugcgaaccaggccgcgauccugauggggcuggacaaaggauggccaaucuccaagauggacaucggcgugccccuccuggcccuggggugcuacagccaggucaacccccugacccugaccgccgccgugcugaugcucguggcgcacuacgccaucaucggcccggggcugcaggccaaggccacgagggaagcccagaagcggacggcggccggcaucaugaagaaccccaccgucgacgguauuguggcaauagaccucgaccccguggucuacgacgccaaguuugagaagcaguugggucagaucaugcugcugauacucuguacuucccagaucuugcugaugcgcaccaccugggcucugugcgagucaaucacccuggcaaccggcccccugaccacacucugggaggggucgccgggcaaguucuggaacaccacgaucgcuguuucgauggccaacaucuuucgggggagcuacuuagccggggccggacuagcguucucccuaaugaaauccuugggcggagggcgccgggggacuggggcccagggcgagacccugggcgagaaguggaaacgccaacucaaccagcuguccaagagcgaguucaauaccuauaagcgguccggaauuauggagguggaccgcagcgaggccaaggaggguuugcggcgcggggagacgacaaagcacgccgucucccgcggcacagcgaaacucagaugguucguugagcggaaccuggugaagcccgagggcaaggucauagacuugggaugcgggcguggaggcuggagcuacuacugcgccggacuaaagaaggugaccgaagugaagggcuacaccaagggcggccccggccaugaggaaccgauuccaauggccaccuacggauggaaccucgucaaauuacacucugggaaggacguguucuucaucccacccgaaaaaugcgauacucuucucugcgacauaggagagagcagccccaacccgaccauugaggaaggucggacgcugcgcgugcugaagauggucgaacccuggcuccgugggaaucaguucugcauaaaaauccuuaaccccuacaugcccagcgugguggagaccuuggagcagaugcagcgcaagcacggcggcaugcucguccggaauccgcugucccgcaacucuacacacgagauguacuggguguccugcgggaccggcaacaucgugagugcaguuaacaugaccaguagaaugcuacugaaccgguuuacgauggcgcaucgcaagcccacauacgagcgggauguggaccuaggggcgggcacccgccacguggccguagagcccgagguggccaaucuggacaucaucggccagcguaucgaaaacaucaagcaugagcacaaauccacauggcauuacgaugaggacaaccccuacaagacgugggccuaccacgggucuuacgaagucaagccgagcggcagcgccuccagcauggucaacgggguggucaagcuccugaccaagcccugggacguuauccccaugguaacccagauugcgaugaccgacacgacccccuucggccagcagcgcguauuuaaggaaaagguggacacgaggacgccgaaggccaagcgagguacggcccagaucauggaggugaccgcucgguggcuguggggguucuugucucgcaacaagaagccgcguauaugcacccgcgaggaguucacccgaaagguccgcagcaacgcggcgauuggcgcaguauuuguggacgagaaccaguggaacuccgccaaggaggccgucgaggacgagcgguucugggaccuggugcaucgcgagcgggaacugcacaagcaggggaaaugugcgacgugcguguacaacaugaugggaaagcgcgagaagaaacucggggaguuuggcaaggccaaggggagccgagcuaucugguacaugugguugggcgccagguuccucgaguucgaggcccucggcuucaugaaugaggaccauugguucucccgcgagaacagccugucagggguagagggugaaggacugcacaagcucggauacaucuugcgcgacaucucuaaaauccccgggggcaacauguacgcugacgacaccgccgguugggacacccggaucaccgaggacgaccuucagaacgaagccaaaaucacagacaucauggagccggagcacgcucuccuagccaccucaaucuucaagcucaccuaucaaaacaagguagugcgagugcagcggcccgcgaagaacgggaccguaauggacgugauuucucgcagagaccaacggggguccggacaagucggcacguauggccucaacaccuucacaaacauggaggcgcagcugauccgccagauggagucugaggggauauuuucccccagcgagcuggagacucccaaccucgcugaacgggugcuagacuggcuggagaaguacggcguggagagacuuaagcggauggcuaucucgggggacgauugcgucgucaaaccgaucgacgaccgcuucgccacggcgcugacagcucugaacgacaugggcaaagugcggaaggacaucccacagugggagcccagcaagggguggaacgauuggcagcaaguccccuuuuguagccaucacuuccaccagcuaaucaugaaggauggccgcgagaucguggugcccugccggaaccaggacgagcuggucggccgcgcgcgggugucccagggugcaggauggucacugcgcgagacugccugccucgggaaguccuacgcgcagauguggcagcugauguacuuccaccggcgggacuuacggcucgccgccaacgccauuugcucagcggucccuguagacuggguuccgacaucucgcacgaccuggagcauccaugcccaccaccaguggaugacgaccgaggacaugcuguccguuuggaaccgcguauggaucgaggaaaacccguggauggaggacaagacucacauauccagcuggggagacgugccguaccuggggaagcgggaggaccaauggugcggcagccucaucggccugacagcgcgcgccaccugggccacuaacauccagguggcgaucaaccaggugcgucgccugaucgggaacgagaacuaucucgacuacaugaccuccaugaaacgguuuaaaaacgagagcgacccugagggcgcccugugguaa

SEQ ID NO: 23817 - RNA, 9879 nt, Artificial Sequence
  derived and/or modified CDS sequence (opt11) from DENV-1__FJ639674__SS-prME
agcgugaccaugcuguugaugcugaugcccacggcucuggcauuccaccucacaacccggggcggggagccccacaugaucgugaguaaacaggaaagggggaaaagccugcuguuuaagaccagcgccggggugaauaugugcacccuaaucgccauggacuugggggaguucugcgaggauacaaugacauacaaaugcccacgcaucaccgaagccgagccggacgacguggacugcuggugcaacgccaccgacaccugggugaccuacgggaccugcagccagaccggcgagcacaggcgcgacaagagauccguggcccuggcgccgcaugugggccucgggcuggaaacgcggaccgaaaccuggaugaguuccgagggggccuggaagcagauccaacgcguggagaccugggcucugcgccacccuggcuucacggugauagcccuuuuucuggcucacgccaucggcaccagcaucacccagaaggggaucauuuucauccugcucaugcuggugacccccuccauggccaugcgaugcguaggcaucgggagccgugauuuuguggagggguugagcggcgccacuuggguggacgucgugcucgaacacgggucgugcgugacaaccauggccaaggacaagcccacccuagauaucgagcugcucaagacggaggucaccaaccccgcggugcugcggaaacuuugcaucgaggcgaagauuuccaauaccaccacggacagccgcugcccgacccaaggcgaggcgacccucguggaggagcaggacgccaacuucgucugccggcguaccuucguggaccgaggcugggggaaugggugcggacuauuugggaaggggucccugaucacgugcgccaaauuuaagugcgugaccaagcucgaagguaagaucguccaguaugagaacuugaaguacucagugaucgugacuguucacacaggcgaccagcaccagguggguaacgagucaacggagcacggcaccaccgccaccauuacgccccaggcccccagcacggagauacagcucacggacuacggggcccucacguuggacugcucaccccggacgggacuggacuucaaugagaugguccuucuuacgaugaaggaaaaguccugguuggugcacaagcagugguuccucgaccuaccgcuucccuggacaagcggggccuccaccagccaggagaccuggaaccggcaggacuugcuagugaccuuuaagacggcacacgcgaagaagcaggaggucguagugcugggcucccaggagggcgcuaugcacaccgcccucaccggggcgacagagauccagaccagcggcaccaccacgaucuucgccgggcaccuuaagugcagacugaaaauggacaaguuaacgcugaaggggauguccuacgucaugugcacggggagcuucaagcuggaaaaagagguggccgaaacccagcauggcacggugcucguacagaucaaguacgaaggcacugacgcaccuugcaagauccccuucuccacccaggacgagaagggagugacacagaauggcagacugauaacggccaauccgauagugaccgauaaagagaagccggugaacaucgaagccgagccgccguucggugaaagcuacaucgugaucggcgcaggagagaaggccuugaagcuguccugguuuaagaagggcagcuccaucggcaagauguuugaagccacggcgcgcggggcccggcgcauggcgaucuuaggagacaccgcaugggauuuuggaagcaucggcgguguuuucaccuccgucgggaaguuaguucaccagaucuucggcaccgcuuacgggguacuguucagcggcguaagcuggaccaugaagaucgggaucggcgugcuccugaccuggcucggccucaacucucgcuccaugagcuuauccaugacguguauugcggugggacuggucacccuauaccugggcgucaugguacaggccgacagcgggugcgugaucaacuggaagggucgggagcuaaaaugcgggagcgguaucuucguuaccaacgaggugcacaccuggacggagcaguacaaauuucaggcggauuccccgaagcgcuugagcgccgcaaucggcaaggcgugggaagagggggucuguggcauccgguccgccacccgccuggagaacauaauguggaagcagauaagcaacgaauugaaccacauccuccuggaaaacgacaugaaguuuaccguuguggucggggacguugcaggcauucuggcccagggcaagaagaugauccgaccucaacccauggaguauaaguacuccuggaaauccuggggcaaggccaaaaucauaggcgccgacgugcaaaacaccaccuucaucaucgacgggcccaacaccccggagugucccgacgaccagcgugcuuggaauaucugggaggucgaagacuacggcuucggcaucuucaccacuaauaucuggcucaaacuccgugacucauauacccagguuugcgaccacaggcucaugagcgcugccaucaaggacuccaaggccgugcacgcugacaugggcuacuggaucgagagcgagaaaaacgagacguggaagcucgcgagagccuccuucauagaggucaagaccugcauuuggcccaagagccacacucugugguccaacggcgugcucgaguccgagaugaucaucccgaagaucuacggagggccgaucucacaacacaacuaccgccccggauauuucacccagacggccggcccauggcaccucgggaagcuggagcuggauuucgauuugugcgagggcaccacugugguaguggacgagcacugcggcaauagagggccgagccugcgcaccacgaccguuaccggcaagaucauacacgaauggugcugccgcuccugcacccugccgccccugcgcuuuaagggggaggacggcugcugguacgggauggagauacggcccguaaaggaaaaggaggagaacuuggucaagagcauggugagcgccggcuccggcgaggucgacagcuuuucccucggccugcugugcaucagcauaaugauugaggaggugaugcgcagccgguggucgcguaaaaugcugaugacaggcaccuuagcgguauucuuccugcugauuauggggcagcuaaccuggaacgauuugauccgguuaugcauaauggucggcgcaaacgccucugaccggauggggaugggcaccaccuaccuagcccugauggccacguucaagaugcgcccaauguucgccgugggacucuuauuccgccgccugaccagccgggaggugcugcuacugaccaucgggcuaucgcucgucgcgagcguggaguugcccaacagucuggaggagcuaggcgacgggcuggccaugggcaucaugauccuaaagcuccugacggacuuccagagccaccagcuaugggccacgcuccugucccuuacguucaucaagaccacguucagccuccacuacgccuggaagaccauggcgauggugcugaguaucgugagccuuuuuccgcucugccuguccacaaccagccagaagacgacauggcugcccgugcuccucgguucccuggggugcaagccgcucaccauguuccugaucgccgagaacaagaucuggggucgcaagagcuggccacugaacgaagggauaauggccguggggaucgugagcauacuccuguccagccugcucaagaaugacguuccgcuggccgggccccugauugccggcggaaugcucaucgcgugcuacgucaucuccggcaguagugcagaccugagccuggaaaaagccgcagagguauccugggaggaggaggccgagcacagcggugcgucccacaauaucuuaguggagguccaggacgacgguacuaugaagaucaaggacgaagaacgggaugauacgcuuaccauccugcucaaggcuacccugcuggccgugagcggcguguacccgcucagcaucccggccacucuauucgugugguacuuuuggcagaagaaaaagcaacgcucagguguucugugggacacacccucaccacccgaaguggaacgggcgguccucgacgacgggaucuaccggaucaugcagcgaggccugcuggggcgcagccaagugggcguggguguauuccaggagaacguuuuccacacgauguggcacgugacccggggcgcgguccugauguaucaggggaagaggcucgagccuagcugggccagcgugaagaaggaccugauuuccuacggcggcgguuggcggcuucagggcagcuggaacaccggggaggaggugcaggucauagccguggagccuggcaagaaccccaagaauguacagaccgcgccggggacguucaagaccuccgagggcgaggucggcgcgaucgcgcucgacuucaagccgggaaccagcggcagcccgaucguuaaucgcgagggaaagauagucggccuguacggaaacggagucgugaccacgucugguaccuaugugagcgccaucgcccaggccaaagcgucacaggaggggccccucccugagaucgaggacgaggucuuccggaagaggaaccugacaauaauggaccugcacccgggcagcgggaagacgcggcgcuaucugcccgcaaucguccgggaggcuaucaaacgcaaguugcggacgcugauccuugccccgacacgcguggucgccuccgaaauggcagaggcccucaagggcaugcccauccgauaccagacaacagcugucaagagcgagcauacgggcaaggagaucguggaccugaugugccacgcgaccuucacgaugcgguuacucucacccguccgugugcccaacuacaacaugaucaucauggacgaggcccacuucacagauccgagcuccaucgcggcucggggguacaucucaaccagaguugguaugggggaggccgccgccaucuucaugacagcgacgccucccggcuccgucgaggccuucccccagucaaaugcggugauacaggacgaggagcgggauaucccugagagaaguuggaacagcggauacgaguggauuaccgacuuccccggcaagacggugugguuugucccgucgauuaagagcggcaacgacaucgccaacugccugcggaaaaacggaaagcgcgugauacagcuguccagaaagaccuuugauaccgaauaccagaagaccaagaauaaugacugggacuacguggucacgaccgacauaagcgagaugggcgcgaacuucagggccgaucgggugaucgacccccgccggugccucaagccggugauccugaaggaugggcccgagcgcgucauccuggcaggccccaugccugugaccgucgccagcgccgcgcaacggcgggggaggauuggccgcaaccauaauaaggagggcgaccaauacaucuacaugggacagccgcucaacaacgacgaggaccaugcacacuggaccgaagcaaagaugcugcuggauaacaucaacacgcccgagggcauaauaccagcccuauucgagccggagcgcgagaaguccgcagcgaucgacggugaguacagacugaggggcgaggcccggaagaccuucguggaacugaugagacgaggggaccuuccggugugguuaagcuacaaagucgcauccgagggcuuccaguauagcgaucgacgcuggugcuucgacggcgagcgcaauaaccaggugcuggaggagaacauggacguggagauuuggacgaaggagggagaaagaaagaagcuccggccccgguggcuugacgcccguaccuacagugacccccuggcccuccgggaguuuaaggaguucgcggcgggccgccgguccguuucaggggaccuuauacuggagaucggcaaguugccccagcaccugacgcaaagagcucagaacgcacuggacaaccuugugaugcuucacaauucggagcagggcgggcgggcguaccgccaugcuauggaggaacugccggauaccaucgagaccuugaugcuguuagcccucaucgccgugcugaccgguggugucacccuauucuuccucuccgggcgcgggcugggcaaaacauccaucggacuucucugcgugauggccuccucggugcuacuauggauggcaucuguggagccccacuggauugccgccagcaucauccuugaguucuuccugauggugcugcucauccccgagccagaccgccagcggaccccgcaggauaaucagcuggccuaugugguuaucggccuccucuucaugauucugaccguggcugcuaacgagaugggccugcuugagaccacgaagaaggaccuagggaucggccacguggcggucgagaaccaccaccacgccgccaugcuggauguagaucuccaccccgccucugcguggaccuuauacgccguggccaccaccaucaucacgcccaugaugcgccacaccaucgagaauaccaccgccaacaucagccugacggcaaucgcgaaccaagccgccauccugaugggacuggacaaggguuggccgauuuccaaaauggacaucggcgucccacugcucgcccugggaugcuacagccaggugaacccccugacccuuaccgcggcagugcugaugcuuguggcccacuacgccaucauaggacccggucuccaggccaaggcaacccgggaggcccagaagcgcacggccgccggcaucaugaagaacccgacuguggaugggaucguggcaauagaccuggaccccgucguuuacgacgcgaaguucgagaaacagcugggucagaucauguugcugauacugugcaccucgcagauccuccuaaugcgcacuacgugggcccugugcgagagcaucacccucgccaccggcccgcuaacuacacugugggaaggcucccccggcaaguuuuggaacacgaccaucgccgucagcauggccaacaucuuccgggggagcuaccuagcgggcgcugggcuggccuuuucccugaugaaaucccuagggggugggaggcggggcaccggggcacagggcgagacgcugggcgagaaguggaagcgccaguugaaccagcucuccaaaagcgaguucaacaccuauaagcggucagguaucauggaggucgaccgcagugaggcgaaagagggccugaagcgcggggagacuacuaagcacgccgugucgcgcgggacggccaagcugcggugguucguggagcgcaaccucgucaagccagaggggaaggugaucgaccuggguugcggacgcggagggugguccuacuacugugcagggcucaagaaggucaccgaggucaagggguauaccaagggcgggcccggacacgaagaacccaucccgauggccacguacggguggaacuugguaaagcuccacuccgggaaggacguguucuucaucccgccugagaagugcgacacgcugcugugugacauuggugagagcuccccaaaccccaccaucgaggagggccgcacccuccggguccugaagaugguggagccguggcuacgcgggaaucaguucugcaucaagauacuaaaccccuacaugccaagcgugguagagacgcuggaacaaaugcagcggaagcauggcgguaugcucguucgcaauccgcucuccaggaacaguacccacgaaauguacuggguguccugcgggacgggaaacauagucuccgcggugaacaugacgucgcguaugcugcugaaucgcuuuaccauggcacaucgcaagccgacauacgagcgcgacgucgaccucggggccggcacgcgccacguugccguggaacccgaaguggccaaccuggacaucaucggacagcgcauagagaacaucaagcacgagcacaagagcaccuggcauuacgacgaagacaaccccuacaaaaccugggcguaucacggguccuacgaggucaagcccagcggaucagccucaagcauggugaacgggguggugaaguuacucaccaaaccgugggacgugauacccauggucacgcagauugccaugacagacacuacgcccuucggccagcagagaguuuucaaggagaaaguggacacgcguaccccuaaggcaaagcgggggaccgcgcaaauuauggaagucaccgcuaaguggcuguggggcuuccuaucccgaaacaagaagccgcggaucugcacgcgcgaggaguucacucgcaaggugcgcagcaacgccgccaucggcgccguguucguagacgagaaucaauggaacuccgcuaaagaggccguggaggacgagcgguucugggacuuaguucaccgcgagcgcgaacugcauaaacaggggaagugugcaacuugcgucuacaacaugaugggcaaacgcgaaaagaagcugggggaguucgguaaggccaaggggagccgggccauuugguacauguggcuuggugcgagguuccuggaguucgaggcccuggguuuuaugaaugaagaccacugguucagccgggagaacagucucuccgggguggaaggggagggccugcacaagcugggcuauauccuccgcgacaucagcaagauccccgggggaaauauguaugccgacgacaccgcagguugggacacgcggaucacagaggacgaucuccaaaacgaggccaagauuaccgacauaauggaacccgagcaugcccugcucgccaaauccaucuucaaacugaccuaccagaacaaaguaguccgcgugcagcggccggucaagaacgggacggucauggaugucaucagcagacgcgaccagagaggcaguggacaggugggcaccuacggccugaacaccuucaccaacauggaggcccaacucauccgccaaauggagagugaggggaucuuuagucccagcgagcuggaaaccccgaaccuggccggccgaguuuuagacuggcuggagaagcauggcguggagcgccuuaagcguauggccaucuccggugacgacugcguggucaagcccaucgaugaccgguucgcgaccgcccucaccgcccugaacgacauggggaagguacgcaaggacauaccgcagugggagccgagcaaaggauggaacgauuggcagcaggucccguucuguagccaccacuuccaccaacugauaaugaaggacggccgcgagauaguaguacccugccgcaaccaggaugaacucguggggcgcgcuagagucucccagggcgccggguggagccuucgcgaaaccgcgugccugggcaaauccuacgcccagauguggcagcuaauguacuuucaccggcgugaccugcggcuggccgccaacgcuaucugcagcgccgugccgguggacuggguccccacgagcagaaccacguggagcauccacgcccaccaucaguggaugaccacggaagacaugcucuccguguggaauaggguguggaucgaggagaaccccuggauggaggacaagacccacauaucguccuggggcgacguucccuaucugggcaagcgcgaggaucaguggugcggcagccucaucggguuaaccgcccgggccaccugggcgacgaacauucagguggccaucaaucaggugcgccgccuuaucggcaacgagaacuaccuggacuacaugaccuccaugaagcgguucaagaaugaaagcgauccagaaggcgcacucugguga

SEQ ID NO: 23818 - RNA, 9879 nt, Artificial Sequence
  derived and/or modified CDS sequence (opt11) from DENV-1__FJ639675__SS-prME
agcgugaccaugcuacucaugcugaugcccaccgcccuggccuuccaccucacuacccguggcggggagccucacaugauagugaguaagcaggagcgcggcaagagcuuacuguucaagaccagcgccggggugaacauguguacucugaucgccauggaccuaggcgaguucugcgaggacacgaugacuuacaagugcccccgcaucaccgaggcagagccagacgacguggacuguuggugcaacgccacagacacuugggugacuuaugggaccugcagccagacaggggaacacaggcgggacaaacggagugucgccuuagccccgcauguuggccuggggcuggagacaaggaccgaaaccuggaugagcuccgagggcgccuggaagcagauacagcggguagagaccugggcccugcgccaccccgguuucacggugaucgcccucuuucuggcacacgcaauaggcaccucaaucacacagaaggggaucaucuucauccugcucaugcuggucacccccuccauggccaugcggugcgucggaauaggcagccgcgauuuuguggagggguuauccggcgccacauggguggacgucguccuagagcacgguagcugcguaaccacaauggccaaggacaagcccacccuggacaucgaacugcucaaaacggaggucaccaaccccgcaguucugcggaagcuguguaucgaggcaaagaucuccaacacaaccacggacagccgcugcccgacccagggcgaggccacccucguagaggagcaggacgccaauuucgucugccggcgcaccuucguagaccgggguuggggaaacggcugcggguuauucggcaaggggucccugauuacgugcgcgaaguucaagugcgugaccaagcucgaggggaagaucguccaguacgagaaccugaaguauuccguuaucgugaccguacacaccggcgaccagcaccaggugggaaaugagucaacggagcacggcaccacagcgaccaucacgccccaagcuccaagcacggaaauccagcugaccgacuacggggcuuuaacacuggacugcucgccccggaccgggcuggauuucaaugagaugguacuccugacgaugaaggagaaauccuggcucguccauaagcagugguuccucgaccugccgcugcccuggaccuccggggccuccaccagccaggagaccuggaaccggcaggaccuccuggugacguucaagaccgcgcaugcgaagaagcaagaggucgugguguuggguucccaagagggcgccaugcacaccgcacuaaccggggcaacagagauacagaccagcggcaccacaacgauuuucgccgggcaccuuaagugccgccugaagauggauaaacucacccucaaggggauguccuacgucaugugcaccggacuguucaagcucgagaaggagguggcggagacccagcacggcacgguacugguccagaucaaguaugagggcaccgacgcaccuugcaagaucccauucagcacccaggacgagaaggguguaacccagaacggccggcugaucacggccaauccgauagugacggauaaggagaagccugucaacaucgaggccgagccgccuuucggggaguccuacaucguuauaggugccggugagaaggcgcugaaguuaagcugguucaagaagggguccagcaucggcaaaauguucgaggcuacagcccgcggugccagacgcauggcaauccugggcgacaccgccugggacuucggguccaucgguggcguguucacgagcgucggcaaguuggugcaucagaucuucggcaccgccuauggggugcuguucucgggcgugagcuggaccaugaaaaucgggauuggcgugcugcugacauggcucggccugaacucaagauccacgucccugaguaugaccugcaucgcaguggggcuagucacccuguaccucggcgugauggugcaggcugacagugggugcgucaucaacuggaagggccgggagcuuaaaugcgggagcggcaucuucgugacuaacgagguacacacguggaccgagcaauacaaguuccaagcggacagcccgaagcgccuaucaagcgcaauagggaaggcuugggaagagggugucugcggcauccgguccgccacccgccuggagaacaucauguggaagcagaucagcaacgaguugaaccacauccugcuggagaacgauaugaaguucaccguggucgucggggacguggccggcauccucgcgcagggaaaaaagaugauccggccucaacccauggaauacaaguauuccuggaagucauggggcaaggccaagaucaucggcgccgacgugcagaauacaacuuucaucaucgacggccccaacaccccggagugcccagacgaucagcgcgccuggaacaucugggaggucgaggacuacggcuucggaaucuucaccaccaacauuuggcugaagcuccgggacuccuacacccaggugugcgaccacaggcucaugagugcggccaucaaggauuccaaggcugugcacgccgacaugggauauuggaucgaauccgagaagaacgagaccuggaagcuggcccgggcgagcuucaucgaggucaagaccugcaucuggcccaagagccauacccugugguccaacggcguucucgagagcgagaugaucaucccuaagauauaugggggcccgaucagccagcacaacuaccgccccggguacuucacgcagaccgcaggcccuuggcaucucgggaagcuggagcucgacuucgaccugugcgaggggaccaccguggucguggacgaacacugcgggaaccgggguccgagcuugcgaacuaccaccgugaccggcaagaucauucacgaguggugcugucgguccugcacgcugccaccccuccgcuuuaagggagaggacgguugcugguacgguauggagauccggcccgucaaagagaaggaggagaaccuuguaaagagcaugguuagugcuggcuccggggaagucgacagcuucucccucgggcugcuguguaucagcauaaugaucgaggagguuaugcggucccgguggucucguaaaaugcucaugacuggcacacuugccguguucuuccugcucaucauggggcaacugacguggaaugaccuaauccggcucuguaucauggucggcgccaaugcguccgacagaaugggcaugggcaugacguacuuagcccugauggccaccuucaaaaugcgaccgauguucgcugugggccuacuguuccgacgccugaccucgcgggaggugcuucugcugaccaucgggcucagucugguagccagcguggaguugcccaacucccucgaagagcugggcgacgggcucgcuauggguaucaugauauuaaagcugcugacggacuuccagagucaccagcucugggccacccuccugagccuuaccuuuaucaaaaccacguucagccugcacuacgccuggaagacgauggcuaugguguuguccaucgugagccuuuucccucugugccuguccacuaccagccagaagacuaccuggcuucccguacuguugggcagccucgggugcaagccacugaccauguuccugaucgccgaaaauaagaucugggggcgcaaaagcuggccgcucaacgaggguaucauggccgucggcaucgucucaauccuccugucgucucuccugaagaacgacgugccccuggccgggccccugauugcgggcggcauguugaucgccugcuacgugauuuccgggagcucagcggaucugagccuagagaaggccgccgaaguguccugggaggaggaagcggagcacagcggggcgucccauaauaucuugguagagguccaggacgacgggaccaugaagaucaaggacgaagagcgggacgauacgcugaccauccuccugaaggcaacccugcucgccguaagcgguguguacccgcuguccaucccugccaccuuguucgucugguacuucuggcagaaaaagaagcagaggagcggagugcuaugggacacgcccucaccgccggaggucgagcgggcgguccucgacgauggcaucuacagaaucaugcagagagggcuacuagggcgcagccaggugggcguggggguuuuccaggagaacguguuucacacgauguggcacguuacccggggcgcugucuuaauguaccaagggaagcgacuggagcccuccugggcgucggugaagaaggaccugaucuccuacggaggcggguggcgucuccaggguucauggaauaccggagaggaagugcaagucaucgccgucgagcccgggaagaaccccaagaaugugcagaccgcgccaggaacguucaagaccuccgagggcgaggucggcgcaauugcccuggacuucaagcccgggaccagcggcuccccgaucgugaaccgcgaggggaaaaucgugggauuauauggcaacggggucguaaccacguccggcacuuacguaagcgcgaucgcccaggccaaggccucccaggaggggccccucccggaaaucgaggacgaggucuuccgcaagcgcaaccugaccauuauggaccuacaucccggcuccgggaagacccgacgauaccuacccgcuaucgugcgggaagcuaucaagagaaagcuacggacgcugauauuggccccgacccgcguggucgccucggagauggcggaggcgcugaagggcaugcccauccgcuaucagacaaccgcagucaagagcgagcacacgggcaaggagaucguggaccugaugugccacgcuaccuucaccaugcgccuccuguccccggugcgcgugcccaacuauaauaugaucaucauggacgaggcccacuucaccgacccguccuccaucgccgcgcguggcuacaucagcacgcgugucggcaugggggaggccgccgccaucuucaugacugccacaccgcccggcuccgucgaagcguucccccagagcaacgccgugauccaggacgaagagcgagacaucccggagaggagcuggaacagcggcuacgaguggaucacugauuuccccggcaaaacggugugguucguccccuccaucaaaagcggaaacgacaucgccaauugccuuaggaagaacgggaagcgggugauccagcucucccggaagaccuuugacaccgaguaccagaaaacgaagaacaacgacugggacuacguagucacgaccgacaucagcgagaugggcgcgaauuuucgcgccgaccguguaaucgacccccgccggugccugaagccggucaucuugaaggacgggcccgaacgcgucauacuagcuggcccgaugccggucaccguggccucagccgcgcagcggcgcggccggaucggccgcaaccacaacaaggagggggaccaguauauauacaugggccagccgcugaacaacgaugaggaccacgcgcacuggaccgaggcgaagaugcugcuagacaacauuaacacgccggagggcauuauccccgcccuguucgagcccgagcgcgagaaguccgccgccaucgacggggaguaccgccugcgcggcgaggcgcgcaagaccuuuguggagcucaugcgccgcggcgaccucccgguguggcugagcuauaaggucgccucugagggcuuucaguacagcgaucgccgguggugcuucgacggcgagcgaaacaaccaaguacuggaggagaauauggacguggagaucuggaccaaggagggggagcggaagaaacugcgucccagauggcucgacgcccguacguauuccgacccacucgcucugcgggaguucaaggaguuugcugcgggccgcaggagcgucuccggggaccugauacuagaaaucggcaagcugccccaacaccugacgcagcgcgcucagaacgcucucgacaaccuggugaugcugcacaacagcgagcaaggcgggcgcgcauaccgccacgcgauggaggagcuaccggacaccauagagacucugaugcuccuugcgcugaucgccgugcugaccggcggggugaccuuguucuucuuguccgggcggggccugggcaagacgagcaucggccuccugugcgugauggccagcagcgugcugcucuggauggcgagugucgagccccacuggaucgcggccagcaucauucuggaguucuuccugauggugcuccugauccccgagcccgaccgccagcggacaccgcaggacaaccagcuggccuauguggucaucgggcuccuguucaugauuuugacuguagcagccaacgagaugggccuccuggagaccacgaaaaaggaccuggggaucggccacgucgcggucgagaaccaccaccacgcugccaugcuugaugucgaucugcaccccgccucggccuggacccuguacgcuguggccaccaccaucauaacgcccaugaugcgccauacgaucgagaacacaaccgccaacaucucacucaccgcaauagcuaaccaggcggccauccuaauggggcuggauaaaggguggccuaucaguaagauggacaucggcguccccuuacuggcccuggggugcuacucgcaggugaacccccucacccugaccgccgcggugcugaugcucgucgcccauuacgccaucauuggccccgggcugcaggcaaaggccacccgggaggcgcagaagcgcacggccgcaggcaucaugaagaacccgaccguggacgggaucguggccauagaccucgaccccgucguguacgacgccaaauucgagaagcaacucggccagaucauguugcugauccucugcacgucccagaucuugcugaugcgcacuacgugggcccucugugagucaaucacacuggccaccggcccccuaaccacgcucugggaggggucccccggcaaguucuggaacaccaccauugcugugagcauggccaacaucuucagggggaguuaccucgccggagcgggccuggccuucagucugaugaagucgcucgggggcggacgcagaggcacaggggcgcagggcgagacucugggcgaaaaguggaagcgccagcuaaaucagcucuccaaaagcgaguucaacaccuacaagcggagugggaucauggaggucgaccgcagcgaggccaaggaagguuuaaagcgaggggagaccaccaagcacgcgguaucccgcgguacugcgaagcuccggugguucguagagcgcaaucuggucaaaccggagggcaaggugaucgaccugggcugcggccgcggcggguggagcuacuacugcgcgggucugaaaaaggugacagaggucaagggguacaccaagggcggccccggccacgaagaacccauccccauggccacuuacggguggaaccucgugaagcugcacuccggcaaggacgucuucuucaucccgcccgagaagugcgacacccugcucugcgacaucggugaaucauccccaaaucccaccaucgaggaggggcggacgcuucgggucuuaaaaaugguggagccguggcugcgcggaaaccaguucugcauuaagauucugaaccccuacaugcccuccguggucgagacgcuggagcagaugcagcggaagcacggcggcauguuggugaggaacccacugagcaggaauuccacccaugagauguacuggguguccugcgggacgggcaacauagucucggccgugaauaugaccucgagaaugcugcugaaccgguuuaccauggcccaccgcaaaccgacuuacgagagagacguggaccuuggugcuggcacgcggcacgucgcaguggagccagaaguggccaaccuggacaucauagggcagcguaucgagaacaucaagcacgagcacaagagcacuuggcacuacgacgaggacaacccuuacaagaccugggccuaccacggauccuacgaggucaagccaucaggcucggcguccagcauggugaacggcgucgugaagcuucugaccaagccgugggacgucauccccauggucacacagauugccaugaccgacacuacccccuucggccagcagcggguguuuaaggagaagguggacacgcggacccccaaggccaagcgagggaccgcccagaucauggaggucacagcuaaguggcuauggggcuuccucucccgaaacaagaagccgcggaucugcacgagagaggaguucacucggaaagugcguucaaaugcagcuaucggcgcggucuucguugacgaaaaccaguggaacuccgccaaggaggcgguggaggacgagagguucugggaccuggugcaccgcgagcgagagcugcacaagcaagggaaaugcgccaccugcgucuacaacaugauggguaagagagagaagaagcuuggagaguucggcaaagccaaagguagccgggccaucugguacauguggcugggcgcacgcuuccuggaguucgaggcgcuaggauucaugaacgaggaccacugguucucccgggagaauagccuguccgggguagagggagaggguuuacacaagcucggcuacauccugcgcgauaucagcaagauacccgggggcaacauguaugccgaugacacugcgggcugggacacaagaaucaccgaggacgaccugcagaacgaggccaagaucaccgacaucauggagcccgagcacgcuuuacucgcgaaguccauauucaagcugaccuaccaaaauaaggugguccgugugcagcggccggccaagaacgguacgguaauggacguaaucagccgccgcgaccagcguggcagcggccaggugggcaccuauggcuuaaacaccuucaccaacauggaggcccagcugauccgccaaauggagagcgaggggauauuuucuccaucggagcuggagacaccgaacuuagccgaacggguguuagacugguuagaaaagcacggggucgaacgccucaagcggauggccaucuccggggacgacugcguggugaaacccaucgaugaccgcuucgccaccgcccugacggcccugaacgauauggguaaggucagaaaagacauuccgcaaugggagcccagcaagggguggaacgacuggcagcagguccccuucugcucucaccacuuccaccagcucaucaugaaggacggccgcgagauaguggugcccugccggaaccaagacgagcugguuggcagagccagagugagccagggggccggcuggagccugcgcgaaacggcgugccuggggaaaaguuacgcucaaauguggcagcugauguacuuccaccggcgggaucugaggcucgcagccaacgcgaucugcucugccgucccgguggacugggugcccacuucgcgcaccaccuggagcauucacgcccaccaccaguggaugaccacggaggacaugcuguccguauggaaucggguguggaucgaggagaaccccuggauggaggacaagacccacaucucuuccuggggcgaugugcccuaccugggaaagagagaggaccaguggugcgggagucugauaggccugaccgcccgcgccaccugggcgacgaacauccaggucgccaucaaccaaguuagacgccugaucggaaacgagaacuaccucgacuacaugaccaguaugaaacgguuuaagaacgagucagacccggagggcgcccugugguga

SEQ ID NO: 23819 - RNA, 9879 nt, Artificial Sequence
  derived and/or modified CDS sequence (opt11) from DENV-1__FJ639676__SS-prME
ucaguuacuaugcuccugaugcuaaugcccacugcccuugcuuuucaccucaccaccaggggcggggagccccacaugaucguguccaaacaggaacguggcaagagcuugcuauucaagacaagugcuggggugaacaugugcacccugaucgccauggaccugggcgagcugugugaggauaccaugacguacaagugcccgaggauaaccgagguagagccugaugacgucgauugcugguguaacacuaccgacacauggguaaccuacgggaccugcucgcagacgggagagcacaggcgagacaagagauccguggcccucgcgccccacgccggccuggggcuggaaacgagggcggagacuuggaugucguccgagggcgccuggaagcagauccagcgggucgaaaccugggccuugcgccaccccggguucacgguuaucgcccuguuccuagcgcacgugaucgggaccucuaucacccagaagggaaucauuuucauucuacugaugcuuguuacgccuuccauggccaugcgaugcguaggaaucggcagccgcgauuucguggagggacuauccggugccacgugggucgauguggugcuggaacaugguucgugcguaaccaccauggccaaggacaagcccacgcucgacaucgaacuacugaagacugaggugaccaaccccgccgugcugcggaaguuaugcaucgaggcgaagauuuccaacaccaccaccgacucucgcuguccgacccaaggcgaagcaacacuggucgaggagcaggaugccaacuucgugugccggcgcaccuuuguagaccgggggugggggaaugggugcggucuguuugggaaggggucccucaucacaugcgcaaaguucaagugcguaaccaagcuggaagguaagaucgugcaguacgagaaccugaaauacucugucaucgugaccgugcacaccggcgaccagcaccaggucgggaacgaguccacagagcacgguaccaccgcuaccaucacgccccaggcgccuacgagcgagauccaacucaccgauuacggggcguugacccuagacuguagcccccggaccggccucgacuucaacgaaauggugcugcucacgaugaaggagaagucauggcuagugcacaagcagugguuccucgaccugccucucccguggaccagcggggccuccaccagccaagagacguggaaccggcaggaccugcuggugacguucaaaaccgcccaugccaagaagcaagagguggucguacucgguucgcaggagggcgcgaugcacacggccuugaccggggccacggagauccagaccagcggcacuaccacgauuuucgccgggcaccuaaagugcaggcucaagauggacaagcuaacccugaagggcaugucguacgucaugugcacugggagcuucaagcuggagaaggagguggcggagacccaacacggaacaguccugguccagaucaaguacgaagggaccgacgcgcccugcaagauccccuuuuccacgcaggaugaaaaggggguuacccagaacgggcgccugaucacggcuaaccccauugucaccgauaaggaaaagcccgugaauaucgaggcugaaccgcccuuuggggaaucguacaucgugaucggcgccggugagaaagcacugaagcucucgugguucaagaagggaucauccaucgguaagauguucgaggccacugcaagaggggcucggaggauggccauucugggggauaccgcgugggacuucggaagcaucggcggagucuucacguccguggggaagcuggugcaucagaucuuuggcaccgccuacgggguccucuucucuggcguauccuggaccaugaaaaucggaauuggcguacuguuaaccuggcucggccugaacucgcguuccacaagccuguccaugacaugcaucgcgguaggucucguaacccuguaucugggcgugaugguccaggccgacagugggugcgugauuaacuggaaaggccgggagcucaagugcgggagcggcaucuucgugacgaacgagguccacacguggaccgagcaguacaaauuccaggccgacuccccaaaacgacugagcgcggcaaucgggaaggccugggaggagggggugugcggcaucagaucagccacgcgguuggagaacaucauguggcggcagaucuccaaugagcucaaucacauccugcuggagaacgacaugaaguucacuguggucgugggggacguggugggcauccucgcgcaggggaagaaaaugauacgcccccagcccauggagcacaaguacuccuggaaguccuggggaaaggcgaaaauaauuggcgccgacgugcagaacaccacguucauuaucgacgggcccaacaccccugagugccccgacgaccagagagcuuggaacaucugggagguggaggacuacggauucgggauauucaccacaaacaucuggcugaagcugcgcgacucuuacacgcaggucugcgaccaccgguugaugagcgccgcgaucaaggacuccaaggccguccacgcggacaugggguacuggaucgaguccgaaaagaacgaaaccuggaagcuggcgcgcgcguccuucaucgaggugaagacuugcaucuggcccaagagccacaccuuauggagcaauggcguucucgaaagcgaaaugaucauccccaagaucuacggcggcccuaucucccagcauaacuauagaccugguuacuuuacgcagaccgcgggaccuuggcacuuggggaaacuggagcuagacuucgaccugugcgaaggcaccaccgugguugucgacgagcacuguggcaaccgagggccuagccugcggaccacuaccgugacagguaagauuauccacgaauggugcugucgauccugcacacucccacccuugcgauucaagggagaggacgggugcugguacgggauggagauucgccccgugaaagaaaaggaggagaaccuggucaagagcauggugagcgcggguuccggagaaguagacagcuucucacucgggcuccuaugcaucagcauaaugaucgaggagguaaugcggagccgguggagcaggaagaugcucaugacggguacucuggcaguguuuuuccuguuaauaguggggcagcugacuuggaacgaccugauacgccucugcauaauggucggcgccaacgccuccgaccgcauggggaugggcaccaccuaccuggcguuaauggccaccuucaagaugaggccgauguucgccguaggucuacuguuucggcggcuuaccagccgcgagguucuccuacugacgaucgggcucucucugguggcgagcguggaacuucccaacucccucgaggagcucggcgacgggcuggccauggggaucaugauccucaaacuacugacagacuuccaaucuuaccaacucugggccacgcugcuaucgcugacguucaucaagacgaccuucuccuuacacuaugccuggaaaaccauggccaugguucuauccaucgugagccuccuuccccucugccucuccaccacgagccaaaagaccaccuggcugcccgugcugcucggcucucugggcugcaagccgcugaccauguucuucaucgcggagaacaagaucuggggccgcaagagcuggccacucaacgaagggauaauggcggugggcauagugagcauucugcuguccucucuccuaaagaacgacgugcccuuggccggaccauuaaucgcgggcggcaugcuuauagccugcuacgucaucuccgggucauccgccgacuugagccuggagaaagcggcggaggugucuugggaggaagaggccgaacacucuggugccucccacaacauccugguagaaguucaggacgacgggacgaugaagauaaaggacgaggaacgcgaugacacucugacgaucuugcugaaggccacccuccuugcggugaguggcguauacccgcuuuccauucccgcaaccuuauucgucugguacuuuuggcagaaaaagaagcagcggagcgggguucucugggacacgcccagcccuccagagguggagcgugccguccucgaugacggcauuuaccggaucaugcagcguggcuugcuggggcggagucaggugggcguuggcgucuuccaggagaacguguuucauaccauguggcacgucacccgcggcgccgugcucauguaccaggggaagcggcuagagcccaguugggccucuguaaagaaggauuugaucuccuacggcgggggauggcggcuucagggcucuuggaacaccggagaggaggugcaggucaucgcgguggagcccggcaagaaccccaagaacgugcaaacugcucccgggacuuucaagaccccggagggcgaggucggcgcgaucgcgcuggauuucaagcccgggaccuccggaagccccaucgugaaccgagaggggaagaucgugggcuuguacggcaacggugucguaacgaccagcggcaccuacguguccgccaucgcgcaggcaaaagccucacaagaggggccgcucccggagaucgaggacgagguguuccgcaaacggaaccucacgaucauggaccuccacccaggcucggguaaaacgcggcgguaccugccggcaaucgugagggaggcgaucaagcggaaacugcgcacgcugauccuggcccccacccgcguagucgccagcgaaauggccgaggcccugaagggcaugcccauccgguaccagaccacggcggugaaguccgagcacaccggccgcgagaucguggaccugaugugucacgccacuuucaccaugcgacuucugagccccguacgcgugccgaauuauaacaugaucaucauggacgaggcucacuucacggaccccuccagcaucgccgcccggggguauaucuccacucgcgugggcaugggggaggcagccgccauauucaugaccgccaccccgccuggcagcguugaggccuuuccgcagaguaaugcugugauacaagacgaggagcgugacauccccgagcgcagcuggaacuccggguacgaguggaucacggauuuccccggcaaaaccgugugguucgucccgaguaucaaaagcggcaacgacauugccaauugcuugcggaagaacgggaagcgcgugauucagcucucccggaagaccuucgacaccgaguaccagaagacgaagaacaaugacugggacuauguggucaccacggacaucucggagaugggcgccaacuuucgcgccgaucggguuaucgauccccgccggugccuuaaacccgucauccucaaggacgggcccgagcgcgugauccucgcgggccccaugccgguaaccguagcaagcgccgcacagcggcgcggccggauuggucgcaaccacaauaaggaaggggaccaguacaucuacaugggacagcccuugaacaacgacgaagaccacgcccacuggacggaagcgaagaugcugcucgauaacaucaacacucccgagggcauuauccccgcccuguucgagccggagcgggagaaguccgccgcgaucgacggagaauaccggcugaggggagaggcccgcaagaccuuuguggagcucaugaggcgcggugaucucccaguguggcuuagcuacaaggucgccagcgaaggcuuccaguacucggaccgccgguggugcuucgacggugagcgaaauaaccagguguuggaagagaauauggacguggagauauggaccaaggagggggagcggaagaagcugcgcccccgguggcuggacgcccgcacguauucggacccgcuggcacuucgggaguucaaagaauuugcggccggucgccggucgaucagcggggaccugauucucgagaucggcaagcuaccccagcaccucacccaacgcgcgcagaacgcccucgacaaucuggucaugcugcauaauuccgagcagggcggacgggccuaccgccacgcuauggaggaacuccccgacacaaucgaaacgcugaugcuucucgcccugaucgcaguccugacgggcgggguaacccucuucuuccugagcggccggggguuagguaagaccuccaucggccucuuaugugucauggcuagcuccgcccugcucuggauggcauccguagagccccacuggauugcggccuccaucauacuggaguucuuccugauggugcuccugauccccgagccggaccgccagcggaccccucaggacaaccagcuugccuacguugugaucgggcuccuguucaugauccucacaguggccgcuaacgagaugggccuccucgagacgacuaagaaagaccuggggaucggccacgucgcgguggagaaccaucaccaugccaccaugcucgauguggaccuacaccccgcgagcgccuggacccuguacgcuguggcgacuacaaucaucacuccgaugaugcgccauaccaucgagaauaccacagccaauaucucccucaccgcgauugccaaccaggcagcgauccugaugggucuagauaaaggcuggccaaucagcaagauggauaucggcgugccccuccuggcccugggguguuacucccaaguaaacccccugacccugacggccgcuguccuaaugcucguagcgcacuacgccaucaucggaccgggucuccaggccaaggccacccgcgaggcccagaagcggaccgcugccggcaucaugaaaaaccccaccguggaugggauagucgccauagaucuggacccugugguguacgacgccaaguucgagaaacaguugggccagaucaugcugcugauccuguguacuagccagauccuacuuaugcgcaccaccugggcccugugugaguccauaacucuggcgacgggacccuugaccacucucugggaggggagcccaggaaaguucuggaacaccacgaucgcaguaucgauggccaauaucuuccggggcagcuaccuggcgggcgcgggccuggccuucagccucaugaagucccucggaggagggcgucgggggacuggagcccagggcgagacucugggggagaaguggaaacgccagcucaaccagcuuagcaaguccgaguucaacaccuacaagaggagcgggauucuagagguggaucguuccgaggcgaaagagggccuccguagaggcgagacgaccaagcacgccgugucucggggcaccgcgaagcugaggugguuugucgagcggaaccuggugaagcccgaggggaagguuauugaccuggguugcggccgcgggggcugguccuacuacugcgccgggcucaagaagguuaccgagguuaaagguuacacuaagggcgggccgggacaugaggagcccaucccuauggccaccuacggguggaaccuugugaagcugcacagcggcaaggacgucuucuuuaucccgcccgagaagugcgacacccuccugugugacaucggcgagaguagccccaacccgacgaucgaagaaggaagaacgcugcgcguacuaaagauggucgagcccuggcuucggggcaaccaguucuguaucaagauccugaauccguauaugccuuccgucguugagacgcucgaacaaaugcagaggaagcacgggggcaugcugguacggaauccgcucagccgcaacuccacccacgagauguacugggugagcugcgguaccggcaauauagucuccgcaguaaacaugacgucacgcaugcugcugaacagauucacgauggcccaccgcaaacccaccuacgagcgggacguggaucugggggcgggcacccgccacgucgcaguggagccugaggucgcaaaucucgauaucaucggccaaagaaucgagaacaucaaacacgagcacaagucuaccuggcacuaugaugaggacaaccccuacaaaacgugggccuaccacggcagcuaugagguuaagcccuccggaagcgcaagcuccauggucaacgggguuguuaagcugcugaccaagccaugggaugucauccccauggugacgcagauugcgaugacggacacgacgcccuucggccagcagcgugucuucaaggagaagguggacacgcggaccccuaaggccaagcgcgggaccgcccagaucauggaggugacugcuagauggcucuggggcuuccuaucucgcaacaagaagcccaggaucuguacgcgcgaggaguuuaccagaaaggugcgcucgaacgccgcgaucggagccgucuucguggacgagaaccaauggaacucugccaaggaggccguagaggaugagagguucugggaccugguccaccgagaacgugagcuccacaaacaggguaagugcgcgacgugcguguacaacaugaugggcaagagagagaaaaagcugggcgaguucggaaaagccaaaggaucccgggccauuugguacauguggcugggcgcgagauuccuugaguucgaagcccuuggcuucaugaacgaggaccacugguucucuagggaaaauucgcugagcggaguagagggcgaggggcuccacaagcuaggcuacauccugagggacaucagcaagauucccgggggaaacauguaugcggaugacaccgccggcugggauacccguauaaccgaggacgaccuucagaacgaggcgaagauuacggacaucauggagccggaacacgccuuguuagcaaccucaauuuucaaacucaccuaccaaaauaaggucgugcgggugcagcggcccgcaaagaacgggaccgucauggacgugauaagccggcgcgaucaacgggguagcggacagguaggcacguacggucugaacacuuucacgaacauggaagcacagcugauccgccagauggaauccgaagggaucuucucucccuccgagcucgagacccccaaccuggcugagcgggucuuggauuggcucgaaaaguauggagucgagaggcugaagcggauggcuauaagcggggaugauuguguagugaagccgauagacgaucgcuucgcaacggcgcuaacagccuuaaacgauaugggcaaaguacggaaggacaucccccagugggagcccucaaaaggauggaaugauuggcagcagguacccuucugcagccaccacuuccaccaacugaucaugaaggacgguagagagaucgucgugccgugcagaaaccaggacgagcuggugggcagagcccgggugagccagggugccggcuggucacuccgugagaccgccugccugggcaagagcuacgcucagauguggcaacugauguacuuucaccgucgcgacuugcgacucgcagccaacgcaauaugcucagcagugcccguggacuggguaccgaccagccgcacgaccugguccauacacgcccaccaccaguggaugaccaccgaggauaugcugucaguguggaaccgcguguggaucgaagagaaccccuggauggaggauaagacacacaucuccucaugggaggacgucccguaccucggcaagcgggaagaccaguggugugggucccucaucggccugaccgcucgcgccacgugggcgacaaacauucaaguugcgaucaaccaggugagacgccucaucggcaacgagaauuaccuggacuucaugaccagcaugaagagauucaagaacgaguccgacacggaaggggcccugugguga

SEQ ID NO: 23820 - RNA, 9879 nt, Artificial Sequence
  derived and/or modified CDS sequence (opt11) from DENV-1__FJ639677__SS-prME
ucaguaaccaugcugcucaugcuaaugccgacggccuuggcauuccaccugaccacccgaggaggagaaccucacaugauugucucgaaacaagaacgggguaaaucacuacucuucaaaacauccgcaggggugaauaugugcacacuuaucgccauggaccucggagaacuuugcgaggauaccaugacuuauaaaugcccccgcgugacagaggccgagccggaugacgucgauugcuggugcaacgccaccgacacgugggugacguauggcacgugcagccaaacaggcgagcaccgcagagauaagaggucgguggcucucgcaccgcacguaggccucggccuagagaccagaaccgaaaccuggaugucgucggaaggugcauggaagcaaauucaacgcgucgagacaugggcccuuagacaccccggcuucaccguaauagcgcuguuucuggcccacgcuauuggcaccucaaucacucaaaaaggcauaauauucauucuccuaaugcucgucacacccucaauggcgaugcgcugcguggguaucggaagcagggacuucguugaaggucugaguggcgccaccuggguagacguuguucuagaacacggaaguugugucacaaccauggcgaaggacaaaccaacguuagauauagagcuccugaaaaccgagguuacaaauccagcaguacuccgaaaguugugcauagaggcuaaaauuaguaacaccacaacagauuccagauguccuacccagggcgaagcaacccuuguggaagaacaggacgccaacuucguaugucgaaggacguuuguagauaggggcuggggcaacgguugcggacucuucggcaagggcucucucauaacuugcgcgaaauucaaguguguuacuaaacucgaagggaaaauuguucaguacgaaaaucuaaaguauucagugauaguaaccguacacacgggugaccaacaccagguggguaacgaaaguacagaacaugggacgacagcaacgaucacuccccaggccccaacuaccgagauccaacuaaccgauuauggagcgcucacccuggacuguucgccuaggacggggcucgacuucaaugaaauggugcuacuuaccaugaaggagaagaguuggcuuguacacaaacaaugguuucuggaccuuccguuaccguggaccaguggagcauccacaucccaggaaacguggaaccgacaagaucuccuagugacuuucaagacggcacacgcuaaaaagcaagaaguugucgucuugggcucucaggaaggggcaaugcacacggcccuaacaggggcaacggaaauccagacaucgggaacaacaacaaucuuugccgggcaccugaaaugccgccucaaaauggacaaacuuacccucaaaggcaugagcuacguaauguguacgggcaguuucaaacuggagaaggaaguagcagagacgcagcauggcacggugcuaguccaaauuaaauaugaaggaacagacgcacccugcaaaauccccuucagcacgcaagacgaaaagggcguaacccaaaacgggcgguuaauaacagcgaacccaauagucaccgacaaagaaaagccagugaauauagaggccgaaccuccauucggggagagcuacauagugaucggcgcgggagaaaaggcccucaagcucucaugguucaaaaaggggaguagcaucggaaagauguuugaagccacagcaagaggcgcacgccgcauggcgauccuuggugacaccgcaugggacuuugggagcauaggagggguuuuuacgucaguuggaaaguuaguacaccaaauauucggaacggcauauggaguacuauucuccggagugucguggaccaugaagaucggcaucggagugcuccuaaccuggcucggccucaauucaagaaguacgagccuaagcaugacaugcauugccguaggccuaguaacccucuaccucggcgugaugguacaggcagacucaggaugcgugaucaacuggaaggggcgcgaacucaagugcgguucgggaauauucguaacuaacgaaguacacacguggacggaacaauacaaauuccaagcagacagucccaagcgccugagcgcagccauagggaaagcgugggaagagggugucugcgggauacgaagugcgacgagauuagaaaauauaauguggaaacaaauuucaaaugaacuaaaccacauccuacuugagaacgauaugaaacucacaguagucgugggcgacguagccggcauccucgcacaagggaagaaaaugauucgaccccagccuauggaauacaaauacucauggaaaagcuggggcaaagcaaaaauaaucggcgcagacgcgcagaauaccaccuucaucauagacggcccuaacacgccggaaugcccagaugaccagcgggcguggaacaucugggagguagaagacuacggauucggaauauuuacgaccaacauuuggcuaaaguuacgcgacucauacacacaaguaugugaucaccguuuaaugagcgcggcaauaaaagacucgaaagcaguccaugccgacaugggauacuggaucgaguccgaaaagaaugaaacguggaaacucgcgagggcuucauucauugagguaaaaacaugcauauggccaaagucucauacacucugguccaacggagugcucgagucggagaugauaaucccaaagauuuacggaggaccuauaagccagcacaacuaccgucccggcuauuuuacacaaacugccggacccuggcaccuggguaaacucgaacuagauuucgaccucugcgaaggcacaaccguuguaguggacgaacacugugguaacaggggcccaucucuacgcaccacgacaguuacuggcaaaaucauccacgaaugguguugccggucguguacccugccgccacuacgcuuccgaggcgaggauggcugcugguacggcauggaaaucagaccagugaaggaaaaagaagaaaaccuugucaagaguauggucagcgccggaaguggggaaguugacaguuuuucucucggccugcucuguauauccauaaugauagaggaaguuaugcgaagcagauggagccguaaaauguuaaugaccggaacccuagcggucuucuuccuccucauuaugggacagcuaaccuggaacgaccuaauaagacucugcauuauggugggggcaaaugccuccgaccggaugggcaugggaaccaccuaccucgcacuaauggcaacguucaagaugcguccaauguucgcgauggggcuccucuucaggcggcuuaccucuagagagguacuccugcugacaaucggccuaucccucguggccucggucgagcuaccaaacagucucgaagaacucggcgacggacuggcaaugggaaucaugauauuaaagcuauuaacggauuuccaaagccaccaacugugggcuacucuauuaucuuuaaccuucauaaaaacaacauucagccugcacuacgcuuggaagacaauggcaauggugcucagcaucgugagccucuuuccguugugccucucuacgacaucgcagaaaacuacguggcuaccuguauugcuaggcucgcuaggaugcaaaccucucaccauguuucuaauagcggagaauaaaauaugggggcgcaaguccuggccgcuuaacgagggaauaauggcaguagggauaguguccauacugcugagcagccucuuaaagaacgacgugccacucgccgggccccuaauagccggagguaugcugauagcguguuacgucaucaguggcuccagcgcagaccucucccuagagaaagcggcagaagucuccugggaggaggaagcggaacacucaggugcgucacacaacauacugguggagguccaagacgauggaacaaugaaaauuaaagacgaagaacgagacgauacauuaacaauacuacucaaagcaacccugcucgcugucucagggguguacccgcucuccauccccgccacccuuuucgucugguacuucuggcagaaaaagaaacaacggagcggaguacugugggauacaccgucaccacccgaaguagaacgagcaguccucgacgacgggauauaucgaauuaugcaacgcggacuccugggucgcucacaaguaggcgucggaguauuccaagagaacguguuccacaccauguggcaugucacacgaggagccguucugauguaccaaggcaaaagacuagaacccucaugggcaagcgucaagaaagaccuuauuaguuacgggggaggcuggcgccuaaagggaucauggaauacgggagaagaaguacaggugauagcaguagaaccaggcaaaaaccccaaaaacguccaaaccgcacccgggaccuucaagacccccgagggagaagucggagcuauagcgcuggauuucaaaccagggaccucggggagccccauugucaaccgcgaggguaaaauuguaggucuauacggaaacggaguggucacgacauccggcaccuauguuagugcaauagcgcaagcuaaagcaucucaggaaggaccgcugccggaaauugaggacgaagucuuccgcaagcgaaaucucacaauaauggaccugcaccccgguagcgggaagacuagaagauaccugccagcaaucguuagagaggcuauaaaacggaaacuaagaacccucauacucgccccaacacggguugucgcaucggaaauggcggaggcccucaaagggaugcccauccgcuaccagaccaccgccguuaagucugagcacaccggcaaggaaauagucgaccucaugugucacgccacauucacaaugcgccuacucucccccguccgaguuccaaacuacaacaugauaaucauggacgaggcccacuucacugauccguccagcaucgcagcgcggggcuauauuuccacccggguaggcaugggggaagcagcagcgauauuuaugacggcaacucccccuggaagcguagaggccuucccccaaucuaacgccgucauacaagacgaagaacgcgacaucccggagaggagcuggaacaguggauacgaguggauuacagacuuucccgguaaaacggucugguucguucccaguaucaaauccgggaacgacaucgcaaacugccuucggaagaacggaaagagggucauucagcuaagcaggaaaaccuuugacaccgaauaccagaaaaccaaaaauaacgauugggacuauguggucaccacugacauaagcgaaaugggggcuaauuucagagcugaucgggucauagacccacgccguugccuaaaaccagucauucugaaggauggacccgagcgugugauccucgcaggacccaugcccgucacgguagcauccgcagcccagcgacggggccgaaucgggcggaaccacaacaaagaaggcgaccaguacaucuacaugggacaaccccugaacaacgacgaagaccacgcgcauuggaccgaagcaaagaugcuucucgacaauauaaacacgcccgagggcauaauaccagcucuguucgaacccgagagagagaagucggcggcgauugacggggaauaccgccuaaggggagaagcacggaaaacauuuguagagcuaaugcgcagaggagaucugccaguauggcuaagcuacaaaguagcaucagaaggguuucaauacagcgaccgcagauggugcuucgauggagagaggaacaaccagguccucgaggaaaacauggacgucgaaauauggacaaaggaaggagaaagaaagaaacucaggcccagguggcucgacgccaggacguacagcgaccccuuggccuugcgagaguucaaggaauuugcggcagggcgacgauccgugucaggggaccucauacuagaaaucgguaaacugccgcaacaccuaacacaaagagcucagaacgcucuugauaaccuagucauguuacauaacucggagcaagggggacgcgcguaccgacaugccauggaggaacuccccgacaccaucgagacacugaugcuucuggcacuaaucgcuguccuaacagggggagucacgcuauucuucuugagcggaagaggacucggcaagacgagcauaggccugcugugcguaauggcuucaucggugcuccuuuggauggcgucuguugaaccacauuggauagccgcuucuaucauacuagaguucuucuuaaugguacuuuugauacccgaaccagacagacagagaacuccccaggacaaccagcuagcauacgugguaauagggcuccuuuuuaugauccucaccguggccgcaaacgaaaugggacucuuagaaacaaccaagaaggacuuaggcaucgggcacgucgcagucgagaaucaccaccacgcggcuaugcucgacguagaccuccaccccgcgucagcguggacacuuuacgcaguggcaacgacaaucauaacccccaugaugcgccacacaaucgaaaacaccacggccaauaucucucugacagcaauagcgaaccaagccgcaauacugaugggacuagacaaggguuggcccauuagcaaaauggacauaggugugcccuuacuugcacucgguugcuacagccaaguaaacccucuuacccucacugccgcaguccuaaugcugguagcccacuacgcuauuauugggccgggucuccaggcaaaagcaacgcgugaggcgcagaagaggaccgccgcagguauaaugaaaaaccccaccguggacggcauagucgccauagaucuugaccccgucguguacgacgcaaaguucgagaaacaacucgggcagauaaugcuucucauccuuugcaccagccaaauccuccuaaugcguacaacgugggcacuuugcgaaagcauaacacucgcgacuggaccacugacaacacuaugggagggaucgcccggcaaguuuuggaauacaaccauagcgguauccauggcaaacaucuucagaggauccuacuuggccggcgcaggacucgcauucucacugaugaagucccuaggaggaggacgacgagggacgggcgcacaaggggagacucuaggagaaaaauggaaacgacaacugaaucagcucucgaaaagugaguucaacacguacaaacggaguggcauuauggaaguugaccgcagcgaagcgaaagagggccuaaaaagaggcgaaacgacaaaacaugcaguauccagagggaccgccaaacuacgcugguuuguggaacggaauuuagugaaaccagagggaaaggucauugaccuaggaugcggccgcggaggcuggucguacuacugugcgggacucaagaaggucaccgaaguaaaaggguacacgaagggcggcccaggucacgaagaaccgaucccaauggcaaccuacgguuggaaccugguuaagcuccacagcggcaaggacguguucuucauaccaccagagaaaugugauacacuguuaugcgauaucggagagucaagucccaacccuacgaucgaggaaggccggacacugagaguccucaaaauggucgagccauggcuacgcggcaaucaauucugcauaaagauccuaaauccguacaugccuagcguggucgaaacccuggaacaaaugcagaggaaacacggaggcaugcuagugagaaacccccucucccgaaauuccacacacgagauguacugggucucaugugggacagggaacaucgucucggccguaaauaugaccagccgcaugcucuugaaccgguucacaauggcccaucgaaagcccacuuacgaacgcgacguugaccuggggacagguacacgucacguagccguugagccggaaguagccaaucucgauauaaucgggcaaagaaucgagaacaucaaacacgaacacaagaguaccuggcacuaugacgaggacaacccuuacaagacaugggccuaccaugguaguuacgagguaaagcccagcgggucagcgucgaguaugguaaacggcgugguaaagcuccucacgaagccgugggacgucaucccaauggucacgcaaauugccaugacagacacaaccccuuuuggccaacagagaguguucaaggaaaagguggauaccaggacgccuaaagcgaaacgcggaaccgcacaaaucauggaaguaacagcacgcuggcucuggggcuuucuuaguagaagcaagaaaccacgaaucugcacccgcgaagaguucauacggaaaguacgcaguaacgcagcgaucggcgccguguucguagacgaaaaccaguggaacagcgcgaaagaagcgguagaagacgagagguucugggacuuaguucaccgagaacgagaacugcacaagcaagguaaaugugccacgugcguguacaauaugaugggaaaacgagaaaagaagcuaggcgaguucgggaaagccaaaggaagccgugccauaugguauauguggcucggagcacgcuuccuggaguucgaggcacuuggguuuaugaacgaagaccauugguucagccgagaaaacucacuaucaggcguagaaggggaagggcuacacaagcucgguuacauacuccgagacauaagcaagaucccgggcgggaacauguaugcggacgauaccgcaggaugggacacacgaauuacggaagacgacuuacagaacgaagcgaagauaaccgacauaauggaacccgaacaugcgcuccuagccaaagcaauauucaaacucacauaucaaaacaaggugguacgcguccaaaggccagccaagaacggaacugucauggauguuaucagcagacgagaccagaggggauccgggcaagucggcaccuaugggcugaauacguucacaaauauggaagcacaacugauacgacagauggaguccgaaggaauauucagcccaagcgaacuagagacaccaaaccucgcggagcgcgcgcucgauuggcuagaaaaauauggaguggaaagacugaaaagaauggccauuaguggagacgacugcgucguaaaaccgaucgacgaucgguucgccaccgcucuaacagcgcucaacgauauggggaaagucaggaaggauauaccccaaugggagcccucgaaaggauggaacgacuggcagcaaguaccguucugcucacaccacuuucaucaauugaucaugaaagacggaagggaaaucgucguaccauguaggaaccaggacgagcuagucggcagagcacgcgugucacaaggcgccggauggagucugagggaaacagccugucucgguaaaucauacgcacaaauguggcaacugauguacuuucaccguagagaccuuagacucgcugcgaacgcaauaugcagugcagucccgguagauuggguacccacgaguagaacgacguggucuauacacgcucaccaccaauggaugaccaccgaggacaugcuauccguauggaauagaguauggaucgaggaaaauccauggauggaggauaaaacacacaucagcagcugggaggacgucccauaccuggggaagcgagaagaccaauggugugggucgcucaucggucugacagcacgcgccacaugggcgaccaacauacaaguagcgauaaaccaggucagacgacucaucggcaaugaaaacuaccuagacuauaugacaucgaugaagcguuucaaaaacgaaucggacccugagggugcacuuugguaa

SEQ ID NO: 23821 - RNA, 9879 nt, Artificial Sequence
  derived and/or modified CDS sequence (opt11) from DENV-1__GQ868618__SS-prME
agcgugacuauguuacucaugcugaugcccaccgcgcuggcauuccaccucacaaccaggggcggggaaccacacaugaucgugucuaagcaggagcgaggcaaaagcuugcuguuuaagaccuccgccggggucaauaugugcacacucaucgccauggauuugggcgaguucugcgaggacaccaugaccuacaaguguccccgcaucacugaggcggagcccgacgacguggacugcuggugcaaugccaccgacacgugggugaccuacgggaccugcagccagacaggcgaacaccgccgggacaagcgcuccguugcacuggcgccccacguaggccucgggcuggaaacgcgcaccgagaccuggaugagcucugagggcgcguggaagcagauccagcggguggagaccugggcacugcgccaccccggcuucacggucaucgcccuuuuccucgcgcacgcgauuggcaccagcaucacccagaagggaauuauuuucauacugcucaugcugguuacccccuccauggccaugcgguguguuggcaucgguagccgagacuucguugaggggcuguccggggccacguggguggacgucgugcucgaacacgggagcugcgugacaacgauggcgaaggacaagcccaccuuggacaucgagcuccucaagacggaagucacaaaucccgccguccugcggaagcugugcauagaggccaagauuuccaacaccaccacggacucacgcugcccgacacagggggaagccacauuaguggaagagcaggacgccaauuucgucugcagacggacauucguggacagaggaugggggaacggcugcggucuguucgguaaggggucacuaaucacaugcgcaaaguucaaguguguuaccaagcucgaggguaaaauuguccaguaugagaaccuuaaguacagcgugaucguaaccguccauaccggggaccagcaucagguggguaacgaguccaccgagcauggaaccacggcgacgaucacuccgcaggcgccaucgacagagauccaacugaccgacuacggggcgcucaccuuagauugcagcccccggaccggccucgacuucaacgagaugguccuacuuacgaugaaagaaaaguccuggcugguacauaaacaaugguuccucgaccugccgcugccuuggacgucuggagccucgacuagccaggagaccuggaaucggcaagaucuccugguaacauucaagaccgcccacgcuaagaagcaggaggucgugguacuuggcucccaggagggcgccaugcacaccgcgcuaaccggcgccacggagauccagaccagcggcaccaccacgaucuucgcuggccaucugaagugccgcuugaagauggacaagcugacccugaagggcauguccuacgucaugugcacugggagcuucaaacuggaaaaagagguugcggaaacccagcacggcacggugcucguccagauuaaguacgaaggcaccgacgcucccugcaagaucccguucuccacccaggacgagaaagguguaacccagaacggucgacugauuacggcgaacccgaucgugaccgauaaggagaagcccgucaacaucgaggccgagccgcccuucggggagagcuacaucgugaucggcgcgggcgagaaagcccugaagcuguccugguucaagaaggggagcuccaucgggaagauguucgaggcaaccgcccgcggggcccgcaggauggcgauacucggcgacacugccugggacuuugggucaaucggcggcguguucacguccguugggaagcuggugcaccaaaucuucggcaccgcuuauggggugcuauucagcggcgucuccuggaccaugaagauuggcauuggggugcucuugaccuggcucggccucaacagccgcuccacgagccucuccaugaccugcaucgccguggggcucgucacccucuaccugggcgucaugguccaggccgacucagggugcgucaucaacuggaagggccgggagcugaagugcgggagcggaaucuucgugaccaacgaagugcacacguggaccgaacaguacaaguuccaggcggauuccccgaagcgccucagcgccgcaaucggcaaggccugggaggagggggucugcggcauccgauccgccacccgccuggagaacaucauguggaagcaaauaagcaaugagcugaaccacauacuccucgagaacgauaugaaguucaccguggugguuggugacguggcgggcauccuggcccaggggaagaagaugauccggccgcagcccauggaguacaaauacuccuggaagaguugggggaaggccaagaucaucggcgcagacgugcagaacacgacguucaucaucgauggccccaacacaccggagugccccgacgaccagcgcgcguggaacaucugggagguggaggacuacggcuucgggauauucacaaccaacaucuggcucaaguuacgugacucuuacacccaggugugcgaucaccgccugaugagcgccgcaauuaaggacucgaaggccgugcacgcggacaugggcuacuggaucgagagcgaaaaaaacgagacguggaaacucgcgcgggccuccuucaucgaggucaagaccugcaucuggccaaaaagccacacccugugguccaacggcgugcuggaaucagagaugaucaucccaaagauuuacgggggcccuaucucccagcacaacuaccgcccuggguacuucacgcagacagccgggccguggcaccucgggaagcuggagcuggauuucgaucugugcgagggcaccaccgugguagucgacgagcacugcggcaaccgggggccgagccuccggacaaccacugucacugguaaaaucauucacgagugguguugccgauccugcacgcugccgccccugcgcuucaagggggaggacggcugcugguacgggauggaaauccgacccguuaaggagaaggaagagaaccuggucaagagcauggucagugccgguagcggagaggucgacagcuucucccucggccuccugugcaucagcaucaugaucgaagaggugaugcgcucccgguggagccgaaagaugcuuaugacggggacgcucgccguguucuuucugcugaucauggggcaacucaccuggaacgaccugauccggcucugcaucaugguaggugcgaacgccuccgaccgcaugggcaugggcacgacguaccucgcccugauggcaaccuucaagaugcgcccgauguucgccgugggccuccuguucaggcggcugaccucucgagagguccuacuccugacgaucgggcucucccucgucgcgagcguggagcugcccaauucccuggaggaguuaggugacgggcuggccaugggcaucaugauccugaagcugcugaccgacuuccaaagccaccaacuaugggccacccuccugucccugacguucauaaagacgaccuucucacuucacuacgccuggaaaaccauggcgaugguccugaguauagugagccuguuuccccucugccuguccaccacgagccagaagaccaccugguuaccagugcuccuaggaucccuggggugcaagccgcucaccauguucuuaaucgccgagaacaagaucuggggccgcaagagcuggccacugaaugaagggaucauggccguuggcaucgugaguauccuccuguccucacugcucaagaacgaugucccguuggccggcccccuaaucgcuggcggcaugcucaucgccugcuacguaaucuccgggagcuccgccgaccugagccuggagaaagccgccgagguguccugggaggaggaggccgagcauagcggcgcgagccacaacauccuaguggaggugcaggaugaugggacgaugaagauaaaggacgaagagcgggacgacacacugacgauacuccucaaggcuaccuuacuagcgguaagcggcguguacccgcucucaauccccgccacucuguuugucugguacuuuuggcagaaaaagaagcagcguagcggggugcugugggauacgcccagcccacccgaaguagagagagccgucuuggacgacggcaucuaccgcauaaugcagcguggacugcuggggcggagccaggugggcgugggagucuuccaggagaacguauuccacacgauguggcacgucacccggggcgcuguccugauguaccaagggaaacgucucgagcccuccugggcuagcguuaagaaggaccugaucuccuacggcgguggguggcggcugcagggcuccuggaacaccggggaggaagugcaggucauagcaguggagcccggcaaaaaccccaagaaugugcagacggccccagggaccuucaagaccuccgaaggcgaggucggcgccauugcgcucgauuucaagcccgggaccucaggaagccccauugucaaccgcgaggguaagaucgugggccuguacggaaacggugucgucacgaccuccggcaccuauguaagcgccauagcccaggccaaggcgucccaggaggguccccugccggagaucgaggacgaggucuuccggaagcggaaccucaccaucauggaccuacaccccggcucggguaagacgcgacgcuaccuacccgccaucgugcgggaggccauaaagcgcaagcuccguacccugauucuggccccuacucgcgucgucgccucggaaauggcggaggcccucaagggcaugcccauccgguaccaaacuaccgcgguaaagagcgagcacaccggcaaagagaucguggaccugaugugccacgccacguucaccaugcggcuccucagccccguucgcgugcccaacuacaacaugaucaucauggaugaggcccacuuuacggacccgagcuccaucgcggcccggggguacaucucaacucgagugggaaugggggaggccgccgcgaucuuuaugacugcgacuccgcccgggaguguagaggcguucccucaaagcaacgccgucauccaggacgaagagcgggacauaccagaacgcucguggaacagcggguacgaguggaucacggacuuccccggaaagaccgugugguucguccccuccaucaagagcggcaacgacaucgccaacugucugcgaaagaacgguaagcgcgugauccagcugucccgaaaaacauucgacaccgaguaccagaagacgaagaacaacgauugggauuacguugucaccacagauaucucggagaugggugcgaacuucagagccgacagggugaucgaccccaggcggugccuaaagccgguaauccuaaaagauggccccgaacgcgucauccuggccggccccaugccagugaccguagcauccgcggcacagcggcgcgggcggaucggccgcaaccacaacaaggagggcgaccaauacauauacaugggucagccccucaauaacgacgaggaccacgcacacuggacggaggcaaaaaugcugcuggacaacaucaauacucccgagggcaucauccccgcacucuucgagcccgagcgggagaaguccgccgcgaucgacggggaauaccgccugcgcggcgaggcccggaagaccuucguagagcugaugcggcgcggggaccucccgguguggcugagcuauaaggucgcgucugagggcuuccaguauagcgaccggcgguggugcuucgacggcgagcgcaacaaccagguucuggaggagaacauggauguggaaauuuggaccaaggagggugagcgcaagaagcugagaccccgcugguuggaugcccgcacauacagugacccccuggccuuacgggaauucaaggaguuugccgcuggccgccggagugucuccggggaccugauccuggagaucggaaagcugccccagcaccugacccagcgcgcccagaacgcccuggacaaccucgugauguuacacaacagcgagcagggagggcgggcauaccgccacgcaauggaggagcugccggauaccaucgagacccucaugcugcuagcacucaucgccgugcugacggguggggucacccuuuucuuccucuccggccggggacugggcaaaaccaguaucggcuuacucugcgugauggccuccagcgugcugcuuuggauggcguccguggagccccacuggaucgccgccagcauuaucuuggaguucuuccugauggugcugcucauccccgagccggauaggcaacguaccccccaggacaaccagcuggccuacgugguaaucgggcuccucuucaugauacugaccguggccgcgaacgagaugggccuucucgaaacgaccaagaaagaucucgggauuggccacgucgccgucgagaaccaccaccacgccgccaugcuggauguggaccuccaucccgccucagcguggacccuauacgcuguggccaccacgauaaucacccccaugaugcgccauacuaucgagaacaccacggccaauaucagccugacugccaucgcgaaccaggccgccauccucaugggguuggacaagggcuggccgaucuccaagauggacauaggcgucccccuacucgcucuggggugcuacagccaggugaacccucugacacuuaccgccgcgguccuaaugcugguggcccacuacgcuauuauaggccccggccuccaggcaaaagcuacuagggaggcccagaagcggaccgccgccggcaucaugaagaacccgaccguggacggcauagucgccaucgaucuugaucccgucgucuacgaugcgaaguucgagaagcaguuaggacaaauuauguuacugauccugugcaccucccaaauacucuuaaugcgcacuacaugggcacuaugcgagaguaucaccuuagccaccggcccccugacgacccugugggaagggagucccggcaaguucuggaacacgaccaucgccgugagcauggccaacaucuuccgggggagcuaucucgcgggcgccgggcuggccuuuucccugaugaagucccucgggggcgggcgccggggaacgggggcccagggcgagacucuuggagagaaguggaaacgccagcugaaucaacuauccaagagcgaguucaauacuuauaagcguuccgggaucauggagguagaccguagcgaagcaaaggagggacugaagcgcggggagaccacuaagcacgcagugucccgcggcacugccaagcugagaugguucguggaacgcaaccucguaaagccugaaggaaaggugaucgaccugggaugcggccgcggcggguggagcuauuacugcgccggucuaaagaaggugacagaaguaaaggguuacaccaagggcggccccggccacgaggagcccauccccauggccacguacggguggaaccuggugaagcuccacuccgggaaggauguguucuucaucccgccagagaagugcgacacacuguuaugugacaucggggagagcucccccaaucccaccaucgaagagggccggacgcuacggguccugaagaugguggagccguggcuccgcgggaaccaauucugcaucaagauccuaaaucccuacaugcccagcguggucgagacgcuggagcagaugcagcggaaacacggggggaugcuugugcgcaauccccucagccggaacagcacccacgagauguacugggugucgugcggcacaggaaacaucgucagcgcggugaacaugacaucuagaaugcuccugaaucguuucaccauggcccaccgcaagccgaccuacgaacgcgacgucgaccucggggccggcacccggcacguggccguggagcccgagguggccaaccuagacaucaucggucagcgcauugagaacaucaagcacgaacacaagucgaccuggcacuacgaugaggacaaucccuacaagaccugggcguaccacggguccuacgaaguaaaacccagcggcagcgcgucgagcaugguuaacggggucguaaagcuguugacgaaaccaugggacguaaucccuauggucacccagaucgcuaugaccgacaccacccccuuuggccagcagcggguguucaaggagaagguggacacacgcacccccaaggccaaacgggggaccgcccagaucauggaaguuacagccaaguggcuguggggcuuccuauccagaaacaagaagccgcggauaugcacgcgcgaggaguucacccggaaggugcgcucaaacgccgccaucggggccgucuuugucgacgagaaucaguggaacuccgcgaaggaggcggucgaggacgagcgauucugggaccucguacaccgcgaacgggaacugcacaagcagggaaagugcgcgaccugcgucuacaauaugaugggcaagcgugagaaaaaguugggggaguucggcaaggccaaggggagcagagccaucugguacauguggcugggcgcgcgcuuuuuagaguucgaggcccugggcuucaugaacgaggaccacugguucagucgggagaacagccucuccgggguagagggugaggggcugcacaaguugggcuacauccugcgcgacaucagcaagauacccggaggcaauauguacgccgaugacacggccggcugggacacccggaucaccgaggacgaccugcaaaacgaagccaaaauuaccgauauuauggagcccgagcacgcgcugcucgccaaauccauuuucaagcugacguaccagaacaaggucguccgcguacagagaccggccaagaacgggaccgugauggacguuaucagccgcagagaccagagaggguccggccaggugggcaccuacggcuuaaacaccuucacgaacauggaggcccaacucauccgccagauggagagcgaagggauauuuucccccucggaguuggagaccccgaaccuugcagaacggguccucgacuggcuggagaaacacggugucgagcgccugaagaggauggcgaucuccggcgacgauugcgugguaaagcccaucgaugaucgcuucgcgacggcccucaccgcccuaaacgacauggguaaaguccgaaaagacaucccucagugggagccgucgaagggguggaaugauuggcagcagguccccuuuugcagccaccacuuccaccagcugaucaugaaggacggucgugaaaucgugguccccugccggaaccaggacgagcucgugggccgcgcacgggugucccaaggggcagguuggagccugagggaaacggccugucuggggaaguccuacgcccagauguggcagcucauguacuuccaucggcgcgaccugcgucuugccgcgaacgcgaucuguagcgccgucccgguggacuggguccccacaucccguaccaccuggagcauacacgcccaccaccaguggaugacgaccgaggacaugcuguccgucuggaacaggguguggauugaggagaaccccuggauggaggacaagacacacaucucuuccuggggcgauguacccuaccuggggaaacgcgaagaccaguggugcggcucccugaucggucucacggcccgggcgacuugggcgacaaacauccaggucgccaucaaccaggugcgccgccucaucgggaacgaaaacuaccuggacuacaugaccuccaugaagcgguucaagaacgagagcgauccggagggggcccuaugguga

SEQ ID NO: 23822 - RNA, 9879 nt, Artificial Sequence
  derived and/or modified CDS sequence (opt11) from DENV-1__GQ868619__SS-prME
uccgugaccaugcuguuaaugcugaugccgacggccuuagcuuuucaccucaccacucggggcggggagccucacaugaucgugucuaaacaggagcggggcaagagcuuauuguucaagaccagugcaggggugaacaugugcacccucaucgcgauggaucugggugagcugugcgaggauacgaugacauacaaaugcccucgcaucaccgaagcagagcccgacgacguggacugcuggugcaacgccacggauacguggguuacuuacgggaccugcucucaaaccggcgagcaccgccgagauaagcggucaguggcauuagcaccccacgugggccuggggcuugaaacgcgcaccgagaccuggaugagcucugaaggugccuggaaacagauccagcgggucgagaccugggcccuuagacaccccgguuucaccgugaucgcccuguuccuggcucacgccaucggcaccagcaucacccagaaggggaucaucuucaucuuacuaaugcuggugacccccaguauggcgaugcgcugcgucggcauuggcagccgcgacuucguggaggggcugucuggcgccacguggguggacguuguacuggaacacgggagcugcgugaccacaauggccaaagauaagcccacacuggauauugagcuccugaagacagaggugacaaaccccgcgguacugcggaaacucugcaucgaagcaaaaauuucgaacacaaccacugacagccguugcccgacccagggcgaggccacccuaguggaagaacaggacgccaacuucguuugccgucggaccuucguggaccgcggcugggggaauggcugcgggcucuuuggcaagggcagccucauaacgugcgccaaguucaagugcgucacuaagcuggagggcaagaucguacaguacgagaaccuuaaauacagcgugaucgugaccguccacaccggugaccaacaccaaguaggaaaugagucaacugagcauggcaccacggcgaccaucacuccucaggcccccacgacagagauucagcucaccgacuacggggcccugacauuggauugcagcccgcgcacuggcuuagacuucaacgagaugguccugcugaccaugaaggagaaauccuggcucguacacaagcagugguucuuagaccuaccccucccguggacguccggggcaagcacuucacaggagacguggaaucgacaagacuuacuggugaccuucaaaacugcccacgcgaaaaagcaagaagucguagugcucggcucucaagagggcgcgaugcacaccgcacuuacgggcgcgacugagauccagacgucuggaacuacgaccaucuucgcaggacaucugaagugucgccucaagauggacaagcugacccugaagggcaugagcuacgucaugugcacaggcagcuuuaagcucgaaaaggagguggcggagacgcagcacggcacggugcugguacagaucaaguacgagggcaccgacgcacccugcaaaauccccuucaguacccaagacgagaagggggugacgcagaacggccgguuaaucaccgcuaacccaauugugaccgacaaggagaaaccugucaacaucgaagccgagccacccuuuggggaguccuauauaguaauaggggcgggcgagaaagcccuuaaacucagcugguucaagaagggguccaguaucggcaagauguucgaggccaccgcacgcggcgcccgcaggauggcaaucuugggagacacugccugggacuuugggucgaucgguggcguguuuaccagcgucgggaaguuggugcaucaaaucuucgggaccgccuacgggguacuauuuuccggcgugagcuggaccaugaaaauagggauuggcguacuguugacaugguugggauugaacucacgcagcaccucucugagcaugacgugcauugccguugggcucgucacccuuuauuugggcguaaugguacaggcggacuccgggugcgucauuaacuggaaggggcgggagcucaagugcgggagcggcaucuucgugacgaacgaggugcacaccuggaccgaacaguacaaguuccaagccgacucaccaaagagauuauccgccgccauuggcaaggcuugggaggagggggucugcggcauccggagcgccacccgccuggagaacaucauguggaagcaaauuuccaaugaacucaaccacauccugcuggagaacgacaugaagcuaacaguuguggucggugacguugcggguauccuggcccaggggaagaaaaugauccguccccagcccauggaguacaaguauucuuggaaauccuggggcaaggccaagaucaucggcgccgacgcccagaacaccaccuuuauuauugaugggcccaacaccccagagugcccagacgaccagagggccuggaacauaugggagguggaagacuauggguucgggauauucacgacuaacauuuggcucaagcuaagagacagcuacacccaggucugcgaucaucgccugauguccgccgccaucaaggacagcaaggccgugcacgccgauauggguuauuggaucgaguccgagaaaaacgagaccuggaagcuggcccgggccagcuucaucgaggugaagacuugcaucuggcccaaaucgcacacacuauggucuaacgggguccuggagucugagaugaucauuccaaaaaucuacgggggccccaucucacagcauaacuaccgccccggcuacuuuacccaaaccgccgggccuuggcaucugggcaaguuggagcuggacuucgauuugugcgagggaaccacggugguagucgacgaacacuguggcaaccgcgggccgucccucaggaccaccaccgugacggguaagaucauccacgaguggugcugccggagcugcaccuuaccuccacugagguucagaggggaagacggcugcugguacgggauggagauucggcccgugaaggagaaagaagaaaaccucgucaaguccauggucagcgccggcagcggcgaggucgacuccuucagccucgggcugcucugcaucuccauuaugaucgaagaggugaugcggagccgcuggagucggaagaugcugaugaccggaacccuugugguguucuuccugcuaauuauggggcagcugacuuggaacgaccucauccggcugugcaucauggucggcgcgaacgccagcgaccgcaugggcaugggaacgacuuaucuggcccucauggccacguucaagaugcggcccauguuugccguuggucuccuguuccgccgauuaacgucccgugaggugcuguuacucaccaucgggcuuagccuggucgcgucgguagaauuaccgaauagucuggaggagcuuggugacgggcucgccaugggcaucaugauucugaagcugcucaccgacuuccagucccaccagcugugggcaacacuucucucacugacguuuaucaagacgaccuuuucgcugcacuacgccuggaagaccauggcaaugguccucagcaucgugucccuguucccguuaugccucagcacgaccagccagaaaacaaccugguugcccgugcuauugggcagcuuaggauguaagccucuaacaauguuccucaucgccgagaacaagaucuggggccggaaguccuggccccugaacgaagggauuauggccgugggaaucgucagcauucuucucucgagucugcuuaagaacgacgugccgcucgcggggccauuaaucgccggcggcaugcugaucgcguguuaugucaucagcgggucguccgcagaccucucccuugagaaggccgccgagguuagcugggaggaagaggccgaacacuccggggccucgcauaacauccucguggaaguacaggacgacgguaccaugaagaucaaggacgaggagcgcgacgacacuuuaacaauacugcugaaggcuacgcuccuagcuguauccgggguguacccgcugucuaucccggcuacccucuucgucugguacuucuggcagaagaagaaacagcgauccggcgugcugugggacacgcccagcccgccagagguagagcgcgcaguccuggacgacggcauuuaccggauaaugcagcgcggccugcucgggcgcucgcaaguggguguggggguauuucaagagaacguguuccacaccauguggcacgugacccgcggcgccguccuuauguaccaggggaagcggcuggagcccucaugggccucuguuaagaaagaccucauaagcuacgguggcgguuggcgccugcagggcaguuggaacacgggggaggagguacaagucaucgccguggagcccggcaagaacccgaaaaacgugcagacggcacccggcaccuuuaaaaccccugagggcgaggugggcgccaucgcacuugauuuuaagcccgggacaucgggcuccccgauagugaacagagagggcaagaucgugggccucuaugggaacggaguagugacaacuagcgggacauacgucagcgccaucgcccaggcgaaggcgucccaggaagggccccugccggagaucgaggacgagguguuccgcaagcgaaaccugacgauuauggaucuccaccccggcuccgggaagacgaggagguaccuuccggccauagugcgcgaggcgaucaagcggaaguuacguacccucauccuugcgcccacacgcgugguugcuagcgagauggcggaagcccugaaggguaugcccauccgguaccaaacuaccgccguuaagagcgagcacacgggaaaggagaucguggacuugaugugccaugcuaccuucacgaugcgccucuuaucccccgugagagugccgaacuacaauaugaucauuauggacgaggcccauuucacggacccaagcagcaucgcggcccgcggguacauaagcacacgggugggcaugggggaggcagccgccaucuucaugaccgcuacgccucccgggaguauggaggccuucccucagagcaacgcggucauucaggacgaggagcgcgacauuccggagcgguccuggaacucgggguacgaguggauaaccgacuucccuggcaaaaccguaugguucguucccucuaucaagagcggcaacgacaucgccaacugccuccgaaagaacggcaagcggguaauccaacugucccgcaagacguucgacacagaguaucagaagaccaagaacaacgacugggacuacguagugacgaccgauauauccgagaugggugcgaacuuccgggcugacagggugaucgauccgcggcgaugcuuaaagccgaucauucucaaggacgggcccgagcggguaauccuagccgguccgaugccggucacggucgcguccgccgcgcagcgccgggggcguauaggccggaaccacaacaaggagggcgaccaguacaucuacaugggucagccguuaaacaacgaugaggaccacgcccacuggaccgaggccaagaugcuauuagacaauaucaacaccccugagggcaucauccccgcccucuuugagccggagcgcgaaaagucugcugcgauugacggugaguaucgccuccggggcgaggcccgcaagacguucguggagcuuaugcggcgcggagacuugccggucuggcucucauauaagguugccagcgagggguuccaguacucugaccggcgcugguguuuugacggggagcguaacaaccagguucuggaagagaacauggacguugagaucuggacgaaggaaggggagaggaagaaacugcggccccgcuggcucgacgcgaggaccuacucugauccccuggcacugagggaguucaaggaguucgcagccggccggcgcagcgugucaggagaucucauccuagagauaggcaagcugccgcagcaucuaacgcagagggcccagaacgcucuggauaacuuagugaugcuccacaacagcgaacagggcggccgcgcguaccgccacgccauggaggagcugccggacacgauugagacgcuuaugcuucuggcccugaucgccguccucaccggcggggugaugcuguucuuucuauccggacgcggacucggcaagaccaguaucgguuuguuaugugugauggccaguagcgggcugcuuuggauggcgagcgucgagccccacuggaucgccgccucaauuauccuggaguucuuuuuaaugguacugcugauccccgagccggaccggcagcggaccccacaggauaaccaguuggccuacgucguuauggggcuguuguucaugauacugacaguggccgcgaacgagauggggcugcuagagacgaccaaaaaggacuuaggcaucgggcauguggccguggagaaccaucaccacgccgccauguuagauguggaccuacaccccgcuuccgcguggacacucuacgccguggccacgacaaucaucacaccgaugaugcggcacaccaucgagaacaccaccgccaacaucagccugaccgccaucgcuaaucaagcggcgauucugaugggccuggacaagggcuggcccaucucaaagauggacaucggagucccccugcuggcgcucgggugcuacucacaagugaaccccuuaaccuuaacagcggcaguacucaugcuggucgcacacuacgccauaaucgggccgggccugcaggcaaaggcgacgagggaggcccagaagcgcacggccgcugggauuaugaagaauccgacugucgacggcauugucgccaucgacuuggaccccgucguguacgacgcaaaguucgagaagcagcugggccagaucaugcugcucauccugugcacuagccagauccuucucaugagaacgacuugggcccuaugcgagucaaucacgcuggcgacugggccccuuacgacucugugggagggcucgccgggaaaauucuggaacaccaccaucgccgugagcauggccaacauauuccgcggcagcuaccuggcgggcgccgggcucgcauucagccucaugaaguccuuaggcggcggccggcgugggacgggcgcacagggcgaaacccucggggaaaaguggaagcggcagcugaaccaacugucgaagucggaguucaauaccuauaaacgcucaggcauuauggaggucgaccggagcgaggcgaaagaggggcuaaagagaggcgagaccacgaagcacgcggugucgcggggcacugcaaaacugcggugguuuguagagcggaacuuggucaagcccgaagggaaagugauagaccugggaugcgggcgcggcggguggagcuacuacugcgccgggcucaagaaagugaccgaaguaaaaggguauacgaaagguggcccagggcacgaggagcccaucccuauggcuacuuacggcuggaauuuggugaaguugcacaguggcaaggacgucuucuuuauacccccggagaagugcgacacacuccuuugcgacaucggagagagcuccccaaacccgaccaucgaggaagggagaaccuuacguguccucaagaugguggaaccuuggcugcggggcaaccaauuuugcaucaaaauccugaacccauacaugcccagcgugguggaaacucucgagcaaaugcagcgcaagcacggcggaaugcuggugcggaacccccugucgcgcaacucgacucacgagauguacugggugaguugcgggacggggaauaucgucucagcagugaacaugaccucgcguaugcugcuaaaccgcuucacgauggcucaccgcaaacccacuuacgaacgugacguggaccuggggacgggcacccgccacgucgccguggagcccgaggucgccaaccuagacaucauugggcagcggaucgaaaacauuaagcaugagcauaaaagcaccuggcacuaugacgaagacaacccauauaagacuugggccuaccacggaaguuaugagguuaagccguccgggucagcguccagcauggugaacggcgugguaaagcugcugacuaagccgugggacgugauccccauggucacucagaucgcaaugaccgacaccacccccuuugggcagcagcgcguguucaaagaaaagguugacacccggacgccgaaagcuaagcgaggcacugcucagaucauggaaguaaccgcucgguggcuuuggggauuccucagccgcaacaagaagccccggauauguacccgggaggaguucacccgcaaggugcgcagcaaugcagcuauaggggccgucuuuguagacgaaaaccaguggaacagcgccaaggaggcgguagaggacgaaagauucugggaccuuguacaccgcgaacgugagcuccacaaacagggcaagugugcuacaugcgucuacaacaugauggggaagcgagagaaaaagcugggcgaguuugggaaagcaaagggcagccgggcgaucugguacauguggcuuggcgcccgcuuucucgaauuugaggcgcuaggguuuaugaacgaggaccacugguuuucccgcgagaacucgcugaguggcguggagggggaggggcuccacaagcugggcuacauccugcgugacaucagcaaaauccccggcggcaacauguaugcugaugacacggcggggugggacacacggaucacagaggacgaccuccagaacgaggcaaagaucacagacaucauggagccggagcaugcccuacuugcgaaggccaucuucaaacucaccuaccagaauaaggugguccgagugcagcgcccagccaaaaacggcaccguuauggaugucauuucccgccgcgaccaacgggguaguggccaggugggcacguacgggcugaacaccuuuaccaauauggaggcgcagcugauacgccaaauggaguccgagggcauuuucagcccgagcgagcuggagaccccaaacuuggcggagcgggcgcuagacugguuagaaaaguacggaguggagcgucugaagcgcauggccaucaguggcgaugacuguguagugaagccuauagaugaccgcuuugccaccgccuuaaccgcacucaacgacaugggaaagguacggaaggacauaccccaaugggagcccuccaaagguuggaacgacuggcagcagguucccuucugcucccaucacuuucaucagcugauaaugaaggauggccgcgaaaucguaguaccguguaggaaccaggacgagcuggucggacgcgcgcgagugucccaaggcgccggguggagccuccgggaaaccgccugccugggcaagagcuaugcccaaauguggcagcucauguacuuccaucggcgcgaucucagacuugccgcaaacgccaucuguuccgcugugcccgucgauuggguccccacaagccgcaccacguggucaauacacgcucaccaccaguggaugaccacggaggacaugcugagcguguggaaccggguguggaucgaggagaaccccuggauggaggauaagacccacaucuccuccugggaggaugugccguaccucgggaagcgcgaggaccagugguguggcucgcugaucggccugacggcucgggcuacuugggccacuaacauucagguggccaucaaccagguccggcgccuaaucgggaacgagaacuaccuggauuacaugaccucgaugaaaagguucaaaaacgaauccgacccugagggugcccugugguga

SEQ ID NO: 23823 - RNA, 9879 nt, Artificial Sequence
  derived and/or modified CDS sequence (opt11) from DENV-1__FJ639678__SS-prME
agcgugaccauguuacucaugcugaugcccaccgcuuuagccuuccacuugaccacccggggcggagaaccgcacaugauaguuagcaagcaagaacggggcaaggcgcuucuguucaagacgucggcgggagugaacaugugcacacucaucgcaauggaccugggggaguuaugcgaggacaccaugacuuacaagugcccgcguaucacagagguggagcccgacgacgucgauugcugguguaacgccaccgauacguggguaaccuacgggaccugcccacagaccggggagcaccgaagagaccggcgcucaguggcccucgcgccccaugucggccugggccuagagacacgggcagagacguggaugucgucugagggggccuggaagcagauucaacgcguggagaccugggcucucaggcaucccggguucaccguaaucgcacuguuccuggcccacgccaucgguaccagcaucacucagaaaggcaucaucuucauacuuuuaauguuggucacaccguccauggcaaugcgcugcgucggcaucgguaaccgggauuucguggagggguuaagcggcgccaccuggguagacgugguucuggagcacggauccugcgucacgaccauggcgaaggauaagcccacccuggacaucgaacuccugaaaaccgaggugacaaacccggcagugcugcgcaaguuguguauugaggccaaaaucaguaacaccaccaccgauucucggugccccacgcagggggaggccacgcuggucgaagaacaagacgcuaauuucguaugccgacggaccuuuguggacaggggcugggguaauggcugcgggcuguucggcaaggggucccucauuacgugcgcgaaguucaaaugugucacaaagcuggaggggaagauagugcaguacgagaauuuaaaauacuccgugauugucaccgugcacaccggcgaccagcaccaggucgggaacgaaaguacagagcacggcacgaccgccacgaucacaccccaggcccccaccuccgagauucagcuaacugauuacggggcgcucacacuugauugcagcccgcggaccggccuggacuucaaugagauggugcugcuuaccaugaaggaaaaguccuggcuugugcacaagcagugguucuuagaccucccccucccauggacgagcggcgccaguaccagccaggaaacauggaaccgccaggaccuccuugugaccuucaagacugcacacgcaaaaaaacaagaggucgucguacucgggagucaggagggcgcaaugcauaccgcgcuuaccggggccaccgagauacagacuucggguacgaccaccaucuucgcgggacaccuaaagugccggcuuaagauggacaagcugacgcugaagggcaugagcuacgugaugugcaccggauccuucaaacucgaaaaagaaguggccgagacucagcacggcacuguccuggugcaaauaaaguaugagggcacggaugccccuugcaagauuccguuuucaacccaggacgagaagggggugacccagaacggcagacucaucacagccaaucccauugucacagacaaggagaaacccguuaauaucgaggcagagcccccguucggggaauccuacaucgugaucggggccggggaaaaggcacugaagcucaguugguucaagaaagguuccagcaucggcaaaauguucgaggcuacagcccgcggugcccgccggauggcaauccugggcgauaccgcuugggacuucggguccaucgggggcgucuuuaccucagucgggaaguuggugcaccagauuuucggcacggccuauggggugcuauuuagcggugucucguggaccaugaagaucggaaucggugugcuguuaaccugguuaggccugaacagucggagcaccucccugagcaugacgugcauagccguuggccucgugacucuguaccugggugugaugguacaggcggacuccggaugcguaaucaacuggaaaggcagagagcucaagugcgggucgggcaucuucgucaccaacgaaguacauaccuggacugagcaguacaaguuccaagccgacucccccaaacggcugagcgccgccauuggcaaggcuugggaagaaggggugugcggcauccguucugcgacccggcuggagaacaucauguggaagcagaucuccaacgagcucaaccacauccuucuagaaaacgacaugaaguucaccguggucguaggugacgugguaggcauccucgcccaggggaagaagaugauuaggccccaaccaauggaauauaaguauagcuggaaguccuggggcaaggcuaagaucauaggcgcugauauucagaacacgaccuuuauuaucgacgggcccaacacgcccgaguguccggaugaccagcgggcguggaacaucugggaaguggaagacuacggcuucgguaucuuuaccaccaacauuuggcugaagcugcgugacucuuacacgcaggugugcgaccaccgccuuauguccgccgcaaucaaggacagcaaagccguccacgcagacaugggguacuggaucgaaagugagaaaaacgagacuuggaaacuggcgcgcgccucguucaucgagguaaaaacaugcaucuggccuaagucccacacacuauggagcaacggaguguuagaguccgagaugaucaucccaaagauauacggaggcccaaucucccagcacaacuaucgacccggguacuucacccaaacagccgguccguggcaccuagggaagcuugagcuugauuuugaccucugcgagggcacaaccguuguggucgacgagcacugcggcaaccgcggucccucauuacggaccaccacgguuacaggcaagaucauccacgaguggugcugccgcagcuguacucuaccgccccuccgguuuaagggggaggacggcuguugguaugguauggagaucagaccgguaaaggagaaggaggagaaucuggugaagagcaugguaucggccggcuccggcgagguggauuccuucucuuuaggccugcuguguaucaguaucaugaucgaggaaguaaugcggagucgcuggucccggaagaugcucaugacgggcacccuggccgucuucuuccugcucauuauggggcagcugaccuggaacgaucugaucagacucugcaucauggugggcgccaacgcaagcgaccgcaugggaaugggcaccacauaccuggccuugauggccacauucaagaugcggccuauguucgccgugggcuuacuguuuagacggcugaccucccgggagguccuccuccugaccauugggcucagccugguggcgucgguagagcugccgaacagcuuggaggagcugggcgacgggcuggccaugggcauaaugauccucaaguugcuaacggacuuccaaucgcaccagcuaugggccacucuguuaagccucacuuucauaaagacuacauucagccugcacuacgccuggaagaccauggccauggugcugucaaucguaucucuccugcccuuaugccucucgacgacaucccagaagacuacauggcuuccgguccuguuaggcagccuggggugcaagccccugaccauguuccugaucgcggagaacaagaucuggggacguaaguccuggccccugaacgaggggauuauggccgucgguauugugagcauacuccucucaagccuuuuaaagaaugaugucccccuggcaggcccgcugaucgccggcggcaugcugaucgcgugcuaugucaucagcggaagcucugcagacuuaucccuggagaaggccgcagaggugucaugggaggaggaagccgagcacuccggcgcgagucauaacauccugguggaagugcaggacgaugggaccaugaaaaucaaggacgaagagcgugacgacacguuaacuaucuugcuuaaggcuacacuccuggcgguguccggcgucuacccucugagcauccccgccacucucuuccugugguacuucuggcagaagaagaagcaacggucagguguguugugggacaccccgagcccgccagagguugagcgcgccguccuggacgacggcaucuaccggauuaugcagcgcggauuacuggggcggucgcaggugggcguuggggucuuccaggaaaacguguuucacacgauguggcaugugacccgaggagcuguccugauguaccaggggaagaggcucgaacccagcugggccuccgugaagaaggaccugaucucguacggcggcgguuggcgccugcaggguuccuggaacaccggugaggaggugcaggucaucgcaguugaacccgggaagaacccgaagaacgugcagaccgccccugggaccuucaaaaccccggaaggcgaagugggugccauugcgcucgacuucaagcccggaacuuccggcuccccgauaguaaaccgggaagggaaaaucgugggccuguacgguaacgggguggugaccacgagcgggaccuacguauccgcaaucgcccaggccaaagcuucucaggaggggcccuugccggagaucgaggacgaagucuuuaggaaacgcaaccucacgauaauggaccugcacccgggcagcggcaaaaccaggcgcuaccugccugccaucguacgcgaagcuaucaagcggaaauuacgcacgcugauccuggcgcccaccaggguggucgccuccgagauggcagaggcgcucaaagguaugcccauccgguaccaaaccaccgccguaaagucggagcacacggggaaggaaaucguagaccugaugugccacgccaccuucaccaugcgccugcucucuccgguccggguccccaacuacaacaugauaaucauggacgaggcucacuuuaccgaucccagcagcauugcggcccgcggauacauuucgacgcgagugggcaugggggaggcagccgccaucuucaugaccgcgaccccgccaggcucgguugaagccuuuccccagucuaaugcagucauccaggacgaggagcgagacauccccgagcgguccuggaauucgggguacgaauggaucacagacuucccgggaaagacggugugguucguccccuccaucaagagcggcaacgacaucgcgaacugccuacgcaagaacgggaagcggguuauacagcugucccgcaagaccuucgacaccgaguaucagaaaaccaagaauaacgacugggacuacguggucacuaccgacaucucugagaugggcgccaacuuucgggcagaccgugugauagacccccggcguugccugaagccgguuaucuuaaaggacggacaggagagggucauccuggccggucccaugccggugacggucgcuuccgccgcgcagcgccgggggcgcaucgguagaaaccacaauaaagaaggcgaccaguacaucuacauggggcagccccuaaauaacgacgaggaucaugcccacuggaccgaggccaaaaugcugcuggauaacaucaacacgcccgagggaaucaucccugcgcucuucgagccggaacgcgagaaguccgccgcgauagauggggaguaccgacugcgaggugaggcacgcaagaccuucguagagcugaugcggcgaggggaccuccccguuuggcugagcuacaaggucgccagcgaaggcuuucaguacuccgaucggcguuggugcuuugacggcgagagaaacaaucaaguacuggaagagaacauggaugucgagaucuggaccaaggagggugagaggaagaagcuccgacccaggugguuagacgccaggacauauagcgacccacuggccuugcgcgaguucaaggaguucgcggcggggcggcgguccgugucgggcgaccugauacucgagaucggcaagcucccgcagcaccugacgcagaaggcccaaaacgcccuagauaaucucgucaugcugcacaacagcgagcaagguggccgggcguaucgccacgcuauggaagagcuacccgauaccaucgagaccuuaauguugcuggcccuaauugcagugcugacgggcggggucacgcuguucuuccucuccggccguggacuggguaagacuagcauaggacuucucugcgugauggcguccagcgcgcucuuauggauggccuccguugagccgcacuggaucgcggccucuaucauccuugaguucuuucugaugguucugcucauacccgaaccggaccgccagcguacaccacaggacaaccaacuggccuacgucgugaucggccuccuguuuaugaucuuaacagucgcugcgaacgagaugggacugcucgagaccacgaaaaaggaccuggggaucggccacgucgccgucgagaaccaucaccaugcuacuaugcuugacgucgaucuacaccccgccuccgcguggacccuguacgcagucgccaccacuaucauaaccccaaugaugcgccacacaauugagaacaccacggcuaacaucagccugaccgccaucgcaaaccaggccgcaauccucauggggcuggacaagggcuggccgaucuccaagauggacaucggcgugccacuacucgcccuagggugcuacucacaggucaauccccugacccuuacagcggcgguacugaugcugguggcccacuaugccaucaucggcccugggcuccaggcgaaagcuacgcgggaggcacagaagcgcacggcagccggcauaaugaaaaaccccacugucgacgggaucguagcuaucgaccuggaucccguugucuacgacgcaaaguucgagaagcagcuuggccagaucaugcuccugauccugugcaccagccagauccuacugaugcgcacgacuugggcacugugcgagagcaucaccuuagccaccgggccccugacuacucugugggaagggucaccgggcaaguuuuggaacaccaccauugccguguccauggccaauaucuuccggggcuccuauuuagcgggcgccggccuggcauucagccucaugaagucgcuggggggaggacgaaggggcacgggugcucagggggagacacuuggagagaaguggaagcgccagcugaaccaguugaguaagagcgaauucaacacauacaagcgguccgggauaauggaaguggacaggagcgaagccaaagagggucugaagcguggcgagacaacccgccacgcagucagucggggcaccgccaaguuacgaugguucguggagcgcaaccuggugaagccugaggguaaggucaucgaccucggcugcgggcgcgggggauggagcuacuacugcgccggguugaagaaggucaccgaggugaagggcuauaccaagggcgggccuggccacgaagagccgaucccgauggcuacguacgguuggaaccuggucaaacuccauuccggcaaggacguguucuucaucccgcccgagaagugcgacacauugcugugcgauaucggugagucuuccccaaaccccacuauagaggaggguaggacccuccgcguucuuaagauggucgagccuuggcugcgggggaaccaguuuugcaucaagauucucaaccccuauaugcccagcgugguggagacgcuggagcagaugcagcgcaagcacggcggcaugcugguccggaauccgcucucccgcaacucaacccacgaaauguacuggguguccugugggaccggcaacauagugagcgcugucaacaugacgucucggaugcugcucaacagguucaccauggcccaccgcaaaccaacuuacgagcgcgauguugaccuuggggccggcacccgucacguggcuguggagccugagguggccaaccuggacaucaucggccagcggaucgaaaacauuaagcaugaacauaagagcaccuggcacuaugacgaagacaaccccuauaagacgugggcguaccauggcuccuacgaaguaaaaccgagcggcucagccagcucgauggucaacgggguggucaaacugcucacgaagcccugggacgugauuccuauggugacccagauagcaaugaccgauacgacgcccuucggccagcagcgcguguucaaagaaaagguggacacccggaccccgaaggcaaaacaggggaccgcccagaucauggaggugacggcuagauggcuguggggauuccugucucggaacaagaagccccgcauaugcacccgggaggaguucacgcgcaagguccgaagcaaugccgcgauuggggccgucuuuguggacgagaaccaguggaacucugcaaaggaggcugucgaggacgagcgcuucugggaucuagugcacagagagcgcgagcugcacaagcaaggaaagugcgcgaccugcguguauaacaugaugggcaagagagagaagaagcugggggaguucggcaaggccaaggggagccgcgcgauaugguacauguggcucggugcuagguuccuggaguuugaagccuuaggguucaugaacgaggaucacugguuuagccgcgagaacucucucucaggggucgaaggcgaaggccugcacaagcugggcuacauucuccgagacauaagcaaaaucccugguggcaauauguaugccgaugacacugccggaugggacacgcgcaucacagaggaugaccugcggaacgaagccaagaucaccgacaucauggagcccgaacacgcgcuccucgccacgucgaucuucaagcugaccuaccagaacaagguggugagagugcagcgcccggccaagaacgggaccgugauggacgugauaagccggcgcgaccagcggggcuccggucaaguuggcaccuacggccuuaacacauuuaccaauauggaggcccaacucauucgccagauggaaagcgaagggaucuuuuccccgucagagcucgagacucccaacuuagcugagcggguauuagacuggcuggagaaguacggcguggagcgccugaagcgaauggcgaucucaggugacgacugcguggucaagccgauagacgaccguuucgcgacugcgcuaacugcgcugaaugacaugggcaagguccguaaggacaucccccaaugggagccgaguaagggcuggaacgacuggcaacagguccccuucugcucccaucacuuccaccaguuaauuaugaaggacggccgcgagauuguggugccgugccgaaaccaggaugagcucgugggucgugcucgggugagccagggggcgggcugguccuuacgcgagaccgccugucugggcaagagcuacgcccagauguggcagcuaauguauuuccaccggcgcgaccugcggcuggcugcaaaugccaucuguagcgcuguccccguugacugggugcccaccagcaggaccacgugguccauccacgcgcaccaccaguggaugacgaccgaggacaugcucuccguguggaauagagucuggaucgaagagaacccguggauggaggacaagacccacaucagcuccugggaggacgugccuuacuuaggcaagcgugaagaccaguggugcgggagccugaucgggcugacggcccgcgccacgugggcaaccaacauucagguggcaauaaaccagguccggcgccugaucgggaaugagaacuaucuggacuacaugaccagcaugaagcgguucaagaacgagucggacccugagggagcgcucugguga

SEQ ID NO: 23824 - RNA, 9879 nt, Artificial Sequence
  derived and/or modified CDS sequence (opt11) from DENV-1__FJ639679__SS-prME
agcgugaccaugcugcuuaugcuaaugcccacggcacucgccuuccaccucaccacccgcggcggggagccccacaugauagucuccaagcaggagcggggcaagucucuacuauucaagacgagugccggggugaacaugugcacccucaucgcuauggaccugggcgagcugugcgaggacacuaugaccuacaagugcccccggaucaccgaggcagagcccgaugacguugacugcuggugcaacgcaaccgacacgugggugaccuacgggaccugcucucagacgggcgaacaccggagagacaaacggucgguugcccuggcgccccacgugggcuuggggcuagagacgcgcaccgagaccuggaugagcuccgagggcgccuggaagcaaauccagcgggucgagacuugggcccuccgccacccgggguuuacggugauagccuuauuucuggcgcacgcuaucggcacuagcaucacccagaaggggauuaucuuuauccuccugaugcucgucacucccuccauggccaugcggugcgucggcaucggcagccgcgauuucguugaggggcucucuggggccacguggguagacgugguacuggagcacgggagcugcguuaccacaauggccaaagacaagcccacccuggacaucgaacuccugaagacagaagucaccaaucccgcgauccugcguaagcucugcaucgaggccaaaaucuccaacaccaccacggacagccgcugcccgacacagggcgaagccacacugguggaggaacaggaugccaacuucgugugucggaggaccuucgucgaccgaggcugggggaauggcugcgggcuguucggaaagggaucccuaauaacgugcgccaaguucaagugcgugaccaaguuggagggcaagaucgugcaguacgagaaccugaaauacagcgucaucgugacagugcacaccggagaccaacaccaggucgggaacgagucgacggagcacggcacaaccgcgacuaucacgccacaggcacccaccaccgagauacaguuaacggacuacggugcccugacccuagacugcagcccccgcacgggccucgauuucaacgaaauggugcugcuaaccaugaaagagaaauccuggcucguccacaagcagugguuccuggauuugccccuccccuggaccucaggagccucaaccucccaggagacguggaaccggcaggaccugcuggugaccuucaagaccgcccacgcgaaaaagcaggaaguuguugugcucggcucccaggagggcgccaugcauaccgcccugacgggggccacagagauccagaccucaggcaccacuaccaucuuugccgggcaccugaaaugccgcuuaaagauggauaagcugacccugaagggcaugagcuaugugaugugcaccgguuccuuuaagcucgagaaggagguggcagaaacgcagcacggcaccgugcugguccagaucaaguaugagggaaccgacgccccauguaagaucccguuuagcacccaggacgagaagggcgucacgcaaaacggccggcugauaaccgccaacccgaucgugacagacaaggagaagcccgugaacauagaggccgagccgccauucggggaguccuacaucgucaucggagcuggcgagaaggcccugaagcucagcugguucaagaaggggucaucgauagggaagauguucgaggccaccgcccgcggcgcucggcguauggcaauacugggagacacggccugggauuucggguccauugguggcguguucacuaguguugggaaacugguccaccagaucuucgggaccgccuacgggguacuauucuccggggugagcuggacaaugaagauagggaucggcguccuccugacuuggcucggcuuaaauucccgcagcacgagucugagcaugaccugcaucgccgucgggcucgugacccuguaccugggcgucaugguucaggccgacuccgggugcgugaucaacuggaagggccgggagcucaaaugcgggagcggcaucuucgucacgaacgaggugcacacguggacggagcaguacaaguuucaggcugacagcccgaagcgccuguccgccgccaucggcaaagccugggaagagggggugugugggauucggucggccaccagacucgagaauaucauguggaagcaaaucagcaacgaguugaaucauaucuuacuugaaaacgacaugaaguuuaccgugguggugggggacgucgcgggcauccucgcccaggggaagaaaaugauccggccgcagcccauggaguacaaguacagcuggaagucauggggcaaagccaagauuaucggcgcggaugugcagaacaccaccuucauuaucgacgggcccaauaccccugagugucccgaugaucagcgcgccuggaacaucugggagguggaagauuacggcuucgggaucuucaccacgaauaucuggcuuaagcugcgggacucuuacacccagguaugcgaccacagacucauguccgccgcuauuaaggacagcaaggccgugcacgccgacauggguuacuggaucgaaucagagaagaacgagacuuggaagcuagcgagggccuccuucaucgaagugaagacgugcaucuggcccaagucccauacgcuguggagcaacggcguccucgagucggagaugaucaucccgaagauuuacgggggucccauuagccagcacaacuauaggcccggguacuuuacccagaccgccggccccuggcaccuggguaaguuagaacucgacuuugaccugugugagggcacuaccgugguggucgacgagcacugcggcaauaggggcccgucccugcgcaccaccaccgugaccggcaagauaauccacgaguggugcugccggucuugcacccugcccccccuccgcuuccguggggaggacggcugcugguacgguauggagauacgcccaguaaaagagaaggaggaaaaccuggucaaguccauggugagcgccggcucaggcgagguggacuccuucucacucgggcugcugugcaucucaauaaugauagaggaaguuaugcggagccgguggucccggaagaugcucaugacugguacucuggccguguuccuccucuugaucauggggcagcuaacauggaacgaccucauccgccugugcaucauggugggcgccaacgcgagcgaccgcauggggaugggaaccacauaccucgcccucauggcaaccuucaagaugcggccgauguucgccgucgggcuucuguucagacggcucaccucccgcgaagugcugcugcucaccaucggccuuagucucguggcuuccgucgagcucccuaauagccuggaggagcugggcgacgggcucgccaugggcauaaugauucugaaguuacucaccgacuuccagucccaccaacugugggccacccuucuaucccugacguucaucaagaccacguucucauuacacuacgccuggaagaccauggcgaugguauugagcauugucuccuuauucccccuuugccucucuacgacuucccaaaaaaccacauggcugcccgugcugcugggcucucuggggugcaagccgcugaccauguuucucaucgcggagaacaagaucuggggucggcgcuccuggccgcugaacgaggggauaauggccguaggcaucgucagcauucuuuugaguucccuucucaagaacgacgugccgcuagcggggccccugaucgcaggcggcaugcugaucgcuugcuacgugaucagcgggagcagcgcagaccucuccuuggagaaagccgcagaggucagcugggaagaagaggcggagcacagcggcgcgagccauaacauccugguggaggugcaggaugacggaaccaugaagauaaaagacgaggaacgggacgauacccucaccauccuacugaaggcgacccuccuggccgucuccggaguguacccgcugucuauccccgccacccucuuugugugguacuucuggcaaaagaaaaagcagcgcuccgggguccugugggacacccccagcccgcccgaaguggagcgggcagugcuagacgacggaauuuaccggaucaugcagcgcggccugcucgggcguucccaggucggcguugggguguuccaggagaacgucuuccacaccauguggcacgucacuagaggugcgguucugauguaccaggggaagcgccuggaacccagcugggccucggucaagaaggaccuaaucagcuauggcggcggguggcgacugcaaggcuccuggaacacgggggaggagguccaggugauagccgucgagcccggcaagaacccaaagaacgugcagacagcccccgggaccuucaagacccccgagggugaggugggggccaucgcccuggacuucaagccagggacgagcgggagcccaaucguaaaccgcgagggcaagaucguaggccucuauggcaacggcgucguaacgaccagcggcaccuacgugagcgccaucgcccaagcgaaggcgucccaagaggggccguuacccgaaaucgaggacgaggucuuccggaagcgcaaccuuacgaucauggaccuccauccuggcagcgggaaaacccggcgcuaucugccggccauaguacgugaggccaucaagcgcaagcugcgcacccucauccuggcccccacccggguaguggcguccgaaauggcugaagccuugaagggcaugcccauccgcuaccagacgaccgccgucaagucugagcacaccggcaaagagauaguggaccucaugugccaugccaccuucacuaugcgguuacuguccccugugcgagucccgaauuacaacaugaucaucauggaugaagcccacuucaccgaccccucgaguaucgcggcccguggguacaucucuacccgggugggcaugggggaggccgccgcuaucuucaugacugcgacuccgcccggcuccgucgaggcguucccgcagagcaaugccgucauucaggacgaggaaagagacauccccgaacgcuccuggaacucagguuacgaauggaucaccgauuuccccggcaagaccgugugguuugugccgagcaucaaaagcgguaacgauaucgccaacugccuccguaagaaugguaaacgagucauccagcuuucccggaaaaccuucgauacggaguaccagaagaccaagaauaacgacugggauuacgugguuaccaccgacauuucggagaugggcgcgaacuuucgcgccgaccggguaauagacccgcgccggugccugaagcccgucauccucaaggaugggcccgagcgcguuauccuggccggccccaugccggucaccguggccuccgcugcccagcggcgcgggcggaucggccgcaaccacaacaaagagggcgaccaguacaucuacauggggcagcccuuaaauaacgacgaagaccacgcucacuggaccgaagcaaaaauguuacuggacaacaucaacaccccggaggguaucauccccgcccuuuucgagccggagcgugaaaaguccgcagcgauagacggugaguaucggcuccgaggcgaggcccgaaagacuuucgucgagcugaugagacgcggggaccugccgguguggcucuccuacaagguggccagcgagggcuuccaguacucggaccgccgguggugcuucgacggcgagcgcaacaaccaaguccuggaggagaacauggacguugaaaucuggacgaaggaaggggagcgcaagaagcugcgcccgagguggcucgacgcccgcaccuacucggacccccucgccuuacgggaauucaaggaguucgcggccggcaggcggagcguguccggggaccuaauccuggagaucggcaagcugccgcagcaccucacccagcgcgcccagaacgccuuggacaaccuggucaugcuccacaacagcgagcaaggcgggcgcgcguaccgccacgccauggaggagcugcccgacaccaucgagacguugaugcuccuggcccuuauugcggugcucaccggcggggugacccuguucuuucuguccggccgggggcucggcaagaccaguaucggacugcugugugucauggccuccagcguccuauuauggauggcgucaguugagccacauuggaucgccgcuuccauaauccuggaguucuuccucaugguccugcucauccccgaaccugaccgccagcggacgccccaggacaaccagcucgcuuauguugugauuggcuugcuguucaugauccugacgguugccgcgaacgagaugggccuguuggaaaccaccaagaaggaccucgggaucggccauguagcugucgggaaccaccaccaugcggccaugcuggacgucgaccugcaccccgccucagcguggacccucuacgcaguggccacgaccauaaucacgccuaugaugcgccacaccaucgagaauacgaccgccaacaucagcuuaacagccaucgcgaaccaggccgccauccugaugggccucgacaagggcuggcccauauccaagauggacaucggggugccgcugcuagcucucggcugcuacagccaggucaacccccugacccugacggcagccgugcucaugcugguggcucacuaugcuauaaucgggccgggccugcaggcaaaggcgacccgcgaggcgcaaaagcggacagcggccgggaucaugaagaaccccaccgucgaugguaucguggcgaucgauuuagaccccguggucuacgacgcuaaguucgaaaagcagcugggccagaucaugcuucucauccugugcacuucgcagauccugcucaugcgcacgaccugggcccuuugcgagaguaucacacuggcuacgggcccccuaaccacccugugggagggaaguccggggaaguucuggaacaccacgaucgcgguaagcauggccaacaucuuccggggguccuaccuggccggggccggucucgcauucagccugaugaagucccugggcgggggccgccgggggaccggcgcccagggcgagacccucggggagaaguggaagcgacaguugaaccagcuguccaaaagcgaguucaacaccuacaagcgauccggcauuauggagguggaucgcagcgaggcuaaggagggccucaagcggggcgagacgaccaagcaugcugucucccgcgggaccgccaagcuacggugguucguggaacgcaaccuugugaaaccugagggcaaagucaucgaccugggcuguggccggggagggugguccuacuacugcgcaggccucaagaaagugacugaggugaagggguacacgaagggcggccccggucacgaggagccgaucccgauggccaccuacggguggaaccugguaaagcuucacuccgggaaagacguguucuucaucccgcccgagaagugcgacacccuccugugcgacaucggcgagaguucacccaauccgacaaucgaggaggggcgcacgcugcgggugcuaaagauggucgagcccuggcugcggggcaaccaauucugcaucaagauccuuaaccccuacaugcccuccguuguugagacgcucgaacagaugcagaggaagcacggcgggaugcuuguccgcaacccucuuagccggaacagcacccacgagauguacuggguguccugugguaccgggaauaucgugagcgcggucaacaugaccucccguaugcuccugaaccgcuucacgauggcccaucggaagcccacguaugaacgcgacguggaccugggugccggcacccggcacguggcagucgagcccgagguggcuaaccucgacaucaucgggcagcgcaucgagaauauaaagcaugaacacaagucgacauggcauuacgaugaggacaaucccuacaagacgugggcuuaccacggcuccuacgaggucaagcccagcggauccgccagcagcauggucaacggcguggucaaguugcugacgaagccuugggacgugauccccaugguaacccaaaucgcuaugaccgacacgacccccuucgggcagcagcgggucuucaaggagaaaguggauacccgcacaccgaaggcuaagcggggcacggcucagaucauggaggucaccgcgaaguggcuuuggggauuucugucucgcaacaagaagccccggaucuguaccagggaagaguucacccggaagguccgcagcaacgccgccauuggggcgguguucguggacgaaaaucaguggaacuccgcgaaggaggccgucgaggaugagcgauucugggaccuggugcaccgcgagcgggaacugcacaagcagggcaagugcgccacgugcguguacaacaugauggggaagagagagaagaagcugggggaguucgggaaggccaagggcaguagagcaauuugguacaugugguuaggggcgcgauuccuagaguucgaggcgcuuggguucaugaacgaggaccacugguucucccgggagaauucacugucaggugucgagggugagggucugcacaagcuuggguacauauugcgcgauaucagcaagauccccggugguaacauguaugccgaugacacggcugggugggacacaaggaucacggaggacgauuuacagaacgaagcucgaaucacugacaucauggagccggagcacgcgcuccuugcuaaguccaucuucaaacuaacuuaccagaacaaaguggugcgcguccaacggccggccaagaacggcaccgugauggacgugaucagccgccgggaucagcgcgggucaggccaggucgguaccuacggacucaacacguucacgaacauggaggcccaguuaauccggcagauggagagcgagggcaucuucucccccagcgaauuggagacccccaaccuggccgcacgcguguuggauuggcucgagaaguauggaguggagcgacucaagcgcauggcuaucuccggcgacgauugcgucguuaagccgaucgacgaccgguucgccaccgcccugacggcccucaacgacauggggaaagugcgcaaggauauuccacagugggaacccucgaagggcuggaacgacuggcagcagguccccuucugcucccaccacuuccaccagcugaucaugaaggacggccgggagaucgugguacccugccgcaaucaggaugagcuuguagggcgggcgcgcgugucgcagggcgccggcuggagccucagggagaccgccugccugggcaagucguacgcccagauguggcagcugauguacuuccaccgccgggaucuccgucuagcggccaacgcuaucugcagcgcgguccccgucgacuggauccccacaucccggaccacauggagcauccacgcccaccaccaauggaugaccaccgaggacauguuguccgucuggaaccgcguguggaucgaagagaaccccuggauggaagauaagacccacaucucguccuggggugacgugccguaccugggcaagcgcgaagaccaguggugcggcagucugauagggcugacagcgcgggccaccugggccaccaacauccaaguagcuaucaaucaggugcgccggcucaucggcaacgagaacuaucuggacuauaugaccuccaugaagcgcuucaagaacgagucugacccugagggggcacugugguga

SEQ ID NO: 23825 - RNA, 9879 nt, Artificial Sequence
  derived and/or modified CDS sequence (opt11) from DENV-1__FJ850069__SS-prME
agugugacuaugcuguuaaugcucaugccuacggcccuggccuuucaucugaccacccgcggcggggagccucauaugaucgucggcaaacaagagcguggcaaaagccugcuguucaagacgagcgcuggagugaacaugugcacccucauagccauggaccucggcgagcucugugaggacacgaugaccuacaagugcccccgcauuaccgagguggagcccgacgacguagacugcugguguaacacuaccgacacgugggucaccuaugggaccugcagccagacuggagagcaucggcgcgacaagcggagcguggccuuggcgccccaugucgggcugggccuggagacccgggcugagaccuggaugagcagcgagggggcauggaaacagauccagcgcguggagacaugggcccuccggcaucccggcuucacggugaucgcacuguuccuggcccacgucaucgggacauccaucacccagaagggaauuaucuucauccucuuaaugcugguaacccccagcauggcaaugcggugugugggaaucggcucccgcgacuucgucgagggcuuauccggagcaacuuggguagaugugguccuggagcauggcuccugcgucacaaccauggcgaaggacaagccgacgcuggacaucgagcuacugaagacagaagugaccaaccccgcuguuuugcggaaacucugcaucgaggcuaagaucagcaacacuaccacagacucccggugcccgacucagggcgaggcgaccuuaguggaagaacaagacgccaacuucgugugccgucgcaccuucgucgaccggggguggggcaacgggugcggccuguucgggaagggcucucucaucacgugcgccaaguucaaaugugugacgaagcuggagggcaagauagugcaguacgagaaccugaaauacuccgucaucgugacagugcacaccggggaucagcaccagguaggcaacgagagcacggagcacgguacaacugccacgaucacgccccaggccccgacgagugaaauccaacucacugauuacggagcacuaacccuggacugcagcccccgcaccgggcucgacuucaacgagaugguccucuugacaaugaaggagaaguccuggcucguacacaagcagugguuccuggacuuacccuuacccuggaccagcggcgccagcaccucucaggagacuuggaaccggcaagaccugcuggugacguucaaaaccgcccacgccaaaaagcaggaaguggucguucuuggcagccaggaaggggccaugcauacagcgcugacuggcgcuacagagauccagaccuccgggaccaccacgaucuucgcagggcaccugaaaugccgccucaagauggacaagcugacuuugaaagggaugagcuacguaaugugcacgggcucuuucaaguuggaaaaggaggucgccgagacucagcacgguacgguguuagugcagaucaaauacgaggggaccgacgcccccugcaagauccccuucucuacccaagaugagaagggggucacccagaaugggaggcugaucacggcaaauccuaucgugaccgacaaagagaagcccgugaauaucgaggccgagccgcccuuuggcgaauccuacaucgucauuggcgcaggggagaaggcccugaagcucagcugguucaagaaggguuccagcaucgggaagauguuugaggcaaccgccagaggcgcccggcgcauggccauuuuaggagacacagccugggacuucggcuccauuggggggguauuuaccuccgugggcaagcuugugcaucagaucuucgggacggcguacggcguucuuuuuuccggaguaagcuggaccaugaagaucggcaucggaguccugcugaccugguuagggcugaacucccgaucgacaagucuuuccaugaccugcauagccgugggccucguuacccuguaucugggugucaugguacaggccgacucgggcugcgugauuaacuggaaggguagagagcugaagugcgggaguggaauuuucgugacaaacgagguucacacauggaccgagcaguacaaguuccaggccgacagcccuaaacgccuguccgccgcgaucgggaaggccugggaggagggcguuugcgggauccggagcgccacccgccuggagaacauuauguggcggcagaucaguaacgagcucaaccauauucuucuggagaacgacaugaaguucacagucgucguaggcgacgucguagggauccuugcccaggggaagaaaaugauccggccgcagccuauggagcauaaauacagcuggaaguccuggggcaaggccaagaucaucggggcggacguccaaaacacgacguucaucauugauggcccaaacaccccggagugccccgacgaccagagagccuggaacaucugggaggucgaggacuacgguuucggcaucuucaccaccaauauuuggcugaaacugcgcgacagcuacacccaagugugcgaccaccgauuaaugucugccgccaucaaggacagcaaggccguccacgcggacaugggcuacuggauugagagcgagaagaacgagacguggaagcuggcacgcgccagcuucauugaagucaaaacaugcaucuggccaaagucccacacccuguggagcaacggugugcucgagucagagaugaucauacccaagaucuacggcgggccgaucagccagcacaacuauagacccggcuauuucacgcagaccgccgggcccuggcaccugggaaagcuggagcucgacuucgaccuuugcgaagguaccacuguggucguggaugagcacugcgguaacaggggcccaucucugcggacgaccaccguuaccgguaaaaucauucacgaguggugcuguagaucaugcacgcugccaccccuccgguuuaagggcgaagacgggugcugguacggcauggaaauccgcccugucaaggaaaaagaagagaaccuggugaagaguauggugagcgcgggcagcggggaagucgacuccuucagcuuaggacuccugugcaucuccaucaugaucgaggaagugaugcgaagccgcuggucccgaaaaaugcucaugaccgggacacuggcaguguucuuccuguuaaucaugggccagcucacauggaacgaccugaucaggcucugcaucauggucggcgcgaacgcaagcgaucgcaugggcaugggaaccaccuaccuugcccugauggcgacuuucaagaugcguccgauguuugccguagggcuccuguucaggcggcugacaaguagggagguucucuugcugacaaucggucucagccuuguggccucuguagagcugcccaacagccucgaagaacuaggggacgggcuggcgauggggauaaugauccucaaguugcugaccgacuuccagaguuaccagcuuugggucacccugcucagccucaccuuuaucaagacgaccuucucccugcacuacgccuggaagacuauggcgauggugcuaucgaucgugagccuucugccacugugccucagcaccacgucccagaagacgaccugguugcccgucuuacucgguucccuugggugcaagccgcugacgauguucuuuauagccgagaacaagaucugggggaggaaauccuggccccucaacgagggcaucauggccguugggaucguguccauuuuacuguccucccuccugaagaaugacgucccccuagcuggcccccucaucgcgggcggcauguuaauugccugcuaugugaucagcggcuccagcgcagacuugagccucgagaaggccgccgaggugagcugggaagaggaagcagagcacuccggggcaucucacaacauccucgucgaggugcaggaugacggcacuaugaaaaucaaggacgaggaacgcgacgacacacugaccauucuccucaaggccacccuacucgccguguccgggguguacccauuaagcauccccgcuacucuauucgugugguacuuuuggcagaagaagaagcagcgaagcggcgugcucugggacacgccaagcccgcccgaggucgagcgcgcgguucuggacgauggcaucuaccggaucaugcagcgcggguuacugggccggucccagguaggcguaggcguguuucaggagaacguguuccacaccauguggcacguuacccgcggcgccgugcucauguaccagggcaagcggcuggagcccucaugggccuccgugaaaaaggacuugaucagcuauggcggggguuggagacuucagggcuccuggaacaccggcgaggaggugcaagugaucgccguggagccggggaagaaucccaaaaacguccagacggcuccggguaccuucaagacccccgagggagaggugggagcgauugcccuagacuucaagcccggcaccagcgggucucccauugugaaucgggaggguaagaucgucggccuguacggaaauggcguggugacgaccucagguaccuacguaagcgccaucgcccaggccaaggcaucccaggaaggcccacuccccgagaucgaggacgagguguuucgcaagcggaaccugaccaucauggaccugcacccgggguccggaaagacgagaagguaccucccggcuaucgugcgggaagccaucaaacggaagcugcgaacccugauccucgccccgacccgagucguggcguccgagauggcugaggcgcugaagggcaugcccauccgguaccagaccacggcugucaaaagcgagcacacugggcgggaaaucgucgacuuaaugugccaugcaaccuuuaccaugcggcuccugucccccgugcgcgugccgaacuacaacaugaucaucauggacgaggcccacuucaccgacccuuccuccaucgccgcccggggcuacaucagcacccgcgucgggaugggcgaggccgccgcuauauucaugaccgccacgccgccugggucuguggaggccuucccucaaagcaacgccguuauucaagacgaggagcgugacauccccgagcgcuccuggaauagcggcuacgaguggaucacggacuuccccggcaaaaccgucugguucgugcccuccauuaagagcgggaacgacaucgccaacugccugcggaagaacggcaagcgcgugauccagcucucccggaagaccuucgauaccgaguaccagaaaacgaagaacaacgacugggacuacguugugaccacagacaucagcgagaugggagcgaacuuucgcgcggaucgggucaucgacccacgccggugccugaagcccgugauucugaaggacggccccgagcgugugauccucgccggaccuaugccagugaccguggcauccgcggcccaacgucgcggccgcauagggcgcaaccacaacaaggagggggaccaguauaucuacaugggccagccgcugaacaacgacgaggaccacgcccacuggacggaggccaagaugcugcucgacaauaucaauaccccggaggggaucauucccgcacuguucgagccagagcgcgagaaguccgcugccaucgacggcgaguaccggcugcggggcgaggccaggaagaccuucguggagcucaugcgcaggggagaccugcccguguggcuguccuacaagguggccagcgagggcuuccaguauucggaccggcgcuggugcuucgacggggaaaggaacaaccagguucucgaagagaauauggacgucgagaucuggaccaaggagggugagcguaaaaagcugcgcccccgguggcuggacgcccgcacguacuccgauccacucgcgcugcgcgaguucaaagaguucgccgcaggacgcaggagcauaucaggggaccugauccucgagaucggcaagcugccgcagcaucugacacaacgcgcccagaaugcccucgacaaucuggugaugcugcacaacagcgagcagggagggcgggccuacagacacgccauggaggaacugcccgauaccaucgagacccugaugcuguuggcacugaucgccgucuugaccgggggggucacccucuucuuccuguccggccggggccugggcaagacuaguaucgggcuccugugcgugauggcgucuagcgcccugcucuggauggccuccguugagccccacuggaucgccgccagcaucauccuggaguuuuuccugaugguacuccucauccccgagccggaccgccagagaaccccccaggacaaccagcuggcauacgugguuaucggucuuuuauucaugauucuuaccgucgccgccaacgaaauggggcuccuugaaacgaccaagaaagaucugggcauugggcacguggccguggagaaccaucaccacgcgaccauguuagacguugaccugcaccccgcgagcgcauggaccuuguacgcgguggccacaaccaucauuacuccgaugaugcgccacacaaucgagaacacgacagcaaacaucagccuuaccgcgaucgcaaaccaggccgccauacugaugggccucgacaagggcuggcccaucuccaagauggacaucggggugccccuccuggcccuggguugcuacagccaggucaacccccucacccugacggcggccgugcugaugcugguggcccacuacgccaucaucgggccggggcugcaggcgaaagcaacccgcgaagcccagaagcggaccgcugccgggaucaugaagaaccccacuguugacggaauaguggcgaucgaccuggacccuguggucuacgaugccaaguucgagaagcaguugggccaaaucaugcugcuaauccucuguacgucccagauacugcugaugcgcaccaccugggcccucugcgagagcaucacccuggcgacggggccccugaccacccucugggagggcaguccagggaaguucuggaacacaacgauugccgugagcauggcuaauauauuucggggcucguaccuggcuggggccgggcuggccuucagcuuaaugaaaucuuugggggggggcagacgggggaccggcgcccagggcgagacccugggggagaaguggaagcggcagcugaaucaacuuuccaagagugaguucaauacauacaagcggucaggcauuuuagagguggaccgcagcgaggccaaggaagggcuuagaagaggggagacgaccaagcacgccgucucccggggcaccgccaaguugcgaugguucguggaaagaaaccuggugaagcccgagggaaaagucauugaucugggcugcgggcgggguggauggagcuacuauugcgccggacucaagaaagugaccgagguuaaagguuauacgaagggaggccccgggcacgaggagcccaucccgauggcgaccuauggcuggaaucucgucaagcuacauucggguaaggacguauucuucauuccaccagagaagugcgauacucuacucugugacaucggcgagagcagucccaacccgaccaucgaagaggggcggacgcugcgcgugcucaagauggucgagccuuggcugcggggcaaucaauucuguaucaagauccugaaccccuacaugcccagcgugguggagacccucgagcaaaugcagcgcaaacacggcgggauguuagucagaaacccgcuaucccgcaacagcacucacgaaauguacuggguauccugcggcacugggaacauagugagcgccgucaacaugaccucccgaaugcuccugaaccgcuuuacuauggcccaucgcaagcccaccuacgagcgagacguggacuuaggcgccggcacccgccauguggcagucgagcccgagguggccaaccucgacaucaucgggcaaaggaucgagaacaucaagcacgagcacaagagcaccuggcauuacgaugaggacaaccccuacaagacaugggccuaccacggcuccuacgaggucaagccgagcggaagugccucgagcauggugaauggcguggugaagcugcugaccaagcccugggacgugauccccauggugacccagaucgcuaugaccgauacgacccccuuuggucagcagcgcguguucaaggagaaaguugauacgcggaccccgaaggccaagcgcggcacggcgcagauuauggaggugacagccggcugguuguggggauucuuaucgcggaacaagaagccucgcaucugcacccgggaggaguuuacccgcaagguccguagcaacgccgccauuggcgcaguguucguggacgagaaucaguggaacuccgcgaaggaggccguggaggacgagcgcuucugggaccugguucaucgggagcgggaacuucacaagcaggggaagugugccacgugcguguacaacaugaugggaaagcgugagaaaaaguugggggaguucgggaaagccaagggaagccgcgcgaucugguacauguggcugggcgcacgguuucucgaguucgaggccuugggcuucaugaacgaggaccacugguucucccgcgagaacagccuguccggggucgagggcgaggggcuccacaagcugggcuauaucuuacgagacaucagcaagauaccgggcgggaacauguaugccgacgacaccgcuggcugggacacccgaaucacggaggacgaucuccagaaugaggcgaagaucacagacaucauggagccggagcacgcccuucuggccaccuccaucuucaagcucaccuaucagaacaagguggugcgcguccagcggcccgccaagaacgggaccguuauggacgugaucagccgucgggaccagcgcggcuccggccagguagguaccuacggacugaacaccuuuaccaacauggaagcccaguuaauccgccaaauggaaucggagggaaucuuuucccccagcgagcucgagacacccaaccuggcggaacgcgugcuggacuggcuggagaaguacggcgucgagcggcugaagagaauggccaucucuggggacgacugcgucgugaagccgauagacgaccgguucgccacagcccuaaccgcccucaaugacaugggcaagguacgcaaggauaucccgcagugggagcccagcaagggcuggaacgauuggcaacagguucccuucugcucccaccauuuccaccagcugaucaugaaggacggacgggagauuguggugccgugccgcaaccaggacgagcuggucggccgggcaagagugagccagggggccggcuggagccuccgcgagaccgcuugccuggggaaguccuacgcccagauguggcagcuuauguauuuccaucgccgggaccugaggcuggcugcgaacgcuaucugcagugccgugcccgucgacuggguuccgaccucccggacgaccugguccauccacgcgcaccaucaguggaugacuaccgaggacaugcuauccguguggaaccgggucuggaucgaggagaaccccuggauggaggauaagacgcacaucagcagcugggaggacgucccguauuuaggcaagcgcgaagaccaguggugcgguucauugauagggcugaccgcucgugccacaugggccacuaacauccagguggcaauuaaccagguccgccgacucaucggcaacgaaaacuaccuggacuacaugaccagcaugaagcgcuucaagaacgagucagacacggagggggcccuaugguga

SEQ ID NO: 23826 - RNA, 9879 nt, Artificial Sequence
  derived and/or modified CDS sequence (opt11) from DENV-1__FJ639680__SS-prME
agcguaacaaugcugcuaaugcugaugcccacggcacuagccuuccaucucaccacgcggggcggugagccccacaugauaguguccaaacaggagcgcgggaagucccugcuguucaaaaccagcgccggggugaauaugugcacccugaucgccauggaccugggcgagcuaugcgaggauacgaugacauacaagugcccccguaucacggaggccgagcccgaugacguggacuguuggugcaaugccacugauacgugggugacuuacgggaccugcucucagacuggcgagcaucggcgcgauaaacgguccguggcccucgcgccccacgugggucuggggcuggagacgcgcaccgagaccuggaugagcuccgagggcgccuggaagcagauccagcgggucgagaccugggcgcuccgccaccccggguucacggugaucgcccuguuucuggcacaugcaaucggcaccaguaucacccagaaggggaucaucuucauacuccugaugcuggucacacccuccauggccaugcggugugucggcaucggcagccgcgacuucgucgagggacuuucgggggccacauggguggacguagugcucgagcacgggagcugcguaaccacgauggccaaggacaaaccuacucuggauaucgagcuccugaaaacggaggugaccaaccccgcgguucugaggaagcuauguaucgaggccaagaucuccaacaccacgacggauaguagauguccgacccaaggggaggccacacugguagaggagcaggacgccaacuucgucugccggcgcaccuucguggaccgggggugggggaauggcugcgggcuguucggcaaggggucccucaucacgugcgccaaguucaagugcguaaccaagcucgagggcaagaucgugcaguaugagaaccugaaguacagcguaauugugacuguucacaccggagaucaacaccagguggggaaugaguccaccgagcacggcaccacagccaccauaacgccccaggcacccacgaccgaaauccaacucaccgacuacggugcgcugacccuggacugcagcccccguacaggccucgauuucaacgagaugguccugcugaccaugaaggagaagucguggcucgugcacaagcaaugguuuuuagaccugccccugcccuggaccucuggagccagcacuucccaggagacguggaaccgucaagaccugcucgugaccuucaagacugcccacgccaagaagcaggaggucgugguacucggcucucaggagggcgccaugcauaccgcccugaccggggcuacugaaauccaaacaucugguaccacgacuaucuuugcggggcaccuuaaaugcaggcucaagauggauaaacuaacucuuaagggcaugagcuacguuaugugcaccggguccuucaagcuggagaaggagguggcggagacgcagcacggaaccgugcugguccagaucaaguacgagggcaccgacgcucccugcaagauccccuucucgacccaggacgagaagggggugacgcagaacggccggcugaucacggccaacccgaucguuaccgacaaggaaaagcccgugaacaucgaggcagagccacccuucggggaguccuauaucgugauuggagcuggcgagaaggcacugaagcucucgugguuuaaaaagggguccagcauaggcaaaauguucgaggccaccgccagaggugccaggcgcauggcgauccugggcgacacggccugggauuucgggucgaucgggggcguuuucacaucugucgggaaguuagugcaucagaucuucggcaccgccuacggagugcuguucagcggcgucucauggaccaugaaaaucgggaucggcgugcugcugacauggcucggucugaacucccgcagcacuucgcugucuaugaccugcaucgccguggggcuaguuacguuauaccugggcgugaugguacaggccgacuccgggugcguuaucaacuggaagggcagggagcucaagugcgggucaggcauauuuguuacgaacgagguacacaccuggaccgagcaauacaaauuccaggcggauagcccgaagcgcuuguccgcugccaucggcaaggcgugggaggagggugucugugggaucaggucggcaacucgccuugagaacaucauguggaaacagaucuccaacgagcuuaaccauauucugcuggagaacgacaugaaacucaccgugguggugggggacgucgcgggcauacuggcccaggggaagaagaugauccguccccagcccauggaguacaaguacagcuggaaguccugggggaaggccaagaucauaggcgccgacgcgcagaauacgaccuucaucaucgacgggccuaauaccccugaguguccagacgaccagcgcgccuggaacaucugggaggucgaggacuacggcuucgggaucuucacaacuaauaucuggcugaaguuacgugauagcuacacccaggucugcgaccaccgccugauguccgccgccauuaaggauagcaaagccgugcacgcagauaugggcuacuggauugaauccgagaagaacgagaccuggaagcuggcccgggccagcuucaucgaggugaaaacuugcaucuggcccaagucccacacguuauggagcaacggcguacuggaguccgaaaugaucauccccaaaaucuacggaggccccauaagccaacauaacuaccgcccgggguacuucacgcagaccgccggcccguggcaccuggggaagcucgaguuggacuucgaccugugugaaggcacaacggugguggucgacgagcacugcggcaaccgggggccgagccucaggaccaccaccguaacggguaagauuauccacgaguggugcugccggagcugcaccuuaccgccccugcgcuuccgcggggaagacggcuguugguacggcauggagauacgcccugugaaggagaaagaggagaaccucgucaaguccaugguuagcgccggcucgggcgaaguugacuccuuuucccuggggcugcucuguauauccaucaugaucgaggagguaaugcggagcagauggucccggaaaaugcugaugacggggacccuggcgguguucuuccuccugaucauggggcaauuaacguggaacgaccucauccgccugugcaucauggucggggccaacgccucugaccgcauggggaugggcaccaccuaccucgcguugauggcgaccuucaagaugcggccgauguuugcugucggccugcuguuccgcagacucacgagucgcgaagugcugcuacucaccauugggcugagccugguggccuccgucgagcuucccaacagccuggaggagcuuggggacggguuagcaaugggcaucaugauccugaaacugcucaccgacuuccagucccaccagcugugggccacguugcugagccugacguucauuaagaccaccuucucccuucauuacgcguggaaaacuauggccauggugcucagcauuguuucccuuuucccgcugugccucucuacaaccagucagaaaaccaccuggcucccgguacuccucggcagccuggggugcaagccgcugacgauguuccucaucgcugagaacaagaucuggggccggaaauccuggccauuaaacgaggggaucauggccgugggcaucguaucuauccugcuuagcucccugcugaagaacgaugugccccucgcugggccccugaucgcgggcggcaugcucauagccugcuauguaaucagcggauccagcgccgaccucucccuggagaaggccgccgaaguuagcugggaggaggaggcugagcauucgggcgccagccacaacauccugguggaggugcaggacgaugggacgaugaagaucaaggacgaggagcgcgacgacacucucacgauccuucugaaggccacccuccuugcugucuccgguguauacccgcugagcauccccgcaacccucuucgugugguauuuuuggcagaagaagaaacagcguuccggcguucucugggacacccccagcccgcccgaaguggaacgcgcggugcuggaugacggcaucuaccggauaaugcaacgcgggcugcucgggcggucccagguggggguggggguguuccaggagaacgucuuccacaccauguggcacgugacccgcggcgccgugcugauguaccaagggaaacgguuggagccuagcugggccucaguaaagaaagacuugaucaguuacggcggaggguggagacugcagggauccuggaauacgggggaggagguacagguaaucgcugucgaacccggcaaaaacccuaaaaacgugcagaccgccccaggaaccuucaagacccccgagggcgagguuggagcaaucgcccuggacuuuaagcccgggacauccgguucccccaucgucaaccgggagggaaaaaucgugggccuguauggcaacgggguggucaccaccucagggaccuauguguccgccaucgcccaggccaaggcaagucaagaagggccgcugcccgagaucgaagacgaaguguucaggaagcggaaccugacuaucauggaccuccaccccggaagcgggaagacccgccgcuaccucccugccaucguccgcgaggccaucaagcggaagcuacgcacccucaucuuagccccuacacgcgugguggcgagugagauggccgaggcacugaagggcaugcccauccgguaucagacaaccgccgucaaaucugagcauaccggcaaggagaucguggaccucaugugccacgccaccuucacgaugaggcuacugucccccguccgggucccgaacuacaacaugauuaucauggacgaggcgcauuuuacugaccccagcuccaucgccgcccgcggauacaucuccacgcgggugggcaugggggaagcagccgccaucuucaugaccgccacgccgcccggguccguagaggccuuuccucagagcaacgccgucauccaagaugaggagcgcgacauccccgagcgguccuggaacagcggauacgaguggaucaccgacuuccccggcaagacggugugguuugugccauccaucaagagcggcaaugacauagccaacugcuugcgcaagaacgggaagcgggucauccagcugucccgcaagaccuucgacacggaguaccagaagacuaagaacaacgacugggacuacguugugaccaccgauaucagcgaaaugggggccaauuuccgggccgaucgcgugaucgacccgcggcggugccugaagccagugauccucaaagacgggcccgagcgggugauucuggccggccccaugccggucaccguggccagugccgcucagcgccgggggcgcaucggccggaaccacaacaaggagggcgaccaguacaucuacaugggacaaccccugaauaacgacgaggaccaugcccacuggacagaggccaaaaugcucuuggacaauaucaacacccccgagggcaucauucccgcacuguucgagcccgagagagaaaagagcgcagcaaucgacggggaguaucggcuccgcggcgaggcccggaagacuuucgucgagcugaugcggcguggggaucuccccgugugguugagcuacaagguggccagcgaaggcuuccaguacagcgacaggcgcugguguuuugacggagagcggaacaaccaagugcuggaggagaacauggauguggagauuuggaccaaggagggcgagcgcaagaagcugcggccgcgauggcucgacgcccggaccuacuccgaccccuuggcguuacgcgaguucaaggaauuugccgcgggccggaggagcgucuccggggacuugauccucgagaucgggaagcugccgcagcaucuaacccaacgggcucagaacgcgcuggauaaucugguuaugcuccacaacuccgagcagggcggucgcgccuaccggcacgcuauggaggaacugccugauaccaucgaaacacugaugcuccuugcccugaucgccgugcuaacgggcggggucacccuguucuuccuguccggccgcgggcucggcaagaccagcaucggccuacugugcgucauggcgucuagcgugcugcuguggauggccuccguggagccccacuggaucgcugccagcauuauccuggaguuuuucuugaugguuuugcugauaccggagccggaccgccaacgcacuccccaggacaaccagcucgccuacguggugaucggucuguuauucaugauccucacgguugccgcgaacgagaugggccuguuggaaaccacuaagaaggaccucggaauagggcacguggccguggagaaccauaaucaugcggccaugcuggacgucgaccuucaucccgcgucagcguggacacuguacgccgucgccacgaccaucaucacuccgaugaugcgacacaccauugagaacacgaccgccaauaucagccugaccgcuaucgccaaccaggccgccauacugaugggacucgacaaaggcuggcccauuuccaagauggacaucggcguaccccugcucgcgcucgggugcuauagccaggucaaccccuugacgcugacagccgcagugcucaugcugguggcgcacuaugcaaucaucggcccgggacugcaggcaaaggcaacgcgcgaagcccagaagagaaccgccgcuggcauaaugaaaaaccccacggucgacgggaucguggcaauagaccucgacccuguggucuacgacgccaaguucgagaagcagcugggccagaucaugcugcucauccuguguacgucacaaaucuugcucaugcggacgaccugggccuuaugcgagagcauuacccuggcaacuggcccacucaccacccugugggagggaagcccggggaaguucuggaacacgacgaucgccgugagcauggcgaacaucuuccgcgguagcuaccuggccggcgccggccucgccuuuagccugaugaaguccuuagggggcgggcgacgcgggaccggggcgcagggcgaaacucucggcgagaaguggaaacggcagcugaaccagcuguccaagucugaguuuaacaccuacaagcgcuccgguauaauggagguugaucggagcgaggccaaggagggccuuaagagaggggagacgacaaaacacgccgugagucggggcaccgccaagcugcgcugguucguggaacguaaucugguaaagcccgagggcaaggucaucgaucugggauguggucgcgggggcuggagcuacuacugugccggccucaagaaggugacagaggucaagggguacacuaaggguggcccgggccacgaggagcccaucccgauggcgacauacggguggaaccugguaaagcuccacuccggcaaggacguguucuuuaucccgcccgaaaagugugacaccuuacugugcgacaucggggagagcaguccuaacccgaccauagaggagggccggacgcugcgcgugcucaaaauggucgagcccuggcugaggggcaaccaguucugcauuaagauccugaaccccuacaugcccagcgugguggagacccucgagcaaaugcagcggaagcacggcggcaugcugguccggaacccucuaagcaggaacagcacccacgagauguacugggugucaugcgggaccggcaacaucgucagcgccgucaacaugaccucccggaugcuccucaaucgauucacaauggcccaccgcaagcccacauacgagcgggauguggaccugggcaccggcacccgccacguagcaguugagcccgagguggccaaccucgacaucaucgggcaaaggauugagaacaucaaacaugagcacaaguccacguggcacuacgacgaggacaaccccuacaagaccugggcguaccacggauccuacgaaguaaagcccaguggcucugcuuccaguaugguuaacgggguuguaaagcugcugaccaagccgugggacguuauccccaugguaacccagaucgccaugacggacaccacucccuucggccagcagcgcgucuucaaagagaagguggacacacgcacgccgaaggccaagcgcgggaccgcccagauaauggaagugaccgcgcgauggcuuuggggcuuccugagccgcaauaagaagccccggaucugcacacgcgaggaguuuacucggaaaguaagaagcaacgccgcgaucggcgcggucuuuguggacgagaaccaguggaacuccgcgaaggaggcgguagaagacgaacgguucugggaucuggugcaccgggagcgagagcuccauaagcaagggaaaugcgcgaccugcgucuacaacaugauggguaagcgugagaagaaguugggggaguucggcaaggccaaggggagccgggccauuugguacauguggcuuggugcgcgcuuucucgaguucgaggccuugggcuucaugaacgaggaccauugguucucucgggaaaauucgcuauccgguguggagggcgagggucugcacaagcucggcuacauccugcgugacaucagcaagauccccgggggcaauauguacgccgacgacaccgccgggugggauacucggaucacggaggacgaccuccagaacgaggccaagauuaccgacaucauggagccagagcacgcgcugcuggcuaaggcuauuuucaagcugaccuaccagaacaaggucgugcgcguccagcgcccggcaaagaacgggacagugauggacgugaucucccggcgcgaccagcgcggcagcggccagguuggcacuuacggccugaacacuuucaccaacauggaggcccagcugaucagacagauggaauccgaagggaucuuuagccccuccgagcucgagacccccaaucuggcagagagagcccuagacuggcucgagaaauauggaguggagcgcuugaagcgcauggccaucagcggggacgacuguguggucaagccaauugacgaccgcuucgcuacggcccugaccgcccugaacgacauggguaaagugcggaaggauaucccccagugggaacccucaaagggguggaacgacuggcagcagguccccuucugcucucaccacuuucaucagcuaaucaugaaagacggccgcgaaaucgucgugccgugucgaaaccaggacgagcuggucggccgggcccgcgucucgcagggggcgggcuggagcuuacgcgagaccgccugccuggguaagagcuacgcucagauguggcagcugauguacuuccaccggcgcgaccuccgacuggcugccaacgccaucugcagugccgugccgguggacuggguccccaccagccgaacgacgugguccauccacgcacaccaccaguggaugaccaccgaagacaugcugagcgucuggaacagaguguggaucgaggagaaccccuggauggaggacaagacccacaucucaagcugggaggacguuccguaccucggcaagcgcgaagaccaguggugcgggucucugaucggccuaaccgcccgcgccaccugggccaccaacauccagguggccaucaaccaagugcggcgccucauuggcaacgaaaacuaccucgauuacaugaccagcaugaagcgguucaaaaacgaguccgaucccgagggggcgcugugguag

SEQ ID NO: 23827 - RNA, 9879 nt, Artificial Sequence
  derived and/or modified CDS sequence (opt11) from DENV-1__FJ639682__SS-prME
agcguaacgaugcugcucaugcuuaugcccaccgcacuggcguuccaccucacuacccgggguggggagccccauaugauugugagcaaacaggagcggggaaagagccugcuauuuaagacaagcgccgggguaaauaugugcacgcugaucgcgauggaccugggugagcugugcgaggacacaaugaccuacaaguguccccgcaucaccgaggccgagcccgaugacgucgacuguuggugcaacgcaaccgacaccugggugaccuaugggaccugcagccaaacuggcgagcaccggcgggauaagcgguccguggcccucgcaccccacgucggccuggggcuugagacgagaaccgagaccuggaugagcuccgagggcgccuggaaacagauccagcggguggagacgugggcacuccgucaucccggguucacggugauugcucuguuccuggcgcacgcaaucggcacaagcaucacccagaaggggaucauauuuauacucuuaaugcuggucacccccucaauggccaugcggugcgucgguaucgguagcagagacuucguagaggggcucuccggcgccacauggguggauguagugcucgagcacgggagcugcgucacaaccauggccaaggacaagcccacccuggacauugagcuccugaagacggagguaaccaaccccgcaguguugcggaagcucugcaucgaggccaagauaucgaauacaaccacagacagccgcugcccuacucagggcgaggccacccugguagaggagcaggacgccaacuucgucugccggcgcaccuucguggacaggggcuggggcaaugguugcgggcuguuuggcaaggguucccucauuacgugugccaaguucaagugugucaccaagcucgagggcaagaucgugcaguacgagaaccuaaaguacagcgugaucgucaccguccacaccggcgaccagcaccagguggggaacgaauccacggagcacgguacuaccgccacaaucacgccccaggcccccacgaccgagauacaguuaaccgacuacggggccuuaacccuagacuguucgccccgcacgggccucgacuucaacgaaauggucuuacugaccaugaaagagaaguccuggcuagugcacaagcagugguuccuggaccugccccugcccuggacaagcggggccagcaccucccaagagacguggaaccggcaggaucugcuggugaccuucaagaccgcacacgcgaagaagcaggagguagugguccuggguagccaggagggagccaugcacaccgcucugaccggggccaccgagauccagacauccggcaccacgacgaucuucgccgggcaccugaagugccgccuuaaaauggacaagcugacccugaagggcaugagcuacgucaugugcaccggcuccuucaagcucgagaaggaaguggcggagacgcagcacggcaccgugcugguccagaucaaguacgagggcaccgacgcucccugcaagauccccuucagcacccaggacgagaagggggucacgcagaauggccggcuaauuaccgccaacccgauagucaccgacaaggagaagcccguaaacaucgaggccgagccgcccuucggggaguccuacaucgugaucggagcgggcgagaagacucugaagcucagcugguucaagaaaggguccucgaucggaaagauguucgaggccacagcacgcggggccaggcguauggccauacugggcgauacagcgugggacuucggguccaucggcggcguguucaccagcgucggcaagcuggugcaccagaucuucggaaccgccuaugguguccuguucuccggcgucagcuggacgaugaagaucgggaucgggguacugcugacauggcuuggcuuaaauucccgcucuacuucguuaagcaugaccugcauugcaguugggcuugucacgcuuuaucugggugucaugguccaggccgacuccgggugcgucauuaacuggaagggcagggaacuuaaaugcgggagcggcaucuucgugaccaacgagguucacaccuggaccgagcaguacaaauuccaggccgacagcccgaaacgccuguccgcggccauuggcaaggccugggaggaggggguuugcggcauccggagcgccacacgccuagagaacaucauguggaagcagaucuccaacgagcucaaccacauccugcuggagaacgauaugaagcugacgguggucgucggggacgucgcuggcauccuugcucaggggaagaaaaugauacggccccagcccauggaguacaaguacaguuggaaguccuggggcaaagccaagauuaucggcgccgacgcucaaaacaccaccuuuauuauagaugggcccaacaccccggagugccccgaugaucaacgcgcguggaacaucugggagguggaggauuauggauucgggaucuucacgaccaacaucuggcugaagcuacgugacagcuauacccaggucugcgaccaccgccugaugucggcagccaucaaggauagcaaggccgugcacgccgacaugggcuacuggaucgaguccgaaaagaacgagaccuggaagcuggcaagggccagcuucaucgaggugaagacuugcaucuggccgaaaagccacacccucuggagcaacggcguacuugaguccgagaugaucauccccaaaaucuaugggggcccgauuagccagcacaacuaccgccccggguacuuuacacagaccgcgggccccuggcaccuagggaagcucgagcuugacuucgaccuuugcgagggcacgaccgucguggucgacgagcacugcggcaacagagggccgucccuccgcaccaccacggucacgggaaagauaauccaugaguggugcugucggagcugcacccugccgcccuuaagguuccguggugaggacggcugcugguaugggauggagauccgcccgguuaaggaaaaagaggagaaccucgucaagaguauggucagcgccggaagcggcgaggucgauuccuucagccuugggcugcucugcauauccauuaugaucgaggagguaaugcggagccguuggucccguaaaaugcugaugaccggcacgcuggccguguucuuucuccugaucauggggcagcugaccuggaacgacuugauccgccugugcauaaugguaggcgcgaaugccagcgaccgcauggggaugggcaccacuuauuuggcucucauggcuacguucaagaugcggccaauguucgccgucggguugcuguuccgacgguuaaccucccgcgagguucugcugcucaccaucgggcugagcuugguggcgucugucgagcuccccaauagccucgaggagcugggugacgggcuugccaugggaaucaugauacugaagcugcucaccgacuuucagucccaucagcugugggccacgcugcuuagccugaccuuuauuaagaccaccuucucacuccacuacgcauggaagacgauggcgauggugcucagcauugucucccuguucccccugugccucucaaccaccucccagaaaaccacguggcuuccuguacugcuaggcagccucgggugcaagccgcugaccauguuucucauugccgagaacaaaaucuggggcagaaaguccuggccucuuaacgaggggaucauggcagucggaaucgugagcauccugcucuccucccuacucaagaacgacgugccccucgccggcccccugaucgccgggggcaugcugauagcgugcuacgugcuuagugguuccagcgcugaucugucgcuggagaaggccgcugaagucuccugggaagaggaggcagagcacuccggcgcgagccacaacauucucguggaagugcaggacgacgguacuaugaaaaucaaggacgaggagagggacgacacucugaccauuuugcucaaggccacucucuuggccgucucuggcguuuacccucucagcauacccgccacccuauucgucugguacuuuuggcagaagaagaagcagcgguccgggguccugugggacacccccaguccacccgagguggagcgagcugugcuagacgauggcauauacagaaucaugcagcgcggccuucuggggcggagccaggucgggguggggguguuccaggaaaacgucuuccauaccauguggcacguaacgcgcggcgcgguccugauguaccaagguaagcggcucgagcccagcugggccucggucaagaaggaccugaucagcuacggcggaggguggcgccugcaaggcuccuggaauaccggagaggagguccagguaaucgcgguggagcccggcaagaaucccaaaaacgugcaaaccgcccccgggaccuucaagacgcccgaaggagaggugggcgccauugcgcucgacuucaagccaggaaccagcgguuccccuauagucaaccgggagggaaaaaucgugggacuguacggcaacgguguggucaccacaucgggcacguacgugucggccauagcccaggccaaagcgucccaggaggggccgcugcccgagauagaggacgagguguuuagaaagcgaaauuuaaccaucauggaucugcaccccggcagcgggaagacgcgccgguaucugcccgccauagugcgcgaggcuaucaagcggaagcuccgcacacugauuuuggccccgacgagagugguugccuccgagauggcggaggcccucaaggggauucccauccgguaccagaccacagccgugaaaagcgagcacaccggcaaggagaucguggaccugaugugucaugccacguucaccaugcgucuguuaucucccgugcggguccccaacuacaacaugauuaucauggacgaggcacacuucaccgaccccuccuccaucgcggcccgcggguacaucagcacccgggucggcaugggggaagcugccgccaucuucaugacggcgacaccgcccggcucgguggaggccuucccacagagcaacgcagucauccaggacgaggagcgugacaucccugagcgguccuggaacagcggguacgaguggaucaccgauuucccaggcaagaccgugugguucgugccuuccauuaagagcggcaacgacaucgccaacugucugcggaagaacgggaagcgggucauccaacugucucggaagacguucgacaccgaguaccagaagaccaagaacaacgacugggacuacguugucacgacggacaucagcgagaugggcgcgaacuuccgggccgaucgcgucaucgacccgagacgcugccucaaacccgugauucugaaggacgggcccgagcgggugauucuggccggccccaugccaguaacgguggccuccgccgcucagcgacgggggaggaucggccggaaccacaacaaggagggggaucaguacauauacauggggcaaccccucaacaacgacgaggaucacgcccacuggaccgaggccaaaaugcuguuagacaacauaaacaccccggagggcaucauuccggcccucuucgaaccggagcgcgagaaguccgcggcgaucgacggggaguacagacugaggggcgaagccaggaagacguucgucgaacugaugcggcgaggggaucucccuguguggcuuuccuacaagguggccagcgaaggcuuccaguauagcgaccggcgcuggugcuucgacggcgaacggaacaaccaggugcuggaggaaaacauggacguggagaucuggaccaaggagggugagcgcaagaagcuccgaccccgcugguuagaugcgcguacuuacuccgaccccuuggcccuccgagaguucaaagaguucgcugccggccggagaagcgugaguggggaccugauccuggaaaucggcaagcucccccagcaccugacccagagggcgcagaacgcccuggacaaccuagugauguuacacaacagugagcagggugggagagcguaccggcacgccauggaggagcugcccgacacgaucgagacauugauguuauuagcgcucaucgcggugcugaccggcgggguaacccuguuuuuccucuccggcagagggcuggguaagaccagcaucggccugcugugcgucauggcauccucugugcugcuguggauggcaagcguggagccgcacuggaucgcugcaagcauaauccucgaguucuuccuuaugguccugcugauucccgagccggaccggcagcgcacaccccaggacaaccaguuagccuacgugguaaucggcuugcuguuuaugauccugaccguggccgcgaacgagauggguuuacucgaaacaaccaagaaggaccuggggaucggacauguggccguggagaaccaucaccacgcggcgaugcuggacgucgaucuccaccccgccuccgcauggacgcuguacgcgguggcaaccaccauaaucaccccgaugaugcggcacacgaucgaaaacaccaccgccaacauuagcuugaccgccaucgcgaaccaggccgccauccucaugggccuggacaagggcuggcccaucagcaagauggacaucggagugccccugcucgcucuggggugcuacagccaggucaacccucugacgcucaccgcggccgugcucauguugguggcucacuaugcaaucaucggaccaggucuccaggccaaggcgacacgcgaggcccagaagcgcaccgccgccggcaucaugaagaaccccacgguugacgggauuguggccaucgaccuagacccgguagucuacgacgcaaaguuugagaagcagcucggucagaucaugcuccugauccugugcacgagucagaucuugcuuaugcggacaaccugggcccugugcgagagcaucacgcuagccacuggcccccugaccacacugugggaagggagcccgggcaaguucuggaacacgaccaucgccgucagcauggccaauauauuccgcggguccuaccucgcgggcgccggccuugcuuuuagccuaaugaagucccucgguggugggcggagaggcaccggugcccagggcgagacccugggcgagaaguggaagcggcagcugaaccagcucuccaaaagcgaguucaacacguauaagcgcuccgggaucauggagguggaccggagcgaggcgaaggaaggcuuaaagagaggggagaccaccaagcacgccgucucccgaggcacugccaagcuccgcugguucguggagcggaaucuggugaagcccgaggggaaggucaucgaccucgguugcggcaggggcggcuggucauacuacugcgccgggcucaaaaaggugacugaagugaagggcuauacgaagggcgggcccggccacgaagaacccaucccuauggcuaccuauggguggaacuuggugaagcuccacuccggcaaagacguguucuucaucccgcccgagaagugcgacacucuguugugcgacaucggggagucuucccccaacccgacgaucgaggagggcaggacccuccgcgugcuuaagauggucgagcccugguugcgggggaaucaauucuguaucaagauccuaaacccuuacaugcccagcgugguggagacacuggaacagaugcagcgcaagcacggcggcaugcuugugcggaacccgcugucccgcaacagcacccacgaaauguacuggguuuccugcggaaccggcaacaucgugagugcugucaauaugacgucccggaugcuacucaaccgcuucacgauggcccaccgcaaacccaccuacgagcgggauguggacuuagguaccgguaccaggcauguggcgguagagcccgaaguugccaaccuggauaucaucggccagcgaaucgagaauaucaagcacgagcacaaaagcaccuggcacuacgacgaggacaaccccuacaagaccugggccuaccacggguccuacgagguaaagccgagcggcuccgcgucgagcauggucaacgggguagucaaacugcucaccaagccuugggacgugauccccaugguuacacaaauagccaugaccgacaccacacccuucggacagcagcgcgucuucaaggagaaaguugauacucgaacuccgaaggccaaacgcgggaccgcccagauaauggaagugacugcccggugguuguggggcuuuuuaagucgcaacaagaagccgaggaucugcacgcgcgaggaguucacacggaagguccgcagcaacgcggccaucggcgccguguucgucgaugagaaccaguggaacuccgccaaggaggccgucgaggacgagcgguucugggacuuggugcacagggaacgggagcugcacaagcaggggaagugcgcgaccugcguuuacaacaugaugggaaagcgcgagaagaagcucggugaguucggcaaggccaagggcagccgggccauuugguacauguggcucggcgcccgcuuccuggaguucgaggcgcugggauuuaugaacgaggaccauugguucucccgggaaaauagccucuccggugucgagggcgaagggcugcacaagcugggguauauccuccgagauauuucgaaaauccccgggggcaacauguaugccgacgacaccgcgggcugggauacgcgaaucacagaggacgaccuacagaacgaggccaagaucaccgacaucauggagccagagcaugcccugcucgcgaaggccaucuucaagcugacguaccagaacaagguagugcgcgugcagcgccccgccaagaacgggacaguuauggaugugauauccagacgcgaccagcgagggagcgggcaggucggaaccuauggccuaaacacguucaccaacauggaagcccagcugauccgccagauggaauccgaggggaucuucagucccuccgagcuggaaaccccuaaucuggccgagcgggcgcuugacuggcucgagaaguacgguguggagagacugaagcggauggccauuagcggugacgacugcgugguaaagccgaucgacgacagguucgccacggcccugaccgcgcuaaacgacaugggcaaggugcggaaggacaucccccagugggagcccuccaagggauggaaugacuggcagcagguccccuucugcagccaccauuuccaccagcugauaaugaaggacggcagggagauugucgugccgugucggaaccaggacgagcuagugggucgcgcgcgggucucccagggagcgggcuggagccugcgcgagaccgccugccugggcaagagcuacgcccagauguggcagcucauguacuuucaccgucgugaccugcggcuugcggccaacgccaucuguuccgcggugcccguggacuggguccccacgagccgcaccaccugguccauccaugcgcaccaucaauggaugaccacggaggacaugcucagcguguggaacagggucuggaucgaggagaaccccuggauggaagauaaaacccauauaaguagcugggaggacgucccuuaccucggcaagagggaagaccaauggugugguucccugaucggccucaccgcgcgcgccacuugggccaccaacauccagguggcgaucaaucaggugcggcgucugaucggaaaugagaacuacuuggauuacaugacaagcaugaagagauucaaaaaugagagcgaccccgagggggccuuaugguga

SEQ ID NO: 23828 - RNA, 9879 nt, Artificial Sequence
  derived and/or modified CDS sequence (opt11) from DENV-1__JQ287664__SS-prME
agcgugaccaugcugcucaugcugaugcccaccgccuuagccuuccaccucacgacccggggcggggaaccacacaugaucguuuccaagcaggagcggggcaaaucucugcucuucaagaccuccgcgggggugaacaugugcacccucaucgccauggaccugggcgagcugugugaggauaccaugaccuacaagugcccccggaucacggagguagagccagacgacguugacuguuggugcaacaccacugacaccugggugaccuacgggacgugcagccaaacuggcgagcaccggcgggacaaacgguccguggcccucgccccucacgucggacuggggcucgagacccgcgccgaaaccuggauguccuccgaaggugccuggaagcagauccagcggguggaaaccugggcccuccgccauccuggguucacgguuaucgcccuguuccuggcccacguaaucggcacaagcauaacgcagaagggcaucaucuuuauauuguugaugcuagugacacccucgauggccaugcgcugugugggcaucggcagccgugauuucguagaaggccuguccggcgccacguggguggacgugguccuggagcaugggagcugcguuaccaccauggcaaaggacaagcccacccucgacaucgagcuccuuaagacggagguuaccaauccggccguacugagaaagcucugcauagaggcaaagaucuccaacaccacaacagacagccgcugcccuacgcagggcgaggcgacccugguggaggaacaggaugccaacuuuguuugccggcgcaccuucguggaccgugggugggggaacggcugcggucucuuugggaaggggucccucaucacgugcgccaaguucaagugcgucacuaagcuggagggcaagaucguucaguacgagaacuuaaaguacagcgucaucgugaccguccacacgggcgaccagcaccaggugggaaacgaaucgacggagcacggcaccaccgccaccaucacgccccaggccccaacgagcgaaauacagcucacagacuauggagcguugacgcuggacugcagcccccggaccggacucgacuucaacgagaugguucugcucacgaugaaggagaagucaugguuggugcacaagcaaugguuccuggaccugccccugcccuggaccucaggagccuccaccagccaggagaccuggaacaggcaggaucugcuaguaacuuucaagacggcccacgccaagaagcaggaggugguggugcucggcucgcaggagggcgccaugcacaccgcgcugacaggggcuacggagauccagacgucuggcaccaccaccauauuugcagggcaccugaagugccgucucaagauggauaaauuaacccugaaggguauguccuacgugauguguaccgggagcuucaagcucgagaaggaggucgcggagacccagcacggcacggugcuggugcagaucaaguacgagggcacagacgcacccuguaagauccccuucuccacacaggacgagaagggggucacccagaacggcagguugauaacagcgaaccccauagugacggacaaagagaagcccgugaacauugaggccgagccgccguucggggagagcuacauagucaucggggcaggcgagaaggcccugaagcucuccugguucaaaaaagggagcuccauaggcaagauguuugaggcaacugcgcgcggagcacggcgcauggccauucugggcgacaccgccugggacuucgggagcaucggcggaguguucacuucgguggggaagcugguccaccagaucuucggcacugcauacggggugcuauucucgggcguaagcuggaccaugaagaucgggaucggcguccugcugacgugguuaggccuaaacagccgcucgacgucccuguccaugaccugcauagcugugggucucgugacccuguaccugggcguuaugguacaagcugacagcgggugugugauuaacuggaagggccgggagcucaagugcgggagcggcaucuuuguaaccaacgaggugcacaccuggaccgagcaguacaaguuccaggccgauuccccgaagcgcuugagcgcagcgaucggcaaggcgugggaagagggcgugugcggcauucgguccgccacccgccuggagaauaucauguggcggcaaauaagcaacgagcucaaccacauccugcuggagaacgacaugaaguucaccgucguggugggggaugucgugggcaucuuggcccaggggaagaagaugaucagaccgcagcccauggagcacaaauacuccuggaaguccuggggaaaggccaaaaucaucggcgcggacguacagaacaccaccuucaucauugaugggcccaauaccccggagugucccgacgaccagcgggccuggaacauuugggaggucgaggacuacggcuucgggaucuucaccaccaacaucugguuaaagcugcgugacucauacacccaggucugcgaccaccguuuaaugagcgcggccauaaaggacuccaaggcggugcaugcagacaugggcuacuggauugaaagcgagaagaacgagaccuggaagcuugcccgcgccuccuucauagaggucaagacuugcaucuggcccaagagccacacucucugguccaauggcgugcucgagagcgagaugaucauaccaaagaucuacgggggcccgauuucccagcacaacuacaggcccggguauuuuacccaaacggccggacccuggcaccugggcaagcucgagcuugacuucgaccucugcgagggcaccaccguggucguggacgagcacugcggcaaccgggggccgagccugcgcacgaccacagucaccggcaagaucauccacgagugguguugcagauccugcacguugccgccccuccgguucaagggcgaagacggcugcugguauggaauggagauccgcccugucaaggagaaagaggagaaccuggucaagagcauggugagcgcggguuccggcgaagucgacagcuucucucucgggcugcuguguaucagcauaaugaucgaggaagugaugcguucccgcuggagccggaagauguugaugaccgguacccuggcgguguucuuccugcucaucauggggcaacuaaccuggaacgaucugauccgccucugcaucauggucggagccaacgcguccgaccgcaugggaaugggcacgacauaccuggcccugauggcgaccuucaagaugcggccgauguuugcggugggucuacuguuccgcagacugaccagccgagagguccuccuucugacgaucgggcugucacugguggccagcguggagcugcccaacucccucgaagaguugggcgaugggcuggccaugggcaucaugauccucaagcugcuaaccgacuuucaguccuaccagcucugggccacauugcuuucccucaccuucaucaagacgacuuuuagccugcacuacgcauggaagaccauggccaugguccuguccaucgugagccuccugccccucugucucucaaccacgagccagaagaccaccuggcugcccgugcugcuuggcuccuugggcugcaaaccgcugaccauguuuuucaucgccgagaacaaaaucugggggcggaagagcuggccacuuaacgaggggaucauggccgucggcaucgugagcauccugcucuccagcuuacugaaaaacgacguaccccucgcggguccucucaucgcaggugguaugcuuauagcgugcuacgucaucuccgguucauccgccgaccugagcuuagagaaggccgcggagguguccugggaggaagaagcagagcauucgggcgccucccacaauauucugguggagguccaggacgacgggacaaugaagaucaaagacgaagagcgcgacgacacccugaccauucuccugaaagccacgcugcucgcggucagcggcgucuacccgcuguccauccccgcgacgcuauucguuugguacuucuggcagaaaaagaagcagcgauccgggguccuuugggacacgcccagcccgcccgaaguggagcgggcgguccucgacgacggcaucuaucggaucaugcagcgcggucugcuggggcggagccaggugggcgugggggucuuccaggagaauguguuccacacaauguggcaugugacccggggggccguccucauguaucagggaaagcggcuggagcccucgugggccuccgucaagaaagaucuuaucucuuacggcggcggguggcgucuccagggaucguggaacacaggggaagaggugcaagucauugccguggagcccggcaagaaccccaaaaacgugcagacggcgcccgggaccuucaagacccccgagggcgaggugggugcuaucgcgcuggacuucaagcccggaaccuccggcagccccaucgugaaccgggaggggaagaucgugggccuguacgggaacgguguuguuacgaccagcggcaccuacguguccgcaaucgcccaggcgaaagccagccaggaagggcccuugcccgaaaucgaggacgagguguuccgcaagcggaaccugaccaucauggaccugcaccccggcucggggaagacgaggaaguaccugccggcuaucguucgggaggcaaucaagcgcaagcugcggacccugauacucgcacccaccagaguuguugccagcgagauggcggaggcacugaaaggcaugccgauccgcuaccagacaacggccgugaaguccgagcauaccgggcgggagaucguggaucucaugugccacgccacauucaccaugcgccuccugucucccguccgugugccgaacuacaacaugaucauuauggacgaggcucacuucacagacccaucgagcaucgccgcccgugguuacauuucuacccgagugggaaugggggaggccgcggccaucuucaugaccgcgacgccgcccggcagcguugaggccuuuccgcagucuaaugcugugauucaggacgaggagcgcgauauccccgagcgcagcuggaacuccggguacgaguggaucacggauuuccccggcaagacggugugguucguccccagcaucaagucaggaaacgacaucgccaacugccuucgcaagaacgggaagagggugauccagcucucccgcaaaacuuucgacaccgaguaccaaaagacgaagaacaacgacugggacuauguggucaccacggauaucuccgagaugggcgccaacuucagggcggaccgcgugaucgacccgcggcgcugucucaagcccgucauucugaaggacgggcccgaacgagugauccucgccggacccaugccggugaccgucgcgagcgccgcccagaggcgagggcgcauaggccgcaaccacaacaaggaaggcgaccaguacaucuacauggggcagcccuuaaauaacgacgaggaucacgcccacuggaccgaggccaaaaugcugcuugacaacaucaacacacccgagggcauaauacccgcgcuguucgagccggagcgcgagaaguccgccgccaucgauggggaguaccgccugcggggagaagccaggaagacguucguggaguugaugcgccgcggggaccugcccguguggcugagcuacaaggucgcuagcgagggcuuccaauacucggaccggcgcugguguuucgauggugagcggaacaaccaagugcucgaggaaaauauggacguggaaaucuggaccaaggagggugaacgcaagaagcugaggccccgcuggcuggacgcccggacguacucugacccccucgcccugcgcgaguucaaggaauuugccgcgggcagacgcuccauaucaggagaucugauucucgagaucgguaagcugccgcagcaccugacccagagggcucagaaugcgcucgauaaucuaguuaugcugcauaauuccgagcagggugggcgcgccuaccgccacgccauggaggaguuaccggacaccauagagacacugaugcugcucgcccugaucgcgguucugacgggcggagugacccuguuuuuccugagcgggcgcgggcuggguaaaaccuccaucggccuucugugcgucauggcgagcucugccuugcucuggauggcaagcguggagccccauuggaucgccgcguccaucauccucgaguucuuccugauggugcucuuaauucccgagccugaccggcagagaacgccacaagacaaccagcuggccuacgucgucaucgggcuccuguucaugauacugaccguggcagcaaacgagaugggccuccuggagacgaccaagaaagaccuggggaucggccaugucgccguggagaaccaccaucacgcuaccaugcucgacguggaccuacauccagcgagcgccuggacgcuguacgccgucgccacaaccaucaucaccccgaugaugaggcacacuauagaaaacacgaccgcaaacaucucccucaccgccaucgccaaccaggccgcgauccuuauggggcuggacaagggauggccaauuagcaagauggacaucggcgugccccuccuggcccuggggugcuauucccaggugaacccccucacccuaacugcugcgguccugaugcucguggcccacuacgcgauaaucggcccggggcuucaggcuaaagccaccagagaggcccagaagcgcaccgcggccggcaucaugaaaaaucccaccguggacggaaucgucgcaauugaccuggacccugugguguacgacgccaaguucgagaagcagcucggccaaauaaugcugcugauacuuugcacgucgcagauucugcugaugcggacaaccugggcgcucugugaauccaucacacuugcaacggguccacugaccacccucugggaggggagcccaggcaaguucuggaacaccacuaucgcugucucuauggcuaacaucuuucgcggaagcuaccuggccggagccggccuggcguucagccucaugaagucccucgggggugggagacgcgggaccggggcucagggcgagacccuaggcgagaaauggaaacggcagcucaaucagcucaguaagucagaguucaacaccuacaagcgcucggguaucuuagagguggaccgguccgaggccaaggagggcuuacguagaggugagacgaccaagcaugccgucagccgcgggaccgcuaaacugcggugguucgucgagagaaaccuggugaagcccgaggggaaggugaucgacuugggcugugggcgcggcgggugguccuacuacugcgcggggcucaaaaaggugaccgaggugaagggauauacgaagggcggcccuggccacgaggagccaaucccaauggccacuuaugguuggaaccuggugaagcugcacuccggcaaggacguuuucuucauccccccggagaagugugacacccuccugugugacaucggggaguccucccccaacccuacgaucgaggaggggcgcacgcuacgggugcucaagaugguagaacccuggcugagagguaaucaguucugcaucaagaucuugaaccccuacaugcccuccguugucgagacccucgaacagaugcagcggaagcauggcggcaugcuggugcgcaacccgcugucgcggaacuccacccacgagauguacuggguuagcugcgguacaggaaacaucguguccgcugugaacaugaccagccgcaugcucuuaaaccgcuucacgauggcccaucggaaacccaccuacgagcgcgacgucgaccugggggccggcacccggcacguggcgguggagcccgaggucgccaauuuagacaucauuggccagcgcaucgagaacaucaagcaugaacauaaguccaccuggcacuaugacgaggacaacccuuauaagacgugggccuaccacgggucguacgaggugaagccguccggaagcgcgucgagcauggucaacgguguggugaagcugcugaccaagccuugggacguuauacccauggucacgcagaucgccaugaccgacacgacacccuuuggccagcagagggucuucaaggagaaggucgacacccgaaccccgaaggcgaagcggggcaccgcccagaucauggaggugacggcacgcuggcuguggggcuuccugagccggaacaagaagccccgcauuuguacccgugaggaguuuacgcgcaagguuagguccaacgccgcgauuggcgcagucuucguggacgagaaccaguggaauagcgccaaggaggcuguugaggacgagcgcuucugggaccugguccaccgggagcgggagcuucacaagcaggggaagugcgccacguguguguacaacaugauggguaagcgggaaaagaagcugggggaguucggcaaggcgaaagguuccagagccaucugguacauguggcuuggcgcccgguuucucgaguucgaggcgcugggcuucaugaacgaggaccacugguucagccgcgagaacucccugagcgggguggagggcgagggacuacacaaacugggcuacauccugcgggauaucuccaagauccccgggggcaacauguacgcggacgacaccgcgggcugggacacacgaaucacagaggaugaccuucagaacgaggccaaaauaaccgacauaauggagccagagcaugcccugcuggccacuagcaucuucaagcugacauaucagaacaaggucgugcgcguucaacgaccugccaagaacgggacugucauggacgugaucagccgccgugaccagcgcggaagcggccaggugggcacguacggccugaauacguuuacaaacauggaggcccagcuaauccggcaaauggagucugaggggauauucagccccuccgagcucgagacucccaaccuggccgagcgcguccuggauuggcucgagaaguauggcguagagcggcugaagcgcauggccaucagcggugacgacugcguggucaagccgaucgacgaucgguuugcaacggcgcucaccgcgcucaaugacauggggaaggugcguaaggacaucccccagugggagccuuccaagggguggaacgacuggcaacaggucccuuucuguagccaucacuuccaccagcugaucaugaaggacgggagagagaucgucgugccgugccgcaaucaggaugagcuggugggccgggcccgcgucagccaaggagcaggcuggagccuccgugagacugcaugccugggcaagagcuacgcccagauguggcaguugauguauuuccacaggcgggaccuccggcuagcggccaacgccaucuguuccgccguucccuucgacugggugcccaccucgcggacgaccugguccauucacgcgcaccaccaguggaugaccaccgaagacauguuaucagucuggaaccgaguguggaucgaggagaaccccuggauggaagauaagacgcauauauccucaugggaggacgugccguaccucgggaagagagaagaccaguggugcgguucccugaucggcuuaaccgcgcgggcgaccugggccaccaacauccaagucgccauaaaccagguaagacggcucaucggcaaugagaacuaccuagauuacaugaccagcaugaagcgcuuuaagaaugaguccgacacggagggggcgcugugguga

SEQ ID NO: 23829 - RNA, 9879 nt, Artificial Sequence
  derived and/or modified CDS sequence (opt11) from DENV-1__FJ639683__SS-prME
agcgugaccaugcugcucaugcugaugccuaccgcccuggccuuccaccucacuacccggggcggugaaccccacaugaucgugagcaagcaggagcggggcaagucgcugcuguuuaaaacaagcgcgggggugaacaugugcacacugaucgccauggaccugggcgagcugugcgaggauacgaugaccuacaagugcccacggaucaccgaggcagagcccgacgacguggacugcuggugcaacgccacugacacguggguuaccuacgggacgugcagccagaccggugagcaccggcgcgacaagcgguccguggcccucgcgccccacguuggucuggggcucgagacgcgcaccgaaacauggaugagcuccgagggagccuggaagcagauccaacggguggaaaccugggcccuccgccaccccggguucacggugaucgcccuguuccuggcgcacgccaucggcacaucaauuacccagaaggggaucauauucauccucuuaaugcuggugacccccuccauggccaugcggugcgucggaaucggcucgcgagacuucguggagggucucuccggcgccacguggguggacgucguacuggagcacgggagcugcgugaccaccauggccaaggacaagcccaccuuggauauugagcuccugaagacggaggucaccaacccagcgaucuuacggaagcucugcauagaggccaagauuuccaacaccaccacagacagccgcugccccacccagggcgaggccacccugguggaggagcaggacgcaaacuucgugugccggcggacauucgucgaucggggcugggggaacgggugugggcuguucggcaaggggucccucaucacgugcgccaaguucaagugcgugaccaaacuggagggcaagaucgugcaguacgaaaaccugaaguacagcgucaucgugaccgugcacaccggcgaccagcaccaggucgggaacgaguccacggagcacgggaccaccgccacgaucacgccccaggcccccacgaccgaaauccagcucaccgacuacggggcccugacccuggacugcagcccccgcacaggccucgauuucaacgaaauggugcugcugacgaugaaggagaaauccuggcucguccacaagcagugguuccuggaucugccgcuccccuggaccagcggggccagcacaucccaagagacguggaaccggcaggaccugcuggugaccuucaagaccgcccaugccaagaagcaggagguggucgugcucggcagccaggagggcgccaugcacaccgcacugacgggggcaaccgagauacagaccaguggcaccacaaccaucuucgcugggcaccugaagugccgccucaagauggacaagcugacccugaagggcaugaguuacgugaugugcaccggguccuucaaguuggagaaggagguggcugaaacgcagcacggcaccguacuggugcagaucaaguacgaggguacagaugcccccugcaagauuccuuucagcacccaggaugagaagggggucacgcaaaacggccggcuuaucaccgccaacccgaucgugaccgacaaggagaagcccgugaacaucgaggccgagccgccuuucggggaguccuacaucguuauaggcgcgggcgagaaggcacugaaguugagcugguucaagaaggggaguagcaucggcaagauguucgaggccaccgcccguggggcccggcgcauggcaauccugggcgauacggccugggacuucggguccaucggcggcguguucaccagcguggguaaacugguacaccagaucuucggcaccgccuacgggguccucuucuccggcgugagcuggacuaugaagaucgggaucggcgucuuacugacauggcucggccugaacucuaggagcaccuccuuuagcaugaccugcaucgccguggggcuggugacccucuaccugggcgucauggugcaggccgacuccgggugcgugaucaacuggaagggccgggagcugaagugcgggagcggcauuuucgucaccaacgaaguacacaccuggaccgagcaguacaaguuccaggcggacagcccaaagcgacucuccgccgcuaucggcaaggccugggaggaggggguaugcggcauccguucagccaccagauuagagaacaucauguggaagcagaucuccaacgaguugaaccacauccuccuugagaacgacaugaaauucaccgucguggugggggacgucgcuggcauccuggcccaggggaagaagaugauccggccucagcccauggaguacaaguacagcuggaaguccuggggcaaggccaagaucaucggcgccgacgugcagaauaccaccuucaucaucgacgggcccaacaccccggagugucccgacgaccaacgcgcguggaacaucugggagguggaggacuacggcuucgggaucuucacgacgaacauauggcugaagcugcgggacagcuacacccaggucugcgaucaccgccugauguccgccgccauaaaggacaguaaagccgugcacgccgacaugggcuacuggaucgaguccgagaagaacgagaccuggaaacucgcgcgggccagcuucaucgagguuaagacgugcaucuggcccaagucccacacgcuguggagcaacggcguccuggaguccgagaugaucauccccaagaucuacggagggccaaucucgcagcacaacuaccgccccggguacuucacccagaccgccggccccuggcacuuggggaagcuggagcuggacuucgaccuaugcgagggcaccacgguggucgucgacgagcacuguggcaaccgcgggccgucucugcgcaccaccacaguaacgggcaagaucauccacgaguggugcugccggagcugcacccugccuccccuccgcuuccgcggggaggacggcugcugguacgggauggagaucagaccugugaaggagaaggaggagaaucuugucaaaagccuugugagcgccggcagcggugagguggauuccuucagccucgggcugcugugcaucuccaucaugaucgaggaggucaugcggucuagauggucccggaagaugcucaugaccggcacccucgccguguuccugcuccugaucauggggcagcugacguggaacgaccucauccgccugugcaucauggugggcgcuaacgccagcgaucgcauggggaugggcacgaccuaccuggcccucauggccacauucaagaugcgaccaauguucgccguagggcugcuguuccggaggcucacgucccgcgaggugcugcugcucaccaucgggcucagccugguggcgucagucgagcuccccaacagccuggaggagcugggcgacggucucgccaugggcaucaugauccuuaagcugcucacugauuuucagucccaucagcugugggcaacccuccuuagccucacguucaucaagaccaccuucucccugcauuacgccuggaaaaccauggcgauggugcucagcauugucucccucuucccauugugcuuaagcacgaccucccagaagacuaccuggcugcccgugcugcucggcagccugggguguaaaccucugacgauguuccucaucgcggagaacaagaucuggggcaggcgcuccuggccgcugaacgaggggaucauggccgugggcaucgucucgauccugcucagcucccugcugaagaacgacgugcccuuagcaggaccccugaucgccgggggcaugcugaucgcgugcuacguaaucagcggguccagcgccgaccucucccuggagaaagccgcugaggucagcugggaggaggaggccgagcacucgggcgcgagccacaacauccugguagagguccaggacgacgggaccaugaagaucaaggaugaggagcgggacgacacccucaccauccugcugaaggccacccuccuggccgucuccgguguguacccgcugucgauccccgccaccuuauucgucugguauuucuggcagaagaagaagcagcgcuccgggguccugugggacacccccucaccgcccgagguagagcgggccgugcuggacgacggcaucuacagaaucaugcagcggggccugcucgggcgaucccaggucggcguggggguguuccaagagaaugucuuccacaccauguggcacgugacccggggcgcgguacuuauguaccaggggaagcgccuggaacccagcugggcuuccgucaagaaggaccuuaucagcuacggcggcggguggcggcugcaggguuccuggaacacgggggaggaggugcagguaauagccgucgagcccggaaagaaccccaagaacgugcaaacugcacccgggaccuuuaagacacccgagggcgaggugggcgccaucgcgcuggacuucaagcccgggacuagcggaagccccauaguuaaccgcgaggggaagaucgugggccucuacggcaacgggguggucaccacaagcgggaccuacgugucagccaucgcccaggcuaaggcgagccaggaggggccgcugcccgagaucgaggacgaggucuuucggaaacgaaaccugacgaucauggaucuccacccuggaagcgggaaaacucgacgcuaucugccggcuaucguaagagaggccaucaaaagaaagcugcgcacccucaucuuagcccccacccgggugguggccuccgagauggcagaggcccuuaagggcaugcccauacgcuaccagacgaccgccgucaagagcgagcacaccgggaaggagaucguggaccucaugugccacgccaccuucacgaugagacuccuguccccagugcgcgucccgaacuacaacaugauuaucauggacgaggcccacuucaccgaccccucguccaucgcggcccggggguacaucagcacccgcgugggcaugggggaggccgccgccaucuucaugacugcgacgccgcccggcucaguggaggcauuuccgcagagcaacgccgucauccaggacgaagagcgugacaucccagagcgcaguuggaacagcgggcacgaguggaucacagacuucccgggcaagaccgugugguucgugccauccaucaaguccggcaacgacaucgcuaacugccuccggaagaacgggaagcgcgucauccagcucucacggaagaccuucgacacggaguaccagaagacuaagaacaacgacugggacuacgucgugaccacagacauaucggagaugggcgcuaacuuucgcgcggacagggucaucgacccgcgccggugccugaagcccguuauccucaaggacgggccagagcgugugauccuagccggccccaugcccgucacgguggccucagccgcucagcggcgcgggagaaucgggcgcaaccacaacaaggagggcgaccaguacaucuacauggggcagccccugaacaacgacgaggaccacgcccacuggaccgaggccaagaugcuccuggacaauaucaacacccccgagggcaucauccccgcccuguucgagccggagcgcgagaagucagccgcgaucgacggggaguaccggcuccgcggagaggcccggaaaaccuucgucgagcugaugcgccgcggggaucugccgguguggcucuccuacaagguggccucugaggguuuucaguacagcgacaggcgguggugcuucgauggugagcgcaacaaccaagugcuggaagagaauauggacguggaaaucuggacgaaggagggggagcggaagaaacugcgcccccggugguuagacgcccgcaccuacuccgacccccuggcccugcgggaauucaaggaguucgcggccggcaggcggagcguguccggggaccucauccuggaaauuggcaagcugccgcagcaccuaacccagcgcgcucagaacgcccuggacaaccuggucaugcuccacaacagcgagcagggcgggcgggcuuaccgccacgccauggaggagcuccccgacaccaucgagacgcugaugcuccuggcccugaucgccgugcucaccggggggguuacccuauucuuccuguccggccgggggcucggcaagaccagcaucggccuccuguguguuauggccuccucggugcuccuguggauggcguccguggagccccacuggaucgccgccagcaucauccuggaguucuuccucaugguccugcugauacccgaaccggaccgccagcggacgccccaggacaaccaguuggccuacguggucaucgggcugcuguucaugauccucacaguugccgcgaacgagaugggccugcuggagaccaccaagaaggaccucgggaucggccauguggccguggguaaccaccaccacgccgcaaugcuggacguggauuugcacccugccagcgcguggaccuuauacgccguggccacgaccaucaucacgccaaugaugcgccacaccaucgagaacacgaccgccaacaucucccuuaccgccaucgcgaaccaggcugccauccugaugggccucgacaagggcuggcccaucuccaagauggacaucggggugccccugcuugccuuaggcugcuacucccaggucaacccgcugacucugaccgcggccgugcucaugcugguggcccacuacgccauaaucggaccgggccugcaggccaaggcgacgcgcgaggcccagaagcggaccgccgccgggauuaugaagaaucccaccgucgauggcaucguggccaucgaccucgaccccguggucuacgacgcuaaguuugagaaacagcugggccagaucaugcugcucauccuguguacgucgcagauccugcucaugcgcaccaccugggcccugugugagagcaucacccuggcgacggggccccucaccacccugugggagggcuccccggggaaguucuggaacacaacgaucgccgugagcauggccaacaucuuccggggcuccuaccuggcgggcgccgggcucgccuucagccugaugaagagccugggcgggggccgccgggggaccggcgcucaaggcgagacccugggagagaaguggaagcgucagcuaaaucaacuguccaagagcgaguucaacaccuacaagcgguccggcaucauggagguggaccgcagcgaggcgaaggagggccuaaagcggggcgagacuaccaagcacgccgucucccgugggaccgccaaacugcggugguucguagagcgcaaccuggucaagcccgagggcaaggucaucgaccugggcugcgguaggggcggguggagcuacuacugcgcaggccucaagaaggugacugaggugaagggauacacgaagggcggccccgggcacgaggagcccaucccgauggccacuuacggguggaaccuagucaaacugcacucugggaaggacguguucuucgugccgcccgagaagugcgauacccuccuuugcgacaucggagagagcuccccuaacccgaccaucgaagaggggcgcacgcugcgggucuugaagaugguggagcccuggcugcgcggcaaccaguucugcaucaaaauucugaaccccuacaugcccuccguggucgagacccucgagcagaugcagcggaagcacggcgggaugcugguccgcaacccgcugucgcggaacucgacccacgagauguacuggguguccugcgggacggguaacaucgucagcgcggugaacaugaccucccgcaugcuccugaaccgcuuuacgauggcccaccgaaagcccaccuacgaacgcgacguggaucugggcgccggcacccggcacgucgcaguggaacccgagguggccaaccuggacauaauagggcagcgcaucgagaacauaaagcacgagcacaagagcaccuggcacuacgacgaggacaaccccuacaagacgugggcguaccacgguuccuacgaggucaagccaagcggguccgccagcagcaugguuaacggcgucgugaagcugcugacaaagcccugggacgugauccccauggucacccagaucgcgaugaccgauacgacccccuucgggcagcagcggguguucaaggagaagguggacacccguacaccgaaggccaagcggggaacggcccagaucauggaagucaccgccaaguggcucuggggcuuccugucccgcaacaagaagccccggaucuguacccgcgaggaguucacgagaaaggugcgcagcaaugccgccaucggggccguguucgucgacgagaaccaguggaacuccgccaaggaggcgguggaggacgaacgguucugggaccuggugcaccgcgagcgggaguuacacaagcagggcaagugcgccacgugcgucuauaacaugauggggaagcgagagaagaagcugggcgaguucggcaaggccaagggcagccgggccaucugguacauguggcugggggcgcgcuuccucgaguucgaggcccugggcuucaugaaugaggaccacugguucucccgggagaacucccuguccggcguggaaggggaaggcuugcacaagcugggguacauacugcgcgacaucagcaagauccccgguggcaacauguacgccgacgacaccgccgggugggacacccggaucaccgaggacgacuugcagaacgaggcucgcaucacggacauaauggagccggagcacgcucuacuggccaaguccaucuucaagcucaccuaccaaaauaaggugguccgcgugcaacggcccgccaagaacggcacagugauggacgucaucucccgccgggaccagcgcgguuccggccaagugggaaccuacgggcugaacacguucaccaacauggaggcccagcugauccggcaaauggagagcgagggcaucuuuucccccagcgagcucgagacccccaaccuggccgaacgcguucuggacuggcucgagaaguacggggucgaacggcugaagcgcauggcgaucuccggcgacgacugcguugugaagccgaucgacgaccgguucgccaccgcccucacggcccuaaaugacauggggaaaguccgcaaagauaucccccagugggagccaagcaagggguggaacgacuggcagcagguccccuucugcucccaccacuuccaccagcugauaaugaaggauggccgggagaucguggucccgugccgcaaccaggacgagcuggugggacgcgcgcgugugagccagggugcgggguggucgcuccgagagaccgccugcuuaggcaaguccuacgcccagauguggcagcugauguauuuucaccgcagagaccuccgccuggccgcgaacgccaucuguagcgccguccccguggacuggauccccaccucccggaccacguggagcauccacgcccaccaccaguggaugaccaccgaggacauguugucuguguggaaccgcgucuggaucgaggagaaccccuggauggaagacaagacccauaucagcuccuggggcgacgugccguaccucggcaagcgcgaggaccaguggugcggcagccugaucgggcugacggcccgggcgacaugggcgaccaacauucagguugccaucaaccagguccgucggcucaucggcaacgagaauuacuuggacuacaugaccuccaugaaacgcuuuaaaaacgagagcgaccccgagggggcacuaugguga

SEQ ID NO: 23830 - RNA, 9879 nt, Artificial Sequence
  derived and/or modified CDS sequence (opt11) from DENV-1__FJ639684__SS-prME
agcgugaccaugcuauuaaugcugaugcccaccgcgcuggccuuccaucucaccacccguggcggggagccacacaugauuguguccaagcaggagcgcggcaagagccuuuuauuuaagaccucugcgggcgucaacaugugcacccucaucgccauggaccuuggggaauuuugcgaggauacaaugaccuacaagugcccccgcaucagcgaggccgagcccgacgacguggauuguuggugcaacgcgaccgacacaugggugaccuacgggaccugcucccagaccggcgagcaccgacgcgauaagagaagcguggccuuagcgccccaugugggccuaggguuggaaacccggacagagaccuggauguccagcgaaggcgccuggaagcagauucaacgggucgagacaugggcgcuacgccaccccggguucaccgucaucgcccucuuccuggcucacgccaucggcacguccaucacccagaaggguaucaucuucauccugcucaugcugguaacccccaguauggccaugcggugcguugggauaggcucccgggauuuuguggagggucuguccggcgcgaccugggucgacguggugcuggagcauggauccugcgugacgaccauggccaaggacaagccuacuuuagacauagaguugcucaaaaccgaggucacgaaccccgcgguccugcggaaacugugcaucgaggccaagauaucaaauaccaccacggacuccagaugcccaacgcagggcgaggccaccuuggucgaggaacaagacgccaacuuuguaugcagacgcaccuucguggaccggggguggggaaacggcugcggucuguucggcaaggggaguuugaucacgugcgccaaguuuaagugcgugacgaaauuggagggaaagauuguccaguacgagaaccugaaguacagcgucaucgugaccguccacaccggagaccagcaccagguggggaacgaaaguaccgaacacggcacgaccgcgaccaucacgccgcaagccccuuccaccgaaauucaguuaacggacuauggagcccucacccuggacuguucuccacgaacggggcuggauuucaacgagaugguccuccugacaaugaaggaaaagucuuggcugguacacaaacaaugguuccucgaccugccgcuacccuggacgucgggggcaagcaccucccaggagaccuggaaccggcaggaccuccucgugaccuucaagacggcucaugcgaagaagcaggaggugguggugcugggcucccaggaaggcgcuaugcacaccgccuuaacuggugcuaccgagauccagacguccgggacaaccacuaucuuugcagggcaccugaaaugccggcuaaagauggacaaacucacgcugaaggguaugagcuauguaaugugcacugggagcuuuaaacuggagaaggagguugcugagacccaacauggcaccgugcucguccagaucaaguacgagggaacagacgcccccuguaaaauucccuucuccacccaggaugagaagggggugacccagaacggccgacugauaaccgccaacccgauugugacggacaaggagaagcccgucaacauagaggccgagccgcccuuuggggagucguauaucgugaucggcgcgggcgagaaggcacucaagcugagcugguucaaaaaggggucuucaaucgggaaaauguucgaggccaccgcccgcggggcccgucguauggccauccucggugauacggcaugggauuucggguccauuggcggcguguucaccaguguuggaaagcuugugcaccaaaucuucgggacggccuacgggguguuauucuccggcgucucuuggacaaugaagaucgguaucggcguucuccugacguggcugggccugaauucccgcaguaccucucugagcaugacgugcaucgccguggggcucgucacccucuaucugggcguaaugguacaggcggacagcggaugugucaucaacuggaagggccgggaacugaaaugcggguccggcauuuucgugaccaaugaggugcacacauggacggagcaguauaaauuucaggcugacucgccuaagcgccucuccgccgcgaucgggaaagcaugggaggaaggugucugcggcauacggagcgcgacacgccuggagaacaucauguggaaacagaucuccaacgagcugaaccacauauuacuagagaacgacaugaaguucacggugguggucggagacguggcggggauccuggcccagggaaagaagaugauccggccccaacccauggaguacaaguacagcuggaagucuuggggaaaagccaaaaucaucggcgcugacgugcagaacaccaccuucaucaucgacgguccaaacacgccggagugcccggacgaucaaagggcguggaauaucugggagguagaggacuacggguuuggcauuuucaccaccaacauuuggcucaagcugcgggacagcuacacccaaguuugcgaccaucggcugaugucugcugccauuaaggacagcaaggccgugcacgccgacaugggguacuggaucgagagcgaaaagaacgagacguggaagcuggcgcgggcaagcuucaucgaagucaagaccugcaucuggccuaagucccacacccucuggagcaacggggugcucgaauccgagaugauuauucccaagaucuacggaggcccgaucagccagcacaacuaucgccccgguuacuuuacccagacggcaggacccuggcaccucgggaagcuggaacuggacuucgaccucugcgaggguaccacgguggucguggacgagcauugcggcaacaggggcccuucccuccgcaccacaaccguuaccggaaagaucauccaugaaugguguugccggagcuguacucuuccaccccuccgcuucaagggggaagauggcugcugguacgggauggagauccgccccgucaaggaaaaagaggagaaccuggugaagagcauggucucggccggaagcggcgaggucgacucguuuagucuggggcuacuuugcaucuccauaaugaucgaggaagucaugcgcucacgguggucccgcaagaugcuuaugacgggcacccucgccguuuuuuuccuacugaucaugggccaauuaaccuggaaugaucugauccggcugugcaucauggucggcgccaacgcgagcgaccgcauggggauggggaugaccuaucucgcauugauggccacauucaaaaugcgcccgauguucgcuguggggcuccucuuccggcgccuaaccucacgggaagugcugcuccucaccaucgggcugagccucguagcuucgguggagcugcccaauagccuagaggagcucggggauggguuggccaugggaaucaugaucuugaaacucuugaccgacuuccagucccaccagcugugggccacucuucucucucugaccuuuaucaagacaaccuucucccuucacuacgccuggaagacgauggccaugguccugagcaucgugucucuguucccccucugucugagcacuaccagccagaagacgaccuggcuucccgugcuccugggcucccuggggugcaaaccgcucacgauguuucucauagcggagaauaagaucuggggccgcaagagcuggccccugaacgaggggaucauggccgucggcaucguguccaucuugcugucaagucugcugaaaaacgacgugccacuggccgggccgcugaucgcgggcggcaugcucaucgcuugcuaugucaucucaggguccucggccgaccuguccuuagagaaagccgccgaaguguccugggaagaggaggccgagcauucgggggcgagccacaacauuuuagucgagguccaggacgacggaaccaugaaaaucaaggaugaggagcgggacgacacgcugacgauucugcucaaggccacacuuuuggccguguccggagucuauccgcucagcauccccgccacccuguucguaugguacuucuggcagaagaagaagcagcgcuccgggguacugugggauacacccucacccccugaaguggagagggcggugcucgacgacggcaucuaccgcaucaugcagcggggccugcuugggcgcucacaggugggcgugggggucuuucaggagaauguguuccacaccauguggcacguuacucggggcgcgguucugauguaccaagggaaacgccuugagcccaguugggccucugugaagaaggacuugaucagcuacggaggcggcuggcggcugcaggggaguuggaacacaggugaagaggugcaggucaucgccguggagccgggcaaaaaccccaagaacguccagacugcccccgggaccuuuaagacgagcgagggcgagguuggcgccauagcgcucgacuucaaacccgggaccaguggcucccccaucgugaaucgugagggaaagaucgugggcuuauacggcaacggggucgugaccacgagcggcacauacguguccgccauugcccaggcaaaagcgagccaggaggggccccugccagagaucgaggaugaaguuuuccgaaagcggaaccucaccaucauggaccugcacccgggguccggcaagacgcggcgcuaccugcccgcaauagugcgggaggcgauaaagcgcaaguugcgcacucucauccuggccccgacgcgaguagucgccagcgagauggcugaggcccucaagggaaugccaauccgguaccagacgacagccguuaaaucugagcacaccgggaaagagaucguggaucugaugugccacgccaccuucacaaugcgacugcucagcccaguucgcgugccuaacuacaauaugauuauuauggacgaggcccacuucaccgaucccucaagcauugcugcccggggguacauuuccaccaggguggguaugggcgaggccgccgcuaucuuuaugacagcgacgccucccgguucagucgaggccuuuccccagucgaacgcagugauccaggaugaagagcgugacaucccugagaggagcuggaauagcggguacgaguggaucacagacuucccuggcaagaccguaugguucguccccagcaucaagucuggaaacgacaucgcgaacugccugcgcaagaacgggaagcgcgucauccagcugucaagaaagacguucgacaccgaguaccaaaagaccaagaacaacgacugggacuauguuguaaccacggauaucuccgaaaugggcgcaaacuucagagcagaccgggugaucgacccccgccggugccuuaagccagugauacugaaagacgggccggagcgcgucauacucgccggccccaugccaguaaccguugccuccgccgcgcagcggcgcgggcguaucggccggaaccauaacaaagagggcgaucaguacaucuacauggggcaaccccuuaacaacgaugaggaccacgcucacuggacugaggccaagaugcugcuggauaauauaaacacgcccgagggcaucaucccagccuuguucgaacccgagcgggaaaagagugcagcgaucgauggggaguaccgccugcgcggggaggccagaaaaacguucguugagcuaaugaggcgcggagaccuccccguuuggcuguccuauaaagucgccagcgagggcuuccaguacuccgaccgccguuggugcuucgacggcgagagaaacaaccagguguuagaggagaacauggacguggagaucuggaccaaggagggggagcguaagaagcuccgccccagauggcuggacgcccgcaccuacucagacccccuggcccuccgcgaguuuaaggaguucgccgccggccgcagaagugucagcggggaccuuauccuggaaauuggcaagcucccccaacaccugacccagcgcgcccagaacgccuuagauaacuugguuaugcuccacaauucugaacaagguggccgggcguaccgccacgcgauggaagaguugccggauacgaucgagacgcucaugcuguuagcccucaucgccgugcugacaggcggggucacacuguucuuccuuuccggccgggggcucgguaagacgucuauaggucugcucugugucauggcuagcuccguuuugcuguggauggcgagcgucgagccgcacuggauugccgcuucgaucauucuggaauucuuucugaugguucuguuaauaccagaaccggaccgccagcggaccccgcaggacaaccagcuggccuacguggucaucggccuccucuucaugauucugacggucgcggcgaaugagauggggcuacuagagacuaccaagaaagaccugggcaucggccacguggccgucgaaaaccaccaucaugcagccaugcuggacguggaccuccacccggcgagcgcguggacgcuguacgcuguggcaaccacuaucaucacccccaugaugagacacacgaucgagaacacgaccgccaacaucucccugacugcgaucgccaaccaggccgccauucucaugggguuagacaaaggcuggccgaucucaaaaauggauauaggcgucccccuuuuagcccuggggugcuacagccaggugaacccccuaacucucaccgcggccguucugaugcuggucgcccacuaugcaaucauuggccccgggcuccaggccaaggccacccgggaggcccaaaaacgcaccgccgccggaaucaugaagaacccaacgguggacgggauuguagcgauugaccuagacccggucguguaugacgcgaaauucgagaagcaauugggccagauaaugcuacugauucucugcaccucacagauccuccugaugcgaacgaccugggcgcuaugcgagucaaucacccucgcaaccgguccccuuacaacccugugggaggggagcccggggaaguuuuggaacacaacuauugccgugagcauggccaacauauuccguggcucuuacuuagcaggcgccggccuggccuucuccuuaaugaaaucccucgggggcgggcgccguggcaccggugcccagggugagacccuuggcgaaaaguggaagcgccagcuaaaccagcuuagcaaguccgaguucaacacuuacaagcggucgggcaucauggaggucgacagguccgaagccaaggaaggccugaaaagaggcgagaccaccaagcacgccguuucacgcgggacugccaaacuccggugguucguggagcgcaaccucgucaagcccgaagggaaagugaucgaccuaggcugcggccgcggaggguggucauauuauugcgccgggcugaagaaggugacggaggucaagggguacaccaagggcggaccuggccacgaggagccaaucccaauggccaccuaugguuggaaccucgugaaguuacauagcggaaaggauguguucuucguaccgcccgaaaagugcgauacccuacugugugacaucggggaguccagccccaacccgacgaucgaggagggccgcaccuuacgugugcugaagaugguggaaccguggcugcgcgggaaccaguuuugcaucaagauccucaacccuuacaugcccuccgugguggagacucuagagcagaugcagcgcaaacacggcggcaugcuggugcgcaacccccucagccggaauagcacgcaugaaauguacugggucagcugcgguacggguaacaucgugucggcggugaauaugaccagccgcaugcugcugaauagauucaccauggcccaccguaagccgaccuacgaacgagauguggacuuaggggccggcacccggcacguugccguggaacccgagguagccaaucuggacauaauaggacagcguauagagaacauuaagcacgagcauaaguccacauggcauuacgacgaggacaaccccuacaaaacuugggcguaccacgggagcuacgaggugaagcccucaggcucggccucauccauggucaacgggguggugaagcugcucacaaaaccaugggacgugaucccaauggugacccaaaucgcuaugacggacaccacccccuucggccagcagcggguguucaaggagaagguggacacacgcacgccuaaggccaagcgcggaaccgcgcagauuauggaggugaccgcgaaauggcuauggggcuuucugagccgcaacaagaagccgcguauaugcacucgcgaggaguuuacgcggaaggugcgguccaacgccgccauaggcgcaguauuuguggacgagaaccaguggaacagcgcgaaggaggcgguggaggacgagcgcuucugggaucugguccaccgggaacgggagcugcauaagcagggaaagugugcgaccugcguuuacaacaugauggggaagcgagagaaaaagcuaggggaguucggcaaagccaaagggucccgagccaucugguacauguggcucggcgcccgcuuccuggaguucgaggcccuggguuucaugaacgaggaccacugguuuucccgggagaauucccugagcggaguggagggagaggggcugcauaaacuuggcuacauacuccgggacauuuccaaaaucagcgggggcaauauguacgccgacgacacggcuggcugggacacacggaucacggaagacgacuugcaaaacgaggcgaagauuaccgacauuauggagccagagcacgcacugcuggccaaaucaaucuucaaacugacauaccaaaacaaggugguccguguucagagacccgcgaagaacgggacagucauggaugugauaagccggagagaccagcggggcucuggacagguggggacuuacggccugaacaccuucaccaacauggaggcacaguugauccgccaaauggagagcgaaggaaucuucucaccgucggaacuggagacccccaaucucgccgagcgggcuuuagacuggcuggaaaagcacggcgucgagcgucugaagcgcauggccaucagcggggacgacugcguggugaagccgauugacgaucgguucgcuaccgcccugacagccuugaacgacauggggaagguccggaaagauauaccccagugggagccauccaaggguuggaacgacuggcagcagguacccuucugcucccaucacuuccaccaacugauaaugaaggacgggcgcgagaucguuguccccugccggaaccaggacgaguugguuggccgagcacgcgugucgcagggggcggguuggagccugcgcgagaccgccugcuugggaaaaucuuacgcccagauguggcagcucauguacuuccacaggagggaccugcgucuggcggccaacgccauuugcucugcggucccgguugacugggugccgaccagucgcacaaccuggagcauccaugcccaccaccaauggaugacaaccgaagacaugcuuuccguauggaaucggguguggauagaggagaaccccuggauggaggacaagacacacaucagcaguugggaggacgugcccuaccuaggcaagcgcgaggaccaguggugugggucacucaucggacucacagcacgggcuaccugggcuaccaacauccagguagccaucaaccaggucaggcgacuuauaggcaaugaaaauuaccuugauuacaugacgucaaugaagcgguucaagaaugaauccgugccugagggagcucucugguga

SEQ ID NO: 23831 - RNA, 9879 nt, Artificial Sequence
  derived and/or modified CDS sequence (opt11) from DENV-1__FJ639685__SS-prME
agcguaacuauguugcucaugcugaugccaaccgcccuggccuuccaccucacaacgcggggaggggaaccacacaugaucgugagcaagcaagagcggggaaagucgcugcuguucaagaccucagcgggggugaacaugugcacccucaucgccauggaucuuggcgagcugugcgaggacaccaugaccuacaaaugcccccggaucacagaagccgagcccgacgacguggacugcuggugcaacgcgaccgacacgugggucacauaugguaccugcagccagaccggcgagcaccggcgcgacaagcgguccguggcacucgcgccccaugucggucuggggcuagagacgcgcaccgaaaccuggaugagcuccgagggcgccuggaaacagauccagaggguugagacuugggcccucaggcaccccggguucacggugaucgcccuguucuuagcgcacgccaucggcaccucgauuacccagaaggggaucaucuucauccuccugaugcugguuacccccuccauggccaugcgguguguagggaucgggucccgcgacuucguggagggauuaaguggcgccacguggguugacguagugcuggagcacgggagcugcgugacuaccauggcuaaggauaagccgacccuugacaucgaacuccugaagacggaggucaccaacccggcuauccugcggaagcucugcauugaagccaagaucuccaauaccacuacugacucgcgcugccccacucagggagaagccacccuuguggaggagcaggacgccaacuucgugugccgccgaaccuucguugaucggggcuggggaaacggaugcgggcuguucggaaaggggucccucauaacuugcgccaaguuuaagugugugacaaaacuggagggcaagaucgugcaguacgagaaucugaaauacuccguuaucgugaccguacacaccggcgaccaacaccaagucggcaacgaguccacggagcacggcaccaccgccacaaucacgccccaggcccccacgaccgagauccagcucacagacuacggagcucugacccuggacugcagcccccgcacaggccucgacuucaacgagaugguguuauugaccaugaaggaaaaguccuggcucguccacaagcagugguuucuggaucugccgcucccguggacaagcggggccagcaccucccaggaaacguggaaccggcaagaccuccuagugacauucaagaccgcccacgcgaagaagcaggaggugguggugcucggcagccaggagggcgccaugcacaccgcucugacgggggccaccgagauucagaccuccggcaccacgacgaucuuugcagggcacuuaaagugccgccugaagauggacaagcucacucucaagggcauguccuacgugauguguaccggauccuucaagcucgagaaggaggucgcggagacgcaacacggcacggugcuggugcagauuaaauacgagggcaccgacgcccccugcaaaauccccuuuagcacccaggaugagaagggggugacgcagaacggccgucugaucacugccaacccgaucgugaccgacaaggaaaagcccgugaauaucgaggccgaaccgcccuucggggaauccuacaucguaauaggagcgggcgagaaagcgcugaagcucagcugguucaaaaagggauccaguaucggaaagauguucgaggcuaccgccaggggggcucggcgcauggcgauacuaggugauacggccugggacuuuggguccauaggcggcguguuuacaagcguggggaagcugguccaccagaucuucggcacugccuacgggguccuguuuucgggcguaagcuggaccaugaagaucgggaucggcguccugcugacguggcucggccuaaauucccgcagcaccucuuucaguaugaccugcaucgccgugggguuagugaccuuauaccucggugucauggugcaggccgacuccggaugcgugaucaacuggaaaggacgggagcugaagugcgggagcggcauuuucgucacgaacgaggugcacaccuggaccgagcaguacaaauuccaggcugacagccccaagagguuauccgccgccaucgguaaggccugggaggagggaguguguggcauccggagcgccacccgccucgagaacaucauguggaagcagaucuccaacgaacugaaucacauccuccuggagaacgacaugaaauucacgguuguggugggcgacgucgccggcauacuggcccaggggaagaagaugauacggccccagccuauggaguacaaauacagcuggaaguccuggggcaaagccaagaucaucggcgcggaugugcaaaacaccaccuucaucaucgaugggcccaauaccccugagugccccgaugaccagcgcgcguggaacaucugggagguggaggacuacggcuucgggaucuucaccacgaacaucuggcucaagcugagagacagcuauacccagguaugcgaccauaggcugauguccgccgccaucaaggacagcaaggcagugcaugccgacaugggcuacuggaucgaauccgagaagaacgagaccuggaaacuggcgagagccagcuuuaucgaggugaaaaccugcaucuggccuaagucacacacacuauggagcaauggcguacuggaaagcgagaugaucauccccaagaucuaugggggcccgaucagccagcacaacuacaggcccggguauuucacccagaccgccgggcccuggcaucucgggaagcuugaacuggacuuugaccuuugcgagggcaccacggugguuguugacgagcacuguggcaaucgggggccgucccugcgcaccaccacggugacuggcaagaucauccacgaguggugcugccggagcugcaccuuaccgccccuccgcuuucgcggggaagacggcugcugguaugggauggagauccggcccgugaaggagaaagaggagaacuuggucaaguccauggugagcgccggcucgggcgagguggacuccuucagccuggggcuccugugcaucucgaucaugaucgaggaggucaugcgcucacgcuggucccggaagaugcugaugaccggcacccuugcaguauuccugcugcucaucaugggacaguugacuuggaacgaccugauacgccugugcaucauggugggugcgaacgccagcgaccguauggguaugggaaccacguacuuggcccugauggccaccuucaagaugcgaccgauguucgccgucgggcucuuguuccgccggcugacguccagagagguacuccugcuuaccauuggccucucgcugguggcguccgucgaguugcccaacucccucgaggagcugggcgacggguuggcuaugggcaucaugauccucaagcugcugacagacuuccagucucaccagcucugggccacccugcugagccugacauucaucaagacgaccuuuucccugcauuacgccuggaagacaauggcaauggugcucagcaucgucucccucuucccccugugucugagcacgaccucccagaagaccaccuggcuccccgugcuccugggaagccuuggcugcaagccgcugacgauguuccugaucgcggagaauaagaucuggggcagacguuccuggccccugaacgaggggaucauggccgugggcaucgucucgauucuacucagcucccuccugaaaaacgacgugccucuugcggguccccugaucgcgggcggcaugcugaucgccugcuacgugaucagcggguccuccgcagaccugagucucgagaaggccgccgaggucagcugggaagaagaggcagagcacuccggcgcgagucauaacauccuggucgaagugcaagaugacgggacuaugaagaucaaggaugaggagcgggacgacacccugacgauccucuugaaggccacacugcuugcuguguccggcguguacccgcugagcauaccugccacgcuguucgugugguacuucuggcagaagaagaagcaacgcuccggugucuuaugggacacgccuagcccgcccgaaguggagcgggccgugcuggacgauggcaucuaccgcaucaugcagcguggacugcuuggucgcucccaggucggcgucggggucuuccaggagaacgucuuccacacgauguggcaugugacgcguggcgccguccucauguaccaggguaagcgccuggagcccaguugggccagcguuaagaaggaccuuaucucauacggcggcggguggaggcuccagggcucguggaacacgggggaggaaguccaggugaucgccgucgagccuggcaagaaucccaagaaugugcagaccgccccagguaccuucaagacgcccgagggagaagugggcgccauagcucuggacuucaagccgggcacgagcggcucccccaucguaaaccgcgaggggaagaucgugggacuguacggcaacggagucgucaccaccaguggcaccuacguaagcgccaucgcccaggccaaggcuucccaggaggggccgcuaccugagaucgaggaugagguguuccguaagcgaaaccuaacgauaauggaccugcacccuggcaguggcaagacucggcgcuaucucccugccauaguccgcgaggccauuaagcggaaacugcggacguuaauccuggcccccacccgggugguggcguccgagauggccgaggcccugaaggguaugccuauccgcuaccagacgaccgccgucaagucugagcauacugguaaggagaucguggaccugaugugccacgcaaccuucacaaugcggcuccugaguccagucagggucccgaauuauaacaugaucaucauggacgaagcucauuucaccgacccaagcuccaucgccgcacggggguacaucagcacgcgcgugggcaugggugaggccgccgccaucuuuaugacagcuacgccgccaggcuccguggaggccuucccgcagagcaacgccgucauccaggacgaggaacgggacauucccgagcgauccuggaacagcggguacgaguggauaaccgacuucccugggaagaccguaugguucguucccuccaucaagagcggcaacgacaucgccaacugccugcggaagaacgggaagcgcgugauacagcucucacggaagaccuucgacacagaguaccagaagacgaagaacaacgacugggacuauguggucacuaccgauaucagcgagaugggugcgaacuuccgcgccgaccgggucaucgacccgcgacggugcuugaagcccgugauacuaaaggacgggccagagcgcgugauccucgccggcccgaugccagugacgguggccuccgccgcgcaacggcgcggucgcaucggucgcaaccacaacaaggagggagaccaguacaucuacaugggucagccccugaacaacgacgaagaccaugcccacuggaccgaggccaaaaugcuacucgacaacauaaacacacccgaaggcaucauccccgcccucuuugaaccggagcgggaaaaguccgccgccaucgacggcgaguaccggcugcgcggagaggcucgcaagaccuucgucgagcuaaugcgccgcggcgacuugcccgucugguuauccuacaagguggccagcgaaggcuuccaauacagcgaccgucgguggugcuucgacggcgagcguaacaaccaggugcuugaggagaacauggacgucgaaaucuggacgaaggagggcgagaggaagaaguuaagaccccguuggcuggacgccagaacauacucagacccccucgcgcugagggaguucaaggaguucgcagccggccgccggagcgugagcggggaccugauacuggagaucggcaagcugccucagcaccucacccagcgcgcacaaaacgcccucgacaaccuggucaugcugcacaauagugagcagggugggagagcguaccgucacgccauggaggagcucccagacaccauugagacacuaauguuacuugcccugaucgccgugcugaccggcggcgugacccucuucuuccugucaggcagaggacuggguaagaccagcauaggccuccugugugucauggccaguagcgugcugcucuggauggcgaguguggagccgcacuggaucgccgcgagcaucauccuggaguucuuccuaaugguccuccugauccccgagccggaccgccagaggacgccucaggacaaccagcuggccuacguggugaucggcuuacuguuuaugauacugacgguagccgccaacgagaugggccuccuggagaccaccaagaaagaucuggggaucggacacguggcggccgggaaccaccaccacgccgcaauguuagauguugaccugcaucccgcguccgccuggacccuguacgccgucgcaacgaccaucaucaccccaaugaugcgccacaccaucgagaacacgaccgccaacaucagccucaccgcuauagcaaaccaggccgcuauccugaugggccuggacaagggguggcccaucagcaagauggauaucggggugccccuucucgcgcugggcugcuacucacaggugaacccacucaccuugacggcggccgugcugaugcucguggcccacuacgccaucauugggccuggccugcaggcgaaggcuacccgcgaggcccagaagaggacagcggccgggaucaugaagaacccuaccguggacggcauagucgcgaucgacuuagacccagugguguacgacgccaaguucgagaagcagcucggccagaucaugcugcuaauccucugcaccucgcagauccuguuaaugagaaccaccugggcccucugcgagagcaucacccuggccacggggccucugacuacgcucugggaggguucgccggggaaguucuggaacaccacgaucgccguaagcauggcgaauaucuuccgggguuccuaccuggccggcgccgggcuggccuucagugugaugaaauccuuaggcggggguaggcgggggaccggcgcgcaaggcgaaacccugggggagaaguggaagcgccaauuaaaccagcucuccaagagcgaguucaacacauacaagcgauccggcaucauggagguggaccgcagcgaggccaaggaggggcugaaacggggagagacgaccaaacacgccgucucccgcgggacggccaagcuucggugguucgucgagcgcaaccucgugaagcccgaaggcaaggucaucgaccuggggugcgggcggggaggguggagcuauuacugcgccggccugaagaaggugacagaggugaaaggguacacgaagggcgggcccggccacgaggagccgauuccgauggcgaccuacggcuggaaccuggucaagcugcacuccgggaaagacguguuuuucgugccgcccgagaagugcgacacuuuguuaugugauauuggcgagaguucccccaacccuaccaucgaggagggacgcacgcuccgcguccugaagaugguggagcccuggcuacgcggaaaccaguucugcaucaagauccucaacccguacaugccgagcgugguagagacgcuggaacagaugcaacggaagcauggcgggaugcucgugcggaacccgcucucccggaacucgacccacgaaauguacuggguuucuugcggcaccgguaacauagucucagccgugaacaugacuucccggauguugcuuaaccgguucacgauggcccaccggaagccaaccuaugagcgugacguggaccucggcgcagggaccaggcacguagccguggagcccgagguggcgaaucuggacaucaucgggcagcgcaucgagaacaucaagcacgagcacaagagcaccuggcacuacgacgaggacaaccccuacaagacgugggccuaucacggcucauacgagguaaagccgagcggcuccgccagcagcauggugaacggcguugugaagcugcucaccaagcccugggacgucauccccauggucacccagaucgccaugacugacacgacacccuuugggcagcaacggguuuucaaggagaagguggacacccgcacaccgaaagccaaacguggcacugcacagaucauggaggucaccgccaaguggcuguggggcuuccugucccggaacaagaagccccguauuugcacucgcgaggaauucacccggaagguucgcuccaacgccgccaucggggcgguuuucgucgacgagaaucaguggaacuccgccaaggaggccgucgaggacgagcgguucugggaccuagugcaccgcgagcgggagcugcacaagcagggcaagugcgccacgugcguauacaacaugaugggaaagcgcgagaagaagcucggagaguucgguaaagccaagggcagccgcgcgauuugguacauguggcucggagcgcgguucuuagaguucgaggcccugggauucaugaaugaggaccacugguucucccgugagaauagccucuccgguguggagggggagggccugcacaaguugggguacauucuccgcgacaucucaaagauccccggcggaaacauguacgccgacgacacugcggggugggauacccggauaaccgaggacgaccuccagaacgaggcccgaaucacggauaucauggaaccggagcacgcgcugcuggccaaguccaucuucaagcugaccuaccagaacaagguaguccgcguacaacggccggccaagaacggcaccguuauggacgucaucagccgacgggaccagcgcgggaguggucaggugggcaccuaugggcugaauacguucacaaacauggaggcccagcucauccgacagauggagagcgagggcaucuucucccccagugaacuagaaaccccgauccuggcugagcgcgugcucgacuggcuggagaaguacggcgucgagcgccugaagagaauggcuauauccggcgacgacugugucguaaagccgauugacgaccgguucgccacugcacucacggcccugaaugacauggggaagguccgcaaagauauuccccagugggaacccucuaaaggcuggaaugacuggcagcaggugccguucugcucccaccacuuucaucagcugaucaugaaagacggccgggagaucguggucccgugccgcaaccaagacgaacucgucgggagggcgagagugucacagggcgccggauggagcuuacgggagacagccuguuuaggaaaaucuuacgcccaaauguggcagcucauguacuuccaccgcagagaccugcggcuugcagccaacgccaucugcagcgcaguccccguagacuggaucccuacaucccggacgacguggagcauccacgcccaccaucaguggaugaccacugaggacaugcucucgguguggaaccgcgucuggaucgaggaaaaccccuggauggaggacaagacccacauaagcuccuggggcgacgugcccuaccucggcaaacgcgaggaccaguggugcggcagucugaucggcuuaacggcgagagccaccugggcuacgaacauccagguggccaucaaccagguccgccgcuugaucgggaacgagaacuaccuagauuacaugaccucgaugaagcguuucaagaaugagagcgacccugagggggcccucugguga

SEQ ID NO: 23832 - RNA, 9879 nt, Artificial Sequence
  derived and/or modified CDS sequence (opt11) from DENV-1__FJ639686__SS-prME
agcgugaccaugcugcuaauguugaugcccaccgcccuugccuuccaccugacuacccggggcggggaaccccacaugaucguuagcaagcaggaacgggggaaaucgcugcuuuucaagacgucagccggggugaauaugugcacccuuaucgccauggaccugggcgagcuaugcgaggacaccaugaccuacaagugcccccgcaucaccgaggcggagcccgaugacguggauugcuggugcaaugccaccgacacuugggugaccuacgggaccugcagccaaaccggcgagcaccggagggacaagagauccguggcccucgcgccccacguggggcugggacuggagacgcgcaccgagaccuggaugucauccgagggcgccuggaagcagauucagcggguggagaccugggcccuccgucaccccggauucacggugaucgcgcuuuuccuggcgcacgccaucggcaccagcaucacacagaaagggaucaucuucaucuugcugaugcuggugacccccaguauggccaugcggugcgucggaaucggcucgcgcgacuucguggagggacucucaggagccaccuggguggaugucgugcuggagcacgguuccugcgugacuacaauggccaaggacaaaccuacgcuggauaucgaacuccugaagacggagguuacaaaucccgcgauacugcgcaagcucugcaucgaggccaagaucucgaauacgaccacggacagccgcugucccacucagggcgaggccaccuugguggaggaacaggacgccaauuucguaugucgacgcaccuucgucgaucgggggugggggaacggcugugggcuguucggcaaggggagucucaucacgugcgccaaguucaagugcgugaccaagcuggagggcaagaucgugcaguacgagaaccugaaguacagcguaaucgugaccgugcauaccggcgaucagcaucaggucgguaaugaguccaccgaacacggcaccaccgcgaccaucacuccccaggcccccacgaccgagauccagcuuaccgacuacggggcccugacccuggacugcagcccccgcacgggccuugacuucaacgaaauggugcuccugacuaugaaagagaaguccuggcucguacacaagcagugguuccuggaccugccccuacccuggaccaguggagccagcacuucccaggagacauggaaccggcaggacuuacuggugaccuucaaaaccgcccacgcaaagaagcaggaggucgucguauuggguagccaggagggagccaugcacaccgcgcugacgggggcuacggagauccagaccuccggcaccacgacuaucuuugccgggcaccugaagugccgccucaagauggauaaguuaacccugaaggggaugagcuacgugauguguaccggguccuuuaagcuggagaaggaagucgcggagacucagcacggaaccgugcuggugcagaucagguacgagggcaccgaugccccauguaagauccccuuuucuacccaagaugagcgcgggguaacgcagaacggccggcugaucaccgccaacccgaucgugaccgacaaagagaagcccgugaacaucgaggccgagccgccauuuggcgaaaguuacaucguaaucggcgcgggcgagaaggcccugaaguugagcugguuuaagaagggauccagcaucggcaagauguucgaggccacugcccgcggcgcccgacgaauggcgaucuuaggcgacacggccugggacuucggguccauaggcggaguguucaccagcguagguaagcugguccaucagaucuucggcacugcauacggaguccucuucuccggcguuagcuggacgaugaaaauaggcauuggaguccuguuaacguggcucggccucaauucccgcagcacaucuuuuagcaugaccugcauagccguggggcuugucacccucuaucugggugucaugguacaggccgacagugggugcguuauaaacuggaaggggcgggaauuaaagugcgggagcggcaucuuugucacgaacgaggugcauaccuggaccgaacaguacaaguuccaggccgauagccccaagcgccuguccgccgccaucggcaaggcgugggaggaggggguaugcggcauccgguccgccacccgacuggagaacauuauguggaaacagauuaguaacgagcugaaccacaucuugcuagagaaugacaugaaguuuaccgucguggugggggacguagcgggcauccuugcccaggggaaaaagaugauccggccccagcccauggaguacaaguacagcuggcgcuccuggggcaaggccaagaucauuggcgccgacgugcaaaacacgaccuucaucaucgacgggcccaacaccccggagugcccugacgaccagcgggcguggaauaucugggagguggaggacuacgguuuugggauauuuaccaccaacaucuggcugaagcugcgcgauuccuauacacaagucugcgaccaccggcugaugagcgccgcaauaaaggacagcaaggccgugcacgccgacaugggcuacuggaucgaguccgagaagaaugagaccuggaaacucgcgcgcgcgagcuucaucgaagugaagacuugcaucuggcccaagucccauacgcuguggagcaacggcguccuggaauccgaaaugauuauucccaagaucuacgggggcccuaucagucagcacaacuaccguccuggguauuucacccagaccgccggccccuggcaccucgggaagcuggagcuggauuuugaccucugcgagggaacgacgguggucgucgacgaacacugcggcaaccgcgggccgucccugcggaccaccaccgugacgggcaagaucauccacgagugguguugccgaagcugcacauuaccuccccuccguuuccgcggugaggacgggugcugguacgggauggagauccggcccgucaaagagaaggaggaaaaccuggucaaguccauggugagcgccggcagcggcgagguggacuccuucucgcucggacuccuauguaucuccauaaugaucgaagaggucaugcgcagccgcugguccagaaagaugcuuaugaccggcacauuggccguguuucuucugcucaucauggggcaacugacguggaaugaucuuauccgacuauguaucauggugggugcgaacgccucagaccggauggggaugggcaccaccuaccuugcccugauggcaaccuuuaagaugcguccgauguucgcagucgggcuccucuuccggcgccugacgucgcgggagguucuauuacugacaauagggcucagcuuaguggccuccgucgaguuacccaauagccuugaggagcugggggacggccuggcuaugggcaucaugauccucaagcuacuuaccgacuuucaaucccaucagcucugggccacccugcugucacucacguucauaaagacaaccuuuucccugcacuaugccuggaagaccauggcaauggugcugucaaucgucucccucuuuccgcugugccucuccacgaccucacagaagaccaccuggcuccccguccuguugggcagccucggauguaagccgcuaaccauguuccugaucgccgagaacaagaucuggggccgccgguccuggccccucaaugaggggauuauggccguggguaucgucucaauauuacugucgucgcuccugaagaaugacgugccccuggccgggccccucaucgcgggcggcaugcugaucgcgugcuacguaaucucgggguccagcgcugaccugucgcucgagaaggccgccgaggucagcugggaggaggaggccgagcauuccggagcgagccauaacauccugguagagguccaggacgacggaacaaugaagauaaaggacgaggagagagacgacacccucaccauccuccugaaggccacgcugcucgcaguuuccggaguguacccacuuagcaucccugcaacguuauucgugugguacuucuggcagaagaagaagcagcgcuccggaguccuaugggauacuccuucgccgcccgagguagagcgcgccgugcuggaugacgguaucuaccguaucaugcagcguggccugcuggggcggucccaggucggagugggaguguuccaggagaacgucuuucacacuauguggcacguuacccguggcgccgugcucauguaucaaggaaaacggcuggagcccucgugggccucagucaagaaggaccucauuuccuauggcggcgguuggcgccuccagggauccuggaauacgggggaggagguccaggugaucgcugucgagcccggcaagaaccccaaaaacgugcagaccgcacccgggaccuuuaagacccccgagggugaggugggcgcgaucgcgcuggacuucaagccaggaacgucuggcucccccauugucaaccgggaagggaaaauagugggccucuacggcaacgggguggucacgaccaguggcacauacgugagcgccaucgcacaggccaaagcaucccaagaggggccucucccugagauugaggacgagguguuccgcaagcggaaccugacgaucauggaccugcaccccggaagcgggaaaacccgccgcuaucuccccgcuaucguccgagaggccauuaagagaaagcugcggaccuuaauccucgcccccacgcgcgucguagccuccgagauggccgaggcccuuaaaggcaugccgauccgguaccagacgaccgccgucaagagcgagcacaccgggaaggagaucguggaccuaaugugccacgccaccuucaccaugcgccuccugucccccguacgggucccgaacuacaacaugauuaucauggacgaggcccacuuuaccgacccgaguuccaucgcggcccgcggguauaucagcacccgggugggaaugggggaggccgcugcaaucuucaugaccgcgacgccacccggcuccguggaggcguucccgcaaagcaacgcagucauccaggacgaggagcgcgacaucccagagcggucguggaauagcggcuacgaguggaucaccgacuuccccggcaaaaccgugugguucgugccauccaucaagagcggcaacgacauagcgaauugccuccguaaaaacgggaagagagucauacaguuaucacgaaagaccuucgauacggaguaccagaagacaaagaacaacgacugggacuacguggugaccaccgacauaagcgaaaugggugcgaacuuccgcgccgaccgcgucaucgacccgcggcggugucugaagcccgugauccugaaggacgggcccgaacgagugauccucgccggccccaugccggucacgguggcuuccgccgcacagcgccgcgggaggaucggccgcaaccacaacaaggaaggcgaccaauacaucuacauggggcagccucugaacaacgacgaggaccacgcccacuggacugaggccaagaugcuguuagacaacaucaacacgccugagggcaucaucccugcgcuguuugagccggagagagagaaguccgccgcgaucgacggcgaguaccguuugcggggcgaggcaagaaaaaccuuugucgagcucaugaggcgcggggaucugcccgucuggcugaguuacaaaguugccagcgagggguuccaguacagcgauagacgcugguguuucgacggugagcggaauaaccagguccucgaagagaacauggauguggagaucuggacgaaggagggggagcggaagaaacugagaccccgcuggcuggaugccagaaccuacuccgacccccucgcguuaagggaguucaaggaguucgcggccggccgaagaucuguguccggggaccugauacuugagaucggcaagcucccccagcacuugacccagcgcgcccagaaugcucucgacaaucuagucaugcugcacaacagcgagcaagggggucgagcguaccggcacgccauggaggagcucccugauaccaucgagacgcugaugcuacucgcucugaucgccgugcugaccgguggggugacccuauuuuuccugaguggcagggggcugggcaagaccagcauaggccuccugugcguaauggcuuccucugugcugcucuggauggccuccguugagccccacuggaucgcugccuccaucauccuggaguuuuuccugaugguccuccugauccccgagccggaccgccaacggacaccccaggacaaccaacuugcguacgugguuauuggguugcuauucaugauacugacggucgccgcgaacgagaugggccuuuuggagacaaccaagaaagaccugggcaucggccacguugcaguggggaaccaucaccacgccgccaugcucgacgucgaccugcaccccgcuuccgcuuggaccuuauaugccguggccacgacuaucaucacccccaugaugcgccacaccauagaaaacacgaccgccaacaucagucucaccgcuauagccaaccaggccgcaaucuugaugggccuggacaagggcuggcccaucaguaagauggacauagggguacccuugcuggcccuuggcugcuauagccaggugaacccauuaacgcugacggcggcggugcugaugcucguagcacacuaugccaucaucgggccuggccugcaggcgaaagcuaccagagaggcccagaagcgcaccgcggccgggaucaugaagaaccccaccgucgacggcauaguggcuaucgaucuggaccccgugguauacgacgcgaaguucgagaagcagcucggacaaaucaugcugcuaauucucugcacgucccagauccugcuaaugcggaccaccugggcgcucugcgagagcauaacacuggccacuggccccuuaaccacacucugggagggcuccccggggaaauucuggaacacaacgaucgccgugagcauggccaacaucuuccggggcuccuaccuggcgggcgccgggcuggccuucagccucaugaagucucugggcggagggcgccgaggaaccggggcccagggcgagacccuaggugagaaauggaaaagacagcucaaccagcuguccaagagcgaguucaauacauacaaacgguccggcaucauggagguggaucggagcgaggcuaaagaaggucugaagagaggugagaucacgaagcaugccgucucccgggggaccgccaagcuccgcugguucguggagcggaaccuggugaaacccgaaggcaaggucaucgaccugggcugcgggcgcggcgggugguccuacuacugcgccggccugaaaaaggugaccgaggucaaggguuacaccaagggcgguccugggcaugaggagcccaucccaauggccacguauggauggaaccuuguuaaacuucacuccggaaaggacguguucuucgugccgcccgagaagugugacaccuugcucugcgacaucggcgagagcuccccgaauccaaccaucgaagaggggcggacgcugcgaguccugaaaaugguagagcccuggcuccggggcaaccaguucugcaucaagauccugaaccccuacaugccaucuguggucgagacacuggagcagaugcagcgaaagcacggugguaugcucgugcgcaacccguuaucccggaacagcacccacgagauguacuggguaucauguggcaccgggaacaucguuuccgcugugaacaugacaucccgcauguugcucaaccgguucaccauggcccaccgcaagcccaccuaugaacgggacguagaccugggcgccgggacccgccacgucgccguggagccggaaguggccaacuuagacaucauagggcagaggauagagaacaucaagcacgaacacaaaucgacauggcacuacgacgaggacaaccccuacaagaccugggcguaccacggcaguuaugaggucaagccaucaggcuccgcuagcagcauggugaacggcguggugaagcuccugaccaagcccugggauguuauccccauggucacccagauugccaugaccgauaccacgccauucgggcagcagcgcguguucaaggaaaaagucgacacccggaccccgaaggccaagcgcggcaccgcgcagaucauggaggucacggcaaaauggcucuggggcuuucuaucucguaacaagaaaccccguaucuguacccgugaggaguucaccaggaaggugcggagcaacgccgccaucggggccguguucguugacgagaaccaguggaacucugcgaaggaagccguagaggacgagcgcuucugggaccugguccaccgggagcgcgaguuacacaagcagggcaagugcgcgaccugcgucuacaacaugauggggaagcgagagaagaagcucggcgaguucggaaaggccaagggcagccgcgcuauuugguacauguggcuaggcgcgcgauuccuggaguucgaggcacucggcuucaugaacgaggaccacugguucucgcgggagaacagccuguccggcguggagggggagggucugcacaagcucggauacauccugcgcgacaucaguaaaaucccuggcggcaauauguacgccgacgacacggccgguugggacacacggauuaccgaagacgaucugcagaaugaggcuaggaucacagacauaauggagccagaacacgccuuauuagccaaaagcaucuucaagcugacauaccagaacaaggugguccgggugcagcgcccagcuaaaaacggcaccgugauggaugugaucagccgacgcgaccaacgcggguccggacagguggggaccuacggucucaacacauucacgaacauggaggcccagcugauccgccagauggagagcgagggcaucuuuuccccaagcgagcucgagacgcccaaccuugccgagagggugcuggacuggcuggaaaaauaugggguagagcgccucaagcggauggcgauauccggcgacgacugcguggugaagccaauagacgaucgcuucgcgaccgcucugacugcccugaacgauauggggaagguccggaaggacaucccccaaugggagcccaguaagggauggaaugacuggcaacagguaccauucuguagccaucacuuccaccaacucaucaugaaggacggcagggaaaucguggucccgugucgaaaccaggacgaguuaguggggcgcgcucggguuucccagggugcgggauggagccugcgcgagacugccugccucggcaaauccuaugcgcagauguggcagcugauguacuuccaccggagggaccuacgccuugccgcaaaugcuauaugcagcgccgucccuguggauuggauccccacgagccggaccaccuggagcauacacgcgcaucaccaguggaugacuaccgaggacaugcuguccguuuggaaucgcgucuggaucgaggagaaccccuggauggaggacaaaacccacaucagcuccuggggcgacgugccguacuugggcaagcgggaggaucaguggugcggcagccuaauaggucugaccgcgcgcgcgacaugggcaaccaacauccagguggccauaaaccaaguccguaggcugaucggcaacgagaacuaccucgacuauaugacuuccaugaagcgguucaagaacgagagcgaccccgagggggcccugugguga

SEQ ID NO: 23833 - RNA, 9879 nt, Artificial Sequence
  derived and/or modified CDS sequence (opt11) from DENV-1__FJ639687__SS-prME
ucagugaccauguugcugaugcugaugcccaccgcccuggcauuccaucuuaccacacggggcggcgagccccacaugaucgugucgaagcaggagcguggcaagagucuccuguucaagaccagcgcaggagugaacaugugcacccucaucgccauggaucugggcgaguucugcgaagauaccaugaccuauaaguguccgagaauuagcgaggccgagccagaugacguggacugcuggugcaacgcgacagauaccugggucacuuacgggaccugcucccagaccggggagcaccggcgcgacaagcggagcguagcccuugcgccccacguuggacucggguuggagacccggacugagacguggauguccuccgagggggccuggaagcagauccagcggguggagacgugggcccugcgccacccaggguuuacagugaucgcccuauuucuggcccacgccaucggcacgucgauuacccagaagggcaucauauucauccugcuuaugcuggugaccccgagcauggcuaugagaugugucggcaucggcuccagagauuuuguggaagggcuuagcggcgcuaccuggguggacgucgugcuagagcacggauccugcgugacaaccauggccaaggacaagcccacacuggacaucgaguugcuaaagaccgaagugacgaaccccgcgguauugcguaagcugugcaucgaggccaagauaagcaauacgacaacagacagucggugcccuacgcagggagaggcaacgcucguggaggagcaagacgccaacuucgucugccggcgcaccuucguggacaggggcugggggaacgggugcgggcuguucgggaagggaagccugaucacgugcgccaaguucaagugcgugaccaagcuugaaggaaagaucgugcaguacgagaaccugaaauacuccgucaucgugacugugcauaccggcgaucaacaccaggugggaaacgagucgacugagcacggcacgacagcuaccaucacgccccaggccccuuccacggagauccagcucacagauuacggcgccuuaacccuggacuguagcccacgcaccggacuagacuuuaacgagaugguccuccugacaaugaaggaaaaguccuggcugguucacaagcagugguuucucgaccugccgcugccguggacguccggggccuccaccucccaggagaccuggaaccggcaggaccuccuggugaccuuuaaaacggcgcacgcgaaaaagcaggagguggugguucugggaagccaagagggagccaugcacaccgcgcugaccggggccaccgagauccagacguccggcaccaccaccauuuucgcagggcaccucaagugccgccugaagauggacaaauugacgcugaagggcaugaguuacgucaugugcaccggguccuucaagcuggagaaagagguggcggagacccagcacggcaccguguuaguccaaaucaaguacgagggcacggacgcccccugcaagauaccguucagcacgcaagacgagaagggagugacccagaacggccggcugaucaccgccaacccuauagugacagacaaagaaaagcccgucaacaucgaagccgagccgccguucggggaguccuauaucguuauaggcgcgggcgagaaagcccugaaguugagcugguucaagaaaggguccagcaucggcaagauguucgaggccaccgcuaggggggcccggcgcauggcuauccucggagacaccgccugggauuucggguccaucggcggcguauucacuagcguggggaaauuaguacaccagauuuucggcacggccuauggggugcuguucucgggagucagcuggaccaugaaaaucgggauaggcgugcuacuaacuuggcugggauugaauagccguagcacgucccuuagcaugaccugcaucgcaguagggcuggugacacuauaccugggcgugaugguccaggcagauagcgggugcgucauuaacuggaagggccgggaauugaagugcgggagcggcauauucguaaccaacgaggugcacacguggacggagcaguacaaguuucaagcggauagcccgaagagauuauccgccgcuaucggcaaggccugggaggaaggcguuugcggcauccguagcgcuacacgccuugagaacauaauguggaaacaaauaucuaacgagcugaaccacauucuccuggagaacgacaugaaguucaccguuguggucggugacgucgcgggcauacuggcgcaggggaaaaagaugauccguccccagcccauggaguauaaguauagcuggaagucaugggguaaggcgaaaaucaucggcgccgacgugcagaacaccaccuucaucauugaugguccaaacacgccggagugcccagacgaccagcgcgcguggaacaucugggaggucgaagacuacggcuucgggauauucaccaccaacaucuggcucaagcugcgggacagcuacacccagguaugugaccaccgcuuaaugucagccgccaucaaggacagcaaggcggugcacgccgacaugggcuauuggaucgaguccgagaagaacgagaccuggaaacucgcucgggcuucguucaucgaggucaaaaccuguaucuggcccaagucccacacccuauggagcaacggggugcuggaguccgaaaugaucauccccaagaucuauggggggcccaucucccagcacaacuaccgccccggguacuucacgcagacggcuggccccuggcaucucgggaagcuggagcuggacuuugaccugugcgagggcaccacuguggucguggacgaacauugcggcaaccgggguccgagucugcgcaccacuaccguuacuggcaagaucauacacgaguggugcugcagaagcuguacccuuccuccccugcgguuuaagggggaggacggcugcugguacgggauggagauaaggcccguuaaggaaaaggaagagaaccucguuaagagcaugguguccgcgggcagcggcgaagucgacaguuucagcuuagggcuccucugcaucuccaucaugaucgaggagguuaugcgcagcagauggagucgaaagaugcugaugacgggcacccucgcgguguuuuuccuguugauaauggggcaguugacguggaaugaccugauccguuugugcaucauggugggagcgaacgccagcgaucggauggguaugggaaugaccuaccuugccuuaauggcgacguucaagaugcggccgauguucgccgucggcuuacuauuccggaggcugaccucacgggaggugcugcuccugaccaucgggcugucacucgucgccaguguggaacugccuaacucacuggaggagcucggcgacggauuggccauggguauuaugauccugaaacuucugaccgacuuccagucccaccaacuaugggcuacacuccugagccugacuuucaucaagaccacguucucccuccauuaugccuggaaaacgauggcgaugguccucagcaucguaagucuguuccccuugugucugaguaccaccucccagaagaccaccuggcuacccgugcuccuggguagccugggguguaaaccguugacuauguuccugaucgcggagaacaagaucuggggccgcaaguccuggccacugaaugaggggauaauggcggucgguaucguauccaucuugcucagcucgcuccucaagaacgacgugccauuggccgggccccugaucgcuggcggcauguuaaucgcgugcuacgucaucagcggcucaucggcggaccuaucuuuagagaaggcggccgaggugucaugggaggaggaggccgaacacuccggcgcgucccacaacauccucguugagguucaagacgacgggaccaugaagauaaaggacgaggagcgcgaugacacgcugaccauccugcucaaagccacacugcuggcgguuucaggcguguacccacucagcaucccggcgacacuguucgugugguauuucuggcaaaaaaagaagcagcgcuccgggguguugugggacaccccgagcccacccgagguugagcgggccgucuuggacgacgguaucuaccgcaucaugcaacggggccuacuggggcgcucccaagugggcguggguguuuuccaggaaaacgucuuucauacaauguggcaugugacgcguggcgcgguucugauguaccaggggaagcgccuugagccaagcugggccucagugaagaaggaccugauuagcuauggcgguggguggcggcugcaagguuccuggaacaccggggaggaggugcaggucauagccguggagcccgguaagaaccccaagaacguucagacagccccggggaccuucaagacuucugagggcgaaguaggcgccaucgcgcuagauuucaaacccgggacaaguggcuccccaauagugaaccgcgaggguaagaucgugggauuguacggaaacggcgucgucaccaccagcggcacguacguguccgcaauugcccaggccaaggcgucucaagaagggccccuuccagaaaucgaggaugaggucuuccggaaacgcaaccuuacuaucauggaccugcacccgggcuccggcaagacccggcgcuacuuaccggccaucgugagagaggccaucaaacgcaagcuccggaccuuaauccucgccccaacgcgagugguagccagcgagauggcggaggcccucaaaggcaugccgauucgcuaucagaccaccgccguaaaguccgagcacaccggcaaggagaucguggaucucaugugccacgccacguuuaccaugcgccugcucagcccaguccgcgugcccaacuauaauaugaucauuauggacgaagcccacuuuaccgacccuucgucaaucgccgcccggggguacaucucuacgcgcguuggaaugggggaggccgccgcgauuuucaugacggcuacuccacccggcagcgcagaggccuuuccgcaauccaacgcugucauccaggacgaagagcgagacaucccggaacgcucauggaacucaggguacgaguggaucacggacuucccuggaaagacagucugguucgugcccagcaucaaauccggcaacgacauugcgaacugccugcggaagaacgggaagcgcgucauccagcucagccgaaagacguuugauacggaguaccagaagaccaagaacaacgacugggacuacguagugacaacggacauuuccgaaaugggagccaacuuccgagccgaucggguaaucgacccucgccgguguuugaagcccguuauccuuaaggacggacccgagcgcgugauucuggcggggcccaugcccgugaccguugcaagugcggcgcagcgcagggggcggauugggaggaaccacaauaaagagggagaccaguauauauacauggggcagccgcuaaacaaugacgaggaccaugcccacuggacugaagccaaaaugcuucuagacaacaucaacacccccgagggcaucaucccggcccucuucgagcccgagcgagaaaaguccgcggcaauugacggggaguaccgccugaggggcgaagcgagaaagacguucguggaacugaugcgccgcggggaccucccgguguggcuguccuauaaaguggccagcgagggcuuccaguacuccgacaggcguugguguuucgacggugagcguaauaaccaaguccuggaagagaacauggacgucgagaucuggacuaaggagggggagcggaagaagcuccgaccccgguggcuggacgcccgcaccuacagcgacccccuugccuuacgagaguucaaggaguucgccgcgggccgucggucugugagcggggaucugauccuggagaucggcaagcucccucaacaccugacucaacgggcccaaaacgcgcuggacaaccuugucauguuacauaauagugagcagggaggccgggccuaccgccaugccauggaggagcucccagauacuauagaaacacucaugcugcuggccuuaaucgccgugcugacuggcggggugaccuuguucuuucucucgggccgugggcucggcaagacgucaaucggccugcuuuguguaauggccaguucggugcucuuauggauggccuccguggagccgcauuggaucgcggcguccauuauccuugaguuuuuccugaugguccugcucauacccgagcccgaucgccagcggaccccacaggacaaccagcuagccuacguagugaucgggcugcuuuucaugaucuuaacagucgcggccaacgaaaugggccuacuggaaaccaccaagaaggaccugggaaucggccauguugccguggagaaccaucaucacgccgccaugcuggauguugaccuccacccugccucugcguggacgcucuacgccgucgccacaacgaucauuacccccaugaugcggcacacgaucgagaacacaacugccaacaucucccugaccgcgaucgccaaccaagccgccaucuuaaugggucuggacaaaggcuggccaauuagcaagauggacauaggcguaccccugcucgcgcuggggugcuacucccaggucaacccccuuacgcucacggccgcagugcuaaugcuggucgcgcacuacgccaucaucggacccgggcugcaagcaaaggccacccgggaggcccaaaagcgcaccgccgccggcaucaugaagaaccccacgguggacggaaucgucgcgauagaccuagacccugugguauacgacgccaaguucgagaagcaacugggucagaucaugcuccugauacucugcaccagccaaauacuccugaugcgcacaacgugggcccugugugagagcaucacgcucgccaccggcccccugacaacucugugggaggggucaccaggcaaguucuggaacacgaccaucgccguuucuauggcgaauaucuuccggggguccuaccucgccggcgccgguuuagcguuuucuuugaugaagucucucgguggcgggcggcgggguacgggggcgcagggcgagacccugggggagaaguggaagcgccagcugaaccagcucagcaagucggaguucaacaccuacaagcgaucugggaucauggagguagaccgcuccgaggcuaaagagggccuuaagcgcggagaaaccacaaaacacgccguuucgcgugguacagcuaaacugcggugguuuguugagcgcaaucucgugaagccggaggggaaggucaucgaccucggcugcggacgcggcgggugguccuacuacugcgccggacuuaagaaggugacggaggucaagggguauacgaagggcgggcccggccaugaggaacccaucccaauggcgaccuauggguggaaccuugucaaguuacacagcggcaaagacguguucuucgugccgcccgagaagugugauacccuguugugcgacaucggggaaucuuccccaaaccccacgaucgaagagggacgcacucuccgaguccugaaaaugguggaaccguggcugcgcgggaaccaguucuguaucaaaauccucaaucccuacaugcccagcguggucgagacucuggagcagaugcagcgaaagcacggcggaaugcugguccguaacccccuuagccggaacuccacucaugagauguacuggguuucgugcgggacggguaacaucgucagcgcagugaauaugacaucgcggauguugcugaaucgcuucaccauggcccaucgcaagccgaccuaugagcgggacguggaccucggugccgggaccaggcaugucgccguggagccugagguagcgaauuuggauauaauagggcagcgcaucgagaacaucaagcacgagcauaagaguacguggcacuacgacgaagacaauccauacaagacgugggccuaccacggaagcuacgaggucaagccuucuggcuccgccagcucgauggugaacgguguugugaagcugcucacgaagccaugggacgugaucccaauggucacccagaucgccaugacggacaccacccccuucggccaacagaggguauucaaagagaagguggacacccgcacgcccaaagccaagcgagggacggcacagauaauggaggucacugccaaguggcuguggggcuucuugagccgaaacaagaaaccgcguaucugcacgcgcgaagaguuuacgcguaaagugcgcuccaacgccgcaaucggcgcgguauucgucgacgagaaccaguggaacagcgccaaggaggccguggaagaugaacguuucugggaccucgugcaccgcgagcgggaauuacacaagcagggaaaaugcgcgacgugcgucuacaauaugauggggaaacgugagaagaagcugggcgaguucggcaaagccaagggaucacgggcgauuugguacaugugguuaggcgcccgcuucuuagaauucgaagcccucggcuucaugaacgaggaccacugguucucuagagagaacucccucucuggcguggagggggaagggcugcacaagcugggcuacauacuccgggauaucuccaagauaucgggcggcaacauguacgccgaugauaccgccggcugggauacgcgcauuacugaggacgaccugcagaacgaggcaaaaaucacugauaucauggagcccgagcaugcacugcucgccaagucuauuuucaaguugacauaccagaacaagguaguccgaguccagcgccccgccaagaaugguacggugauggaugucauuagcagacgggaucaacguggcucgggccaggucggaacguacggcuugaacaccuucacgaacauggaagcccaacucauccgccagauggagagcgaggggaucuucaguccgagcgagcuugagaccccaaauuuagcugagcgggccuuggacuggcuggaaaaacauggaguggagcgccugaagcgaauggcaaucucuggggaugacugcgucgugaagccuauagacgaccgcuucgcaacagcccucaccgcgcucaacgacaugggcaaagugcggaaagacaucccccagugggaaccguccaagggguggaacgauuggcaacaggugcccuucugcucgcaccacuuccaccagcugaucaugaaagauggaagggaaauuguagugcccugccggaaucaagaugaguuaguuggccgcgccaggguuucccagggggccgguuggucacucaaggagaccgccugccuggguaaguccuaugcacagauguggcagcugauguacuuucaccggcgggaccugcgacuggccgcaaacgccaucugcagcgccgugccgguagacugggucccgaccucccguacgaccugguccauacacgcucaccaucaguggaugaccaccgaggacaugcucagcguguggaaccgcguguggauugaggaaaacccguggauggaggacaagacgcacaucagcagcugggaggauguuccauaucuggguaagcgggaggaccaguggugcgggaguuuaaucggacucaccgcgcgugccaccugggccaccaauauacaaguggccaucaaucaggugcgacgccugaucggaaacgagaacuaccuggacuacaugacguccaugaagcgauucaaaaaugagucagacccugagggggcguuaugguga

SEQ ID NO: 23834 - RNA, 9879 nt, Artificial Sequence
  derived and/or modified CDS sequence (opt11) from DENV-1__FJ639688__SS-prME
ucagugaccaugcugcuaaugcuuaugcccaccgcccucgccuuccaccucaccacucgaggcggcgagccccauaugaucgugagcaagcaggagcggggcaaaagccuacuguuuaaaacuagcgccggugugaauaugugcacguugaucgccauggaccugggggagcuaugugaggacaccaugacauacaagugcccacgcauuaccgaggcagagcccgacgacguggacugcuggugcaacgcgacggacacaugggugaccuacgguaccugcagccagaccggcgagcaccggcgugacaagcgguccguagcccuggcuccccacgugggcuuagggcuggagacgcgaacggaaaccuggaugagcuccgagggcgcauggaagcagauccagcggguggaaacgugggcccuccggcaccccggguucaccgugaucgcgcuuuuccuggcgcacgccauaggcaccuccaucacccaaaaagggaucaucuucauacucuugaugcuggugacucccucgauggccaugcggugcgucggcaucgggagccgcgacuuuguugagggccucuccggcgccacgugggucgauguagugcuggagcacggcagcugcgugacaacaauggccaaagacaagccgacccuggacaucgaauugcugaaaacggaggucaccaacccugcggugcugcggaagcugugcaucgaggccaagaucuccaacaccacgacugacagccgcugcccgacgcagggugaagccacccugguagaggagcaagacgccaacuucgucugccggcgaaccuucguggaccgggggugggggaacggcugcgggcuauucgggaagggcagucucaucacgugcgccaaguucaaaugugugacuaagcuggagggcaagaucguccaguacgagaacuuaaaguacagcgugaucgugaccguccacaccggcgaccagcaucaggugggaaacgaguccacggagcacggcaccaccgcaaccaucacgccccaggcaccgacgaccgagauccagcucaccgauuacggggcucugaccuuagacugcagcccccgcaccggccucgacuucaacgagaugguccugcugaccaugaaggagaaaagcugguuaguacauaagcagugguuccuggaccugccccuccccuggacaucaggggccagcaccucccaggagacguggaaccggcaggaccugcuggugaccuucaagaccgcacacgcgaagaagcaggagguuguggugcucggcagucaggagggggccaugcacaccgccuugaccggcgccaccgagauucaaaccuccggcaccaccaccauauuugccgggcaccuuaaaugccggcucaagauggauaagcuaacccugaagggcaugagcuacgucaugugcaccgggucauucaaguuagagaaagagguugcggagacucagcacggcacgguacugguccagauaaaguacgagggcaccgaugcccccuguaagauucccuucagcacacaggacgagaagggugugacucagaacggucgucugauaacugccaacccgaucgugaccgacaaggagaagccggucaauaucgaggccgagccacccuucggggagucuuacaucgugauuggcgcgggcgagaaggcccugaagcucagcugguucaagaagggcuccagcaucggcaagauguucgaggccacagcccgcggggcccggcggauggcgauccugggcgacaccgccugggacuucggguccaucggcggcguguucaccagugucgggaaguuggugcaccagaucuucggcaccgcguaugggguacuguucuccggcgucagcuggaccaugaaaauagggaucggcgugcugcuuacguggcucggccugaacucccgcagcaccucccuuagcaugaccugcaucgccguggggcucgucacgcuguaccuggggguuauggugcaagccgacucagggugcgucaucaacuggaagggucgggagcugaagugugggagcggcaucuucguaacaaacgaggugcacaccuggacggagcaguacaaguuucaggcggacagcccgaaacgccuguccgcagccaucggcaaggccugggaggagggggucugcggcauccggagcgccacacggcuggagaauaucauguggaagcagaucuccaacgagcucaaccauauccuacuggagaacgacaugaaguucaccgugguagucggggauguggcaggcauccucgcccaagggaaaaagaugauacgaccccagccgauggaguacaaauacagcuggaaauccuggggcaaggccaagauaaucggcgccgacguccagaacacgaccuucauuaucgacgggcccaacacgcccgaaugccccgacgaccagagggcguggaacguuugggagguggaggacuacggcuucgggaucuucaccacgaacaucuggcuaaagcugcgggacagcuacacacaggugugugaccaccgccuuauguccgcugccaucaaagauuccaaggccguccaugccgacaugggcuacuggaucgaguccgagaagaacgaaacauggaagcuggcucgggccagcuucaucgaaguuaagaccugcaucuggcccaagucccauacauuguggagcaacggcgugcucgagagugagaugaucauucccaagaucuaugggggaccuaucagccagcacaauuauaggcccggguacuucacucagaccgccggccccuggcaccucgggaagcuggagcuggacuucgaccugugcgaaggcaccacggucgugguagacgaacauugcggaaaccgggggccguccuugcggaccaccacagucacgggcaagaucauccaugaguggugcugccgguccugcacccugccuccccucagauuccgcggagaggacggcugcugguacgggauggagaucagaccggugaaggaaaaggaggagaacuuagugaaaucgauggucagcgccggcagcggcgagguggacuccuuuagucucgggcuccuuuguaucuccauaaugauagaggagguaaugcggagccguuggucccggaagaugcucaugaccgggacccuggccgucuucuuccuguuaaucauggggcagcugacguggaacgaccucauccggcucugcaucauggugggcgcaaacgccuccgacagaauggggaugggcaccaccuacuuagcccugauggcuacguuuaagaugagaccaauguucgcugugggacuccuguuuagacgguuaacaucccgcgagguacuucugcugaccaucgggcugucacuggucgcauccgucgagcugcccacaagccucgaggagcuaggcgaugggcuggccaugggcaucaugauccuaaagcuguugaccgacuuucagucccaccagcucugggccacguuauugucacucaccuucaucaagaccacguucagccugcauuacgccuggaagacuauggcgauggugcuaagcaucgugucccuccugccgcugugccucagcaccaccucccagaagaccacguggcucccggucuuacucgggucgcugggguguaagccguuaaccauguuucucauugccgagaacaagauuuggggccggcgcucauggccccugaaugaggggaucauggccgugggcaucgucucgauccugcucagcucccuacugaagaacgauguaccucucgccgggccccugaucgccggaggcaugcugaucgcgugcuacgugauuagcggguccagcgcagaucucuccuuagagaaagccgcagaagugucaugggaggaggaggcugagcacuccggagcgagucacaacauccuugucgaggugcaggacgacgggacgaugaagauaaaggacgaggagcgggacgauacccucaccauacugcugaaggccacacuccuggccguuucaggcguuuacccgcugaguauccccgccacccucuuugugugguacuucuggcaaaagaagaagcagcgauccgggguucugugggacaccccaagcccucccgagguugagcgggccgugcuggaugacgguaucuaccgcaucaugcagcguggccugcucgggcgcucccaggugggaguggguguguuccaggagaacguguuccacaccauguggcaugucacgcggggcgcggugcugauguaccaggggaaacgccuggaacccucuugggcuuccguaaagaaggaucuaaucucuuacgggggcggauggcggcugcaggggagcuggaacacuggggaggagguacaggugaucgcuguggagcccggcaagaaccccaaaaacguccagaccgcccccgggaccuucaagacucccgaaggcgaggucggcgcgaucgcucuggacuucaagcccgggaccucaggcagccccaucgugaaucgugagggcaagaucgucggccucuacggaaacgggguggugaccaccagcggcacguacgucucagccauugcccaggccaaggcgucccaggaggggccgcuaccggagauagaagacgagguguucaggaagcgaaaccucacgaucauggacuugcaucccggcagcgggaagacccggcgcuaucuuccugcgaucgugcgggaggccauuaagagaaagcugcguacucucauacuggcccccacuaggguuguggccucggaaauggcggaggcccugaagggcaugcccauccguuaccaaacuaccgccgugaagagcgagcacaccgguaaggagaucguggaccucaugugccacgcuacguucaccaugcgucugcugucccccguacgcgugccuaacuauaacaugaucaucauggacgaggcccacuucaccgaucccagcuccauugcggcccggggcuacaucagcaccagagucggcaugggggaagcugccgccaucuucaugacggccacgccgcccggcuccguggaagccuucccgcagagcaacgccgugauccaagaugaggaacgggacaucccugagcgcagcuggaacuccggguacgaauggauuaccgacuucccuggcaagaccgucugguucgugcccuccauaaaaagcggcaacgacaucgccaacugccuccggaagaaugggaagcgcgucauccagcugucccggaagacguucgacaccgaguaccagaagaccaagaauaacgacugggauuauguaguuaccacugacaucucggagaugggcgcaaacuuccgcgcugaccgggugaucgacccucgccggugccugaaacccgugauccucaaggacgggccugagcguguaauccucgccggccccaugccggucaccguggcguccgccgcgcagcggcgugggcggauaggccgcaaccacaacaaggagggcgaucaguacaucuacauggggcagccccugaauaacgacgaagaccacgcacacuggacugaggccaaaaugcuccuugacaacaucaacacccccgagggcaucauccccgcgcuguucgaaccugaacgcgagaaguccgccgccauugacggggaguaccgguuacgcggcgaggcccggaagacuuuuguggagcucaugcgccgcggggaucugccuguauggcucagcuacaagguggcuagcgagggguuucaguacagcgaccgccgguggugcuuugacggcgagcgcaacaaccaggugcuggaggagaacauggacgucgagaucuggaccaaggaaggggagcgcaagaagcugagaccccgguggcucgacgcccgcaccuauuccgauccccuggcccugcgggaguucaaggaguuugcugccggccgucggagcgugaguggggaucucauccuagagaucggcaaacugccgcagcaccucacacagcgcgcccagaacgcuuuggacaaccuagugaugcuccacaacagcgagcaaggcggacgggcguaucggcaugcaauggaagagcugccggauacgauagaaacccugaugcuccuggcucugaucgccguccucaccggcggagugacccuguucuuccugagugggcgagggcucggcaaaaccucaaucggccuacugugcgugauggccaguagcgugcucuuguggauggcguccguagagccccacuggaucgcugccagcauuauacuggaguucuuccucauggugcugcugauccccgaaccagaccgccagcgaacgccccaggacaaucagcucgccuacguugugaucggccugcuguucaugauccucacaguagccgcgaacgagaugggauuacuggagaccacaaagaaagacuuaggcaucgggcaugucgccgccgagaaccaccaccacgccgccaugcuggacguggaucuacaccccgcuuccgccuggacgcucuacgcugucgccacgacaaucaucaccccgaugaugcgccacacgaucgagaacaccaccgccaacaucagccugaccgcgaucgcaaaucaggccgccauuuuaauggggcucgacaagggcuggccgaucagcaagauggacaucggcgucccauuacuagcgcucgggugcuacucgcaggugaauccucugacgcugaccgccgcuguguugaugcucgucgcccauuacgccaucauagguccgggacugcaggcgaaggccacucgcgaggcgcagaagcgcaccgccgccggcaucaugaagaaccccacggucgaugguauuguggcgaucgaucucgaccccgucguguacgacgccaaguucgagaagcagcugggccagauaauguuacucauccugugcaccucccagauccuucucaugcgcaccacgugggcccugugcgagucgaucacgcuggccaccggcccccucaccacgcugugggaggggaguccagguaaauucuggaacacgaccaucgccgugaguauggcgaacaucuuccgcggguccuaccuggcuggcgccggucuagccuuuagcuugaugaagucccucgggggcgggcgcagagggaccggcgcgcagggcgagacccucggcgagaaguggaagcgccagcugaaccagcugucuaagagcgaguucaacacuuauaaacgguccgggaucauggaagucgaucgcucggaggccaaggagggcuuaaagcguggggagaccaccaagcacgccguuucacguggcaccgccaagcugcggugguuuguugagcgcaacuuggucaagcccgaggggaaggugauugaccuagguugcggucgcgggggcuggagcuacuacugcgccgggcucaagaagguaacggaggucaagggcuacaccaagggcggaccaggucacgaggagcccaucccgauggcgaccuacggauggaaccuggugaagcugcacuccggcaaagauguguucuuuaucccgccagagaaaugcgacaccuuacugugugacaucggggagagcucccccaauccgacaaucgaagagggccgcacacugaggguccucaagaugguggaacccuggcugcgcgggaaucaguucuguaucaagauccucaaccccuauaugcccagcgugguagagacucucgagcaaaugcagagaaagcacggcgguauguuaguccgcaacccucugagucggaacagcacucacgaaauguacuggguuuccugcgguaccggcaacaucgucagcgccgugaauaugacaagucgaaugcuucugaaccguuuuaccauggcccaccggaaacccaccuacgagagagacguggaccuuggggccggaacgcggcacguugccguggagcccgagguggcuaaccucgacaucauaggccagcguauugagaacaucaagcacgaacacaaaagcacuuggcacuacgacgaggacaacccuuauaagaccugggccuaccacggguccuacgaggucaagccgagcggcuccgccucuagcauggugaacggggucgugaaguuacugacgaagccuugggacgugaucccaauggucacgcagauggccaugaccgacacgacccccuuuggccagcagcggguguucaaggagaaaguggacacacggacgccgaaggcaaagcgggggaccgcgcaaaucauggaggucaccgccaaauggcucuggggguuccugucccgcaacaagaagcccaggaucugcacccgcgaggaguucacgcggaaggugcgcucaaacgccgccaucggcgcgguguucguugaugagaaccaguggaacuccgccaaggaagccguggaggaugagagauucugggauuuagugcaucgcgagcgggagcuacacaaacagggcaaaugcgcgaccugcgucuauaacaugaugggcaagcgcgagaagaaacugggcgaauuugggaaagcuaaggggucgcgggcuaucugguacauguggcugggcgcccgcuuccucgaguucgaagcccugggcuucaugaacgaagaccauugguuuucccgggagaacucgcuguccgggguggagggcgaaggacuccacaagcugggauacauccugcgcgacaucagcaaaauccccggaggcaacauguacgcggaugacaccgcggguugggacacacgaaucaccgaggacgaccuccagaacgaggcgaggauuaccgacauuauggagccagagcacgcccuauuagcgaaguccaucuucaagcucaccuaccagaacaaggucguccgcgugcagcggcccgcuaagaacgggacugugauggacgugaucagccgcagagaccagcgcggcuccggccagguggggacguacggccugaacaccuucaccaacauggaggcccaauugauccggcagauggaaagcgaggggaucuucucgcccagcgaauuggagacccccaaccuggcggagcgcguucuggacuggcucgaaaaauacggaguagagcggcuuaagcgcauggccauaucuggggaugacugugucgugaagccgaucgacgaccgcuucgccaccgcuuuaacagcacucaacgacaugggcaagguccgcaaagacaucccccagugggagcccagcaagggguggaacgacuggcagcagguccccuuuugcagucaccacuuccaccagcugauuaugaaggauggucgcgaaaucguagucccgugcagaaaccaggaugagcucguuggccgggcgcgcgugagccaaggggccggcuggagccuacgggaaaccgccugucuggggaaauccuaugcccagauguggcagcugauguacuuccaccgccgggaccuccgccuggcagccaacgcgaucugcagcgcuguccccguggauuggauccccaccucccggacuacuuggaguauccacgcacaucaccaguggaugaccaccgaggacaugcuuuccguguggaaccguguauggaucgaggagaauccuuggauggaggacaagacgcacaucaguuccuggggugaugugccauacuuagggaagcgcgaggaccaauggugcggcagccuuaucggccugaccgcgcgagcaaccugggcgaccaacauccaaguggcaaucuaucaaguccgccggcucauugguaacgagaauuaccuggacuacaugaccuccaugaagagguucaagaaugagagcgaccccgagggcgcccugugguag

SEQ ID NO: 23835 - RNA, 9879 nt, Artificial Sequence
  derived and/or modified CDS sequence (opt11) from DENV-1__FJ639689__SS-prME
agcguuaccaugcugcucaugcugaugcccaccgcccuggccuuccaccucacgauucggggcggggagccccacaugaucgugagcaagcaggaacggggcaaaaguuugcuguucaagacguccgccggggugaacaugugcacgcuaaucgccauggaccugggugaguugugcgaggacaccaugaccuacaaaugcccucgcauuaccgaggccgagccggacgacguggauugcuggugcaacgccaccgauaccugggugaccuacgguacaugcagccaaaccggcgaacaccgucgggauaagcgguccguggcccucgcuccccacgugggacuagggcuggagacccgcaccgaaaccuggauguccucggagggcgccuggaagcagauccaacgggucgagacgugggcccuccgccacccgggcuucaccgugaucgcccuguuccuggcgcacgccaucggcacgucaaucacccagaaggguaucaucuucauccuccugaugcuggugacgcccaguauggccaugcguugcgucggcaucggcagcagggacuucguggaagggcucuccggcgccaccuggguggauguagugcuggagcacgggagcugcgugacgaccauggccaaagacaagcccacccuggacaucgagcuccugaaaaccgaagucaccaaucccgccaucuugcggaagcucugcaucgaggccaagauuuccaacaccacgaccgacagcagaugcccaacgcagggcgaggccacccugguugaagagcaggacgcgaacuucgucugccggcgcaccuucgucgaccguggcugggggaacggcugcgggcuguucggcaaggggucgcucaucacgugcgccaaguucaaaugugugacgaagcuggaggguaagaucguccaguaugagaacuuaaaguacucggucauugugaccgugcacacgggcgaccagcaccaggucgggaacgaguccacagagcacggcacgaccgcgaccaucacgccccaggcgcccaccacggagauccagcucaccgacuacggggcccugacccucgacugcuccccccgcaccggccuggacuucaacgagauggugcuguugacgaugaaggagaaauccuggcucguccacaagcagugguuuuuggaccugccucuacccuggaccagcggggccagcacgucccaggagaccuggaaccggcaggaccuguuggugacguucaagaccgcccacgcuaagaagcaagaggugguuguacucggcagccaggagggcgcuaugcacaccgcccugaccggggccaccgaaauucaaacauccggaaccaccacgaucuuugccggccaccuaaagugccgccuuaagauggacaaacugacccugaagggcaugagcuacgugaugugcaccggguccuucaagcucgagaaggaggucgcggagacucagcacggcacgguauuagugcagaucaaauacgagggcacugaugcccccugcaagauccccuuuagcacccaggacgagaagggggucacccagaacggccggcuaaucacugccaacccaauaguaaccgacaaggagaaacccgugaauaucgaagccgaaccgccauucggggaguccuacaucgugaucggcgcgggcgagaaggcccugaagcucagcugguucaagaaggggucaagcaucgguaagauguucgaagccacggcacggggggcgcggcgcauggcgaucuugggcgacaccgccugggacuuuggguccaucggcggcguguucacgagcgucgggaagcuggugcaccaaaucuucggaaccgccuacgggguucuguucuccggcgugagcuggaccaugaagaucggaaucggcguccuucugaccuggcucggcuugaacagccgcagcacguccuucagcaugaccugcaucgccguggggcugguaacccucuaccugggcgucauggugcaggccgacucugggugugugaucaacuggaaggggcgggaacugaagugcgggagcgguauauucgucaccaacgaggugcacacguggaccgagcaauacaaguuccaggcggacagcccgaagcgccuguccgccgcuaucggcaaggccugggaggagggggugugcggcaucagaagcgccaccagacuggagaacaucauguggaaacagaucuccaacgaacugaaccacauccugcuggaaaacgacaugaaauucaccgucgugguuggggacguggcgggcauccuggcccagggaaagaagaugauccggccccagccgauggaguacaaauacagcuggcgcuccuggggcaaggccaagaucaucggugccgacgugcagaacacaacguuuauaaucgacgggccgaacacuccggagugucccgacgaccagcgggcguggaauaucugggagguggaggauuacggguucgggaucuucaccaccaacaucuggcucaagcugcgcgacagcuacacccaagucugcgaccaccgucugauguccgccgccaucaaagauagcaaggccgugcacgccgacaugggcuacuggauugagucggagaagaacgagacuuggaaacucgcgcgcgcaucuuucaucgaggugaagaccugugucuggcccaagagucacacccuuuggagcaacggcgugcuugaguccgagaugaucauccccaagaucuacgggggccccaucagccagcauaacuaccggcccggguacuuuacgcagaccgcuggucccuggcaccucgggaaguuggagcuggacuucgaccucugcgagggaacgaccguggucguggacgagcauugcggcaaccgcgggccuucacugaggacuaccacugucaccggcaagaucauacacgaguggugcugucgcagcugcacguugccgcccuuacgguuucgcggggaggacggaugcugguacgggauggagaucagacccgucaaggagaaagaggagaaccuggugaaguccauggugagcgccggcucuggcgaggucgacucguucagccuggggcugcugugcaucuccauaaugaccgaggagguaaugcgcagccgguggucccgcaaaaugcugaugaccggcacucucgcgguguuccugcugcucaucauggggcagcugacguggaacgaccugauccgcuuaugcauaauggucggcgcgaacgcaagcgaccggauggggaugggcaccaccuaucuggcccugauggcaacauucaagaugcgcccgauguuugccguggggcuccuuuucaggaggcuaacgucccgggaaguacugcugcugaccgucggucucucauugguggcguccgucgagcuccccaacagccucgaggagcuuggcgacgggcuggcuaugggcauuaugaucuuaaaguuauugaccgacuuccagccccaccagcucugggccacccugcugucccucacuuucaucaagaccaccuucagccugcacuacgccuggaagaccauggcgaugguucugucuaucgugagccucuuucccuuaugccuguccacgaccucccagaaaaccaccugguuaccuguacuacucggcucccuagggugcaagccccugacuauguuucugauugccgagaacaaaaucuggggccgcaggucuuggccacucaacgaggggauuauggccguggggaucguuuccauacugcucagcucacuccugaagaacgacguuccguuagcagggccgcucauugccggcgugaugcugaucgcgugcuacguaaucuccggcagcucggccgaccugagccucgagaaggcggccgaggucuccugggaggaggaggccgagcacucaggggcgucccacaacauucugguggaggugcaggacgacggaaccaugaagaucaaggacgaagagcgggacgacaccuuaacaauucuccugaaggccacccugcucgccgucagcgggguguacccacuuuccauccccgccacgcuguucgugugguacuucuggcagaaaaagaagcagcggagcggcgugcucugggacaccccuuccccgcccgaggucgagcgcgcggugcuggacgacggaaucuaccgcaucaugcagcgcggccuauugggccggucgcaggucggggugggcgucuuucaggagaacgucuuccacaccauguggcacgugacccggggggcugugcucauguaccagggcaagcggcuggagcccuccugggccagcgucaagaaggaccugaucaguuaugggggcggcuggcgguuacaggggagcuggaacacgggcgaggagguccaggugaucgccgucgaaccagggaagaacccuaagaacgugcaaaccgcgccaggcaccuucaagacccccgagggggaggugggcgcuaucgcgcucgauuucaagccugguacgaguggcagcccgaucgucaaccgcgagggcaagauagugggguuguacggcaacggugugguaacgaccuccgggaccuaugugagcgccaucgcccaagccaaggcgagccaggagggaccccuaccugagaucgaggacgagguguuuagaaagcggaaccugacuauaauggaccugcauccugggucagguaaaacccggcgguaccuacccgccaucguccgcgaggccaucaaacgcaagcugcggacccugauccucgccccaacccgcgucguagccagcgagauggcggaagcgcugaaggggaugcccauccgguaucaaacgaccgcugucaagagcgaacacacaggcaaggagaucguggaccugaugugccacgcgacuuucacgaugcgccuccuauccccggugcggguccccaacuacaacaugauuaucauggacgaggcucacuucaccgaccccuccagcaucgcugcacgcggcuauaucagcacccggguggguaugggcgaagcggccgccaucuucaugaccgcgacgcccccgggguccguggaggccuucccccaguccaacgcugucauccaggacgaggagcgcgacaucccggagcggaguuggaacuccggcuacgaauggaucaccgacuuuccagggaagacggugugguucgugccgagcaucaaguccggcaaugacaucgcgaacugccugcguaagaacggcaaacgggucauacagcucucacgcaagaccuuugauacggaguaccagaagacgaagaacaacgacugggacuacguagugacuaccgauauauccgagaugggugcgaacuucagagcagaucgcgucaucgacccaaggcgcugucugaagcccgucauccugaaggacggacccgagagaguuaucuuggcggggccgaugccagugacagucgcgagcgccgcgcagcgucggggccgcauugggagaaaccacaacaaggagggcgaccaguacauauacaugggacagccucugaauaacgacgaggaccacgcacacuggacggaggccaagaugcugcucgacaacaucaauaccccggaggggaucaucccggcccuauucgaacccgaacgggagaaguccgccgcgaucgacggcgaguaccgccugcgcggggaggccaggaagaccuucgucgaguuaaugcggcgcggcgaccuucccgugugguugagcuacaagguggcauccgagggguuccaguacagcgaccggcgcugguguuucgacggcgagcggaacaaucagguccuugaggagaacauggacguggagaucuggacuaaggagggcgagcgcaaaaagcugcgaccccgcugguuggacgcgcggaccuauagcgauccguuagccuugcgcgaguucaaagaguucgcggccggccggcgcuccgugagcggcgaccucauacuggaaauuggcaagcugccccagcaccuuacccagagggcccagaacgcccucgacaaccugguaaugcugcacaauucugagcagggcggacgcgcguaccggcacgccauggaggagcuccccgacaccaucgagacgcugaugcugcuugcccugaucgccgugcuuaccgggggcgugacucucuucuuccucuccgggcgcggccuggggaagaccucgaucggccuucugugcgucauggccucguccgugcuacucuggauggcgagcguggagccccacuggaucgccgccuccaucaucuuggaguucuuccugaugguccuccugaucccagagcccgaucggcagcgcacgccccaggacaaccagcuggcauauguggugaucggccuccuguucaugauccuaacggucgccgcgaacgagauggggcuccucgagaccaccaagaaggaccugggcaucgggcacguggccgugggcaaucaccaccaugccgccaugcucgacgucgaccugcacccggcaagcgcguggacccuguacgcaguggccacgacuaucauaacccccaugaugcgccacaccaucgagaacacgaccgccaacaucucccucaccgccauugcaaaccaagcagccauucuuaugggacucgacaagggcuggcccauuagcaagauggacaucggcguaccccuccuggcccuuggaugcuacucccaaguaaacccacucaccuugacagcagccgugcugaugcucguggcacacuacgccaucauuggccccggacuccaggccaaggcgacgcgggaggcacagaagcguaccgccgccggcaucaugaagaaccccaccgucgacgggaucgucgcaaucgauuuagaucccguggucuacgacgcgaaguucgagaagcagcucggccaaauaauguugcugauccucugcacgagccagauccugcucaugcggaccaccugggcccucugugagaguaucaccuuggccacgggcccgcugacgacauugugggaggggagccccgguaaguuuuggaauaccacgaucgccguguccauggccaacaucuuccgugguuccuaccuggcgggggcgggccuggcguuuucucucaugaagucccucgggggcgggaggcgcgggaccggggcccagggcgagacccugggggagaaguggaagcggcaguugaaccagcugagcaaguccgaguucaacacuuacaagcgcucgggaauuauggagguggacagguccgaggcaaaggagggucugaagcguggugagaucacgaaacacgccgucagccggggcaccgccaagcuccgcugguuugucgaacggaaucuggugaagcccgaggggaaggucauagaccugggcugcggccggggggggugguccuacuacugcgccggucugaagaaggugaccgaagugaagggcuacaccaaaggcgggcccggccacgaggagccgauucccauggccacguacggguggaauuugguuaagcuacacagcggcaaggacguguucuuugugccgcccgagaaaugcgacacccugcucugcgacaucggggaauccagcccgaaccccacgauugaggagggacggacccuuaggguccugaagaugguggagccuuggcugcgggggaaccaguucugcaucaaaauccugaaccccuauaugccguccguggucgagacgcuagagcagaugcagcgcaagcacggcggcaugcuggugcggaacccccugucgcgcaacuccacccacgaaauguacugggugagcugcgguaccggcaacaucguauccgcagugaacaugaccagccgcaugcuccucaaccgguucacaauggcccaccgcaaacccacguacgaacgggacguggaccugggggccggcacucgccacguugccguggagcccgagguugcgaaccucgacaucaucggccagcggauugagaacauaaaacacgagcacaagaguacguggcacuacgacgaagacaacccguacaagacaugggcguaccacgggaguuacgaggugaagcccuccggcagcgcguccagcauggugaacggggucgugaagcuccucacgaagccuugggacgugaucccgauggucacccagaucgccaugaccgacacuacgccguucggccagcaacgcguguucaaggagaagguggauacccggacccccaaagccaagagagggaccgcccagaucauggaggucacggcgaaguggcuguggggcuuucucucucggaauaagaagccgcgcaucuguacccgugaggaguucacgcgcaaggugcgguccaacgccgccaucggcgccguguucgucgacgagaaccaauggaacagcgcgaaggaggccguggaggaugaacgcuuuugggaccuggugcaucgggaacgcgagcugcacaagcaggggaagugcgcgaccugcgucuacaacaugaugggcaagcgggagaagaaguugggagaguucggaaaggccaaggggucccgcgccaucugguacauguggcugggcgcgcgguuccuggaguucgaagcacucggcuucaugaacgaagaccacugguuuucacgcgagaacucccucagcgggguggagggcgaggggcugcacaagcuuggcuacauccugcgggacaucuccaagauccccggcgggaacauguaugcugaugauacggccgggugggacacccggaucaccgaggacgaucugcaaaacgaggcccgcauaacggacaucauggagcccgagcaugcgcuccuggccaagagcaucuucaagcugacguaccagaacaaggugguccggguacagcgcccagccaagaacgggaccgugauggacgucaucucacggcgcgaccagcggggcagcggccaggugggcaccuacggcuuaaacaccuucacgaauauggaggcccagcugauccgccagauggaguccgaggggaucuuuagcccguccgagcuggaaacaccgaaccuugccgagcgcguguuggacuggcuagagaaguacggagucgaacgccucaagcggauggcgaucucuggggacgacugcguggugaagccgaucgacgaccgcuucgcgaccgccuuaaccgcccugaacgacauggggaagguccggaaggauaucccccaaugggagcccuccaagggguggaacgacuggcagcaggucccguucugcagccaccacuuccaccagcucaucaugaaggacggccgcgagaucgugguccccugucggaaccaggacgagcuggugggccgcgcccgggugucccaaggggcaggcuggucucugcgcgaaacggccuguuugggcaaaagcuacgcccaaauguggcaacuaauguacuuccaccggcgcgaccugcgacucgccgcuaacgccauaugcagcgccguccccguggacuggaucccuaccagccgaaccaccugguccauacacgcacaccaccaguggaugacgaccgaggacaugcugagcguguggaaccgggucuggaucgaggaaaacccauggauggaggacaagacgcauaucuccagcuggggcgacgugccguaccuggggaaacgggaggaccaguggugcggcuccuuaaucgggcugaccgccagggcuacgugggccaccaacauccagguggccaucaaccagguccggcgccugaucgggaaugagaacuaccucgacuauaugaccagcaugaagcgguucaagaacgagagcgaccccgaaggcgcccuaugguga

SEQ ID NO: 23836 - RNA, 9879 nt, Artificial Sequence
  derived and/or modified CDS sequence (opt11) from DENV-1__FJ639690__SS-prME
agcgugaccaugcuguuaaugcugaugcccaccgcccuggccuuucaccucaccauccgcgggggcgagccacauaugaucgugagcaaacaggagcggggcaagucccugcuguucaagaccuccgcgggggugaacaugugcacccucaucgcaauggaccugggcgaguugugcgaggacaccaugaccuacaaaugcccuaggauaacggaggccgagcccgacgacguggauuguuggugcaaugccaccgacaccugggucacauacgggacaugcagccagauaggagaacaccgacgcgacaagcgguccguggcccucgcgccucaugugggucucgggcuugaaacgcgcacagaaaccuggaugagcuccgagggugccuggaagcagauccagcgggucgagaccugggcccucaggcaucccggguucaccgugauugcccuguucuuggcccacgccaucggcacaaguaucacucagaaggguauuauuuucauccuccugaugcuggugacccccuccauggccaugcggugcgucggaaucggcagccgcgacuuuguggaagggcucaguggcgccaccuggguggacgucguguuggagcacggguccugcgucaccacaauggccaaggacaagcccacccuggacaucgagcuccuaaagaccgaggucaccaaccccgcgauccugcgcaaguuauguaucgaggccaagaucaguaacacgacaaccgacagccgcuguccgacucaaggcgaggccacgcugguggaggagcaggacgccaacuucgugugucggcgcaccuucguagaccggggcugggggaauggcugcggccuguucggaaaggggucccucaucacgugcgccaaguucaagugugucaccaaguuagaggggaagauuguccaguacgagaaccugaaguacucagugaucgugacggugcacaccggagaccagcaccaggucggcaacgaguccaccgagcacgggacuacggcgaccaucacaccacaggccccuacuaccgagauccagcucacggacuacggagcccuaaccuuggacugcagcccccgcaccggcuuggacuucaacgaaaugguguuacucaccaugaaagaaaaguccugguuaguccacaaacagugguucuuggaccugccgcuccccuggacgucgggggccagcacgucccaagagaccuggaaccggcaggaccuccucgucacuuuuaagacggcccaugcgaagaagcaagaggugguaguccucggcagccaggagggcgccaugcacaccgcccuaaccggggcaacagagauccagacauccggaaccacgacuaucuuugccgggcaccugaagugccgucucaaaauggacaagcugacgcugaagggcaugagcuacgugaugugcaccggguccuucaaacucgagaaggagguagcggagacccagcacgggaccguguuggugcagaucaaguacgaaggcacggacgcccccugcaagauccccuucucaacgcaggaugagaagggugucacccagaauggccggcugaucacugccaacccgauugugacggacaaagagaagccagugaacauugaggccgagccgccuuucggggaauccuacaucgucauuggcgcgggcgagaaggcucugaagcucagcugguucaagaaaggguccagcaucgggaaaauguucgaggccaccgcccgcggggcccggcgcauggcgauccugggagacacagccugggacuucggauccaucggcggcguguucaccagcguaggcaagcugguccaccagaucuucggcacugccuacgguguccucuucuccggugugagcuggaccaugaagaucgggaucggcguccuuuugacguggcucggccugaauucccgcaguaccaguuucagcaugacgugcaucgcgguggggcuggugacucucuaccuuggcgucauggugcaagcugauucggggugcgugauuaauuggaagggccgggagcugaagugcgggagcggcaucuucgucaccaacgaggugcauaccuggacggagcaguacaaguuccaagcggacagcccgaagaggcuuuccgccgccauuggcaaggccugggaggagggggugugcggcauccggagcgccacccgccuggagaacauuauguggaaacagauuuccaacgagcugaaccacaucuuguuggagaaugacaugaaguucacgguuguagugggagacguugccggcauccucgcccaggggaaaaagaugauccggccccagccuauggaguacaaguacagcuggcguuccuggggcaaggccaagaucaucggcgccgaugugcaaaacaccaccuucauuaucgacggccccaacacaccggaaugucccgacgaccagcgcgcauggaauaucugggagguugaggacuacggcuuugggaucuucacaaccaauauuugguuaaagcugcgcgacucguacacccaggucugcgaucaccggcugaugucagcagcuaucaaggauagcaaagcugugcacgccgacaugggcuacuggaucgagagugaaaaaaacgagacuuggaagcucgcccgcgcuagcuuuaucgaggugaaaaccugcgucuggcccaagucccauacacucugguccaacggcgugcuggagucggagaugaucauccccaagauauacggggguccuaucagccagcauaacuaccgucccggauacuucacccagacggccggccccuggcaccugggcaaacuggagcuugacuucgaccucugcgagggcaccaccguagucgucgaugagcacuguggcaaccgcgggccguccuugcggaccacgaccgugacggggaagaucauacaugaguggugcugccgcagcugcaccuuaccgcccuugcgguuccgcggagaggacgguugcugguacgggauggagauacgccccgucaaggagaaggaagagaaccuugucaagagcaugguaucugccggaagcggcgagguagauuccuucagccuggggcuccuuugcauuucgaucaugacggaggaggugaugaggagccgguggucccgcaagaugcucaugacuggcacccucgcuguguuccugcugcucauuauggggcagcuuacuuggaacgauuugauccgccugugcaucauggucggcgcaaacgccagcgaccggaugggcaugggcacgaccuaccuggcccugauggcaaccuucaagaugcgccccauguuugcugugggccuccuguuucgaaggcugaccucccgggaggugcuccuacucacggucggacugucgcugguggcaucugucgaguuacccaacagccuggaagagcugggcgacgggcuggccaugggcauuaugauccucaagcuguuaaccgacuuucagccccaccagcuuugggccaccuuacuguccuuaaccuucaucaagacgaccuucucucugcacuacgcauggaagaccauggcgauggugcuguccaucgugagucucuucccccugugccuguccaccacgagccagaagacgacauggcucccgguccugcugggcucuuuggggugcaagccccugaccauguuccugaucgccgagaacaagauuuggggucgccggagcuggccacuuaaugaggguaucauggcugugggcauuguguccauccuguugagcagccuccugaagaacgacgucccgcuugccggcccguugaucgccggcggcaugcugauugcuugcuacguaaucucagggagcuccgccgaccugucgcucgagaaggccgccgagguguccugggaggaggaggccgaacauagcggcgcgucccauaacauuuuggucgaagugcaggaugacgggacgaugaagauuaaggacgaggagcgugacgacacccugaccauacuucugaaggccacgcuucucgcugucagcggcgucuauccgcuguccauacccgccaccuuauucgugugguacuuuuggcagaagaagaagcagcggagcggcguccuuugggacacgcccuccccgcccgaagucgagcgcgccguacuagacgacggcaucuaccggaucaugcagcgcggccugcuggggagaucgcaggugggcguuggcguguuccaggagaacguguuucacacgauguggcacgucacccgcggcgcuguucucauguaccaagggaaacggcuggagcccuccugggccagcgugaagaaagaccuaaucuccuacggcggcggguggcgucuccagggaagcuggaauaccggggaagagguucaggugaucgcuguggagcccgggaagaacccgaagaacguacagacagcacccgggacauucaagacccccgaaggcgaggucggcgcaauugcccuggacuucaagcccgggaccucgggcagcccgaucgugaaucgagaggggaagaucgucggccuguacggcaacgggguggugacgaccuccggaacguacgucuccgccaucgcccaggccaaggcgagccaagaggggccccuccccgagaucgaggacgagguauuccgaaagagaaaccugacgauaauggaucugcacccuggcuccgggaagacgcgccgguaccuucccgccauugugcgcgaggccaucaaacguaagcugcggacacugauccucgccccaacccgcgucguggccagcgaaauggcggaggcgcugaagggcaugccaauccgguaucaaaccacagcagucaaguccgagcauaccggcaaggagaucgucgaccugaugugccacgccaccuucaccaugcgucuccugagcccggugcggguuccaaacuacaacaugaucaucauggaugaggcccauuucacggaccccaguagcaucgcggccagaggcuacaucuccaccaggguuggcaugggggaggccgccgccaucuucaugacagcaaccccgcccggaagcguagaagcauucccccaauccaacgccgugauucaagacgaggagcgggacauccccgagcgaucauggaacuccggauaugaguggaucacggacuuucccggaaaaaccguuugguucgucccgagcaucaaguccggcaacgacaucgccaacugccugcgaaagaacgggaagcgggugauccagcuuagccgcaagaccuucgacacggaguaccaaaagacgaagaacaacgauugggacuacgucgugaccacugauaucagcgaaaugggcgcgaauuuucgggcugauagggugaucgaccccagacggugccugaagcccgucauccugaaagacggccccgagcgggugauccucgccggaccgaugccggucacgguggcuagcgcugcgcagcgccgggggcggauaggccgcaaccacaauaaagagggcgaucaguacaucuacauggggcagccccugaacaacgacgaggaccacgcccacuggacagaagccaagauguuacucgacaacaucaauacccccgagggcaucaucccggcuuuguucgaaccagagcgggagaaguccgcggccauagacggugaguaucgccuacggggcgaggcaagaaaaaccuucguggaacucaugaggcgcggggaccugcccgucugguuaaguuacaagguggccuccgagggcuuucaguacagcgaucgccgcuggugcuucgacggcgagcgcaacaaccaagugcucgaggagaacauggaugucgaaaucuggaccaaggagggggagcgcaagaagcugagaccccgcuggcuggaugcgcggaccuacagcgauccgcucgcccugcgggaauucaaagaguucgcugccggcagacgcucggugucuggggaccugauucucgagaucggcaagcugccccagcaucuuacccagcgggcccaaaacgccuuagacaaccuggugaugcugcauaacuccgagcagggcgggcgcgcguaccgucaugcgauggaggaauugcccgacacuaucgagacccugaugcuacucgcccugauagcgguccugacaggcggggugacacucuucuuccugagcggccgaggucuugggaagacguccaucgggcuacugugcgugauggcgagcuccguccugcuuuggauggcaagcguggaaccacacuggaucgccgccuccaucauacuggaguucuuccugauggugcuccugaucccggagcccgaucggcagcgaacgccccaggauaaccaacuggccuacgucgugaucggucuccuguucaugauccugacgguggccgcuaacgagaugggcuugcuggagacuaccaagaaggaccuggggauaggccaugucgccguggggaaccaccaccacgccgcaaugcucgacguggaccuacacccggccagcgcguggacccuguacgccgucgcaacgacgaucaucacccccaugaugcgccacacgaucgagaacaccacggccaauauaucccucaccgcgaucgcgaaccaggcagcgauccugaugggccuggacaaaggcuggccaaucagcaagauggacaucggggugccccuccuggcacugggcugcuacagucaggugaacccucucacccuaaccgcggccguccugaugcucguagcccacuacgcgaucaucgggcccgggcugcaggccaaggcgacgcgggaggcccagaaacgcacagccgccggaaucaugaagaaucccaccguggacggcaucgucgccaucgaccuggacccugugguguacgaugcgaaguucgaaaagcagcucggccagaucaugcuacugauccucuguacuagccagauccugcuuaugcggacgacaugggcccucugugaaaguaucacccuggccaccggcccgcugacgacccucugggagggcagccccgguaaguucuggaacaccaccaucgcagucuccauggcaaacaucuuccgaggcagcuaccuggcgggcgccggccuggccuucucccugaugaagucccugggagggggacggcgcgggacgggcgcccagggcgagacucugggggagaaguggaagcggcagcucaaccagcucucgaaguccgaguucaacacuuauaagcgcagcggcaucauggaaguugaucgaucagaggcgaaagagggcuugaagcgcggcgagaucaccaaacacgccgugagccgugggacggccaagcuccgcugguucgucgagcggaaucuagugaagccggaggggaaggugaucgaccuggggugcgggcgcggcgggugguccuacuauugcgccggccugaagaaggucaccgaggucaagggauacaccaagggcggcccggggcacgaggagccgaucccaauggccaccuacggcuggaacuuggugaagcugcauagcgggaaggacguguucuuugucccgccagagaagugcgacacacugcuaugcgacauaggcgagucuaguccgaaccccaccaucgaggaagggcggacccugcgcguacuuaaaaugguggagcccuggcuccggggcaaccaguuuugcaucaagauacugaaccccuacaugccguccgugguggagacccuagagcaaaugcagcguaagcacggagggaugcucguucggaacccucugagccgcaacuccacucacgagauguacugggugagcugcgggaccgguaacaucguauccgcuguuaacaugaccagccgcaugcugcuuaaccgguucaccauggcccaccgcaagcccaccuaugagcgggauguagaccugggcgccggcacucgccacguggccguggaacccgagguggcaaaccuggacauaaucgggcaaaggauagagaacaucaagcacgagcauaaguccaccuggcauuaugacgaggacaauccguauaagaccugggccuaucacggcagcuacgaggucaagcccuccgggagcgcuuccaguauggugaacggcgucgucaagcuccugaccaagcccugggaugucauuccuauggugacgcagaucgcaaugaccgacaccacuccguucgggcagcagcgcgucuucaaggagaaggucgacacgcggacccccaaggccaagcgcgguaccgcccagauuauggaagugaccgcgaaguggcuguggggauuccucagccggaacaaaaagccccgcauaugcacgcgagaggaguucacucgcaaaguucgguccaacgccgcuaucggagccguguuuguggacgaaaaccaguggaacagcgcgaaggaggccgucgaggacgaacgcuucugggaccugguucaccgggaacgcgagcugcacaagcagggcaagugcgccaccugcgucuauaacaugauggggaagcgggagaagaaacucggcgaguucgggaaagccaagggcucccgcgccaucugguacauguggcugggcgcgcgguuccuggaauuugaagcccucggguucaugaacgaagaucacugguucagcagggagaacucccugucaggcgucgagggggaggguuugcacaaguuaggguauauccugcgcgacaucuccaaaauuccgggaggcaacauguacgccgacgacaccgcuggaugggacacuaggaucaccgaggacgaccugcagaacgaggcaagaaucaccgacaucauggagccugagcaugcgcuccuggcgaaaucaaucuucaagcuaaccuaccagaauaaggugguucggguccagcgccccgccaagaacggcacggugauggacgugaucaguagacgcgaccaacgggggucaggccaggucggcacguacggccuuaacaccuuuaccaacauggaggcccagcugauccgccagauggaguccgagggcaucuucaguccgagugagcuggagacgccgaaccucgccgagcgcgugcuggacuggcuggagaaguacgggguggagagguuaaagcggauggcgaucagcggcgacgacugcgucgugaagcccaucgacgaccgcuuugccaccgcccugaccgcucugaacgauauggggaaggugaggaaagacaucccccagugggaaccauccaagggauggaacgacuggcagcaggucccguucugcagccaccacuuccaucagcucaucaugaaggacggccgcgagaucguugugcccugccggaaucaagacgagcuggucgggcgcgcacgggucucacagggagccggguggagccuacgggaaaccgccugucucggcaaaagcuacgcccagauguggcagcucauguacuuucaccggcgcgaucugagacuugcggcgaacgcuaucugcagcgccgugcccgucgauuggauacccacgagucgcaccaccuggucaauccacgcacaccaccaguggaugaccacggaggacaugcugagcguguggaaccgcguguggaucgaggagaauccguggauggaggacaagacccacaucuccagcuggggcgauguacccuaccugggcaagcgcgaagaccaauggugcgguucacuaaucgggcugaccgcucgugcgaccugggcuacgaacauccagguugccaucaaucagguucggcggcuaaucggcaacgagaacuaucucgauuacaugaccagcaugaagcgguucaagaacgagagcgacccagagggcgcucugugguga

SEQ ID NO: 23837 - RNA, 9879 nt, Artificial Sequence
  derived and/or modified CDS sequence (opt11) from DENV-1__FJ639691__SS-prME
agcgugacuaugcugcucaugcugaugcccaccgcccuagccuuccacuugacaacacggggcggggaaccccacaugaucgugagcaagcaggaacgggguaagagccugcuguuuaagacuucugccggggugaauaugugcacccucaucgcgauggaccugggcgaauuuugcgaggacaccaugaccuauaagugcccccggauaagcgaggccgagcccgaugacguagauugcuggugcaacgcaacggacaccugggugaccuacggaaccugcucccaaacaggagagcaccggcgugacaagcggucgguggcccuagcgccgcaugugggccuagguuuggaaacacguacggagaccuggauguccagugaaggcgcauggaagcagauccagcgggucgaaaccugggcucugcgccaccccggguucaccgugaucgccuuauuucucgcgcacgccauugguacauccaucacccagaaggggaucaucuuuauccugcucaugcuggugacccccagcauggccaugcggugcgucggcaucggcucccgggauuucguugaaggucuaucgggcgccaccuggguggacgucgugcucgagcacggguccugcgugacgaccauggccaaggauaaaccuacccucgacaucgaacugcucaaaaccgaagucacaaaccccgcggugcugcguaagcugugcauagaggccaagaucagcaacaccaccaccgacucccgcugcccgacgcagggugaggccacguuaguggaggagcaagacgccaacuucguuugccggcgcacauucguggaucggggcuggggcaacggaugcgggcuguuuggaaagggcagccucaucacuugcgccaaauucaagugcguaacaaagcucgagggcaagaucgugcaguacgagaacuugaaguacucagucaucgugaccguccacaccggggaccagcaccagguggggaacgagagcaccgaacacggcacgaccgcgaccauuacuccccaggcccccuccaccgagauccaacugacggacuacggggcccucacccuggacugcucgcccagaacgggccuugacuucaacgagauggucuuacugacuaugaaagagaaguccuggcuggugcacaagcagugguuccucgaccucccgcugcccuggacgucaggggcuagcaccucccaggaaacguggaaccggcaggauuugcuggugaccuucaagacggcccacgcgaaaaaacaggagguagugguacuggguucacaggagggggcuaugcacaccgcccucacgggggccacagagauacagacguccggcacuaccaccaucuucgcggggcaccuuaagugcaggcugaagauggacaagcucacgcugaagggcaugagcuacgugaugugcaccggauccuuuaagcuggagaaggagguagcggagacccagcacgguacaguauuaguccagaucaaauacgagggcacggaugcccccugcaagauacccuuuucuacgcaagacgaaaagggcgugacccagaauggcagacugauaaccgccaacccgaucgugacggacaaggaaaagccgguaaacaucgaggccgagccgcccuucggggaaagcuacaucguaaucggcgcaggcgagaaggcccugaagcugaguugguucaagaaaggguccucgauuggaaagauguucgaggccaccgcccgaggagcaaggaggauggcgauacugggcgauaccgccugggauuucggcagcauaggcggaguguucaccucggucgguaagcugguccaucagaucuucggcacggccuaugggguguuguucucuggcgugagcuggacgaugaagaucggaaucggcguguuacugaccuggcugggccuuaacucccguagcaccuccuugagcaugacgugcaucgccgucgggcugguuacccucuaccugggcgucauggugcaagccgacucugggugcgucaucaacuggaaaggacgcgagcugaagugcggguccggcaucuucgugacuaacgaggugcacaccuggacggagcaguacaaguuccaggcggacucaccgaagcgacuuucggccgccaucggcaaggcaugggaagagggggucugcgguauccggagugccacccgacuagagaacauaauguggaagcagaucuccaacgagcugaaucacauccuccuggagaaugauaugaaguuuaccgugguagucggggauguugcgggcauccucgcgcaggguaagaagaugauacggccccagcccauggaauacaaguacagcuggaaauccuggggcaaggccaagaucaucggcgccgacguucagaacaccaccuuuaucaucgaugggcccaacacuccggagugccccgacgaccagcgcgccuggaacaucugggaggucgaggacuacggcuucgguaucuucaccacaaacaucuggcuaaagcugcgugacucguauacucaggugugcgaccaccggcugauguccgccgccaucaaggacagcaaggccgugcacgccgacaugggcuauuggaucgaguccgagaaaaacgagacguggaaacucgcgcgggccucguucaucgaggucaagaccugcaucuggcccaagucccacacccucuggucuaacggcgugcuggagucugagaugaucauucccaaaauauacgggggcccgauuagccagcacaacuacaggcccggguacuucacccaaacggcgggccccuggcacuugggcaagcuggaguuggacuuugaccucugcgagggcacgaccguggucguggacgagcacugcggcaaccgggggccguccuugcgcacuacgaccgugacuggcaaaaucauccacgaguggugcugccgaucaugcacccugccgccucugcgcuucaagggugaggacggcugcugguacgggauggagauacggcccgucaaggaaaaagaggagaaucugguaaaaagcaugguguccgccggcagcggcgagguggacuccuucagccuggggcuccugugcaucuccaucaugauugaggaggugaugcgcagccgauggucccgcaagaugcugaugacgggcacucucgccguauuuuuccuucugauuauggggcagcuuaccuggaacgaccugauacggcugugcauuauggucggcgcaaacgccucugaccgcauggguaugggcaugaccuacuuggcgcugauggcaacguucaagaugcgcccgauguuugcugugggccuccuguuccggcgucugaccucccgggaggugcuguuacugacgaucgggcugagccucguugcguccguggagcugcccaauagccuggaggagcuuggcgacgggcuggcuaugggcauuaugauucugaagcuccugaccgacuuccaguccuaccagcugugggccacgcuccucagccugacuuucaucaagacgaccuucuccuugcacuacgccuggaagacaauggcgaugguacugagcauugucucccuguucccccucugcuugagcacaaccucccaaaagacuacgugguugccgguacuccugggcagccugggcugcaagccgcucaccauguuucugaucgcggagaacaagaucuggggccgcaaaagcuggccccugaaugagggcauaauggcagugggcaucguguccauccucuuaagcuccuuacucaagaacgauguaccucuggccgggccccugaucgccggcgggauguuaaucgcgugcuaugucauuagcgggucuagcgccgaccugucccuggagaaggcagccgaagugagcugggaagaggaagccgagcacuccggcgcgagccacaacauccucguggagguccaggacgacgggacaaugaagaucaaggacgaggagcgggacgacacccugacgauccugcucaaggcgacccugcuggccguauccggaguguacccgcucagcauacccgccacccuuuucgucugguauuucuggcagaagaagaagcagcgcucuggggugcugugggauacgcccagcccaccugagguggagcgggcaguccucgacgacggcaucuacagaauaaugcagcggggcuugcuugggaggucccagguaggcguugggguauuucaggagaauguguuccacaccauguggcaugugacgaggggggcgguccugauguaccaggggaaacgcuuggaaccuagcugggccuccgugaagaaggacuuaaucagcuacggcggaggcuggcggcuccagggcuccuggaauaccggggaagagguucagguuauagccguggaacccggcaagaaccccaaaaaugugcagaccgcccccgggacguuuaagacuagcgagggcgaggucggcgccaucgcgcuugauuucaagcccgggacgagcggcucgcccaucguaaaucgcgaggggaagauugucggccuguacgggaacggggugguuaccaccucaggcacuuacguguccgccaucgcccaagcuaaagcaagccaagaggggccccugccggagaucgaagacgaggucuuccggaagaggaaccucaccaucauggaucugcaccccggcuccgggaagacccgccgcuacuuacccgccaucguccgggaggccauuaaacggaaacuccggacccuaauccuggccccgacgcguguggucgccagcgaaauggcggaagcccuuaagggcaugccaaucagguaccagacuaccgcugugaaauccgaacauaccggcaaggagaucgucgaccugaugugccacgccacguucacgaugcggcugcucagccccguacgcgugcccaacuauaacaugaucaucauggacgaggcccacuucaccgacccgucuagcaucgcggcccgggguuauaucucgaccagagugggcaugggggaggccgccgccaucuucaugacggcgaccccgcccggcuccgucgaggccuucccccagagcaacgcggugauccaagacgaggagcgggacaucccggagcgaucuuggaacucaggauacgaguggauuaccgacuuccccggcaagaccgucugguuugucccaagcaucaaauccggcaacgacaucgcuaacugccugcggaagaaugggaagcgcgugauucagcugucccggaagacguucgacacugaguaccagaagacgaagaauaacgacugggacuauguggugaccacugauauauccgagaugggcgccaacuuccgcgccgacagagugauugacccccgcaggugccuaaaaccggugauccugaaggacgggcccgaaagagucauacuugcuggccccaugcccgugacugucgccagugccgcccagcgucgcgggaggaucggccgcaaccacaacaaggagggugaccaguacaucuacaugggucagccgcucaacaacgaugaagaucaugcccacuggaccgaagcaaagaugcugcuugacaauaucaacaccccugaggguaucauccccgcccucuucgagcccgaacgggagaaguccgccgcuaucgacggggaguaccgccugaggggcgaggcccggaagaccuucgucgagcuaaugcggcgcggagaccucccgguuuggcucuccuacaaggucgcaagcgagggcuuccaauacucugaccgccguuggugcuucgacggcgagcgcaacaaccaggugcuagaggaaaacauggacguggagaucuggaccaaggagggggagcggaagaagcugcgcccccggugguuagacgcuaggaccuacagcgacccgcuugcacuccgggaguucaaggaguucgcggcaggccgccggagugucagcggggaccugauccuggagaucgggaagcucccccaacaucugacccagcgcgcccagaacgcacuggacaaccucgugaugcugcacaauuccgagcagggcgggcgagcuuaccgccacgccauggaggagcuacccgacacuaucgagacccucaugcuucuggcccucaucgcgguguugaccggcggugucacccuguucuuucucagcggucgggggcucgggaagacguccaucggccugcucugcgugauggccucuucggugcuacuguggauggcuuccgucgagccccacuggaucgccgccuccaucauccucgaguucuucuugaugguuuuacucauccccgaaccugaccgccagcggaccccgcaggacaaccagcuggccuacgugguuauuggccuccucuucaugauucugaccguggccgcaaacgaaaugggccugcucgaaaccacuaagaaggaccugggaaucggucacguggccguugagaaccaccaucacgcagccaugcuggacguggaccuccaucccgcaucugcguggacgcuguacgccgucgccaccaccauuauaacccccaugaugaggcacaccauugagaacaccacugccaacaucucccugacggccaucgcgaaucaagccgcuauacucauggggcuggacaagggcuggccgaucagcaagauggacaucggcgugccccugcuagcucugggauguuacucccaagugaacccacugacguuaacggcggcgguucugauguuagucgcccacuacgcuaucaucggacccggccugcaagccaaagccacgcgggaggcccagaagcgcacagccgcaggcaucaugaagaauccgacuguggacgggauaguugcuaucgacuuggaccccguaguguacgacgcgaaguucgagaagcaguugggccagaucauguuguuaauccugugcaccagccagauccucuugaugcgcaccaccugggcccugugcgaguccaucacacuugccaccggcccacugacuacacugugggaggggucccccggcaaguucuggaacacgacaauagcagugagcauggccaacaucuuccggggguccuaccucgccggcgccggucuggccuucagccucaugaagucccucgggggcggccgccggggcacaggagcccagggcgagacccugggcgagaaguggaagcggcaacugaaccagcucagcaaauccgaauuuaacacguacaagcguagcgggauuauggaggucgaccgcucggaggcgaaggagggucugaagcgaggggagaccaccaaacacgccgucagccgcggaaccgccaagcuacggugguucguggaacgcaaucucguuaaaccggaggguaaagugaucgaccugggcugcggccguggcgggugguccuacuacugcgccgggcucaaaaagguuacggaagucaagggguauacuaagggggggcccggccacgaggagccaaucccuauggccaccuacggguggaacuuggugaaguuacauagcggaaaggacguguucuucgucccgcccgagaagugcgacacccugcuuugcgacaucggggaauccagcccgaacccuacuaucgaggagggucgcacccuacgggugcugaagaugguagagccguggcugcgcgggaaccaguucugcaucaaaauccucaaccccuacaugcccuccguugucgaaacccuggaacagaugcagcggaaacacggcggcaugcuggugcgcaauccgcucagccggaacuccacacacgagauguacugggucuccugcgggacgggcaacauuguauccgcggugaacaugaccagccgcaugcugcugaaccgauucaccauggcccaucgcaagccgaccuacgagcgcgacgucgaccucggggccggcacccggcacguggccguggagcccgagguagcaaaccuggacaucaucggccaacgcauagagaacaucaaacaugagcauaaauccaccuggcacuacgacgaggacaaucccuacaagaccugggcauaucacggcuccuacgaggugaaaccgucuggcucagccuccaguauggucaacggaguggugaaguugcucacuaagccuugggacguuauccccaugguaacccagauugcgaugacggacaccaccccauuuggccagcagcgagucuucaaggagaagguggacaccaggacgcccaaggccaagcguggcacugcccagaucauggaggugaccgcgaaauggcuguggggcuuccugagccgcaauaaaaagccgcggaucugcacccgcgaggaguucacgcguaaggugcgcuccaaugccgccauuggcgccguguucguugacgagaaccaguggaauagcgcaaaagaggccguggaggacgaacgguucugggacuuaguccaccgcgagagagagcuccauaagcaggggaagugcgcgacuugcguguauaacaugaugggcaagcgcgagaagaaguuaggcgaguucggaaaggcaaaggggagucgggccaucugguacauguggcucggcgcgcgcuuccuggaguucgaagcccucggcuucaugaacgaggaucacugguucagccgggagaacucucucucagggguggagggcgagggguugcacaagcugggcuacauauugcgcgacaucagcaagaucagcgguggcaacauguacgccgacgacaccgccgggugggacacccggaucacugaagaugaucugcagaacgaagcaaaaaucacggacauuauggagcccgagcacgcgcuguuggcaaaguccaucuuuaagcugaccuaccagaacaaggucguaagggugcagcgccccgcaaagaacgggacugugauggacgugaucucucgccgcgaccagcgcggcaguggccaagugggaacguauggccugaacacguucaccaacauggaggcccagcuuauccgccagauggaaagcgaagggauuuucagccccagcgagcuggaaacacccaacuuagccgaacggacgcucgacuggcuggaaaagcacggcguggagcgacugaagcgaauggcgaucucgggggacgacugugugguuaagcccaucgacgacagguucgccaccgcucuuaccgcccugaacgacaugggcaaaguccggaaggacaucccccagugggagcccuccaagggguggaacgacuggcagcagguccccuucugcagccaucacuuccaucagcugaucaugaaagacggccgcgagaucguugucccuugcagaaaccaagacgagcuggugggccgggcccgggugucgcagggagcagguuggagccugcgcgaaacugcaugcuugggcaaguccuacgcccagauguggcaacucauguacuuucaccggagagauuugcgguuagcugcaaacgccauaugcagcgccguucccguggacugggugccuacgucccgcaccaccuggagcauucacgcccaccaccaguggaugaccacggaggacaugcucucagucuggaaccgcguguggaucgaggaaaaucccuggauggaggacaagacccacauaucaucaugggaggacgugcccuaucugggcaagcgcgaggaccaguggugcgggagccugaucggacugaccgcacgggcgaccugggccacgaacauccaagucgcuaucaaccagguacgucgucugauuggcaacgagaacuacuuggacuacaugacguccaugaagcgguucaagaacgaaagcgaucucgagggggcccugugguag

SEQ ID NO: 23838 - RNA, 9879 nt, Artificial Sequence
  derived and/or modified CDS sequence (opt11) from DENV-1__FJ639692__SS-prME
uccguuaccaugcugcucauguugaugcccaccgcgcuggcuuuccacuugacuacccggggcggcgagccacauaugauugucucgaagcaggagcggggcaagucucugcucuucaaaaccuccgcggggguaaacauguguaccuugaucgcgauggaccuuggcgagcugugcgaggacacaaugaccuacaaguguccccgaauuaccgaggcagagcccgacgacguugacugcugguguaaugccaccgacacuugggugacauacggcacuuguucgcagaccggagagcaccggcgagauaaacgguccguggcucucgcgccccacgugggacugggucuggagacgcgcaccgagaccuggaugagcucugagagcgcauggaaacagauccagcggguggagacaugggcccuacgccacccgggcuucacugugaucgcccuguuccuggcgcacgccauugguaccucuaucacccaaaaaggcauuaucuucauucuccugaugcuggugacccccucuauggcaaugcgcugcguugggauuggcagucgcgacuucguggagggccuuucaggggccacauggguggacgucguucucgagcacggaucuugcgugaccaccauggccaaggauaagcccacacucgacauugaacuucugaagacggagguaacaaaccccgcgauccugcggaagcucugcaucgaggccaagauuagcaacaccaccacggauuccagaugcccgacccagggcgaggccacccugguggaggaacaggacgcuaacuucguaugccggcgcaccuucguagaccgggguuggggcaaugguugcggucuguucgguaagggcucucucauaacgugcgcaaaguucaaaugcgucaccaagcuggaggggaagaucgugcaauacgagaaucugaaauacucggugaucgucaccgugcacaccggugaucagcaccaagucggcaaugagagcacggagcacggcaccaccgcgaccaucacgccccaagccccuaccacggagauccaacucaccgacuacggcgcccuuacccuggacugcuccccccggacggggcucgacuucaacgagauggugcugcuaacaaugaaggagaagaguugguugguccacaaacaaugguuccuggauuugccccuccccuggacaagcggcgccuccaccagccaggaaacguggaaccgccaggaccugcuggucaccuuuaagaccgcacacgcaaagaagcaggagguugucgugcucggaucacaggagggugccaugcacacugcgcucaccggggccaccgagauccagaccucggggaccacaaccaucuucgccggacaccugaagugccgcuugaagauggacaagcugacccucaaggggauguccuacgugauguguacagggucuuucaagcuggaaaaggagguggcggagacacagcacgggaccgugcuaguccaaauaaaauacgagggcaccgacgcccccugcaagaucccauucuccacccaggacgagaagggagucacgcagaacgggcggcugaucaccgccaacccaaucgucacugacaaggagaagccagugaacaucgaggcagagccgccauucggcgagagcuacaucgucaucggggcaggggagaaagcccugaagcucuccugguucaaaaagggcaguuccaucgggaagauguucgaggccaccgcccgcggagcacgccgcauggcgauccugggggacacggcuugggacuuuggcagcauugggggcguguucacuuccgugggcaaguugguacaccagaucuucgggaccgcuuauggcgugcuguucuccgggguguccuggacuaugaagaucggcaucgggguuuugcugacguggcucggccuuaacagccgaagcaccucccucucuaugaccugcaucgcuguugguuuaguuacgcucuaccugggggugaugguucaggcagacucgggaugugucaucaacuggaaggggcgggagcucaagugugggagcgggaucuucgucaccaacgagguucacaccuggaccgaacaguacaaguuccaggcggacuccccaaagcgccugagcgcggcgaucgggaaggccugggaagaaggcguuugugguauacggucugcuacccggcuugagaacauuauguggaagcagaucaguaacgaguugaaccacauccuccuggagaacgacaugaaguuuaccgugguggucggcgacguugcggguauacuugcccagggcaagaaaaugauccgaccccagcccauggaauacaaguacuccuggaaauccuggggcaaggccaagaucauaggggcugaugugcagaacacgaccuuuaucauugauggcccuaacacuccggaaugcccggacgaccaacgcgcuuggaacaucugggagguggaagacuacggcuuuggcaucuucaccacaaacaucugguugaagcugcgggacaguuauacccaggucugcgaucaccggcucaugucagcugcuaucaaggacuccaaggccguccacgcugacaugggcuacuggaucgagagcgagaagaacgagaccuggaagcuggccagggcuuccuucaucgaggugaagaccugcauuuggcccaaaagucacacgcuuuggucuaacgguguccucgagagcgagaugaucaucccaaagaucuacggagggccaaucucacaacacaacuaccguccgggcuacuucacccagaccgccgggccguggcaccuggguaaacuggaguuggacuucgacuugugcgaagggacuacgguggucguugaugagcacuguggaaaccggggccccagccuacgcaccacgacggugacagggaaaaucauccacgaauggugcugccggucaugcacacugcccccccugcgcuuucggggcgaagacggaugcugguacggcauggagauacgucccgugaaggagaaggaggaaaaucuggucaaaagcauggugagcgcggggucgggcgaaguggauucauuuucccucggcuugcugugcauaagcauaaugaucgaggagguaaugcgaucccgguggagccggaaaaugcucaugaccgggacccuggccguguuccugcuccuuaucauggggcagcugacauggaacgaccucauccgccugugcaucaugguuggggcaaacgccuccgaccgcauggguauggggaccaccuaccuggcccugauggccaccuucaaaaugcggccgauguucgccguggggcugcucuuccgccgguuaacgagccgagagguacuauuacucaccauaggucuauccuuaguggcgagcgucgaacuccccaacucccuggaagaguuaggugacggccucgccauggguauaaugauccugaagcuccucaccgacuuccagagccaucaacugugggccacccugcucucccugacuuucaucaagaccaccuuuagccugcacuaugccuggaaaaccauggcgauggugcucucuaucguaagccuguucccccugugccucuccacgacaagccaaaaaacuaccuggcugcccgugcugcugggcucccuaggcugcaagccucuaacgauguuccucaucgccgaaaacaagauaugggggagacgcagcuggccgcugaacgaggguauaauggccguggggaucgucucuauccugcucuccucucuccugaagaacgaugugcccuuggccgguccucugauugccggcggcaugcugaucgcgugcuaugugauaaguggcucauccgccgaccugucgcuggaaaaggccgccgaggucuccugggaggaagaagccgagcacagcggggcgucccacaacauccugguggagguucaggacgaugguaccaugaagauuaaggacgaggaacgggaugacacgcucacuauccucuuaaaggccacccuccucgcagugagugggguuuacccacugucaauucccgccacccucuuugugugguacuucuggcagaagaagaaacagcgcucgggcguccugugggacacucccagcccacccgagguggagcgggccgugcuugacgaugggaucuaccgcaucaugcagcguggccuucucggccgcucucaggucggggugggaguguuccaggagaacguguuccauaccauguggcacgugacccgcggcgcgguacugauguaccagggcaaaaggcuggaaccaagcugggccagcgucaagaaggaccucauauccuacggcggcggcuggcgguugcagggguccuggaacacuggcgaggagguccaggugauugccgucgagccagggaagaaccccaagaacgugcagacugcgccuggcaccuucaaaacccccgagggggagguuggagcaaucgcgcuggacuucaagcccggcacauccgggucacccaucgucaacagagaaggcaagauagucgguuuauacggcaaugggguggucacgaccucaggcaccuacgugucggccaucgcccaggcuaaagcgagccaggagggcccucugcccgagaucgaggaugaaguuuucagaaaaagaaaucucacgaucauggaccuccacccugggucaggcaaaacgcggcgcuaccugcccgcuauuguacgugaggccauaaagagaaaacugcgcacacugauccuggcccccacccgggugguggccucugagauggcggaggcccugaaggggaugcccauccguuaccagacgaccgcgguuaaauccgagcacaccggcaaggagauuguagaucucaugugccacgccacauucaccaugcgccugcucagccccgugcgcgugccgaacuacaauaugaucauuauggacgaggcccacuucaccgaucccuccaguaucgcggcacguggcuauaucucuacccgcgugggcaugggugaggcugccgccauuuuuaugaccgcgacgccucccgggucaguggaggccuucccgcaguccaacgcacuaauccaggaugaggagcgagacaucccggaacguucauggaacucgggcuacgaguggauuacggauuuccccgggaaaaccguaugguucguccccagcaucaagucugggaacgacaucgcgaacugccuacggaagaacggaaagcgugucauccagcugucucggaaaacuuucgacacggaguaccaaaagacaaagaacaacgacugggauuacguugugacaacagauauuagugaaaugggggcgaacuuccgcgcagaccgggugaucgacccucgccgcugccucaagccgguaauccugaaagauggccccgagcgagugauucuugccggccccaugccggugacggucgccuccgccgcgcaacggagggggcgcauuggacgcaaucacaauaaagagggcgaccaauacaucuacaugggccagccccucaacaaugacgaggaccacgcucauuggacugaggccaagauguuguuagacaacaucaauacccccgaagggaucauacccgcccucuuugagccggagcgggagaaguccgcugcgaucgacggcgaguauagacugcggggcgaagcgcguaagaccuucguggaguugaugcgccguggcgaccuccccgucuggcugagcuacaaggucgccagcgagggguuccaauacuccgaccgccgguggugcuucgacggcgagcgaaacaaccagguguuagaggagaauauggacgucgagaucuggacgaaggagggagagagaaagaaguuacgcccccgguggcuggacgcccgcacauacagugacccgcuagcgcuacgugaguucaaggaauucgcggccgggcgccguucugucagcggcgaccuaaucuuagagauugggaaguuaccgcagcaccugacccagcgcgcccagaacgcccucgacaaucucgugaugcugcacaauucagagcaaggcggccgcgcguaccggcacgccauggaggaguuaccggacacaauagagacguugaugcugcuugcccucaucgcuguucugaccgggggcgugacacuguuuuuccucagcgggcgaggcuuaggcaaaaccuccaucggccuccucugcguaauggccagcagcguccuccuuuggauggcgagcguggaaccccacuggaucgccgccuccaucauccucgaauuuuucuugauggugcugcucaucccagaaccggaccggcagagaacgccacaggauaaccagcuugccuacguugugauuggccuccucuuuaugauccuaacgguugccgcgaacgagaugggucugcucgagaccaccaagaaggaccucggcauugggcacguagcaguuggaaaccaccaccacgcggcaaugcuggacguggaccuccacccagccucagcuuggacacuguacgccgucgccaccaccauaauuaccccuaugaugcgccacaccaucgagaacacgaccgcaaauauuagucugacggccaucgccaaccaggccgccauccuuaugggcuuagauaagggguggccaaucagcaagauggauauaggcgugccgcugcuugcgcuggggugcuacucccaggugaacccccugacccucacggccgccguccugaugcuaguggcccauuacgccauuaucggcccgggguuacaggccaaggcaacccgggaggcccaaaagcgcaccgccgccggcaucaugaagaaccccacaguugacgggauuguugccauugacuuggaccccguugucuaugacgcgaaauucgagaagcaacuuggccagaucaugcuccugauccugugcacgucacagauccuccugaugcgcacgaccugggcccugugcgagucaaucacccucgccacgggcccccugaccacccuuugggaggggagcccaggcaaguucuggaacaccacgaucgcagucagcauggcuaacauauuucgggguucuuaccuggcgggcgcggggcuggcuuuuagccugaugaagucccucggcggggggcgccggggcaccggcgcccagggcgaaacacugggcgagaaguggaagcgacagcugaaccagcucucgaaguccgaguucaacacauacaagcggagcggaaucacggaaguggacagguccgaggcgaaagagggccugaagcgcggagaaaccaccaagcacgccguuagccgcggcaccgcaaaacuucggugguucguugagcgcaaccuggugaagcccgagggaaaggugaucgaccucggcugcggccgcgguggauggucuuacuacugcgccggauugaagaaggucacggaggugaaaggguacacgaagggcgggccaggccaugaggagccgaucccaauggccacauacggcuggaauuuggugaagcuacacagcggcaaggacgucuucuucaucccgcccgagaagugcgacacccuguuaugcgacaucggggaguccucacccaacccuacgaucgaggagggccgcacccuccgggugcuuaagaugguggagcccuggcuuagagggaaccaguuuuguaucaagaucuuaaauccauacaugccuucugucguugagaccuuggagcagaugcagcggaagcacggcggcaugcucgugcgcaacccgcucucgaggaacucaacccacgagauguacugggugucgugcgggaccggcaauaucgucucggcggugaacaugacgagccgcaugcugcuaaaccgcuucaccauggcccaccgcaagcccacuuacgaacgcgacguugaccucggggcuggcacgcggcacguggccguagagcccgagguugcgaaccuagauaucauaggccagcgcaucgagaacaucaagcacgagcacaagaguaccuggcacuacgacgaggacaaucccuacaaaacgugggcguaccacgggagcuacgaggugaagccgucaggaagugcaagcucaauggugaacgggguggugaagcuguuaaccaagccgugggacgucauccccauggugacccagauugccaugacggacacuacccccuuuggccagcagcggguguucaaagagaagguugauacacggacgccgaaggcaaagcgggggacggcccagaucauggagguuaccgcaaaguggcuguggggcuuccugagccgaaacaagaagccgcggaucugcacgcgcgaggaguucacgcgaaaggugcgcagcaaugcagccaucggcgccguuuucguggaugagaaccaauggaacagcgcgaaggaggccguggaggacgagcgguucugggaccucguccaccgcgaacgggagcugcacaagcagggaaagugugcgacgugcguguauaacaugaugggcaaacgggaaaagaaguugggugaauucggcaaggcgaagggguccagggccaucugguacauguggcucggcgccagauucuuggaguucgaggcgcugggguucaugaacgaggaccacugguuuagccgggagaacuccuugagcgggguggaaggcgaggggcugcacaaacucggcuacauucuucgcgacaucuccaagauccccgggggcaauauguacgccgacgauaccgccggcugggacacucggauuacggaggacgacuuacagaacgaggccaggaucaccgacaucauggagccggagcacgcgcuacucgccaaaagcaucuucaaguugacguaccagaacaaagucgugcgcgugcagcggcccgccaaaaacgggaccgucauggaugugaucucccgccgggaucagagaggcagcggccaggugggaacguacggccuuaacaccuuuacuaacauggaggcccaacucauccggcagauggaaucugaggguaucuucucaccuuccgagcuggagacacccaaccuggcggaacgcguauuagacuggcuggaaaaauacggcguggagcgguuaaagagaauggcgauuucgggagacgacugcguggucaagccgaucgacgaccgguucgcgacagccuugaccgcccugaacgacaugggcaagguacgcaaagacaucccccagugggagcccuccaagggcuggaaugauuggcagcaggucccuuucugcagccaccacuuccaccagcugaucaugaaggacggccgggagaucguagugccgugucgcaaccaggacgagcucgucggccgcgcccgcgucucccagggggcuggcuggucccuacgggagacagccugccugggcaaaagcuaugcacagauguggcagcucauguacuuucaccggcgugacuugcgcuuagcggcgaaugccaucugcagcgcugugcccguggacuggaucccuaccaguaggacgaccuggagcauccacgcccaucaucaguggaugacgacugaggauaugcucagcguguggaaccgcguguggaucgaggagaaccccuggauggaggauaagacucacaucuccaguuggggcgacgugccguaccucgggaagcgcgaggaucaauggugugggucuuuaaucgggcucacagcacgggcgaccugggccaccaacauucaagucgccaucaaccaggugcgccggcugauagggaaugagaauuaccuggacuacaugaccagcaugaaacgcuucaaaaacgagagcgacccagagggcgccuugugguga

SEQ ID NO: 23839 - RNA, 9879 nt, Artificial Sequence
  derived and/or modified CDS sequence (opt11) from DENV-1__FJ639693__SS-prME
agcgugaccaugcuacucaugcucaugccuaccgcccuggccuuccaucucaccacccggggcggcgagccccauaugauagugagcaagcaggaacggggcaagagccucuuauucaagaccagcgcggggguaaauauguguacccugaucgccauggaccugggcgaguucugcgaggacacuaugacuuacaagugcccccggauaagcgaggccgaacccgaugacguggacugcuggugcaacgccaccgacaccugggucaccuacgggaccugcagccagacgggugagcaucggcgcgacaagcggagcguggcccuggcgccucacgugggccucgggcuggagacccggacggagaccuggauguccagcgaaggggccuggaagcagauccagcgggucgagaccugggccuugcgccacccgggguucaccguuaucgcccucuuucuugcacacgccaucgggaccuccaucacacagaagggaauaaucuucauccuguuaaugcuagugacccccagcauggccaugcgguguguugguaucggcucccgugacuucguugaggggcugagcggcgccaccugggucgacgucguccuugaacacggguccugcgugaccacaauggccaaagacaagcccaccuuggauaucgagcugcucaagaccgaggucacgaauccggcgguccugaggaagcucuguauugaggccaaaauaagcaacacgaccaccgacucccgcugcccaacgcagggggaggccacccucgucgaggaacaagacgccaauuuuguaugccggcgcacauucguggaccgcggcuggggcaacgggugcgggcuguucggaaaggggagccugaucacaugcgccaaguuuaagugcgugacaaaacucgagggcaagaucguccaguacgaaaaccugaaguacuccgugaucgugacuguccacaccggugaccagcaccagguugggaacgagagcacugagcacggcacaaccgcgacgaucacgccccaggcgcccuccaccgagauccagcugacggauuacggggcccucacccuggauuguagcccucgcaccgggcuggacuucaaugagaugguccuccugaccaugaaggagaaguccuggcuugugcacaagcagugguuccucgaccugccgcugcccuggacguccggggcgagcaccucccaggagaccuggaaucggcaggaccucuuagugaccuucaagacggcucaugcgaaaaagcaggagguggugguguuaggcagccaggagggcgccaugcacaccgcccucacaggggccaccgagauccaaacguccggcaccaccaccauuuucgccgggcaccuaaagugcagacugaaaauggacaaacuuacacugaagggcaugagcuacgucaugugcaccgggaguuucaagcuggagaaggaaguggcggagacacaacacggcaccguccucguccagaucaaauacgagggaacggacgcucccugcaagauaccuuucagcacccaggacgagaaaggggucacgcagaauggccggcugaucaccgccaacccgaucguaacagauaaggagaagcccgugaacaucgaagcagaaccgcccuucggggaguccuacaucguaauuggcgcgggcgagaaagcccugaaguuaagcugguucaagaagggguccaguaucggcaagauguucgaggccaccgcccgcggcgccaggaggauggcgauccucggcgacacggccugggauuucgggucuaucggcggcguguucaccagcgucgggaagcugguucaccagaucuucggcaccgccuacggcgugcuguucuccggcgucagcuggaccaugaagauugggaucggcgugcuacugaccuggcucggcuugaacucccgcagcaccucgcugagcaugacgugcaucgccguugggcuggugacccucuaccugggcgugaugguccaggcggacagcggaugcgucaucaauuggaagggccgugagcugaagugcggguccggcauauucgugaccaacgaggugcacaccuggacggagcaguacaaauuccaagcggacagccccaagcgucucuccgccgccaucgggaaggccugggaggaaggcgucugcgguauccggagcgccacacggcuggagaacaucauguggaaacaaaucuccaacgagcugaaucauauccuccuggagaacgacaugaaguucaccguggucgucggggauguagcgggcauucuggcccaggggaagaagaugauacggccccagcccauggaguacaaauacagcuggaaaaguuggggcaaggcaaagauuaucggggccgacgugcagaacacaaccuucaucauagacgggccuaacacuccugagugccccgacgaccagcgcgcguggaauaucugggaggucgaagacuacggcuucggaaucuuuaccaccaacaucuggcucaagcugagagauagcuacacccagguuugugaucaccgccugauguccgccgccaucaaggacagcaaggccgugcacgcugauaugggcuacuggaucgagagugaaaagaacgagacuuggaagcucgcgcgggccagcuucauugaggucaagaccugcaucuggcccaagucccacacccuauggucaaacggcgugcuggaguccgagaugauaauccccaagaucuaugggggccccauaucgcagcacaacuaucgcccgggguacuucacacagacggcgggccccuggcaccucgggaaacucgagcuggacuucgaccucugugagggcacuaccguggugguggacgagcacugcgguaaccgggggccgucccugcgcacuacgacggugacgggcaagaucauccacgagugguguugccguagcugcaccuugccgccccuacgcuucaaaggagaggacggcuguugguacgggauggaaauccggcccgucaaggaaaaagaagagaacuuagucaagagcaugguguccgccggcagcggagaaguagacucguucagccugggccuccugugcaucuccaucaugaucgaggaggugaugcgcagccgguggucccgcaaaaugcugaugacggguaccuuagccguguucuuccuccugaucauggggcagcucacguggaaugacuugauccgccugugcaucauggucggugcuaaugccagugaucgcauggguaugggcaugacguaccucgcucuaauggccaccuuuaagaugaggccgauguucgccgugggccuccuguuccggcgccugaccucccgggaagugcugcugcugaccaucgggcugagccuagucgcguccguggaguugccgaauagccuugaggagcucggagacggcuuagccauggguaucaugauccugaaguugcugaccgacuuccagucccaccagcuuugggccacgcuucugucacugaccuucaucaagaccacguuuucccuccacuaugccuggaaaaccauggcgaugguccucagcauagugucccuguuuccgcucugccugagcaccaccucccagaagaccacguggcuacccgugcugcuggguagccuugggugcaagccgcuaaccauguuucugaucgcggaaaacaagaucuggggccgcaaaagcuggccacucaacgagggaauuauggcagugggcaucgugucgauucuccugagcucccugcucaagaacgacgugccucuggcugggccccugauugcuggggguaugcugauagcgugcuacgucaucucuggguccagcgccgaucugucauuagagaaggccgcagaggugaguugggaggaggaggcagagcacuccggggcgagccacaacauccucgucgagguccaggacgacgggacaaugaagaucaaggacgaggagcgggaugacacccugaccauccugcucaaggcuacccugcucgccguguccggcguguacccgcuuagcauccccgccacacuauucgucugguacuuuuggcaaaagaaaaagcagcguuccgggguuuugugggacacccccagcccgcccgagguggagcgggcugucuuagacgacggcaucuacagaauuaugcaacgaggccugcuggggcgcucccaggugggcgugggggucuuucaagagaacguguuccacaccauguggcacgucacucgaggcgcgguccucauguaccaggggaagcgcuuagagcccuccugggcguccgugaagaaagaccugaucagcuacggcggaggguggagacugcagggcuccuggaacacaggcgaggaggugcagguuaucgcaguggagcccgggaagaaccccaaaaaugugcagacagcccccggcaccuucaagacgagcgagggcgaggucggcgccaucgcucucgacuuuaagccagggaccagcggcucucccaucgugaaccgcgaggguaagaucguuggcuuguacggcaacggggucguaacaacaagcggcacguacguaagugccauagcccaagcgaaggcgucccaggaggguccccugccggaaaucgaagacgaaguauuucguaagagaaauuuaaccauuauggaucugcaccccggcuccgggaagacccgucgcuaccugcccgcuaucgugcgggaagccaucaagcgcaaacuccggacccugaucuuggccccgacgcgcguuguagccagcgagauggcggaggcucucaagggaaugccuaucagauaccagaccacugccgugaaguccgagcacaccggcaaggagauugucgacuugaugugccacgccacuuucaccaugcggcugcucagcccuguuaggguacccaauuacaacaugaucaucauggacgaggcccacuucaccgacccgaguuccaucgcagcccgggguuacaucuccacccgcgugggaaugggggaagccgcugccaucuucaugacggcgacgccgcccggcagcgccgaagccuucccccaguccaaugccgucauccaggacgaggaacgugacaucccggagcggagcuggaacuccggguaugaguggaucaccgacuuucccggcaagacagucugguucgugcccagcauuaagagcggcaacgacaucgcaaauugccugcggaagaacggaaagagagucauccagcugagccggaagacguucgacaccgaguaccagaagaccaaaaacaacgauugggauuacguggugaccaccgacaucuccgaaaugggcgccaacuuccgggccgaccgggugauagacccccgccgcugccucaagccggugauccucaaggacggcccugagcgcgugauccucgccggccccaugcccgucaccgucgccuccgcggcccagaggcgcgggcgcauuggccgcaaccacaacaaggagggcgaccaguacauuuacauggggcagccgcucaacaacgacgaagaucaugcccacuggacugaggccaagaugcugcuggacaauauuaacacccccgagggcaucauccccgcccuguucgagccggagagggagaaguccgcggccaucgauggagaauaccgccugcgcggcgaggcccggaagacguucguagagcugaugcgccgcggggaccucccgguguggcuguccuacaaggucgccagcgagggguuccaguauuccgaccgcagauggugcuucgacggcgagaggaacaaccaggugcuggaagagaauauggacguggagaucuggaccaaggagggggagcguaagaaacuucggccccguuggcuggacgcccgcacuuacagcgauccccuagcguugcgggaguucaaagaguucgccgccggccgcagguccgugagcggcgacuuaauccuggaaaucggcaaacuaccccagcaccugacccagcgcgcccagaacgcgcuggacaaccucguuauguugcacaacuccgagcagggcgggagggcuuaccgccacgccauggaggaacugccggacacgauagagacccucaugcugcuggcccucaucgccgugcugaccggcggaguuaccuuauucuuccucagcggccgggggcuaggcaagacguccauaggacugcucugcgucauggcgagcucggugcugcuguggauggccagcguggagccucacuggaucgcugccaguaucauccucgaguucuucuuaaugguacugcucauccccgagcccgaucgccagcggaccccgcaagacaaucaacuggcauauguggugaucggccugcuguucaugauauuaaccguugcggccaaugaaaugggccuucucgaaacaaccaagaaggaccuggggauaggccacguggccguggagaaccaccaccacgccgcuaugcuagacgucgaucuccaucccgcguccgcuuggacucucuacgccguggccaccaccauuauuacccccaugaugcgccauacgaucgagaacaccaccgccaacauaucacugacggcgaucgccaaccaggccgccauucucauggggcuggacaagggcuggccgaucaguaaaauggacaucggcgugccccugcucgcgcugggaugcuacucccaagucaaccccuuaacucucaccgcugccguucucauguuagucgcccacuacgccaucauaggccccgggcuccaggcuaaagccacucgggaagcccaaaagcgaaccgcugccggcauuaugaagaacccgacgguggacgggaucguggcgaucgaccuggaccccgugguguacgacgccaaguucgagaaacagcuuggacagauaaugcuccugauccugugcacgagccagauccuucugaugcgcaccaccugggcucugugcgaaagcaucacucuugccgugggcuuccaaacuacccuaugggagggaagccccggcaaguucuggaacaccacuaucgcggugagcauggcgaauauuuuuaggggcuccuaccuggccggcgccggccucgcuuucagccugaugaagucccuggguggcgggcgccgcgggaccggggcacaaggcgagacacucggcgaaaaguggaagaggcagcucaaccagcucagcaagucugaauuuaacacuuacaagcguagcggcaucauggaagucgacaggagcgaagccaaggaaggacucaagcgcggugagacgaccaaacacgcagucagccgcggcaccgccaaguugaggugguucguggagcgcaaccuggucaagccugaggggaagguuauugaccucggcugcggcagaggagggugguccuacuacugcgcggggcugaagaaaguaaccgaagucaagggguauacaaaggguggcccgggucacgaggagcccauccccauggcgacuuacggguggaaccugguuaagcugcacagcgggaaggacguauucuucguacccccggagaaaugcgacacccucuuaugcgacauaggcgaguccagccccaacccuaccaucgaggaaggccgaacuuugcgagugcucaaaaugguggagccuuggcugcgcgggaaccaguucugcauuaagauccucaaccccuacaugcccucggucguggagacccucgaacagaugcaacggaagcacggcgguaugcuggugcgcaacccacugagccggaacuccacacacgagauguauuggguaagcugcgggaccggcaacaucgugucugccguaaacaugacaagccgcaugcuccugaacagauucaccauggcacaucgcaaacccaccuacgaacgcgacgucgaccugggggccgguacccggcacgucgcuguggagccggagguagcgaaccucgacauuaucggccagcgcaucgagaauauuaagcacgagcacaaguccaccuggcauuacgacgaagacaacccuuauaagacuugggcuuaccacgggagcuacgaggucaagcccucaggcucagccagcuccauggucaacgggguggugaaguuacugacaaagccgugggacgucaucccgauggugacacagaucgccaugaccgacacaacccccuucgggcagcagcggguguucaaggagaagguagacacacgaacccccaaggcuaaaagaggcacggcgcagaucauggaggucacagccaaguggcuguggggcuucuuaagccgcaacaagaagccgcggauuugcacacgcgaggaguucacucggaaggugcgguccaacgccgccauaggcgcugucuucguggaugagaaccaauggaacagcgcuaaggaggccguggaagacgagcgguuuugggacuugguccaccgcgaacgggaauugcacaaacaagggaaaugugccacgugcguguacaacaugaugggcaagcgggagaagaagcugggggaguucggcaaggccaagggcucccgggcgauaugguauauguggcugggcgccagguuccucgaguuugaggcccucggguucaugaacgaagaucacugguuuagccgggaaaauuccuugagcgggguggagggcgaggggcugcacaaguuaggcuacauccugcgggacauuuccaaaaucagcgggggcaauauguacgcugacgacaccgcuggcugggacacgcggauaaccgaggacgaccugcaaaaugaggcaaagauaacggacaucauggagcccgaacacgcguugcuggccaaguccaucuucaagcucaccuaccagaauaagguugugcgcgugcagcggcccgccaagaaugggacggucauggauguuaucagccgccgcgaccagcguggcuccggccaaguggggaccuacggccuuaauacguuuaccaacauggaagcccagcugaucagacagauggagagcgaggggaucuucucccccagcgagcucgagacgccgaacuuagcggaacgagcacuggauuggcucgagaagcacggcgucgagcgccugaaacggauggccaucagcggggacgacugcguagugaagccaaucgacgaucgcuuugccaccgcccugacggcccugaacgacaugggcaaggucaggaaggacaucccccagugggagcccucaaagggcuggaacgauuggcaacaggugccguuuugcagccaucacuuccaccagcugauaaugaaggacggccgcgaaaucgugguucccugcagaaaccaggacgagcugguggggcgcgcccggguuucccagggagcaggcuggagccuaagagagacugccugcuuaggcaaguccuacgcgcagauguggcagcugauguacuuccaccggcgcgaucuacggcuggccgccaacgcaaucugcagcgcuggccccgucgauugggugccaaccuccaggaccacguggagcauccacgcgcaccaccaguggaugaccaccgaggacaugcugagcguguggaacagagucuggaucgaggagaacccguggauggaggacaaaacucacaucagcuccugggaggacgugccguaccugggcaagcgcgaggaucaauggugcggcagccugauagggcuuaccgcucgggccaccugggcaaccaacauccagguggcuaucaaccaaguccgccgucucaucgggaacgaaaacuaccuggacuacaugacuuccaugaaaagauucaagaacgagagcgaccccgagggugcgcugugguaa

SEQ ID NO: 23840 - RNA, 9879 nt, Artificial Sequence
  derived and/or modified CDS sequence (opt11) from DENV-1__FJ639694__SS-prME
ucggugacuaugcugcucaugcuuaugcccacugcccucgcuuuucacuugaccacacgcggcggggagccccacaugauagugucgaagcaagagcgcgggaagucccugcuguucaagaccuccgccggggugaacaugugcacacucaucgcuauggaccugggugagcuuugcgaggacaccaugacauacaagugcccccgcaucaccgaggccgaaccagacgacguggauugcuggugcaaugccaccgacacaugggugacguaugggacguguagccagaccggcgagcaccggcgugacaagcgguccguggcucucgcgccccacgucggccugggccuugaaacgcgcacagaaacuuggaugagcuccgagggcgcuuggaagcagauccagcguguggagaccugggccuugcgccauccuggguucaccgugaucgcccucuuccuggcgcacgcgaucggcaccagcaucacgcaaaaggggaucaucuucaucuuguuaaugcuugugacccccuccauggcuaugcggugcgucggcauagggucgcgcgacuucguggagggguuguccggcgccacguggguagacgucguguuggagcacgggagcugcgugacgaccauggcuaaggacaagcccacucuggacaucgagcuccugaagacagaagugaccaaccccgcgauccugcggaagcucugcaucgaggcgaagauauccaacacaaccacggacagccgcugccccacgcagggcgaggccacccuggucgaggagcaggacgcgaacuuugugugcaggcgcaccuucgucgaccgggguugggggaauggcugcgguuuguuuggcaagggguccuugaucacgugcgcgaaguucaagugcgugacuaagcucgaggggaagaucgugcaguacgagaaccugaaauacucggucaucgugaccgugcacacgggcgaccagcaccaggucgggaaugaguccacggagcauggcaccaccgcgaccaucacuccccaggcccccaccaccgagauucagcucaccgauuauggggcccugacucuggacugcucuccucgaacuggacuugacuucaaugaaauggugcugcugacgaugaaggagaagucguggcucguccacaagcagugguuccuggaccugccguugccauggacgagcggagcuagcacaucccaggaaacuuggaacaggcaagaccugcuugucaccuucaagaccgcccacgccaagaagcaagagguggucgugcucggaucucaggagggagcgaugcacaccgcccugacgggggccaccgagauccagaccuccggaaccacgaccaucuuugcugggcaccuuaagugccgccucaagauggacaaguugaccuugaagggcaugagcuacgugauguguaccggguccuucaagcucgagaaggagguagcggagacacagcauggcacagugcuggugcagauaaaguaugagggcaccgaugcgcccugcaaaaucccguucucaacucaggacgagaagggcgucacgcagaaugguaggcucauuaccgccaacccaaucguuacagauaaagagaaacccguaaacaucgaggccgagccgccuuucggggaguccuacauagucaucggcgcuggcgagaaggccuugaagcuaagcugguuuaagaaggggucgagcaucggcaaaauguuugaggccaccgcucgcggcgcacggcguauggcgauccugggggacacggccugggauuucgguuccaucggcggcgucuucaccagcguaggaaaacuuguacaccagaucuucggcaccgcuuacgggguacucuucuccggcgugagcuggaccaugaagaucgguaucggcguccugcugacgugguugggacugaacuccagaagcaccuccuuuagcaugaccugcaucgccguggggcuugugacgcucuaccugggcgucauggugcaggccgacuccgggugcgugaucaacuggaagggccgggagcuaaaaugcgggucaggcauuuucgucacgaaugaggugcacaccuggaccgagcaguacaaguuccaggcggauagcccgaagcgccuuagcgccgccauuggcaaggcuugggaggaaggcgugugcggcauccggagcgccacccgcuuagagaacauuauguggaagcagaucucaaacgaacuaaaccacauccuccuggagaacgacaugaaauucaccgucguagucggagacguagcugggauccuggcccaggggaagaagaugauccggccccagccgauggaauacaaguauagcuggcgcuccugggguaaagccaaaaucaucggagcugaugugcagaacacgaccuucaucaucgacgggcccaacaccccggaguguccagacgaccagcgugcguggaacauaugggagguggaggacuacggcuucggaaucuuuaccacgaacaucuggcugaaacuucgcgacagcuacacccagguaugcgaccaucggcugauguccgccgccauuaaggacuccaaagccgugcaugccgauaugggcuacuggaucgaguccgagaagaacgagaccuggaagcucgcgcgcgccagcuucauagaggugaagacaugcaucuggccgaagucccacacgcucuggaguaacggcgucuuggaguccgaaaugaucauccccaagauauacgguggcccgauaagccagcacaauuaccggcccggcuauuucacccagacugccggucccuggcaccuggggaaacuugagcuggacuucgaccucugcgaggguaccacuguggugguggacgagcacugcggcaaucgggggccaagccugcggacaaccaccguaacgggcaagaucauccacgaguggugcugccgcagcugcacucuaccgccccuccgguuucgaggagaggauggcugcugguacgggauggagauccggcccgugaaggagaaagaggaaaaucugguaaaaucgauggugagcgccggcagcggcgagguagacucauucagcuuggggcuccuaugcaucuccaucaugaucgaggaggucaugaggagccgguggucucgcaagaugcugaugaccggcacccucgccguguuccuccuauuaaucauggggcagcugacguggaacgaccugauccgcuuauguaucauggugggagcgaacgcgagcgaccggaugggcaugggcaccaccuaccuggcguugauggccaccuucaagaugcgcccgauguucgccgucggccuucuguuccggcgccugacguccagggagguucuccuccugaccauaggcuugagcuugguggcgagugucgagcugccaaacagccucgaggagcuaggugacgggcuggccaugggcauuaugauccuaaaacuguuaaccgacuuccagucucaccaguuaugggccacgcugcugagccucacguuuauuaagacaaccuucuccuuacacuaugccuggaagaccauggcgauggugcugagcauagucuccuuauuuccccugugucugaguacgacaucccaaaagacgaccuggcucccuguacuucugggaucucucgggugcaagccgcugacgauguucuuaaucgccgagaauaagaucugggggcgccgcuccuggccccugaacgaggggaucauggccgucggcauugucucgauacugcugucauccuuacugaaaaacgacgugccauuggccgggccgcugaucgccggcgggaugcugaucgcgugcuacgugaucagcggguccagcgcugaccugucccuugaaaaggcugccgaggucagcugggaggaggaagccgagcacaguggcgcgagucacaauauucucguggaagugcaggaugacgggaccaugaaaauuaaggaugaggagcgugacgacacacuaacuauucuccugaaggccacccugcucgcgguauccggcguguacccccugucuauccccgccacgcuguucgugugguacuucuggcagaagaagaagcagcggagcgguguccucugggacaccccuucuccgcccgagguggagcgcgccguacuggacgauggcaucuaccgaaucaugcaacgcggccugcuugggcggucccaggucggagugggaguguuccaggagaacgucuuucacaccauguggcacgugacccgaggagccgugcucauguaccaggggaagcgguuggagccaagcugggccucuguuaagaaggaccuuaucagcuacggugggggcuggcgccuccaaggcuccuggaacacgggggaggaggugcagguaaucgccgucgagcccggcaagaauccuaagaacgugcagacggccccagggaccuucaagaccccagagggcgaggugggcgcuauugcgcucgacuucaagccagggacgagcggcucccccaucgucaaccgggagggcaaaauugucggcuuauacggcaacgguguggucaccacuagcgguacauacguaagcgccauugcccaggccaaggcgucccaggaggggccacuccccgagauagaggacgagguuuuccgcaaacggaaccuuacgaucauggaccugcauccgggcagcggcaagacccgccgguaccugccggccaucguccgcgaagccauaaaacgcaagcugcggacccugauucucgcucccacccgcgugguggccuccgaaauggcggaagcccuuaagggcaugccuauucgguaccagacaacagcuguuaagagcgagcacaccggcaaggagaucguggaucuaaugugucacgccacauucaccaugagacuccugucccccgugcgggugccaaacuauaacaugauaaucauggacgaggcccacuucaccgacccuagcucgauagcggccagaggauacaucagcacccggguugguaugggggaggccgccgcuaucuucaugacagcgacgccaccaggcucaguggaggccuucccgcagagcaacgccguaauccaagacgaggagagagacaucccggaacgauccuggaacucaggcuacgaguggauuaccgacuuucccggcaagacagugugguucgugcccuccaucaaaucgggcaacgauaucgcuaacugccugcguaagaacgggaagcgggugauccagcucucccgaaagacauuugacacagaguaccagaaaacaaagaacaacgacugggacuacguagugaccaccgacaucuccgagaugggggcgaacuuccgagcggaccgcgucaucgacccccggcgcugccugaagcccgugauacugaaggacgggccggagagaguaauccucgccgguccgaugccggucacggucgcuucagcggcacagagacggggccgaaucggccgcaaccacaacaaggagggagaccaguauaucuacaugggccagccccugaacaacgacgaggaucaugcccacuggaccgaggccaaaaugcugcuugacaacaucaacaccccugaaggaauaauccccgcucuuuucgaaccggagcgggagaaguccgccgcgaucgacggggaguaccgccugcggggcgaggcccgcaagaccuucgucgaacuuaugagacgcggugaucugcccguuuggcuguccuauaagguggccagcgagggcuuccaguacucugauagaagguggugcuucgacggggagcggaacaaccagguccucgaggaaaacauggacguggagaucuggacgaaagagggggagcgaaagaaacugagaccccgcuggcuagacgcccggacguacuccgacccuuuagcccugcgcgaguuuaaagaauuugcagccggccggcggucugucagcggcgaccugauccucgagauagggaaacuuccgcagcaucugacccaacgggcccaaaaugccuuagacaaccuagucaugcugcacaacagcgagcaaggcgggcgcgcguaccggcacgccauggaggagcuuccagacacgauagaaacuuugaugcugcucgcccucaucgcugugcuaaccggcggugugaccuuauucuucuuaaguggccgaggccugggaaaaaccagcaucggcuugcugugcgucauggccaguagcgugcuucucuggauggcgucggucgagccucacuggaucgcggcuagcauuauccuagaguucuucuugaugguccuucugauccccgagccggaccgacagaggacaccacaggacaaccagcuagccuacguagucaucgggcuccuguucaugauccugacgguagccgcgaacgagaugggacuacuagagaccacgaagaaggauuuggggaucgggcacguggcuguggggaaucaccaccacgccgccauguuggacgucgaccuccaccccgcuuccgcguggacccuauacgcuguggcaacgaccaucauaaccccaaugaugagacacaccaucgagaacacaaccgccaacaucuccuuaaccgccauugccaaccaggccgccauccugauggggcuggacaagggcuggcccauaucaaagauggacaucggugugccccuccuggccuugggcugcuauagccaggucaacccucuuacgcugacggcggccgugcugaugcuuguggcccacuacgcuaucaucggcccgggacugcaggccaaggcgaccagggaggcacagaagaggaccgccgcggggaucaugaagaaucccacugucgauggcaucguggcaaucgauuuagaccccgugguguaugacgcgaaguuugaaaagcaguuagggcaaauaaugcugcuuauccuauguaccucccagauccuucugaugcggacuacgugggcccucugcgagagcauaacccuggccacggggccccugacaacccucugggagggcuccccggggaaguucuggaauaccacaaucgccgugagcauggccaacaucuuccgaggaucguaccuggcgggugccggguuggccuucucccuaaugaagucccuaggaggagggaggcgcggcaccggcgcccagggcgagacucugggggagaaguggaaacggcagcugaaccaacuguccaagagcgaguuuaacaccuacaagcgcuccggcaucauggagguagaccgcagcgaggcgaaggaagggcugaagcgcggugagaucacaaagcacgccguaucccgggggaccgccaagcuccgaugguuuguggagagaaaccuggugaaaccggaaggaaaggucaucgaccugggauguggacgaggaggguggagcuacuacugugccggccugaagaaaguuaccgaggugaaggguuacaccaagggcgggcccggucacgaggaaccaaucccuauggcaaccuacggauggaaccucgugaagcuccacucaggaaaggacguguucuuugucccgcccgagaagugcgacaccuugcuuugugacauuggagagagcuccccuaacccgacaaucgaggaaggccggacgcuccgcguccugaaaaugguagagcccuggcucagaggcaaccaguucugcaucaaaauucugaauccauauaugccgucuguggucgagacucuggaacagaugcaacgcaagcacggcgggaugcucguucggaacccgcugucccgcaauaguacucacgagauguacuggguuuccugcggcacugguaauaucguuucggcggucaacaugacuuccaggaugcugcugaaccgauucacgauggcccaccgcaagcccacguacgagcgggacguggaccugggcgccggcacccgccaugucgcgguggagcccgagguggcuaaccuggacaucaucgggcagcggauagagaacaucaagcaugagcacaagucaacguggcacuaugacgaggacaaucccuacaagaccugggccuaccacgggucguacgaggucaaaccgagcgggagugccucgucaaugguaaauggcguagugaagcuccugacuaagccuugggacgugaucccgaugguaacccagaucgccaugaccgauaccacccccuucgggcagcaacgcguguucaaggaaaaaguggacacucggacuccuaaagccaaacgcggcaccgcccagaucauggaggugacggcgaaguggcuguggggcuucuugucccggaacaagaagccccgcaucugcaccagagaagaauuuacccgcaaggugaggagcaacgccgccaucggcgccguguucgucgacgagaaccaguggaacuccgccaaggaggccgucgaggacgaacgcuucugggaccuggugcacagagagcgcgagcugcacaaacagggcaaaugcgcaacaugcgucuacaacaugauggggaagcgggagaagaagcucggcgaguucggcaaggccaagggaagccgcgcgauuugguauaugugguugggcgcgagauuccuggaguucgaggcccucggguuuaugaacgaagaucauugguucagcagagagaacagucugucggggguggagggcgagggccugcacaagcucggcuacaucuuaagagauauaagcaagauucccggcggcaauauguaugccgacgauacugccgggugggacaccaggaucacagaggacgaccugcagaacgaggcccgcaucaccgauauaauggagccggagcacgcgcuccuggccaaguccaucuucaagcugacauaccagaacaagguggugcgggugcagcggcccgcuaagaauggcaccgucauggacguaaucagccggagggaccagcgcgggucaggccagguaggcaccuacgggcucaacaccuucacgaauauggaggcccaguugauucgccagauggaaagcgagggcaucuucagccccagcgaacuggagacgcccaaccuugcggagagggugcuggauuggcuggagaaauacggaguggagcgacucaagcggauggcgaucagcggugacgauugcguggugaagccgaucgaugaccgcuucgcuacggcgcugacagcccugaacgacauggggaagguucggaaggauaucccgcagugggagccaagcaagggcuggaacgacuggcagcaggucccauucugcagucaucacuuccaucagcucauuaugaaggacggacgcgagaucguaguccccugccggaaccaagacgaguuaguuggccgcgcccgggugucucagggcgcggguuggucacuucgggagacugccugucuugggaaguccuacgcccagauguggcaacuaauguacuuccaucgacgcgaccugcggcucgccgcgaacgccaucugcagcgccguccccguugauuggauccccaccucccgcaccaccuggucaauacacgcccaucaccaauggaugacgacagaggacaugcuguccguguggaacagaguguggaucgaggagaacccauggauggaagacaagacccacaucucgaacuggggcgaugugccguaccuuggcaaacgggaagaccaguggugcggcucacucaucggguugaccgcacgcgcuacgugggccaccaacauccagguugccaucaaucaaguacggcgccugaucgggaacgagaacuaccucgacuauaugacaucaaugaagcguuucaagaacgaauccgaucccgaaggggcgcugugguga

SEQ ID NO: 23841 - RNA, 9879 nt, Artificial Sequence
  derived and/or modified CDS sequence (opt11) from DENV-1__FJ639695__SS-prME
agcguaacgaugcugcugaugcuuaugccgaccgcacuugcauuccaccugaccacacgcggaggagaaccgcacaugauagucucuaaacaagaacgcggcaaguccuuacuauuuaaaacgucggcaggcguaaacauguguacccucauagcaauggaccucggagaacuuugcgaagacacuaugacuuauaagugcccgcgaauaaccgaagcagaacccgacgacguagacuguugguguaacgcuaccgacaccugggugacauacgggaccuguagccagaccggcgaacaucgucgggacaaaaggagcguagcacuagcuccgcacgucggacucggacuagaaacacgaacagaaacguggaugagcucagaaggggcauggaaacaaauacagcgcgucgaaaccugggcacugcgucacccgggauucaccguuauagcccuuuuucuggcacacgcuauaggaaccucaaucacgcaaaaggguauaauauucauauuacucaugcuugucacucccucuauggcuaugcgguguguaggcaucggaaguagagacuucgucgaggggcuuuccggggcgacguggguagauguaguccuggagcacggcucuugcgucacgacgauggcuaaggacaagccaaccuuggauaucgagcuauugaagaccgagguaacaaaccccgcaauauuaagaaaacuaugcauugaggcgaaaauaucuaauacaacaacagacagucggugcccgacccaaggagaggcaacgcuaguggaggaacaggacgcgaacuucgucugccgucgcacauucgucgaccgcggguggggaaacgggugcggacucuucgggaaaggaucacuaaugacaugcgcaaaauucaaaugcguaacuaagcucgaaggaaagaucguccaguacgagaaccuaaaauacagcguaaucgucaccguacacaccggugaccaacaccaggugggcaacgaaaguacggaacacgggacgacagcgacaaucaccccacaggcacccacaacagaaauacaacuaacggacuauggcgccuuaacacucgauugcagcccgcgaaccggccuagacuucaacgaaaugguccuauugacaaugaaggagaaaucauggcuaguccacaaacagugguuccucgaccuuccccuaccauggaccuccggggcgaguaccagccaggagacguggaaccgucaggaccuacucgugacuuucaagacggcacacgcgaagaaacaggaagugguaguacugggcucucaggaaggggcaaugcacacggcgcucaccggcgcaacggagauccaaacuagcgguacaacaaccauuuuugcgggccaccucaaaugcagguuaaaaauggauaaacucacacugaagggaaugucguacgucaugugcacaggcuccuucaaacucgagaaagagguggccgagacucagcaugggaccguccuuguacaaauaaaguaugaggggacggacgcacccugcaagauacccuucuccacgcaagaugaaaaggggguuacacagaacggacggcuaaucacagcaaauccgauagucaccgacaaggagaaaccggugaacauagaagcggaaccuccuuucggagaaagcuacauagugaucggagcaggggaaaaagcacugaaauugagcugguucaagaaggggagcuccaucgggaagauguucgaggcaaccgcgagaggcgcgcguagaauggcgauacuaggggacacggccugggacuuuggcuccauagguggggucuucacaucaguagguaaacugguacaccagauuuuuggcacagcuuacggaguacuauucucaggcgucuccuggaccaugaaaaucggccuuggggugcuucuuacauggcucggauuaaacucccggagcaccagucuaucaaugaccugcauagccgugggacuggucacguuauaucucggcgucauggugcaagcagacagcgguugcgugaucaacuggaaaggcagggaacuuaagugcggaucgggcauauucguaacaaacgagguucacacuuggacagaacaauacaaguuccaagcagacagcccaaagcggcucucagccgcgaucgggaaggccugggaagaaggcgucuguggaauacgcucugccacgaggcuggaaaauauuauguggaaacaaauaagcaaugaacucaaccacauccuccucgagaacgauaugaaauucacggucguggucggagacguagccgguauacucgcccagggaaagaagaugauucggccacaacccauggaguauaaauacuccuggaaaucguggggaaaggcaaaaauaaucggcgcagacguccaaaauacaacguucaucaucgacggaccgaacacacccgaaugcccggacgaccagagagcauggaacauaugggagguggaagacuaugguuuuggaauauucaccacaaauauuuggcuuaaguuacgcgacagcuacacccaaguaugcgaccaccgacucaugagcgcagccaucaaagacucuaaggccguccaugcagauaugggcuacuggauagagagcgagaagaacgaaacauggaaacucgcccgagccagcuucauagaagugaaaacuugcauauggcccaaaucccauacacuguggagcaacggcguacuugaaucagaaaugauuaucccuaaaaucuacggagggccgaucucccaacacaacuaccgucccggcuacuucacacagacggcagggcccuggcaucuagggaaauuggaacuagacuucgacuuaugcgaaggcacgacuguagugguagaugagcacuguggcaacagagggccgucccugagaacgacgacuguaacuggaaaaauuauacaugaauggugcugccgguccugcacacuaccgccccugagguuuagaggggaagacggcugcugguacggaauggaaauccggccggugaaggaaaaagaagaaaacuuagucaagucuauggugucagcgggcuccggcgaagucgacucuuucagccugggguugcucugcaucagcaucaugaucgaagaaguaaugaggagccgauggucacgcaaaauguuaaugaccgggacacuggcaguauuccugcuccucauuaugggccaacugacuuggaaugaccuuauacgccuuugcaucaugguaggcgccaacgcuagcgaccgcaugggaauggggacgacauaccuugcccuaauggcuaccuuuaaaaugagacccauguucgcagucggccuacucuuccggagacucacauccagggagguacuucuacugaccaucggccuuucacuuguagccagcguagaacuacccaacagucucgaagaacugggagauggcuuggccaugggaauuaugaucuugaaacuacugaccgauuuccagucccaucaacuaugggcaacauuacucucccuaacguucaucaagaccacuuucuccuuacacuaugccuggaagaccauggcgauggugcucagcaucgugucauuauuuccccuaugucucagcacgaccucccagaagaccacaugguuaccaguucuacugggaucccucgggugcaagccacugacgauguuucugauagcugagaauaaaauauggggccgccgaagcuggccccucaaugaaggaauaauggcaguagggaucgucucuauacuucuuucaagccucuugaaaaacgaugugccccuagccggcccgcuaauagccggaggaauguuaaucgccugcuauguaauaagcggcucaucagcagaccuuucacucgagaaagcggcagaggucucaugggaagaagaagccgaacacagcggcgcgucacauaacauccuagucgaaguacaagacgacggaacaaugaaaauuaaggacgaggagagagacgauacgcuaacuauccuacuaaaagccacauugcuagcgguaagcggaguguauccauugucaauccccgcuacucuguuuguaugguacuucuggcaaaagaagaaacaacggagcggugugcucugggauacuccgagucccccggaagucgagagagccguauuagacgacggaaucuaucggaucaugcagaggggguuauugggacgaagccaggugggcgucggcgucuuccaggagaacgucuuucacaccauguggcacgugaccagaggggccgugcuaauguaccaaggaaagcgacuagaaccaucgugggcaagcguaaagaaagaucucauauccuacggaggcggauggaggcuccaaggaucauggaauacaggggaggaaguccagguaauagccguagaaccaggcaaaaaccccaaaaacguccagacagcucccggcacuuucaaaacaccugaaggggaagugggggcaauagcgcuggacuucaagcccggaacauccggaaguccaaucgucaaccgagaaggaaaaauugucggucuuuacgggaacgggguaguaacaacgucgggcacuuacguaagcgcaauugcacaagcaaaagcaagccaagaaggaccccuccccgaaaucgaagacgaaguuuuucggaagagaaaccuuacaaucauggaccuccacccaggcagcgguaagacgagaagguaccuaccagcaaucgugagggaggccaucaaaagaaaauuacgcacgcuaauacuagcgcccacccgagucguggccagcgaaauggcagaggcccuaaagggaaugccaauccgguaccagaccacagcggugaaaagcgaacacacaggcaaagaaauuguggaccugaugugccacgccaccuuuacaaugagacugcuaagcccgguuagggucccaaacuauaauaugaucauaauggaugaggcccacuucaccgacccaagcucaaucgcagcacgaggcuacaucucaacgcgcgucggaaugggagaagcggcggccaucuucaugacagcuacaccacccgguagugucgaggcuuuuccacaaucaaacgccgucauacaggacgaggaaagagacaucccggagcgauccuggaauaguggcuacgaguggauaacggauuuccccgggaagacgguaugguuuguccccucaaucaaaagcggcaaugacaucgcuaacugucuacgcaaaaaugggaaaagaguaauccaauugagcaggaagaccuucgauaccgaauaucagaaaaccaagaacaacgacugggacuacguagucaccaccgacauuagcgagaugggagccaauuucagagcagauagagugaucgacccacguagaugcuugaagccagucauacucaaagacgguccggaacgcgucauacuagccgggccuaugccagucacagucgccagcgcggcacagcggaggggccgaauaggccggagucauaauaaagaaggggaccaauauaucuacauggggcagccccucaauaaugacgaggaucacgcccacuggaccgaggccaagaugcugcucgacaacaucaauacccccgaaggcauaaucccggcccuauucgaaccggagagagagaaaagcgccgccaucgacggggaauaucgucuacgaggagaagcgcgaaaaacguucguggaauugaugcgccgcggagaccuaccaguauggcuaucguacaagguggcaucagagggauuccaauacucggaccgcagauggugcuuugacggcgagcgaaacaaccaagugcuagaagagaacauggacguggaaauauggacgaaagagggugaacgcaagaaacuacggccccgaugguuggaugcccggaccuacuccgauccacucgcccugagggaguuuaaagaguucgccgccggacgaagaagugucucgggggaccuaauccucgaaauaggaaaacugccucagcaccuaacccaacgggcucagaaugcauuggacaacuuaguaaugcuccauaauagcgagcagggcgggcgggcauaccggcacgcaauggaggaacuaccagacacaaucgaaacccuuaugcuacuagcccucaucgcggugcucacagggggcgucacacucuucuuucugagugggaggggccugggaaaaaccaguaucgggcuccuaugcgucauggccagcaguguacuacuuuggauggccagcgucgaaccacacuggaucgccgcaucgaucauccuagaguucuuucuaaugguccuacugauaccagagccagacagacaacgaacuccgcaagacaaccaacucgccuacguagugauaggacuacuauucaugaucuuaacuguagcagccaacgagaugggccuucucgaaacuacuaagaaagaucucgggauaggucacguagcgguuggcaaucaucaccacgcagcuaugcucgaugucgacuuacacccggcgagcgccuggacacucuacgcugucgcgacuacaaucaucacacccaugaugagacacacgaucgagaauacuaccgcaaacaucagucuaacagccaucgcaaaccaggcggccauccuaaugggacuugacaagggguggccgauauccaagauggauaucggcgugccccuucuggcacuugggugcuauagccagguuaacccgcucacauugacagcagcugugcucaugcugguugcccauuacgcaauaauugguccgggacuucaagcaaaggcaacgcgcgaggcacagaaacgaacagcagccggaauaaugaaaaacccgaccguggacggcaucgucgcaauagaccuggaucccguaguuuacgacgccaaguucgagaaacagcuaggccaaauuaugcugcuaauacuaugcaccagucagauucuccuaaugagaaccacaugggcacuaugugaaagcaucacgcuugcgaccggcccacucacgacucugugggaggguucgccuggcaaauuuuggaacaccaccaucgcagucuccauggccaacauuuuccgaggaucguaccuggcaggcgccggacuagccuucucccuaaugaagagucucgguggcggaaggagaggaacgggcgcccagggcgagacgcuuggcgaaaaguggaaacggcaacuaaaccaauuaucaaaaagcgaguucaauacguacaagcggucagggaucauggaaguugaucgcucggaagcgaaagaggggcucaagcgcggggaaacaacaaaacacgccguaucccgagguacggccaaguuacgcugguucguggagagaaaucugguaaaaccagaaggcaagguaaucgaucucggcugcggcagaggcggguggucauacuacugcgccggacugaagaaagugacggaagugaaaggauauacaaaaggcggccccggccaugaagaacccauuccuauggcaacguaugguuggaaccuaguaaaacuacacucaggcaaagacguauucuuuauaccgccagaaaaaugcgacacguuacucugcgacauaggagaaucauccccuaaccccaccauagaggaaggaagaacacuccggguacucaagauggucgagccguggcugcgugggaaccaauucugcauaaagauccuuaauccauauaugccaucuguuguggaaacguuagaacaaaugcaacgcaaacacgggggaaugcuugucagaaacccgcuaagucgcaacucaacgcaugaaauguauuggguaagcugcggcaccggaaacauagucagugcaguuaacaugacgagcaggaugcugcucaauagauuuacgauggcucaccgaaaaccaaccuacgagcgcgacguagaccucggugccgggaccagacacgucgccgucgagccggaaguagcgaaccuagacaucauaggucaaagaauugaaaacauaaaacaugagcauaaaagcacguggcacuacgacgaagacaacccguacaagaccugggccuaccacggcucguacgaaguaaagccaagcggcagugcauccucaauggugaacggcgugguaaagcuacucacaaagccaugggaugucauuccgauggucacacagauugcgaugacggacacuacgcccuucgggcaacagagagucuuuaaagaaaaaguggacacacguacgccgaaagcaaagcgugggacagcgcaaauaauggaagucacagcuaaguggcuauggggauuuuugucgagaaacaaaaagccccguauauguacaagggaggaguucacgcgaaaaguccggagcaacgccgcaauaggggcagucuucgucgacgaaaaccaguggaacagcgcgaaggaggcggucgaagaugaaagauucugggaccuaguacacagggaaagagaacugcacaaacaaggaaagugugccaccuguguauacaauaugaugggaaaaagagagaaaaagcuaggagaguuugguaaagcaaaaggaagccgggcuauaugguacauguggcugggcgcgagguuccucgaguucgaagccuuagguuuuaugaacgaagaccacugguucucucgcgagaauagccugucggggguagaaggcgagggccuccacaaguuaggguacauccugagggauauauccaaaauaccaggaggcaauauguaugccgacgacacagccggaugggauacacguauaaccgaagaugauuugcaaaacgaagcacgaaucacugacauaauggagccggagcacgcgcuguuagccaagucaauauuuaaguugacguaccagaacaaagucguucgcguacaaaggccagcgaagaaugggaccguaauggaugucauaagucgacgagaccaacgcgggucgggccagguagguacuuacggacuaaacacauucacaaacauggaggcacaacucauccgacagauggaauccgaagggaucuuuucacccucugaacucgaaacgccgaaccuagcggagagagugcuaguaugguuggaaaaguacggaguggaaagacuaaagcgcauggccauaaguggagacgacugcguagugaaacccaucgacgaccgcuucgcaacggcccucacagcauuaaaugacaugggcaaaguacgcaaagacauuccacagugggagccuagcaagggauggaacgacuggcagcaaguaccuuucugcagucaccacuuccaccagcucaucaugaaagacggacgcgagauagugguaccuugucgcaaccaagacgagcuaguaggcagggcacgagucagccagggcgccggguggucucuuagggaaaccgcaugccuagguaaaagcuacgcacagauguggcagcucauguacuuucaucguagggacuuacgauuagcagcaaacgcaaucugcagcgcggugcccguugauuggauaccaaccagcagaacuacauggagcauacacgcucaucaccaauggaugacaaccgaagacaugcuuucagucuggaaccgcgucuggauagaggaaaaccccuggauggaggauaaaacccacaucucaagcuggggugauguccccuaucuggguaaaagggaagaccaaugguguggcucacuuaucggacuaacggcacgcgcuacgugggcaacaaauauucagguagcuauaaaccagguacgacggcuuauugggaacgagaacuaucuagacuacaugaccuccaugaaaagguucaagaacgagucggacccagagggggccuuaugguga

SEQ ID NO: 23842 - RNA, 9879 nt, Artificial Sequence
  derived and/or modified CDS sequence (opt11) from DENV-1__FJ639696__SS-prME
agcgugaccauguuacucaugcugaugcccaccgcccucgccuuccaccucaccacccggggaggugagccccauaugaucguuagcaagcaagagcggggcaagucucugcuuuucaagaccagcgcaggggugaacaugugcacucucaucgccauggaccugggggaguucugcgaggauaccaugaccuacaaaugcccacguaucagcgaggcggagcccgacgacguggacugcuggugcaacgccacagacaccugggugaccuacgguacaugcucacagaccggugagcaccggcgcgauaaacggagcgucgcccuggccccucacgugggccucgggcuggagacccggacggagacauggauguccagcgaaggcgcuuggaagcagauccagcggguagagaccugggcccuucgccaccccggguucaccgugaucgcccucuucuuagcgcacgccaucggcacgucuaucacucagaaggggauaaucuucauacugcucaugcuggugacgcccagcauggccaugcggugcguaggcaucggcucccgugacuucguugaggggcugagcggcgccaccuggguugacguugugcuagagcacggguccugcgugacuaccauggccaaggacaagcccacccuggacaucgaguuacucaaaacugaggucacgaaccccgcggugcugcgcaaacugugcaucgaggccaagaucagcaacacuaccaccgacucucgcugcccgacacagggcgaggccacccucguggaggagcaggacgcaaacuucgucugccggcgcaccuucguggaucgggggugggggaacggcugcgggcuguuuggcaaggggucacugauaacuugcgcgaaauuuaagugcgugacgaaguuagagggaaagaucguccaguacgaaaaccugaaguacuccgugauagugaccguccacaccggcgaccaacaccagguggggaacgagagcacagagcauggaacgaccgcgaccaucaccccccaggccccauccaccgagauucagcugacggacuacggggccuugacacuggauugcagccccaggacuggcuuagacuucaacgagaugguauuguugacaaugaaggagaaguccugguugguucacaagcagugguuccucgaccugccgcugcccuggacguccggggccagcacuucacaggagacguggaaccggcaggaccugcuggugaccuucaaaacggcccaugccaagaagcaggaggucguggugcugggcagccaggaaggcgccaugcacaccgcacucaccggagcaaccgaaauucagacaucaggcaccaccacgaucuucgccgggcaccugaagugccgccugaagauggacaaacucacgcugaaaggcaugagcuacgucaugugcaccgggucuuuuaagcuggagaaggagguggccgagacccagcacggcaccgugcucguucagaucaaguaugagggaacagacgcgcccugcaagauccccuucagcacccaagacgaaaagggcgugacgcagaacgggaggcugaucaccgcgaacccaaucguaacggacaaggagaaacccguaaacaucgaggccgagccgcccuucggggagucauacauaguaaucggcgcgggcgagaaggcccugaaacugagcugguucaagaaggguuccagcaucgguaagauguucgaggccaccgcccgcggggcccgucgaauggcgauacucggcgacacggcuugggacuucggguccaucggaggcguguucacuagcgucgggaaacuggugcaccagaucuucggcacggccuacgggguguuguucuccggcgucagcuggaccaugaagaucgggauuggcgugcuccucaccugguuaggucucaacucccgcucgaccuccuugagcaugacgugcauagccgugggucuggucacccucuaucugggcgugaugguccaggccgacagugggugcgucauaaacuggaagggccgggagcugaaaugcgggucgggcaucuucgugaccaacgaggugcacaccuggacggagcaguacaaguuccaggcggauagcccgaagcgccuauccgccgccauaggcaaggccugggaggagggggucugcggcauccgcucagcgacucgccuggagaacauuauguggaagcaaauauccaacgagcugaaccacauccuccuggaaaacgacaugaaguucaccguuguggucggagacguggcugggaucuuagcacaagggaagaagaugauccggccccagcccauggaguacaaauacagcuggaaguccuggggcaaggccaagaucaucggcgccgacguacagaacacuaccuucaucauagacgggccgaacacgccggagugucccgacgaccagagagcguggaacaucugggaggucgaggacuacggcuucgggaucuucaccacuaacauuuggcuuaagcugcgggacagcuauacccaagucugugaccaccgcuuaauguccgccgccaucaaggacagcaaggccgugcacgcugacaugggguacuggaucgagagugaaaagaacgagacguggaagcucgcacgggcuagcuucaucgaggucaagacaugcaucuggcccaaaucccacacccuuuggucuaacggcgugcuggagagcgagaugauaauucccaagauuuacgggggcccgaucagccagcacaacuaucgccccggguacuuuacccagacggccggacccuggcaucucgggaagcuggagcuggacuucgaccucugcgagggcaccaccguggucguggacgagcacugcggcaaccgggguccguccuuacgcaccacgacaguaaccggcaagaucauccacgagugguguugccggagcugcacccuaccgccccugcgcuucaaaggugaggacgggugcugguacgggauggagauccggcccgucaaggagaaagaggagaaccugguuaagagcaugguauccgccggcagcggcgaggucgauuccuucagccuggggcuccugugcaucuccaucaugaucgaggaggucaugagaagccgguggucccgcaagaugcugaugacggguacccucgccguguuuuuccuguugaucaugggacagcucaccuggaaugaccugauacgucuuugcaucauggucggcgcaaaugccuccgaucgcauggggaugggcaugaccuaucuagcgcugauggcgacguucaaaaugcguccaauguucgccgugggucuccuguuccgucgcuuaaccucccgggaaguacugcugcugaccaucggucugagccuggucgcguccguugaguuacccaauagccuggaggagcucggcgaugggcuggccaugggcauaaugaucuuaaaguugcuuacugacuuccagucccaccaauugugggccacgcuccugagccugaccuucaucaagacgaccuucucccuccacuacgccuggaagacgauggcgauggugcugucaaucgugucccuguucccacucugucugagcaccaccucccagaagaccacauggcugcccgugcuuuuaggcagccugggguguaagccgcucaccauguucuuaaucgccgagaacaagaucuggggucgcaagagcuggccccuuaacgaggguaucauggcugucgggaucgugucgauccuccugucuagucugcuuaagaaugaugugccgcuggccgggccccugaucgcgggcggcaugcucaucgcaugcuacgucaucagcggguccagcgccgacuugucucuggaaaaggccgccgaagugagcugggaagaggaggcugagcacucuggcgcgagccacaacauccucgucgaaguccaggacgacgggaccaugaagaucaaggacgaggagcgggacgacacccugacgauccugcucaaggcuacccugcuggccguguccgguguguacccgcucagcauucccgccaccuuauucgucugguauuucuggcagaagaaaaaacagcgcuccggggugcugugggacaccccgucgccgcccgaaguggagcgggccguucucgacgauggcaucuaccgcaucaugcagcggggacuauuagggagaucccaggugggcgugggugucuuccaggagaacguguuccacaccauguggcacgugacacggggcgcgguccugauguaccaggggaagcgccuagagccaagcugggcuuccgugaagaaggaccugaucagcuaugggggcggguggcgacuacagggcuccuggaacaccggggaggagguucaagucaucgcaguggagcccggcaagaaccccaagaacguccagaccgccccugggacguuuaagacgagcgagggcgaaguuggcgccaucgcgcuugacuucaaacccgggaccagcggcucccccaucgugaaccgcgaggggaaaaucgugggccuuuacggcaacgguguagugacuaccagcgggacguacgugagcgccaucgcgcaggccaaagcgucgcaagaggggccacugccggagaucgaggacgaggucuuccggaagcgcaaccucaccauuauggaccugcaccccggcuccgggaagacccggagauaccugccggccaucgugcgggaggccaucaagcgcaagcuccggacccugauacuggccccgacgcgcguaguugccagcgagauggcggaggcccucaagggcaugcccaucagguaucagaccaccgccgugaaguccgaacacaccggcaaggagauuguggaccugaugugccacgccacguucaccaugcggcugcuaagccccguccgcgugcccaacuacaacaugauaaucauggacgaggcucacuucaccgauccgucuagcaucgcugcccggggguacauuuccacucgcgugggaaugggagaggccgcagccaucuuuaugacggcgacgccgccuggcagcguagaggccuucccccaguccaaugcagugauucaggacgaggagcgugacaucccugagcgcucuuggaacuccggguaugaguggaucaccgacuuccccggcaagaccguaugguucgucccaagcaucaaauccggcaacgacaucgccaacugcuuacggaagaacgggaaacgcgugauacagcugucccggaagacuuucgacaccgaguaccagaagaccaagaacaacgacugggacuacguggucacgacggacaucagcgaaaugggcgcgaacuucagagccgacagggugauugacccccgccggugccucaagccggugauccugaaggacgguccagaacgggucauccuggccggccccaugcccgugaccgucgccagcgccgcgcagcggcgcgggcggaucggcaggaaccacaacaaggagggcgaccaguauaucuacaugggccagccacucaacaacgacgaggaccacgcccacuggaccgaggccaagaugcugcuggacaacaucaacacccccgagggcauuauucccgcccucuucgagcccgagcgggagaaguccgccgcgaucgacggugaguaccgccugcgcggcgaggcccguaagacguuuguggagcugaugcggcgcggggaccuccccguguggcugucuuacaagguggccucggagggcuuccaauacagcgaccgccgguggugcuucgacggggagcgcaacaaucagguguuagaggagaacauggacguggagaucuggacuaaagagggggaacggaagaaacuccgcccccgguggcuggacgcccgcaccuacagcgacccuuuagcccuccgggaauucaaagaguucgcggccggccgacgguccgucagcggggaccugauccuggagaucggcaagcugccccaacaccugacgcagcgugcccagaacgcccucgacaaccucgugaugcugcacaacuccgagcaagguggccgggcguaucgccacgccauggaggagcugccagacacgauugagacccucaugcugcuggcccucauagcgguccugaccggcggggucacccuguucuuucucagcggccgggggcugggcaagacaucaauaggacugcucugugugauggccaguuccguguugcuguggauggcaagcgucgagccccacuggauugccgccucuauaauccucgaguucuuccugauggugcugcuuauccccgagcccgaccgccagcggaccccgcaggacaaccaguuagccuacguggucauugggcuccucuucaugaucuugaccguagccgcgaacgagaugggccugcucgagacuaccaagaaggaccuggggaucggccacguagccgucgagaaccaccaucacgccgcuaugcuggacguggaccuccaccccgccagcgcguggacgcuguacgccguggcaaccacuauuaucacgcccaugaugcgccacacgaucgagaacacaacagccaacaucucccuaaccgcuaucgcgaaucaagccgccauccucaugggguuagauaaaggcuggccaauuucaaagauggacaucggcgucccacuucuagcucuggggugcuacucccaggugaacccccugacgcucaccgcggccguuuugaugcuggucgcacacuacgccaucauaggccccgggcuccaggccaaggcuacccgggaggcacagaagcgcaccgccgccgggauaaugaaaaauccgacgguggacgggaucgucgcuauugaccuggaucccgucguauacgacgcgaaauucgaaaagcagcugggccaaauuaugcucuugaucuugugcaccagccagauccugcugaugcgcaccaccugggcccugugcgagucaaucacgcucgccacaggccccuugaccacccugugggagggaagcccagguaaguucuggaacacgaccaucgccgugagcauggcuaacaucuuccggggguccuaucucgcuggugccggccuggccuucagccugaugaagucccucgggggcggccgucgcggcaccggggcgcagggcgagacccugggcgagaaguggaagcgccagcugaaccaacucagcaagucggaguucaacacguauaaacggagcgggaucauggagguggaccgcuccgaggcgaaggaaggccugaagcgcggggaaaccaccaagcaugccgugagccgcggcacugccaagcuaaggugguuugucgagcgcaaccucgucaagccagaggggaaggucaucgaccugggcugcggccgcggcggaugguccuacuacugcgcgggguuaaagaagguuacggaggucaaaggguacaccaagggcgggccuggccaugaggagccuauacccauggccaccuacggguggaaccuggugaaacuccacagcggcaaggacguguucuucgucccgccagagaaaugcgacacacuacugugcgacaucggggaguccucucccaaucccacaaucgaggagggacgcacacucagagugcuaaagauggucgagccguggcugcgcgggaaccaguucugcaucaagaucuugaaccccuacaugccgagugucguggagacccuggagcagaugcagcgcaagcacggaggcaugcucgugcgcaacccccucagccggaacuccacccacgagauguacugggucagcugcggaacgggcaacaucguguccgcugugaacaugaccagucgcaugcugcugaaccgguucaccauggcccaccgcaagccaaccuacgagagagacgucgaccucggggccgggacacggcacgucgccguggagccugagguagccaaccuggacaucauaggccagcgcaucgagaacaucaagcacgaacacaaguccacguggcauuaugaugaggacaacccguacaagaccugggcguaccacgguagcuacgaggugaagcccucaggcagcgccagcuccauggucaacggaguggugaagcugcucacuaagccuugggacgugaucccuauggugacccagaucgcgaugacagacaccacccccuuuggccaacagcggguauuuaaggagaaggucgacacccgcacgcccaaggccaagcgagguaccgcucagauaauggaggugaccgcgaaauggcugugggguuuccugagucggaacaagaagccacguaucuguacccgcgaagaauucacucggaaggugcgcuccaacgcggcuaucggggccgucuucguggacgagaaccaauggaacagcgcgaaagaggccguggaagacgagcgguucugggaucucguccaccgugagcgggagcugcauaagcaggggaagugugcgaccugcguauacaacaugaugggcaaacgcgaaaagaagcuuggcgaguuuggcaaggccaaaggcucccgggcuaucugguacauguggcucggcgcgcguuuucuugaguucgaggcccuaggauucaugaacgaggaucacugguucucccgggagaacuccuuaagugggguagagggcgaggggcugcacaagcugggcuacauacuccgcgacaucuccaagaucuccgggggcaauauguacgccgacgacaccgccggcugggacacccguaucacggaggacgaccugcagaacgaggcgaagaucacagacaucauggagccugagcaugcgcugcucgcgaagucaaucuuuaaacugaccuaccagaacaaggugguucgcgugcaacggcccgccaagaacgggacagucauggacguuauaagcagacgcgaccagcggggcuccggccaggugggcacguacgggcugaacaccuucaccaacauggaggcccagcucauccgccaaauggagagcgaggggauauucuccccgagcgagcuggagacccccaacuuagccgaacgcgcgcuugacuggcuggagaagcaugguguagagagauuaaagcggauggccaucagcggggacgacugcgucgugaagcccaucgacgaucguuucgcaacggccuugaccgcccucaaugauaugggcaagguccggaaggacaucccucagugggagccauccaagggguggaaugacuggcagcagguccccuucugcagccaucacuuccaucagcugauaaugaaggacggccgcgagauugugguccccugccggaaccaggacgaacucgugggccgcgcgcggguaagucaaggggccggcuggagccugcgcgagaccgccugucugggaaaaucguacgcccagauguggcagcucauguacuuucaccggcgcgaucugcggcuggcggcaaacgccaucuguagcgccguucccguggauugggugccgaccucccgcacgaccuggagcauccacgcccaccaucaguggaugacuaccgaagacaugcucuccgucuggaaccggguguggaucgaggagaaccccuggauggaggauaagacgcauaucagcuccugggaggacgugcccuacuuaggcaagagagaggaccaguggugcggcagccugaucggccucaccgcgcgggcuacgugggccacuaacauccaagucgccaucaaccagguacgccgccugaucggcaaugagaacuaccuggacuauaugacguccaugaaacgcuucaagaacgaaagcgaucucgagggggcccugugguga

SEQ ID NO: 23843 - RNA, 9879 nt, Artificial Sequence
  derived and/or modified CDS sequence (opt11) from DENV-1__HM181937__SS-prME
agcgugacgaugcugcucaugcugaugcccacggcucuagcuuuccaccucaccacccgggggggggagccgcacaugaucgucagcaagcaggagcggggcaagaguuuacuguucaagaccagcgcgggugugaacaugugcacccuaaucgcaauggaccugggcgagcugugugaggacacgaugacuuacaagugcccccgcaucaccgaagcggagcccgacgacguggacugcuggugcaacgccaccgacacgugggucaccuacggaacgugcucccaaaccggugagcaccggcgcgauaagcgguccguggcccuugcgccccacguaggccugggacuggagacgcgcaccgagacuuggaugagcuccgagggcgcguggaagcaaauccaacgggucgaaaccugggcccuccgccaccccggguucaccgugauugcucuguuccuggcgcacgcgaucgguacgagcauuacacagaaggggauaaucuucauccuccugaugcuugugacccccuccauggccaugcgguguguuggcaucggaagccgagacuucguagagggacucaguggcgccaccugggucgacgucgugcuggagcacgggagcugcguuaccaccauggcaaaggacaagcccacacuggacauagagcuccugaagacggaggucaccaauccugcgauacuacggaagcucugcauugaggcuaagauuuccaacaccaccacggacagccgcugcccgacacagggcgaagcuacucugguggaggagcaggacgccaacuuugugugccgccgcacuuucgucgaccggggcugggggaacggcugcgggcuguucggcaaggggucacucauuacgugcgcgaaguucaagugcgugaccaagcuggaaggcaagauugugcaguacgagaaccucaaguacagcgucaucgugaccgugcacaccggcgaccagcaccaggucgggaacgaguccacggagcacgguacgaccgcgaccaucacuccccaagcacccaccaccgagauccagcugaccgacuacggggccuugaccuuagauugcucuccccgcaccggccucgacuucaaugagaugguacuguugaccaugaaggagaagucuuggcucgugcacaagcagugguuucuggaccugccacuccccuggaccagcggggccucaaccucccaggagacauggaaucggcaggaccugcuggugaccuuuaagaccgcucacgcgaagaagcaggagguggugguguuaggcagccaggagggggccaugcacaccgcccugaccggggccaccgagauccaaacguccggcacaacgaccaucuucgccgggcaccugaagugccgacucaagauggacaaguuaacccugaagggcaugagcuacgugaugugcaccggcuccuucaaacucgagaaggaggucgcggagacgcagcacggaaccgugcuggugcaaaucaaguaugaaggcaccgacgcccccugcaagauccccuucagcacccaagacgagaagggggucacgcagaacggccggcugaucaccgcuaacccaaucgugaccgacaaggagaagcccgugaacaucgaggccgaaccgcccuucggggaguccuacaucgucaucggcgcgggagagaaggcccugaagcucagcugguucaaaaagggcucaagcauuggcaagauguucgaagccaccgcacgcggggcccggcgcauggcgauauugggcgacacggccugggacuucggguccauuggcggcguguucaccagcguggggaagcugguccaccagaucuucggcaccgccuacgggguccucuucuccggcguaagcuggaccaugaaaaucgguaucggcguccugcuuacguggcugggccugaacucccgcagcaccucccuaagcaugaccuguaucgcgguggggcuuguaacgcuguaccugggcguuauggugcaggccgacuccgggugcguuauaaacuggaagggccgggagcucaagugcgggagcggcaucuucgucacgaacgagguccacacauggaccgagcaguauaaauuccaggcggacagcccuaagagacugucugcggccaucggcaaggccugggaggagggggugugcggcauacgguccgccaccagacuggagaacauaauguggaagcagauaaguaacgagcuaaaucacauccugcuggagaaugacaugaaauucaccgucguggugggggacguggcgggcauucuagcucaaggaaagaagaugaucaggccccagcccauggaguacaaguauucguggaagucuuggggcaaggccaaaaucaucggcgcugacgugcaaaacacgaccuucaucaucgacgggcccaacacgcccgaaugcccggacgaccagcgcgcuuggaauauuugggagguggaggacuacggauucgggaucuucacuaccaacauuuggcugaagcugagggacagcuacacccagguaugugaccaccgccucauguccgcugccauuaaagacucuaaggccguacacgccgacaugggcuacuggaucgagucagaaaaaaacgagaccuggaagcuggcgcgggccagcuucaucgaggugaagacauguaucuggccuaaaucgcacacgcuguggagcaacggcguccucgaguccgagaugaucauccccaagaucuacggggggccuaucucccagcacaacuaccgcccuggguauuucacccagacggccgggccuuggcaccuggggaagcuggagcucgacuucgaccugugcgagggcacaacggugguggucgacgagcacugcgguaaccgggggccgucccugcgcaccaccaccgugaccgggaagaucauccaugaguggugcugccggucgugcaccuuaccgccacuccgauuucgaggagaggacggcugcugguacgggauggaaauccgccccgugaaggaaaaggaggagaaccugguaaaguccauggugagcgccggcagcggcgagguggacuccuucagccucgggcugcuaugcaucuccaucaugaucgaggaggucaugcggagccgcuggucccggaagaugcucaugaccgguacccuggcaguguuccugcuccugaucauggggcagcugacguggaaugaccucauccgccugugcaucauggugggcgcuaacgccucggacaggauggggaugggcaccacguaccuggcccucauggccaccuucaagaugaggccgauguucgccgucgggcugcuguuccgccggcucacgucucgcgaggugcugcugcuaaccaucgggcugagucugguggcguccguggagcuccccaacagccuggaagagcuaggcgauggacucgccaugggcaucaugauccucaagcuucucacugauuuccagucccaccaacugugggcgacacugcugucucugacguuuaucaagaccacuuucucccugcacuacgccuggaagaccauggcgauggugcucuccaucgucagccuguuuccguugugcuuaagcacgaccucacaaaagaccacuuggcugcccgugcuguuaggcucacuggggugcaagccucugaccauguucuuaaucgccgagaacaagaucuggggacgaagaucuuggcccuugaacgaagggaucauggccguagggaucguuucaauccuguuaucuucccuucugaagaacgacgugccccucgccgggccccuaaucgccggaggcaugcugaucgcgugcuacgugaucagcggguccuccgccgaccucucccuggagaaagcggcagaggucagcugggaggaggaggccgagcacuccggcgcgagccacaacauccugguggaggugcaggaugacgggaccaugaagaucaaggacgaggagcgggacgacacccucacaauccugcugaaagccacccuacuggccguguccggcguguacccccuaagcauccccgccacccucuucguuugguacuucuggcagaaaaaaaagcagcgcuccgggguucugugggacacccccagcccgcccgagguggagcgggccgugcuggacgacggcaucuaccgcaucaugcagcggggccuucucgggaggucccaagucggggucgggguuuuccaagagaacgucuuccacaccauguggcacgucacccggggcgcgguguuaauguaccaggggaaacgucuggagcccucuugggccuccgucaagaaggaccucaucagcuacggcggcggguggcggcugcagggcucguggaacacgggggaggagguccaggugaucgccgucgagccuggcaagaaccccaaaaaugugcagaccgcccccgggaccuucaagacgcccgaaggcgaggugggcgccauagcgcuggacuuuaaacccgggacgucagggucccccaucgucaaccgcgaggggaagaucguggggcucuacggaaacgggguugugaccaccagcggcaccuacguaucggccaucgcccaggccaaggcgucucaggaggggccgcugcccgagaucgaagacgagguguuccggaagcgcaaccugacgaucauggaccuccaccccggcagcgguaaaacgcgucgcuaccugccggccaucguccgcgaggccauaaaacgcaagcugcgcacccucauacuggccccgaccagggugguggccuccgaaauggcugaggcccugaagggcaugcccauccgcuaccaaacgaccgccgugaagagcgaacacaccggcaaggaaaucguugaccucaugugccacgccaccuucaccaugcggcugcugucccccguccgcgucccgaacuauaauaugaucaucauggacgaggcccacuucaccgaccccagcucaaucgcagcacguggguauaucuccacccgcgugggcaugggggaggcagccgcaaucuucaugacugcaacgccgccuggcagcguggaagcauucccacagagcaacgccgucauccaggacgaggagcgagacauccccgaacgcuccuggaacagcggguacgaguggaucacugacuuuccagguaaaacugugugguucgugcccuccaucaaaagcggcaacgacaucgccaauugccuccggaagaacgggaaacgcgugauccagcugucccggaagaccuucgacacggaauaccaaaagaccaagaacaacgacugggacuacguagucaccaccgacauuagcgagaugggcgcuaauuuccgcgccgaccgaguaaucgacccccgccggugccuaaagcccgucauacucaaggacggccccgagcgcgugauccuggccggccccaugccgguuacgguggcguccgccgcgcaacggcgcgggcggaucggccguaaucauaacaaggagggcgaccaguacaucuacaugggacagccccugaacaacgacgaggaccacgcgcacuggaccgaggccaagaugcuacuggacaacaucaacacgcccgaggggaucauccccgcccuguucgagcccgaacgcgagaaguccgccgcgaucgacggcgaguaccggcuucgcggcgaagcgcggaaaaccuucgucgagcuuaugcgccgcggggaucugcccguguggcuaucuuacaagguggccagcgagggcuuccaguacagugacaggcgguggugcuucgacggagaacgaaacaaucagguccuggaggagaacauggacguggaaaucuggaccaaggagggcgagcggaagaagcugcggccccgguggcucgaugcgcgcacauacuccgacccccuggcccugagggaguucaaggaguucgcggcaggccgccggucaguguccggagaccucauccuggagauaggcaagcugccgcagcaccucacccagcgcgcccagaacgcccuggacaaccuggucaugcuccacaacagcgaacagggcgggcgggcguaccgccacgccauggaggaauuaccagacacuaucgagacgcugaugcucuuagcacugauugccguccucacaggcggggugacccuguucuuccuguccggccgggggcucggaaagaccagcaucggccugcugugcgucauggccuccagcguccuccuguggauggcguccguggagccccacuggaucgccgccagcaucauucuggaguucuuccucauggucuuacuuauccccgagccggacaggcagaggacgccccaggacaaccagcuggccuacguggugaucgggcugcuguucaugauuuugacggucgccgcgaacgaaaugggccugcuggagacaacuaagaaggaccucggcaucggccacguggccguggggaaccaccaccacgccgccaugcuggacguugaccugcaccccgccagcgcguggacccuauacgcaguggccacgaccaucaucaccccuaugaugcgccauaccaucgagaacacgaccgccaacaucagccugaccgcgaucgcgaaccaagccgccauccugauggggcucgacaagggauggcccauauccaagauggauaucgggguucccuuacuggcccucggcugcuacucccaagucaacccauugacccugacggcggccgugcucauguuaguggcacacuacgcgaucauagguccgggccugcaggccaaggcgacccgugaggcccagaagcggacggccgccgggaucaugaagaaccccaccgucgacggcauuguggccaucgaucucgaccccguuguauacgacgcgaaguucgagaagcagcugggccagaucaugcugcucaucuuguguacgucccagauccuguugaugcguaccaccugggcccugugcgagaguaucacgcuggccacggggccucucaccacccugugggagggcuccccggggaaguucuggaacaccacgaucgccgugucgauggccaacauauuccgcggcaguuaccuggcgggagccggccucgccuucagccugaugaagucguuaggcgggggccgccgggguaccggugcccagggcgagacccuuggggaaaaguggaagcgccaguuaaaccagcuguccaagagcgaguuuaacacguauaagcgguccggaaucauggaaguggaccggagcgaagcaaaggaggggcucaagcgcggcgagacgacgaagcacgccgucucccgcgggaccgcaaaguugcggugguucguggagcgcaacuuagugaagccugaggggaaggucaucgaccucggcugcgggcggggcggguggagcuauuacugcgccggccuuaagaaagugaccgaagugaagggguacacgaaggguggccccgggcacgaggagcccaucccgauggccaccuacggcuggaaccuggucaagcugcacucaggaaaggacgucuuuuucaucccgcccgagaagugcgacacccuccugugcgacaucggggagagcagucccaacccgaccaucgaggaggggcgcacgcugcggguccucaagaugguagagcccuggcugcgcggcaaccaguuuuguauaaagauuuuaaaccccuacaugcccagcguaguggagaccuuagagcagaugcagcggaagcacggcgggaugcugguccguaacccgcugucccggaacagcacccacgagauguacuggguguccugcggcacugggaacaucgugagcgcagucaacaugaccucccgcaugcuccugaaucgcuucacgauggcccaccgcaagcccaccuaugagcgcgacguggaccugggcgccgguacccgacacguggccguagagcccgagguagcgaaccucgacauuauugggcagcgcaucgagaacaucaagcacgagcacaagagcacauggcacuacgaugaggacaaccccuacaagacaugggcguaccacggcuccuacgaggugaagcccaguggguccgccagcagcaugguaaacggcguagucaagcuacugacgaagcccugggacgugauucccauggucacccaaaucgccaugaccgacacgacccccuucggccagcagcggguguuuaaggagaagguggacacccgcaccccaaaggcgaagcggggcacggcccagauaauggaggugaccgcgaaguggcucuggggauuccugucccgcaacaagaagccucggaucugcacccgggaggaguucaccaggaagguccgcagcaaugcugccauuggggcaguguucguagacgagaaccaguggaacuccgcaaaagaggccguagaggacgagagauucugggaccuggugcauaaggagagagagcuccauaagcagggcaagugcgccacgugcguguacaacaugauggguaagcgggaaaagaaacugggcgaauucgggaaggccaagggcaguagggccaucugguacauguggcuuggagcccgguuccucgaguucgaggcccugggcuucaugaaugaagaccacugguucucccgcgagaacagcuugucuggcgucgagggggagggccuccacaagcugggguacauccugcgggacaucagcaagauucccggcggcaacauguacgcagacgacaccgccgggugggacacccgcaucacggaggaugaccuccagaacgaggcccggaucacagacaucauggagccggaacacgcgcugcuggccaaguccaucuucaaacucaccuaccagaacaagguggugcgcguccagcgccccgccaagaacgguaccgugauggacgugaucagccggcgugaccagcgaggguccggccaggucggcaccuacgggcugaacaccuucaccaacauugaggcccagcugaucaggcaaauggagagcgagggcaucuucucccccucagagcucgaaacgccuaaucuggcggagagaguacuggacuggcuagagaaguacgggguggagcgccugaagcggauggcaaucuccggggacgacugcguagugaagccgauugacgaccgcuucgccaccgcccugacggcccucaacgauauggggaaggugcggaaggacaucccucagugggagcccuccaagggcuggaacgacuggcagcagguccccuucugcucccaccacuuccaccagcugaucaugaaggacggccgcgagauagugguuccgugccggaaccaggacgagcuagucgggcgcgcccgggugagccagggcgcgggguggagccuccgcgagaccgccugccuggggaaguccuacgcccagauguggcagcugauguauuuccaccgcagagaccucagacuggccgcgaacgcuaucugcagcgccgugcccguugacuggauccccaccucucgcaccacuuggagcauacacgcccaccaccaguggaugacuacggaggacaugcuguccguguggaauagaguuuggaucgaggagaaccccuggauggaggacaagacgcacaucucgaguuggggcgacgucccuuaccucggcaaacgcgaagaccaguggugcggcagccugaucggccugaccgcgcgggcgaccugggccaccaacauccagguggccaucaaccaaguacgccgcuuaauagggaacgaaaacuaccucgacuacaugaccuccaugaaacgguucaagaacgagucggaccccgagggggcccugugguga

SEQ ID NO: 23844 - RNA, 9879 nt, Artificial Sequence
  derived and/or modified CDS sequence (opt11) from DENV-1__HM181939__SS-prME
agcgugaccaugcugcucaugcugaugcccaccgccuuagcuuuccaccuuaccacccggggcggugagccccacaugaucguuagcaagcaggagcgagguaagagccugcuguuuaagacuagcgccggggugaacaugugcacccucauagccauggaccugggcgaguucugcgaagacaccaugaccuacaaauguccccggaucucugaggccgagcccgacgacguggacugcuggugcaacgcuaccgacaccuggguuaccuacgggaccugcucccagacgggugagcaccgucgugacaagcggagcguggcccuggcgccccacgugggccucgggcuagagacccggacggaaaccuggauguccagcgaaggcgccuggaagcagauacagcgagucgagaccugggcccugcgccaccccggguuuaccgugaucgcgcucuuccuggcgcacgccaucgggacgagcauuacacagaaggggaucaucuucauccugcucaugcuggugacgcccucaauggccaugcggugcgucgggaucggcucccgcgacuucguggagggacugagcggcgccacuuggguagacguugugcucgagcacggcuccugugugacgaccauggcuaaagacaagcccacucuggacaucgaguuacuuaagacggaaguaacgaacccagcggugcugaggaagcuuugcaucgaagccaagaucagcaacaccacaaccgacucccgcugcccgacgcagggcgaagccacccucguggaggagcaggacgccaacuucguaugucggcgcaccuucguggaccggggcugggggaacggcugcgggcuguucggcaaggggagccugaucacuugcgcuaaguucaaaugcgugacgaaacucgaaggcaaaaucguccaguacgaaaaccugaaauacuccgugaucgugacaguccauaccggagaccagcaucaaguggggaaugagagcacugagcacggcacgaccgcgaccaucacgccccaggcucccaguaccgagauccaacugaccgacuacggggcccuaacccuggacugcagcccccggaccggccuggauuucaacgagaugguccuccugaccaugaaagagaagucauggcuggugcacaagcaaugguuccucgaucugccgcugcccuggacauccggugcuagcaccucccaggagacguggaacagacaggaccuccuagugacuuucaagacugcccaugcuaagaagcaggagguugucgucuuaggaagccaggagggugccaugcacaccgcccucaccggggccaccgagauccagacguccggcacgaccacuaucuucgcugggcaccugaagugccgccugaagauggacaagcucacucugaagggcauguccuacgucaugugcaccgggagcuucaaacuggagaaggagguggcggagacccaacacgggaccguccucguccagaucaaguacgagggcacggacgccccgugcaagauucccuucaguacacaggacgaaaagggggugacacagaacggcagacugaucaccgccaaccccaucgucacggauaaggagaagcccgucaacauugaggccgagccacccuucggggagagcuacaucguaaucggcgcgggcgagaaggcccugaaguuaagcugguuuaagaaggggucgagcaucggcaaaauguucgaggccacggcccgcggggcccggcgcauggcgauccucggagacaccgccugggacuucgggaguaucggcggcguauucaccucagucgggaagcuuguucaccagaucuucggcacagccuacgggguccuguuuaguggcgucagcuggaccaugaagaucgggaucggcguguuacucaccugguuaggccuuaacagucgcagcaccagccugagcaugacgugcaucgccguggggcuggucacccucuaccugggcgugaugguacaagccgacagcgggugugucaucaacuggaagggccgggagcugaagugcgggaguggcauuuucgugacuaacgagguucacaccuggacggagcaguacaaauuccaggcggacagcccgaaacgccuauccgccgccaucggcaaggcaugggaggagggggucugcgguauccguagcgcgacccgccuggaaaacaucauguggaagcagaucuccaaugagcugaaccacauccuccuggagaacgacaugaaauucaccguaguagucggugacguggcgggcaucuuagcccaggggaaaaagaugauccggccacagcccauggaauauaaauacagcuggaagucgugggguaaagcgaaaaucaucggcgccgacgugcagaacaccaccuuuauaaucgacgggcccaacacgccggagugccccgacgaccagcgcgcguggaacauaugggaggucgaggacuacggcuuugggaucuuuacaaccaacaucuggcugaagcugcgggacagcuacacccaagugugcgaccaccgccugauguccgccgccauuaaggauagcaaggcagugcaugcagacaugggcuacuggaucgaaucugagaagaacgagacguggaagcuggcgagagccagcuucaucgaggucaagaccugcaucuggccgaagucccacacccucugguccaacggcgugcuagagucagagaugaucaucccuaaaaucuacgggggcccuaucucccaacacaauuaccgccccggcuauuucacccagacggccgggcccuggcaccuggguaagcuggagcuagacuucgaccucugcgagggcacuacgguggucguggacgagcacugcggaaaccgggguccuucccugcgaaccacaacggugaccggcaaaaucauccaugaauggugcugucggucuugcacuuuaccgccccuacgcuucaagggggaggacgguugcugguauggcauggagauucggcccguuaaggagaaggaggaaaaccuuguuaagucuaugguguccgcaggcagcggcgagguugacuccuucagccugggacuccuaugcaucagcaucaugaucgaggaggucaugcgcagccgguggucccgcaaaaugcugaugacgggcacccucgcaguguucuuccugcuuaucaugggccagcuaaccuggaacgaccugauccggcugugcauaauggucggggcuaacgccagcgaucgcauggggaugggcaugaccuaccucgccuugauggccacguucaagaugcgcccgauguucgcugugggccucuuguuccggcgucugaccagccgggaagugcugcuccugacgauaggguuaagccuugucgccagcguggaacuucccaacagccuggaggagcucggugacgggcuggcgaugggaaucaugauccugaagcuccucaccgacuuccagucccaucagcuuugggccacgcuccugagccugaccuucaucaagaccaccuucagccuacacuaugccuggaagacgauggcgaugguccugagcaucgugucccuguucccccucugccugagcacuaccucccaaaagaccacauggcugcccgugcuccugggcagcuuggggugcaagccgcuaacaauguuccugaucgccgagaacaagaucuggggccgcaagagcuggccccugaacgaaggcaucauggccgugggcaucguguccauccuccuuagcucgcugcucaagaacgaugugccccuugccggaccccugaucgccggcggcaugcucaucgcgugcuacguuaucagcgguuccucagcugaccugucccuggagaaggccgcggaggugagcugggaagaggaggccgagcacagcggcgccagucacaacauccucguggagguccaggaugacgguaccaugaaaaucaaggaugaagaacgggacgacacccugacuauucugcuuaaagccacccugcuggccguguccggcguguauccgcugagcauccccgcgacccuguucgucugguacuucuggcaaaaaaaaaagcaacgcuccggggugcugugggacacacccucgccucccgagguggagcgggccguccuggacgacggcaucuaccgcaucaugcagcggggccuucuggggcgcagucagguuggcgugggcguuuuccaggagaauguguuucacacuauguggcacguaacgcggggcgcggucuuaauguaccaggggaaacgccuggagccuaguugggccuccgugaagaaggaccucaucagcuacggcggcggguggcggcugcaaggauccuggaauaccggggaggaggugcagguuaucgccguggagcccggcaagaaccccaagaaugugcagaccgcccccgggaccuucaagacgucagagggcgaggucggagcgaucgcgcucgacuucaagcccgggacaagcgggucccccaucgugaaucgcgaagggaagaucgugggccuguacggcaacggggucgugaccaccagcggcacguacguguccgcuaucgcccaggcgaaggccagucaggagggcccccugccggagaucgaggacgaagucuuccggaagcgcaaccucaccaucauggaccuucaccccggcucggggaagacccggcgauaucugcccgccaucgugcgggaggccaucaagcgcaagcuccggacccugauccuggccccgacgcgcgugguugccagcgagauggcggaggccuuaaagggcaugcccauccgcuaucagaccaccgccguaaaaucagagcacacuggcaaagagaucguggaucucaugugccacgccacguucaccaugcggcugcucagccccgucagagugcccaacuacaacaugaucaucauggacgaggcccacuucacagacccguccagcaucgcggcccggggguacauauccaccagggucggcaugggcgaggccgccgccauauucaugacggcgacccccccaggcuccgucgaagcguucccccaguccaaugcugugauucaggacgaggagcgggacaucccagagcgcagcuggaacuccggguacgaguggaucaccgacuuccccggcaagaccgucugguucgugcccagcaucaaguccggcaacgacauugccaacugccugcggaaaaacgggaagcgcgugauccagcugucacggaagaccuucgauaccgaauaccagaagacgaagaacaaugacugggacuacguggugaccacggauaucuccgagaugggcgcgaacuucagggccgaccgggucaucgacccccgccggugccuaaaaccggugauccuuaaggacgggcccgagcgcgucauucuggccgggcccaugcccgucaccguagccagcgcugcgcagcggcgcgggcgcaucggccgcaaucacaacaaggagggcgaucaguacauuuacaugggucagccgcucaacaacgacgaggaccaugcccauuggaccgaggccaagaugcugcuggacaacaucaacacccccgagggcauuauccccgcucucuucgaacccgagcgggaaaaguccgcggcgaucgacggggaguaccgccugcggggagaagccagaaagacguucguggagcugaugagaagaggggaccuaccuguguggcuguccuacaagguggccagcgaaggcuuccaguacuccgaccgacgcuggugcuucgauggagagcgcaacaaccaagugcuggaagagaacauggacguggagaucuggaccaaggagggggagcggaaaaagcuccgcccccgguggcucgacgcccgcaccuacagcgacccccuagccuuacgagaguuuaaggaguucgcggccggccgccgcuccgucagcggggaccugauccuggagaucggaaaguuaccccagcaccugacccagcgcgcccagaacgccuuagacaaccucgugaugcugcacaacucugagcagggugguagggcguaccgacacgccauggaagagcugccggacacgaucgagacacucaugcugcuugcacucaucgccgugcuaaccggcggggucacccuguucuucuuaagcggucgagggcugggcaagacgagcaucggccuacucugcgugauggccagcuccguccugcuuuggauggcguccguggagccccacuggaucgcggccuccaucauccucgaauucuuucugauggugcuuuugauccccgagccugaccgacagagaaccccgcaggacaaccagcuggccuauguggucaucgggcuccucuuuaugauccugaccguggccgcuaacgagaugggccugcucgagaccacaaagaaagaucuggguaucggccacguugcugucgagaaucaccaccacgccgccaugcuugacguagaucuccaccccgccagcgcguggacgcuauacgccguggcuaccaccaucaucaccccuaugaugcggcacacgauagagaacaccacagcaaacaucucccugaccgcgauagccaaccaggccgccauccucauggggcuggacaagggcuggccgaucucuaagauggacaucggcgucccccuguuagcccugggaugcuacucccaggugaauccucugacgcuaaccgcugccguucugaugcuugucgcccacuacgcaaucaucggccccggauugcaggccaaggcaacccgggaggcccagaagcgcaccgcugccgggaucaugaagaacccgacgguggacgguaucguggcaauagaccucgaccccgucguguacgacgcgaaguucgagaaacagcugggacaaaucaugcugcugauccugugcaccagccagauccuccugaugcgcaccaccugggcauuaugcgaauccaucaccuuggccaccggcccccugaccacucuuugggaggggagccccggaaaguuuuggaauacgaccauugccgugagcauggccaacaucuuccggggguccuaccucgcgggggccggucuagccuucagccugaugaaaucccucggaggggggcgccggggcaccggggcacaaggcgagacccugggagaaaaguggaagcgccaguugaaccaguugagcaaguccgaguucaacacguacaagcggagugggaucauggagguagaccguuccgaagcaaaggagggacugaagcgaggggagacgaccaaacacgcggugagccguggaaccgccaagcuucggugguuuguggagcgcaaccuagucaagccagaggguaaaguaaucgaccugggcugcggcaggggcgggugguccuacuacugcgccgggcugaagaaggugacggaggucaagggguacaccaagggcgggcccggccacgaggagcccaucccgauggccaccuacggauggaaccuggugaagcugcacagcgguaaggacguguucuucgucccgcccgagaagugcgauacccuuuuaugcgacaucggggaauccagccccaaccccacgauagaggaaggccguacccuccgagugcugaaaaugguggagccguggcuacgcgguaaccaguuuugcaucaaaauccucaaccccuacaugcccaguguaguagagacccucgagcagaugcagagaaagcacggcgggaugcuggugcgcaacccgcucagccggaacuccacccacgaaauguacugggucucgugcggcacgggcaacaucgugucagcgaucaacaugaccagccgcaugcuucugaacagguucacaauggcucaccgcaaaccuaccuacgagcgcgacguggaccuaggggccggcacccggcacgucgccguagagcccgagguggccaauuuagacaucaucggccagcggauagaaaacaucaaacacgagcacaaguccacuuggcacuacgacgaagacaaucccuacaagaccugggcguaccaugggucuuaugaggucaagcccagcggcuccgcgagcuccauggucaacgggguugugaagcugcucacaaagccgugggacgugauccccauggucacccaaaucgccaugaccgacaccaccccuuucggccaacaacggguauucaaagagaagguggacacgcgcacgcccaaggccaagcgggguaccgcccaaaucauggaggucaccgcgaaguggcuguggggcuucuuaagccgcaacaaaaaaccgcggauaugcacccgcgaggaguucacgcggaagguucgcuccaacgccgccaucggugccguguucgucgacgagaaccaguggaacagcgcgaaggaggccguggaggaugaacgguucugggaccucguacaccgcgagcgggaacugcauaagcaggggaagugcgccacgugcgucuacaacaugaugggcaagcgcgagaagaagcugggggaguucggcaaggccaaggggucccgggccauuugguacauguggcucggcgcgcgcuuucuagaguucgaggcccuggguuucaugaacgaggaccacugguucagccgggagaauucccucagcgggguggaaggcgagggacugcacaaacugggcuacauccucagagacaucuccaagaucagugggggcaacauguaugccgacgauacagcaggcugggacacccggaucacggaggaugaccuucagaacgaagccaagaucaccgacauuauggagcccgaacacgcgcugcucgccaauaguaucuucaaacugaccuaccagaacaaggugguccgcgugcagagaccggcgaagaacgggaccgugauggacgucaucagccgccgcgaccagcggggcuccggccaagugggcacguacgggcugaauaccuucacgaauauggaggcccagcucauccgacagauggagagcgaggggauuuucuccccgagcgagcuggagacccccaaucuugccgagcgggugcucgacuggcuggagaagcacggcgucgagcgcuugaagcggauggcgaucagcggugacgacugcguggugaaaccuaucgacgaccgcuucgcuacugcccucaccgcccugaacgacaugggcaagguccggaaggauaucccucagugggagccgucaaaaggcuggaacgacuggcagcaaguccccuucugcagccaccacuuucaccagcugaucaugaaggacggccgcgagauuguggucccgugucggaaccaggacgagcucguggggcgcgcgagagugucccagggggcgggcuggagcuugcgcgagaccgccugccuggggaaguccuaugcccagauguggcagcucauguacuuccaccggcgcgaccugcggcuagcugcgaaugcgaucugcucagcaguccccguggacugggugcccaccucccgaacgaccuggaguauacacgcucaccaccaguggaugacaaccgaggacaugcucuccgucuggaaccggguguggaucgaggagaaccccuggauggaggacaagacgcacaucagcuccugggaggacgugcccuaccugggcaagcgcgaggaccaguggugugggagccugaucggguugaccgcccgcgcuacgugggccaccaacauccaggucgcaauaaaccagguucgccgcuuaaucggcaaugagaacuaccuggacuacaugacguccaugaaaagauucaagaacgagagcgacccggagggggcccucugguga

SEQ ID NO: 23845 - RNA, 9879 nt, Artificial Sequence
  derived and/or modified CDS sequence (opt11) from DENV-1__HM181942__SS-prME
agcgugaccaugcuguugaugcuaaugcccaccgcccuggccuuccaccucacuacccggggcggggaaccgcauaugaucgucaguaagcaagagcguggaaagucucuucuguucaagaccagcgcgggggugaacaugugcacgcucaucgcaauggaccugggcgaguucugcgaagacaccaugaccuacaagugcccccggaucuccgaggccgagcccgacgacguggacugcuggugcaaugccaccgacaccuggguuacguaugggacuuguagccagacgggcgagcaccgucgcgauaagcggagcguggccuuggcgccccaugugggcuugggucuugagacccgcacagagaccuggaugaguagcgaaggggcguggaagcagauccagcgggucgagaccugggcccugcggcacccgggcuucaccgugaucgcccucuuccuggcacaugccauuggcacauccauaacgcagaaggggaucaucuucauccuguuaauguuagugacucccagcauggccaugcggugcgugggcaucggaagucgcgacuucguugagggguuaucuggcgcgaccuggguugaugucguucucgagcacgggucgugcgugacgaccauggccaaggauaagccgacucuugacauugagcuccuaaagaccgaggucacaaaucccgcggugcuccgaaagcuguguauugaggcuaaaaucucgaauaccaccaccgacucccgcugccccacacagggcgaggccaccuugguggaggagcaggacgcuaacuucguuugccggcgcaccuuuguggaccggggcugggggaaugguugugggcucuuuggcaaagggagucugauaacuugcgccaaauucaaaugugugacgaagcucgaggguaagaucguccaguaugagaaccugaaauauucaguaaucgugaccguccacaccggcgaucaacaccagguggggaacgagagcacugaacacgggacgaccgcgaccauaacgccccaggcccccuccacagagauccagcugacggacuacggggcccucacauuagacuguucaccgaggaccggccuagacuuuaacgagaugguccugcuuaccaugaaagagaaguccuggcucguucacaagcagugguucuuagaucugccgcugccguggacuuccggggccagcacaucucaggagaccuggaaccgacaggaccuccugguaacguucaagacagcccacgcuaaaaagcaggaagucguggugcugggcagccaggagggcgccaugcacaccgccuuaacgggggccaccgagauccagacguccggcaccaccaccauauucgcugggcaccugaaaugccgccugaagauggacaagcugacacugaagggcaugagcuacgucaugugcacagguaguuucaaacuggaaaaggaaguggcggagacccagcauggcacaguccugguacagaucaaguaugaagguacagacgcacccugcaagauccccuuuagcacccaggacgagaagggaguaacccagaacggccggcuuaucacugccaaccccaucgugacggacaaggagaagccuguaaacauagaggcugagccgcccuucggcgaguccuacauagugauuggcgcgggcgagaaggcccucaagcugucuugguucaaaaagggguccagcauugggaagauguucgaggcgaccgccagaggggcgcggcgcauggccauacuaggcgacacggccugggacuucgggagcauaggcggcguguucaccagcguuggcaaguuagugcaccagaucuucggcacggccuacgggguucuuuucuccggugugucguggacaaugaaaauagggaucggcguucuauuaacuugguuaggucuaaacuccagaagcacaucccugucgaugaccugcauugccguggggcuaguaacccuguaccuaggcguuauggugcaggcagauagcgggugcguaaucaauuggaagggccgggagcuaaaauguggauccggcaucuuuguuacuaacgaggugcacacuuggacggagcaauacaaguuccaggcggauagcccgaagcgccucuccgccgcgaucggaaaagccugggaggaggguguaugcgggauccguagcgcuacccgccuggagaauaucauguggaaacaaaucuccaacgagcucaaccacauccuccuggagaacgacaugaaguuuaccgugguggucggugacgucgcgggaauccuggcccagggcaagaagaugauccggccgcaaccuauggaguacaaguacagcuggaaauccugggggaaggcaaaaaucaucggagcggacguucagaacaccaccuucauuauugauggccccaacacuccggagugcccagacgaucaacgggcguggaacaucugggaagucgaggacuaugguuucgguaucuucaccaccaacaucugguugaagcugcgggacagcuacacccaagugugcgaccaucgccugauguccgccgccaucaaagacagcaaggccgugcacgccgacaugggcuauuggaucgaauccgagaagaacgagacguggaagcucgcgcgagcuucuuucaucgaggugaagaccuguauauggccaaagucccacacgcuguggagcaauggcgugcuggaguccgagaugauaauccccaagaucuacgggggcccgaucucacagcacaacuaucgccccggauacuucacccaaacggccggcccuuggcaccucgggaaguuagagcuggacuuugaccucugcgagggcacgacaguggucguggacgagcacugcggaaaucgcgguccgucguugcgaaccaccaccgugaccggcaagaucauccaugaguggugcugccggagcugcacccuaccgccgcugagauucaagggggaggauggcugcugguacgggauggagauccgucccguaaaggaaaaggaagagaacuuagucaagucuaugguaucagcagggagcggggagguugacucauucucgcuggggcuccuguguaucuccaucaugaucgaagagguaaugcgcagccgcuggucgcggaagaugcugaugacgggcacauuagcgguguuuuuccugcugaucauggggcagcucaccuggaacgaccugauccgucugugcauuaugguuggcgcaaacgccagcgaccgcaugggcauggguaugaccuacuuagcgcucauggccacguucaagaugcggccgauguucgccgugggccuccuguuccggcgucugaccucucgggaagugcugcucuuaaccaucgggcugucgcuugucgcguccguggaacugcccaauagccuggaggagcucggagacgggcuggcgauggguaucaugaucuugaagcuccugacagacuuucagucccaccagcugugggcaacucuccugagccuuaccuucauaaaaaccaccuucucuuuacacuaugccuggaagacgauggcgaugguccugagcauuguaucgcuguuuccccucuguuuaagcaccacuucacagaagaccaccuggcugccgguucuccuggggagccuaggaugcaagccgcuaaccauguucuugaucgcagagaauaagaucuggggccgcaaaaguuggccccugaacgaaggcaucauggccgucggcaucgugaguauccuacugagcucccuccucaaaaacgaugucccccuggccgggccgcugaucgccggcgguaugcucaucgcaugcuacguaaucucugggucgucugcagaccuguccuuggagaaggccgcggaggucagcugggaagaggaggcugagcacucaggcgcuagucauaacauacucguggaaguccaggacgacgggaccaugaagaucaaggaugaggagcgggacgauacccugacgauccuccucaaggccacccugcuggcggucucgggcguguacccguugagcauacccgccacacuguucgucugguauuucuggcagaagaagaaacagcgcuccggagugcugugggacacccccucgccaccagaagucgaaagggcagugcuugacgacggaaucuaucgcaucaugcagcgcggccugcuggggcgcagccaagugggcgucggagucuuucaggagaacguuuuccacaccauguggcacguuacccggggcgcgguccuaauguaucagggcaaacgccucgagcccagcugggccuccguaaagaaagaccugaucagcuauggggguggguggcguuuacagggauccuggaacacaggggaggaaguacaagucaucgcaguggagcccggcaagaaccccaagaaugugcagaccgcuccggguacauuuaagaccagcgaaggagaggucggcgccaucgcgcucgacuucaaaccgggcaccagcggcuccccuauaguaaacagggagggaaagauagugggccuguauggaaacggaguugugacgaccucugguacguacguguccgccaucgcccaggccaaagcuagccaggaggguccucugccggaaauagaggaugaggucuuccggaaacgcaaccuaacgauuauggaccugcacccuggcagcgggaagacgcggagguaccuccccgcaaucguccgggaggccauuaagcgcaaacuccggaccuugauccuugcuccgacgcgcguggucgcauccgaaauggcggaggcgcucaagggcaugcccauacgcuaccagacgacugcagugaaaagcgagcacacgggcaaagaaaucguggaccuuaugugccacgccaccuucacgaugcgacuuuugucgccaguccgcgucccuaacuacaacaugaucaucauggacgaagcccacuucaccgaccccagcagcaucgcggcucggggauacaucagcaccagaguaggcaugggggaagccgcagccauauucaugacggcgacaccgcccggcagcgucgaggcuuucccccaauccaaugccguaauacaagacgaggagcgggauauccccgaacgaaguuggaacagcggguacgaauggaucaccgacuucccgggcaaaacagucugguucguccccagcauaaaauccggcaacgacauugcuaacugcuugcggaaaaacgggaagagagugauccaauuaucgcggaaaacguucgacacagaguaucaaaagacaaagaacaacgauugggauuacgugguaaccacggacaucuccgagaugggcgcgaauuucagggcugaccgcgugaucgacccccgccggugccucaagccagugauacucaaggauggccccgagagagucauccuggccggccccaugccugugaccguugcgagcgcagcacagcggcgcgggcguaucgggcgcaaccacaauaaggagggggaucaguacaucuauauggggcagccguugaacaaugaugaggaccacgcccacuggaccgaggccaaaaugcugcuggauaacaucaacacacccgaagguaucauccccgcccuguuugaaccggagcgugagaaguccgcagcgaucgauggggaauauagacuucgcggcgaggcccggaagacguucguggaauuaaugcgcaggggcgaucucccggugugguuguccuacaaggucgccagcgagggauuccaauacagugaccgccggugguguuucgacggcgagcgcaacaaccagguccuggaggaaaacauggacguggagaucuggacaaaggaaggggagcggaagaaguugcgcccgcgguggcuggacgcccgcaccuacucagacccccuggcucucagagaguucaaggaguucgcggccgggaggagguccgucagcggcgaccugauccuggaaaucggcaagcucccucagcaccugacccagagagcccagaaugcgcuggacaauuuagucauguuacauaacuccgagcagggagggagagcuuaccgccacgccauggaggagcugccggacacgaucgagacucucaugcugcuagcucuaaucgccguccugaccggcggggucacccucuucuucuuaagcggucgugggcucggcaagacgucuaucggucugcucugcguaauggccagcuccgucuuacuguggauggcaucgguagagccucacuggauagccgcguccauaauccucgaguucuuccugauggugcuguugauccccgaacccgaccgccagcggacgccgcaggacaaccagcuggccuacguggucaucggguuacucuucaugauccuuacuguggccgcgaacgagaugggccugcuagaaaccaccaaaaaggacuuagggaucggacauguggccguggagaaucaccaucacgccgcaaugcuggacguggaccuccaccccgccagcgcguggacgcuguacgcgguggccaccaccaucaucaccccuaugaugcggcauacgauugaaaauaccaccgcgaacauaucccugaccgcaaucgcgaaccaggcagcuauccucauggggcuggacaaggguuggccgaucucaaagauggacaucggugugccccugcucgccuugggcugcuacucgcaagugaaucccuugacgcucacagcggccgugcugaugcuggucgcucacuaugcaauuaucgggccugggcuccaggccaaggcgacccgggaggcccagaagcggacggccgccggcaucaugaagaauccgacaguggauggaauaguggccaucgaccuggaccccgucguauacgacgcgaaauucgagaagcaguugggccagauaaugcuccugauccuuugcacuucgcaaauccucuugaugcgcaccaccugggcccugugcgagucuauaacgcucgccacugggccccuaaccacccugugggaaggcucacccgggaaguucuggaauacgaccauagcggugagcauggcgaauaucuuccguggguccuacuuggccggugccggccuggccuucagccugaugaaaucacugggaggcgggcgccgggguacgggggcccaaggcgaaacacuuggcgaaaaguggaaacgccaguugaaccagcucagcaaguccgaguuuaacacauauaagcggagcgggauaauggaggucgacagguccgaggcgaaggaggguuugaaacgcggggagaccacuaaacacgccgugucacgcggcaccgcuaagcugcguugguucguggagcgcaacuuggucaaaccggaggggaaggugauugaucugggcuguggccgcgguggcugguccuauuauugugccggucugaagaaagucacggagguaaagggguauacaaaaggcggucccggccacgaggaaccaauccccauggccaccuacggguggaaccugguuaaacuacacagcggcaaggacguguucuuuguaccgcccgagaaaugcgacacccugcugugcgacaucggggaauccucgccaaacccaacgaucgaagaaggacgcaccuugagaguccugaagaugguggagccguggcugcgcgggaaccaguucugcaucaaaaucuuaaaucccuacaugccauccgucguugagacccuggagcaaaugcagagaaaacacggcgguaugcugguccggaacccccucucgcgcaacucgacucacgagauguacugggucucaugugggacaggcaacaucguguccgcggugaacaugaccucgcgcaugcugcugaaucgguucaccauggcccaccguaagccgacauacgagcgcgacguagaccucggggcggguacccggcauguggccguggaacccgaggucgccaaucuggacaucaucggccagcgcaucgagaacaucaagcaugagcacaaguccacguggcacuacgacgaggacaaccccuacaagaccugggcguaccacgggagcuacgaagugaagccaucgggcuccgcuagcagcauggugaacggggucgucaagcuguuaaccaagccgugggacgucauacccaugguaacccagaucgcaaugaccgacacuacucccuucgggcagcagcggguguucaaagagaaggucgacacgcgcacgccuaaggccaagcgcggcaccgcacaaaucauggaggugaccgccaaguggcuauggggcuuccugagucgcaacaaaaagccacggaucugcacccgcgaggaguuuacgcggaaggugcguuccaacgccgccaucggcgcgguguuuguggaugaaaaucaguggaacagcgcgaaagaggccgucgaggaugagcgguucugggaccugguccaucgugagcgggagcugcacaaacaggggaagugcgcgacaugcgucuacaacaugaugggcaagcgagagaagaagcugggggaguuuggaaaggccaaggggucgcgggcuauaugguacauguggcugggcgcucgguuccuagaguucgaggcacuugguuucaugaacgaggaccacugguucucacgggagaacagccucagugggguggaaggcgagggacuacauaaacuuggcuacauccuccgugacauuucuaaaaucagcgggggcaacauguaugcagacgacaccgccggaugggauacccggaucacagaggacgauuuacagaaugaggcgaagauaacagacauuauggagcccgagcacgcucugcucgcuaauucaaucuucaaacucacuuaucagaacaaaguagugagaguucagcgcccagcaaagaacgggaccgucauggacgugaucagccguagggaccaacggggcuccggccaggugggcacguacggccugaacaccuuuaccaauauggaggcacaguuaaucagacaaauggaaagcgaagggaucuucuccccgucugagcucgagacccccaaccuugccgagcggguccuggacuggcuggaaaaacacggcguggagcgauugaagcgcauggccaucagcggggacgacuguguagugaagcccaucgacgaccgcuuugccacggccuuaaccgcccuaaaugacaugggcaaggugcgcaaggacaucccccaaugggagccgucgaagggguggaacgauuggcagcaggucccauucugcucccaccauuuccaucaguuaaucaugaaagacggccgcgagaucguugugcccugccggaaccaggacgagcuggucggaagggcccgcgucucccagggggccggcuggucuuuacgggagaccgccugccuagggaagucguacgcgcaaauguggcagcucauguauuuccacagacgcgaccugcgacuggccgcgaaugccaucugcagcgccgugccgguggacuggguccccacaagucgcacuaccuggagcauccacgcgcaccaucaguggaugacgacugaggauaugcucagcguguggaacagaguguggaucgaggagaacccguggauggaggacaagacgcacauuuccuccugggaggacgugcccuaccuaggcaaacgagaggaccaguggugcgggagccuuaucggucucaccgcgcgggccaccugggccaccaacauucagguggccaucaaccaggugcgccgccugaucggcaaugaaaauuaucuggacuacaugacgucuaugaaacgcuuuaagaacgaaagcgaccccgagggggcccucugguaa

SEQ ID NO: 23846 - RNA, 9879 nt, Artificial Sequence
  derived and/or modified CDS sequence (opt11) from DENV-1__HM488255__SS-prME
agugucaccaugcuucugauguuaaugcccacugcccucgcguuccaucugacuacacgaggaggugaaccucacaugaucgucucgaaacaagaaaggggaaagagccugcucuuuaagacaagcgccggagucaauaugugcacgcuuaucgcaauggaccugggugaacugugcgaggacacuaugacguacaagugucccaggauaacagaagccgagccggacgaugucgauugcuggugcaacgcuacagacacuugggucacguacgguacaugcucgcaaacaggugaacaccgccgcgauaagaggagcgucgcccuggcaccccacguaggucuuggccuagagacacgaacagagacauggaugucaucagaguccgcauggaaacaaauacaacgagucgagacuugggcccuacgccacccaggauuuacggucauagccuuguuccuugcacacgcuaucggcaccucuauuacacaaaagggaaucauauuuaucuugcugaugcucguaacaccuagcauggcuaugaggugcgucggaauaggaucacgagacuucgucgagggacugagcggagcaacuugggucgacguaguucucgaacaugggucaugcguaacaacaauggcaaaggacaaacccacauuagacaucgaacugcuaaagaccgaagugacaaauccagccauacuacggaaacucuguaucgaggcgaagaucucgaacaccaccacagacagccgcuguccaacccaaggcgaggcaacccuaguagaggaacaagacgcgaacuuuguauguagaagaaccuucgucgaucgcggauggggaaacggaugcggccuguucggcaaaggcagccuuauuacgugcgcaaaauuuaagugcgucacaaaacucgaaggaaagauuguucaauacgaaaaccucaaauacuccguaauaguaacgguccacaccggggaccagcaucaaguaggcaacgagagcacugaacacggaacaacggccacaauaacgccacaggcacccacaacagaaauacaauugacagauuacggagcccuaacgcucgacugcagcccccgcacuggccuggacuuuaaugaaaugguacugcuaacaaugaaagaaaagagcuggcugguucauaagcaaugguuccucgaccuaccacuacccuggacuuccggugcaagcacaucgcaagagacauggaacaggcaagaccugcuagucaccuuuaaaacggcacacgccaaaaagcaagaagugguggugcucggcucacaggaaggcgcuaugcauacagcgcugacaggagcgaccgaaauacagacaagcgggacaacgacaauauuugcaggacaccuaaagugccgguugaaaauggauaagcucacacucaaggggaugagcuauguuaugugcacgggcagcuuuaaguuagagaaagaaguugccgaaacucaacacggaaccguuuugguccaaaucaaguacgaagguaccgaugccccuugcaaaauacccuucagcacucaagacgagaagggggucacucagaacgggaggcuaaucacggcgaaccccaucguaacagacaaggagaaacccgucaauauagaagcagaacccccguuuggcgagagcuacaucgucauaggagcuggcgaaaaggcccugaaacucaguugguucaagaagggcuccagcaucggcaagauguuugaagcaaccgcaagaggggcccgaaggauggcaauccuaggcgacaccgcgugggacuucggcagcaucggaggcguauucaccuccgucgggaaacucguacaucagaucuuuggaaccgccuauggaguucucuucaguggcguaagcuggacaaugaagauaggaaucgguguauuauugacauggcucggccugaacagccguagcacgagcuugaguaugaccugcaucgcuguaggcuuagucacgcuguacuuagggguaaugguacaggcggacucggguugcguuauaaauuggaaaggaagagaacucaaaugcggaagugggaucuucgugaccaaugaaguacacacguggacggagcaauacaaguuccaagcagauucaccaaagcgucucuccgccgcaauaggaaaggccugggaggaaggcgugugcggcauacguuccgcaacccgauuggagaacauaauguggaaacagauaucgaacgagcucaaccacauauuacuggagaacgacaugaaguuuacuguagucguuggcgacgucgcggggauauuagcucaaggcaagaaaaugauccgcccacaaccaauggaguauaaauacaguuggaaaaguugggggaaggcgaaaaucaucggcgcggauguacagaacacgaccuucauaauagauggcccgaauaccccagaguguccggacgaccagcgggccuggaacauaugggaaguugaggacuacggauucggcaucuucaccaccaacaucuggcucaaacuuagagacuccuauacucaaguaugcgaccacaggcuaaugucggcagccauaaaagacuccaaagcaguacaugcagauaugggguacuggaucgaaucggaaaagaacgagaccuggaagcuggcucgugccuccuucauugaagucaaaacauguaucuggccaaaaucacacacacuguggaguaacggcguacuagaaagcgaaaugauaaucccaaaaauauauggcggccccauaagccagcacaacuacagaccaggguauuucacccagacugcuggcccauggcauuugggaaagcucgagcuggauuucgaccuaugugaaggaacgacugucguagucgaugagcauuguggcaaucgcggaccaucccuacgcacaacaacgguaacagggaaaauuauacaugaguggugcugcagauccuguaccuuaccaccucuuagguuccgcggcgaagaugggugcugguacggcauggaaauaagacccgucaaggaaaaagaagaaaaccuggugaaaagcauggugagcgccggcagcggugagguagacagcuucucccuaggacugcucugcauaagcaucaugauugaagaaguaaugcguucucgguggagccggaagaugcuaaugacagguacacucgcugucuucuugcuacuaauaauggggcaguugacguggaacgacuugauucggcuaugcaucauggugggagccaacgcaagcgacaggaugggaaugggaacgaccuaccucgcacucauggcaacguucaaaaugaggcccauguucgcaguaggccuacucuucaggcgacugacuucccgggaaguccuacuacugaccaucggccuaucucugguugcuaguguggaacucccgaacucccuagaggaauugggcgauggacuagcuaugggcauaaugauacucaaauuacuaaccgacuuccaaagucaccaacuaugggcaacccuccuaagccucaccuucauaaagacgacguucagccuacauuacgcguggaaaaccauggcaaugguccucucgauugucagccuuuuuccacucugcuugucaacgacaagccagaaaacaacauggcugccgguccuacucggcagccucggaugcaagccccugacaauguuccuaauagccgagaacaaaauaugggggagaagaagcuggccucugaaugaaggcauaauggcggucgguaucgugagcauacuacucaguucccuauugaaaaacgacguacccuuagcagggccgcucauagcaggaggcaugcucaucgcaugcuacguaaucucggguaguagcgccgaucugucucuggaaaaagcagcagaagucaguugggaagaagaggcagaacacucuggugccucucacaacauacuggucgaggugcaagacgauggcacaaugaaaauaaaagacgaagaacgcgacgauaccuuaacaauacucuugaaggcgacacuucuagcaguaagcggggucuacccacucucuauacccgccacgcuguucguuugguauuuuuggcagaaaaagaagcagagaagcgggguccugugggacacaccuaguccacccgaaguugagcgggcaguacucgacgacggcauauaucgaauaaugcagcguggauuacuuggccgcucacagguuggggucggaguguuccaagaaaauguauuucacaccauguggcacgucacaagaggugccguacugauguaccaaggaaagcgguuggaaccaaguugggccuccguuaagaaggaucucauaucauacgguggcggguggaggcuccaggggagcuggaacacgggugaggaagugcaagucaucgcgguagagccagguaaaaacccuaaaaauguccagacggcacccgguacguucaagacuccugaaggcgaaguaggugcgauagcccuugacuucaagcccgguaccagcggaaguccaauagugaaccgggaaggaaaaauuguuggacuauacgggaacggaguggucacgacaagcgggacguacgucuccgcgauugcacaagcgaaagcaucacaggaagggccccugcccgaaauugaagacgagguauuucgaaaacgcaaccucacuauaauggaccuccauccgggcucuggcaagacgcggcgauaccucccagcaaucgucagggaggccauaaagagaaaauugcguacgcuaauucuagccccaaccaggguaguagcgucagaaauggcggaagcccuaaaaggaaugccgauacgauaccaaacaacggcagugaaaucagaacacaccggcaaggagauagucgaccuaaugugccacgcgacguucacuaugcgacuccuaucgccagugagggucccuaacuacaacaugauaauaauggacgaggcucacuucacugauccuucaucgauagcugcuagaggcuacauuuccacucgaguaggaaugggcgaagccgcugccauuuuuaugaccgccacacccccgggaucaguggaagcguucccacagagcaacgcggugauacaagaugaggaacgagacauaccagaaaggucauggaacagcgguuaugaguggauaacugacuuucccgggaaaacagugugguucguacccagcauaaaaucaggaaacgacauagcaaacugcuuacgcaagaacggaaagcgcgucauucaacuaagccggaaaaccuucgacaccgaauaccagaaaacgaagaacaacgacugggacuacgucgugaccacggauaucucugaaaugggugcuaacuuucgagccgauagggugauagacccacggcguuguuugaagcccguaauucucaaggacggcccagaacgcguaauacuagcagggcccaugccggucacaguagccagcgcagcccagcgacggggccgaaucgggcgcaaccauaacaaggaaggcgaucaguacaucuacaugggacagccccuaaacaacgaugaagaccaugcccauuggaccgaggccaaaaugcugcucgacaacauaaacaccccagaagggauaauaccagcccuauuugaacccgagcgcgagaaaagcgcagccauagacggcgaauaccgacuccgcggggaggcacgaaaaacauucgucgaauugaugcgcagaggggaucuaccagucuggcuaagcuauaaagucgcaagcgaaggcuuccaauacagcgaccgccgcugguguuucgacggagaacggaacaaccagguauuagaagaaaauauggacgucgagaucuggacgaaggaaggcgagcgcaagaaauugagaccccgguggcuggacgccagaacuuacuccgacccacuagcguuaagagaguucaaagaauuugccgcagguagaaggaguguaaguggcgaccucauacuagaaauagggaaacucccucagcacuugacgcagagagcacagaaugcacuggacaaccugguaaugcuccacaacucagaacaagggggacgcgcguauaggcaugcuauggaagaacuuccagacacaaucgaaacucucaugcugcucgcucuuauagcgguucucaccgguggcgugacacucuucuuucucagugggaggggguuagguaagacaaguaucggauugcucugcguaauggcaucaagcgugcugcuuuggauggcguccguugagccacacuggaucgccgccuccaucaucuuggaguucuuucugaugguccuacugauaccggagcccgaccgucagcggacgccccaagacaaccaacucgcguacguagucauuggucugcuauucaugauccuuacgguagcggcuaacgaaauggggcuacucgaaacaaccaagaaagaccuuggaauaggacacgucgcgguagggaaccaccaccacgcugcgaugcuggacguggauuuacacccagccagcgcauggacgcucuacgcagucgcgacgacaauuaucacgccaaugaugcggcacacuauagagaacacgacagcgaacaucucuuuaaccgcaaucgcaaaucaagcagcuaucuuaaugggacucgacaaaggauggccuaucucgaaaauggacaucggcguuccccugcuggcccuaggaugcuacagccaagucaauccccucacacuaaccgccgccguacuaauguuagucgcgcauuacgcgauuauaggccccggccugcaggccaaggcaacccgugaagcgcagaagcguaccgcugcgggcaucaugaagaauccaacgguugaugggauagucgcaaucgaucuggauccagucgucuacgacgcaaaguucgaaaaacaacucggacaaaucaugcucuuaauacugugcaccagccaaauacugcuuaugcgcacgacgugggcacucugugaaaguauaacgcuagcgaccggaccccugacaacgcuuugggaaggaucaccagguaaauuuuggaacacaacgaucgcgguguccauggcgaauauuuuccgcggcagcuaccuggcuggagcgggauuggccuucucacuuaugaaaucacuaggaagaggaagaagaggaacgggagcgcaaggagaaacucucggagaaaaauggaagcgacaacucaaucagcucaguaagagugaauuuaacaccuacaagcgaagcggcaucauggaggucgacagaagugaagcgaaagaaggucuuaaacgaggcgagacaacuaagcaugcuguuagccgaggaacagcaaaacuccgaugguucgucgaacgaaaccuagucaaaccggaggggaaaguaauagaccuagguugugggcggggcggguggucauauuauugcgcaggccucaaaaagguaacagaagucaagggguacacaaagggaggcccaggucacgaagaaccgauaccgauggcaacguacggcuggaaccuagucaaacugcacucagggaaagacguuuucuucauucccccagaaaaaugugacacucugcugugugacauaggggaguccuccccaaaccccacaauagaggaagggcggacucuucgaguacuaaagaugguagagcccugguugcgcgguaaccaauucugcauaaagauccuuaaucccuacaugccaagcguaguagagacgcuggagcaaaugcaacgaaagcacggaggcaugcugguccgcaacccccucucgaggaauagcacacacgaaauguacugggucucuugcggaacuggaaacauaguauccgcggucaacaugacgucuaggaugcuacugaauagguucacaauggcucacaggaaacccaccuacgaaagggauguggaccuuggggcagggaccaggcauguugcagucgaaccagagguagcaaaucucgauauaauaggccaacguauagagaauauuaagcacgagcauaagucgacguggcacuaugacgaggacaauccguacaaaaccugggccuaccauggcagcuacgaagugaagcccagcggaagcgccucaagcauggugaacggcgucgugaaacuguugaccaaaccgugggacgugauacccauggugacccaaauugcaaugacagauaccacaccauucggccagcaacgaguauucaaagagaagguggauacgagaacaccgaaggccaaacgcggaacagcccagaucauggaaguuacagccaagugguuguggggcuuccuaucaagaaacaagaaaccgcggauuugcacgcgggaggaguucacccgcaaggugagaaguaacgcagccaucggcgcagucuucguggacgagaaccaauggaacuccgcgaaggaggcaguggaggacgagagauuuugggaccucgugcauagagaacgagaacuccauaagcaaggaaagugugccacaugcgucuacaauaugaugggaaaaagagaaaagaaacucggggaguucggcaaggcaaagggcagccgggccauaugguauauguggcugggugccagguuucuagaguucgaggcgcucggcuucaugaacgaagaucacugguucucacgggagaacagccuaucuggcguagaaggugaaggccuccacaagcucggauacauccuaagggacauauccaaaaucccgggcgggaacauguaugccgacgacacggcuggaugggacacccgcauaacagaggacgaucugcaaaacgaagcucgcauaaccgacauaauggagccugaacacgcgcuacuagcgaagucaauauuuaaacuaaccuaccaaaacaagguaguacguguacaaagaccagcgaaaaacgggacaguaauggacgucauuucccgacgcgaccagagaggaaguggccaagucgggacguacggccucaauacguucacgaauauggaagcacaauuaauacggcagauggagagugaaggaauauucagcccgagugaacuggagacacccaaucuugccgagcggguauuggauuggcuggaaaaguacgggguggagcggcuaaaaagaauggcaauuagcggagacgauugcguuguaaagcccaucgacgaccgauucgccacagcucugaccgcguuaaaugauaugggaaaagugcguaaagacauuccucaaugggagcccucgaaaggguggaacgacuggcaacagguaccauucugcagccaccacuuucaccagcucaucaugaaggacgggagggaaaucguagucccgugccggaaccaggacgaauuagucggccgggcccgaguaagucaaggggccgguuggucacuccgagaaacagccuguuugggaaagagcuaugcgcaaauguggcagcuaauguacuuucaccgaagagaccuacgcuuagcagcgaacgccaucugcagcgcagugccaguagacuggaucccaacaucaagaaccacauggagcauucacgcgcaccaccaguggaugacaaccgaagacaugcuaucuguguggaaccgcguauggaucgaagagaauccuuggauggaagacaaaacccacauauccagcuggggagaugugcccuacuuaggcaaacgagaggaucaaugguguggaagucucauaggacugaccgcaagagccaccugggccacaaauauacagguugcaaucaaccaggugaggagauugaucgggaacgagaacuacuuggacuacaugaccagcaugaaaagguuuaagaacgaauccgaucccgaaggggcucuaugguag

SEQ ID NO: 23847 - RNA, 9879 nt, Artificial Sequence
  derived and/or modified CDS sequence (opt11) from DENV-1__HM181944__SS-prME
agcgugaccaugcugcucaugcugaugccgacugccuuagccuuccaccucaccacccgggggggggagccccacaugaucgugagcaaacaggagcgggguaagagccugcuguucaaaaccuccgccggcgugaacaugugcaccuuaaucgccauggaccugggcgaacuaugcgaggauaccaugaccuacaagugccccaggauuagcgaggccgagccagacgacguggacugcuggugcaacgcaaccgauaccugggugacguacgggaccugcucccaaaccggggaacaccggcgcgauaaacggagcguggcccucgcgccccacgucggccugggauuagaaacccggacggagacauggauguccucagagggcgccuggaaacagauccagcgcguugagaccugggcccuccgccaccccggguuuaccguuaucgcccuguuccuagcccacgccaucgguacuuccaucacccagaaggggaucaucuucauccuucugauguuagugaccccgagcauggccaugcggugcgucggcaucggcucccgcgauuucguugagggucucagcggcgcgaccuggguggacguugugcuagagcacggguccugcgugacuaccauggccaaggacaaaccuacccuggacaucgagcuccugaaaaccgaggucacgaaccccgcggugcuuaggaagcucugcaucgaggcgaaaaucagcaacaccaccaccgacucgcgcuguccgacgcagggcgaggccacccugguggaggagcaggacgcaaacuucgucugccggcgcacauucguggaucggggcugggguaacggcugcggucuauucggcaaagggagccucaucacgugcgccaaguucaagugcgugaccaagcuggaggggaagaucguccaguacgagaaucugaaguacuccguaaucgugacuguccauaccggagaucaacaccagguggggaaugaaagcaccgagcacggcacgacugcaaccaucacgccccaagcuccauccacugagauccaguugacggacuacggggcgcugacacuggauugcucgccccgcaccggccucgacuucaacgagaugguuuuguuaacaaugaaggagaaguccuggcuggugcacaaacagugguuccuagaccuaccguugcccuggacguccggggccaguacuucccaggagacauggaaccggcaggaccuacuggugaccuucaagacagcccacgcgaagaaacaggaggucguagugcuuggcucacaggagggcgccaugcacaccgcccuuaccggggccaccgaaauccaaacuuccggcaccacaaccauauucgccgggcaucugaagugccgacucaagauggacaaguuaacccugaagggcaugucuuacgucaugugcaccgggucauucaaacucgagaaggagguugcggagacccagcacggcaccgugcugguccagaucaaguacgagggaacggaugccccguguaaaauccccuucucaacccaggacgagaaggggguaacccagaacggcagacuaaucaccgccaacccgaucgugacggacaaggagaagcccgucaacaucgaggccgaaccacccuuuggggaguccuauaucguuaucggagcgggcgagaaggcccugaagcucucuugguucaaaaagggguccagcaucgggaagauguucgaggcaaccgcccgcggagcccggcgcauggcuauccuuggugauacggcaugggacuucggguccaucggcggaguguucaccagcgucgguaagcugguucaccagaucuuuggcacggcauacggggugcuguucuccggcgucagcuggaccaugaagaucgggauuggugugcugcugaccuggcucggccugaacucccgcucaaccuccuugagcaugacguguaucgccguggggcucgucacacuguaccugggcgugauggugcaggcggacagcgggugugugaucaacuggaagggccgagagcucaaaugugguuccggcauuuucgugaccaacgaggugcacaccuggacggagcaguacaaguuucaagcagacucuccgaagcggcuguccgccgccauaggcaaggcgugggaggagggggucugcggcauccggagcgccacacgucuggagaacaucauguggaagcagaucuccaacgagcucaaccauauucuucuggagaaugauaugaaguucaccguggugguuggggacguggcgggcauccucgcccaggguaagaagaugauacgcccccaacccauggaguacaaguauuccuggaaauccuggggcaaggccaaaaucaucggggccgacguacagaacacgacauucaucaucgacgggcccaacacgccggagugccccgacgaccagcgcgccuggaacaucugggaggucgaggauuacggcuucggaaucuucacuaccaacaucuggcucaaguugcgggauagcuacacgcaggugugcgaccaccgccucaugucagccgcaaucaaggauagcaaggccgugcacgccgacaugggcuacuggaucgaguccgagaagaaugagacguggaagcucgcacgggcgagcuuuaucgaagucaaaaccugcaucuggcccaagucccacacgcuguggagcaacggcguccucgaguccgagaugauuauccccaaaauuuacgggggaccuaucagccagcacaacuaccgccccggguauuucacacaaacggccggccccuggcacuugggcaagcuggagcuggacuucgaccuaugcgaaggcaccacuguggucguggacgagcauuguggcaaucgggggccgucgcugcgcaccacaaccgugaccggcaagaucauccaugaguggugcugccggagcugcacccugccgccccuccgcuucaagggggaggacggcugcugguacgggauggagaucaggccaguaaaggagaaggaggaaaacuuagucaagagcaugguguccgccggcagcggcgaggucgacuccuucucccucgggcugcuguguaucuccaucaugaucgaggaggugaugcguucacgguggucccgcaagaugcucaugacgggaaccuuggccgucuucuuccuucucaucauggggcagcugacauggaaugaccugauacggcucugcauaauggucggagcuaacgccagcgaccgcauggggaugggaaugaccuaccuggcccugauggccaccuuuaagaugcgcccuauguucgccgugggccuccucuuccggcgccugaccuccagagaaguguuacuacugaccauugggcuuagccucguggcgucaguggagcuuccgaacagccucgaggagcugggcgacgggcuagcuaugggcaucaugauccugaaguugcugaccgacuuucagucccaccagcucugggcaacacuucuuucccucaccuucaucaagaccaccuucagucugcacuacgccuggaagacgauggcgauggucuugagcauugugaguuuauucccccugugccugucaaccaccucccagaagacgacguggcugcccguucuacuggguagccucgggugcaagccguugacuauguuccuaaucgccgagaacaagaucuggggccgcaagagcuggccccucaacgaagggaucauggccgucggcaucguguccauacugcugagcucccuacugaaaaaugacgugccacuggcugggccacucaucgcaggcggcaugcugaucgcgugcuacguuaucagcgguuccagcgcggaccugucccuugagaaggcagcugagguaagcugggaggaggaggccgagcacagcggggcgucccacaauauccuggucgaaguccaggacgacgggaccaugaagaucaaagacgaggagcgggacgacacccugacgauccuccugaaagccacccugcucgccgugucaggcguauacccgcugagcauccccgccacccuguucgucugguacuucuggcaaaagaaaaaacaacgcuccgggguacucugggacaccccuagcccgccagagguggaacgggccgugcuggaugacggcaucuaccguaucaugcagcgggguuuauuggggcgcucccagguuggcgugggcguauuccaggaaaauguuuuccauaccauguggcaugugacgcggggagccguucucauguaccaggguaagcgccuagaacccagcugggccuccgugaaaaaggaccugaucagcuacggcggcggguggcggcuccaaggguccuggaacaccggggaggaggugcaggucaucgccguagaacccggcaagaaccccaagaacguacagacggcgcccggcaccuucaagacgagcgagggcgaggucggcgccaucgcccucgacuucaagccagguaccuccggcucccccauaguaaaucgggaggggaagauagugggccuauacgguaacgggguuguuaccaccagcggcacguacguguccgccaucgcccaggccaaggccagccaggaagggccccucccggagaucgaggaugaagucuuccggaaacgcaaccugacgaucauggaccugcaccccggcucggggaaaacccggcgcuaucugcccgccaucgugcgggaggcuauuaagcggaagcuucggacccugauccucgcgccgacgagaguggucgcaagcgagauggcugaggcccugaagggcaugccaauucgcuaccaaacuaccgcaguuaagucugagcacaccggcaaggagauuguagaccucaugugccacgcaacuuucaccaugcggcuccugagcccaguccgcguccccaacuacaacaugauaauaauggacgaagcccacuucacagacccguccuccaucgcggcccgaggguacaucuccacccgugugggcaugggcgaggccgccgccaucuucaugacugcgacaccccccggcagcgucgaggccuuuccucaguccaacgccguaauccaagacgaggagcgggacaucccggaacguagcuggaacuccggguacgaguggaucaccgacuuccccggcaagaccgugugguucguucccagcaucaaguccggcaacgauaucgcgaauugccugcggaagaacgggaagagggucauacagcucagccggaagacguucgacaccgaguaccagaagacgaaaaacaacgauugggauuacguggucaccacggacauuuccgagaugggcgcuaacuuccgcgcagaccgggugauagacccucgccggugccugaagccugugauacugaaggauggucccgagcgcgucauauuagcaggccccaugcccguuaccguagccagcgccgcgcaacggcguggacggaucggccggaaucacaacaaggagggcgaccaguacauuuacauggggcaaccgcugaauaacgaugaggaccacgcccauuggaccgaggcaaaaauguugcucgacaacaucaauaccccggagggaaucauccccgcccuguucgagcccgagcgagaaaaguccgccgcgaucgacggggaguaccgccugcgcggcgaggcgcggaagaccuucguggagcucaugcgccgcggggaccuaccaguguggcuguccuacaaggucgccagcgagggcuuccaguacucggaccgccgguggugcuucgacggcgagcgcaacaaucaagugcucgaggaaaacauggacguggagaucuggacuaaagagggggagcggaagaagcugcgcccgcgguggcuggacgcccguacguacagcgacccucucgcccugcgggaguucaaggaauuugcggccggccggcgaucagucuccggggaccuuaucuuagagaucggcaaacucccccagcaccuuacgcagcgcgcucagaacgcccuugacaaccuggugaugcugcacaacuccgagcaaggcggucgggcuuaccgccacgccauggaggagcuaccggauaccaucgagacccugaugcugcucgcccugaucgcugugcugacaggggggguaacgcuuuucuucuugaguggccgggggcuggggaagacguccaucggccuccugugcgugauggcaagcagcgugcugcuguggauggccagcgucgagccccacuggaucgccgccucgaucauccuggaguucuuccuuauggugcuccuaaucccagagcccgaucgucagcggaccccgcaggacaaccaguuggcguacgugguaaucggucuccuguucaugauucugacuguggccgcgaacgagaugggccuccucgagaccacaaagaaagaccuggggauaggccauguggcuguagagaaccaccaucacgccgcaaugcuagauguggaccugcaccccgcuagcgcguggacgcuguacgcaguggccaccaccaucaucaccccuaugaugaggcacaccauugagaacaccaccgcgaacaucucccucacugccaucgcgaaccaggcggccauccugaugggguuagauaaggguuggccgauaaguaagauggauaucggcgucccccuccuggcccugggaugcuacucccaagugaacccacucacccucaccgcggccgugcugaugcucgucgcccacuacgccaucaucggccccggguugcaagccaaggccacccgggaggcucagaagcguaccgcagcgggcaucaugaagaacccgacgguggacgguaucguggccaucgaucuggacccuguuguuuacgacgcuaaguuugagaagcagcucggccagauuaugcuccugauuuugugcaccagccagauccuucuaaugcggaccacuugggcccucugcgaauccaucacgcuggcaacuggcccgcugacuacccucugggaggggagucccggaaaauucuggaacacuaccaucgccgugucuauggccaacaucuuccggggauccuaccuggcgggcgcaggccucgccuucagccucaugaagucccucgggggggggcggagggggaccggggcccagggagagacccuaggcgaaaaguggaaacgccagcucaaccagcuaucgaaguccgaguucaacacauauaaacguagcgggaucauggaggucgaucgcuccgaagccaaggagggccugaagcgcggggaaacgacuaagcaugccgugucacgaggcaccgccaagcuccggugguuuguggagaggaaccuggucaagccggaggggaaggugaucgaucugggcugcggccgcggcggguggucuuacuauugcgccgggcugaagaagguuacggaaguuaaaggguacaccaagggcggccccggucacgaggagcccauccccauggcuaccuacggguggaaucucguuaagcugcacucaggcaaggacguauuuuucguucccccagaaaaaugugacaccuuacuuugugauaucggcgagucaagccccaaucccacaaucgaggaaggucguacccuacgaguccugaagaugguggagccguggcugcgcggcaaccaguucugcauaaagauccugaacccguacaugcccaguguuguggagacccuggagcagaugcaacgcaagcacggcggcaugcucgugcgcaacccacugagccggaacuccacccacgagauguacugggucagcugcggcacgggcaauaucguguccgccgugaacaugaccagucgcauguugcucaaucgguucaccauggcccaccgaaaaccgaccuacgagagagacguggaccugggggccggcacccggcacguggcuguugagccugaggucgccaacuuggacaucaucggccagcgcauagagaacauuaagcacgaacacaaguccacauggcacuacgaugaggacaaccccuacaagaccugggcuuaucacggaucguacgaagugaagcccucaggcucugcgaguuccauggucaacgggguggugaagcuccuuaccaaaccgugggacgucauccccauggugacccaaaucgccaugacggacacuacccccuucggccagcagaggguguucaaggagaagguagacacucgcaccccaaaggccaagagagggaccgcacagaucauggaggugacggccaaguggcuauggggcuuccuuagccgcaacaagaagccgcguauuugcacccgggaggaguucacgcggaaaguacgcuccaacgccgccaucggcgccgucuuuguggacgagaaccaguggaacucagcgaaggaggccguggaggacgagcgguucugggaccugguccaccgcgagcgggagcugcacaagcaagggaaaugcgcgaccugcguguacaacaugaugggaaagcgcgagaaaaagcugggugaguucgggaaggccaaggggucccgggccaucugguacauguggcugggcgcacgcuuucuggaguuugaggcucucggcuucaugaacgaggaccacugguucagccgggaaaacucgcugagcggaguagaaggggaagggcugcacaagcucgguuacauucugagagacaucuccaagaucagcgggggcaauauguacgccgacgacaccgcuggcugggauacccggauuacugaggaugaccugcagaacgaggccaagauaaccgacaucauggaacccgagcacgcgcuucuggccaacuccauauuuaagcugaccuaccagaacaaggucgugagagugcagcggcccgccaagaacgggaccgucauggaugugaucaguagacgcgaucagcgcggguccggccaagucgguacauacggcuuaaacaccuucaccaacauggaggcccagcugauucgccagauggagagcgaggggaucuuuuccccguccgagcuggagacccccaaccucgcugagcggguccuggacuggcuggagaagcauggcguggagcgccucaagcggauggcgaucagcggggaugacugcguugucaaacccaucgacgaucgcuucgcaacggcucugaccgcccugaacgacauggguaaggugcgaaaggacaucccccagugggaaccguccaagggguggaacgacuggcagcagguccccuucugcagccaccauuuccaucaguugauaaugaaggacggcagggagauagugguacccugucggaaccaggaugagcuggugggacgcgcccgggucucccagggugccggcuggagcuuaagggagaccgccugccuggggaagaguuacgcgcagauguggcagcugauguacuuccaccggcgugacuuacggcucgccgcgaaugccaucugcagcgccgugcccguggacugggucccgaccuccaggacgacguggucgauccacgcccaccaccaguggaugaccacagaggacauguuaucaguguggaaucggguguggaucgaagagaaucccuggauggaagacaagacacacaucaguuccugggaggacguccccuaccuggggaagcgggaggaccaguggugcgggucccucaucggccugaccgcccgagcgaccugggccaccaacauccagguggccaucaaccaggugcgccgucuuaucggaaaugagaacuaccuagacuacaugacgucaaugaagcgguucaagaacgaaagcgaccccgagggagcccugugguag

SEQ ID NO: 23848 - RNA, 9879 nt, Artificial Sequence
  derived and/or modified CDS sequence (opt11) from DENV-1__HM181946__SS-prME
agcgugacuauguugcuuaugcugaugcccaccgcccuggcauuccaccucaccacccgcggcggggagccucauaugaucgugagcaagcaggagcgcggcaagagccugcuguuuaagaccuccgccggggugaacaugugcacccucauugccauggaccugggcgaacugugugaggauaccaugaccuacaaaugcccccgcauaaccgaggccgagcccgacgacguggacugcuggugcaacgccaccgacacgugggucacuuaugggaccugcagccagacaggcgagcaccggcgcgacaagcgauccguggcgcucgcuccccacgugggguuaggguuagagacgcgcaccgagaccuggaugagcuccgagggcgcguggaagcagauacagcggguggagaccugggcccucaggcaccccggguucacggugaucgcccuguucuuggcgcaugccaucggcaccagcaucacacagaaggggauaaucuucauccuccugauguuggugacccccuccauggccaugcggugcgucggcaucggcagccgugacuucguggaagggcucuccggcgccacguggguggacgucgugcuugagcacgggagcugugugaccaccauggccaaggacaagcccacccucgacaucgagcuccugaagacggaggucaccaaccccgcgauccugcgaaagcucugcauugaggccaagaucuccaacaccacaaccgacagucgcugccccacccagggcgaggccacccugguggaggaacaggacgccaauuucgugugccggcgcaccuuugucgaccggggcugggggaacggcugcgggcuguucggcaaggggagucucaucacgugcgccaaguucaagugcgugaccaagcuggagggcaagaucguucaguacgaaaaccugaaguacagcgucaucgugaccgugcacaccggcgaccaacaccaggucgggaacgaauccacggagcacggaaccaccgcgaccaucacgccccaagcccccacgaccgagauccagcucaccgacuacggggcccugacccuggacugcagcccccgcacgggguuggacuucaaugagauggugcuucugaccaugaaggagaaauccugguuaguccauaagcagugguucuuagaccugccguugcccuggaccagcggggccagcacaucacaggagacguggaacaggcaggacuugcuggucaccuucaagaccgcccacgcuaaaaagcaggaggugguuguccucggcagccaagagggcgccaugcacaccgcgcugacgggggccaccgagauccagacuuccggcaccacgacgaucuucgccgggcaucugaaaugccgccucaaaauggacaagcugacccugaaggggaugagcuacgucaugugcaccggcucuuucaagcucgagaaggaagucgcggagacgcagcacggcaccgugcugguucagauucguuacgagggcaccgacgcccccugcaagaucccuuucagcacccaggacgagcgcggggucacucagaacggccggcugaucacagccaacccgaucgucaccgauaaggagaagcccgugaacaucgaggccgagccgcccuucggggaguccuacauagucauuggcgcgggcgagaaggcuuugaagcucucaugguucaagaaaggguccagcaucggcaagauguucgaggcuacggcccgaggggcccgccggauggcgauccugggcgacacggccugggacuucggguccaucggcggcguguucaccagcguagggaagcugguucaccaaauauucggcaccgcuuacgggguccucuucucaggcgugagcuggaccaugaagauagggauaggcguccugcugacgugguuaggccucaacucccgcucaacguccuucaguaugaccugcaucgccgugggccuuguaacccucuaccucggcguuauggugcaggccgacagugggugcgugauaaacuggaagggccgagagcugaaaugcgggaguggcaucuucgucacgaacgaaguccauaccuggaccgagcaguauaaguuccaggcggacagcccgaagcgccucucugccgccaucggcaaggccugggaggagggggugugcggcauccggagcgcuacacgccuggagaauaucauguggaagcagaucucuaacgagcugaaccacauccuccuggagaaugacaugaaguucaccgucguggugggggacgucgcuggcauccuggcccaggggaagaagaugaucaggccccagcccauggaguacaaguacucguggcgcuccuggggcaaggccaagaucaucggggcagacgugcagaauacgacauuuaucaucgacgggcccaauaccccggagugcccggacgaccagcgggcguggaacaucugggagguggaggacuauggcuucgggaucuuuacaacgaacaucuggcucaagcugcgcgacagcuacacccaggucugcgaccaccgguugaugagcgccgccauaaaggacagcaaggccgugcacgccgacaugggcuacuggaucgaauccgagaagaacgagaccuggaagcucgcgcgcgccagcuucaucgaggugaaaaccuguaucuggcccaagucucacacgcuguggagcaacgguguacuggaguccgagaugauaauccccaagaucuacgggggcccgaucucccagcacaacuaccggccgggguauuucacccagaccgccggccccuggcaccucgggaaauuagagcuggacuucgaccucugcgagggaaccacggucguggucgaugagcacugcggcaacagagggccgucccugagaacaaccaccgugacgggcaagaucauccacgaguggugcugccgcagcugcacccugcccccucuccgguuccgcggggaggacggcugcugguacgggauggaaauccggcccgugaaggagaaggaggagaaucuggucaaguccauggugagcgccggcucgggcgagguggacuccuucucucugggguugcugugcaucucgauaaugauagaagaggucaugcgcucacgcuggucccggaagaugcugaugaccggcacacucgccguguuccugcugcucaucauggggcagcugacguggaacgaccucauccgccucuguaucauggugggcgccaacgccagcgacaggauggggaugggcaccacguaccuugcccugauggccaccuucaagaugcgaccuauguucgccgucgggcuccuguuccggcgucugacgucccgggaggugcuccugcugacuaucgggcucagucugguggcguccgucgaguugcccaacagcuuggaggaguuaggugacgggcuggcgaugggcaucaugauccugaagcuguuaaccgacuuccagucccaucagcucugggccacccugcugagccuuacguucaucaagaccaccuucucccugcacuacgccuggaagaccauggcgaugguacugagcauagucucccucuuuccccugugccugagcacaaccucccagaagaccaccuggcuccccgugcugcugggcagccucgggugcaagccgcugacgauguuccugaucgccgagaacaagaucuggggcagacgguccuggccccuaaaugaggguaucauggccgugggcaucgucagcaucuugcugagcucccuccugaagaacgaugugccccuggccgggccccucauugcgggcggcaugcugaucgcgugcuaugugaucucaggguccagcgccgaccugucccuugagaaggccgccgaggucagcugggaggaggaggccgaacacaguggcgcgagccacaacauacuagucgaagugcaggacgacgggaccaugaagaucaaggaugaggagagggacgacacacugaccauccuccuaaaggccacccugcuagccguauccggcguguacccgcugagcauccccgccacccuguucgugugguauuucuggcagaagaaaaagcagcgguccgggguccucugggacacuccgagcccgccggagguggaaagagccgugcuggacgauggcaucuaccggauuaugcagcgcggccugcugggucggucccaggucggcguggggguguuccaggagaacguuuuccauacgauguggcacgucacucgaggcgcugugcucauguaccagggcaagcggcuggagcccaguugggccagugucaagaaggacuuaaucagcuacgguggcggguggcgacuccagggcuccuggaacacgggagaggagguccaggugaucgccgucgagcccggcaagaaccccaagaacgugcagaccgcccccgggaccuucaagaccccugaaggcgaggugggcgccaucgcgcuggacuucaagcccgggacgagcggaucccccaucgucaacagggaagggaagauaguaggccuguacggcaacgggguggucaccaccucaggcacguacgugagugccaucgcccaggccaaggcgucacaggaggggccacucccagagaucgaggacgaggucuuccguaagcggaaccugacgauaauggaccugcauccaggcagcgggaagacccgccgcuaccuccccgcaaucguccgggaggccaucaagcgcaagcugcggacccucauccucgcccccacccgcgugguggccagcgagauggcggaagcccugaagggcaugcccauccgguaccaaacgaccgccgucaaaagcgagcacaccgggaaggaaaucguggaccugaugugccaugccaccuucacgaugcgccucuugucccccgugcggguaccgaacuacaacaugaucaucauggacgaggcccacuucaccgacccgagcuccaucgcggccagggguuacauuagcacccgggugggcaugggggaggcagcggccauuuucaugaccgcaacgccuccuggcuccguagaggcguucccgcagagcaaugccgucauccaggacgaggagcgcgauauccccgagcgguccuggaacagcggguacgaguggaucaccgauuucccagguaagacaguuugguucgugcccucuaucaagagcggcaacgacaucgccaacugccugcgcaagaacggcaagcgugucauccagcucucccgcaagaccuucgacacggaguaccagaagaccaagaacaacgacugggauuaugugguuaccaccgacaucagcgagaugggcgcgaacuuccgggccgaccgcgugaucgacccgcggcgcugccugaagcccgugauccugaaggacgggccugagcgggugauccucgccggcccaaugccgguaacgguggcauccgccgcgcagcgccgcgggcggaucggccgcaaccacaacaaagagggcgaccaauacaucuacaugggccagccucuaaacaacgacgaagaucacgcccacuggaccgaggccaagaugcugcucgauaacauuaacacccccgaggggaucauccccgcccuguucgagccagagcgggagaagagcgccgcgauagacggggaguaccgccugcggggcgaggcccgcaagaccuuuguggagcucaugagacgcggggaccugcccguguggcuguccuacaaagucgccagcgaaggcuuccaguacucagacagaagauggugcuucgacggcgagcggaacaaccaggugcucgaggagaacauggacguggagaucuggacgaaggagggagagcgcaagaagcugcggccgagauggcuggacgcccggaccuacuccgacccccuugcccugcgcgaguucaaggaauucgcggcuggccggcgcagcguguccggggacuugauccucgagauuggaaagcugccgcagcacuuaacucaacgggcccagaacgcccucgacaaccuggucauguuacacaacagcgagcagggcgggcgcgcguaccggcacgccauggaggaacuccccgacaccaucgagacgcugaugcugcucgcccugaucgccgugcugaccggcggcgugacccucuucuuccuguccggucgggggcugggcaaaacgaguaucggacuccugugcgucauggccuccagcgugcugcucuggauggcguccguggagccccacuggauagccgccucuauuauccucgaauuuuuccugaugguccucuugauccccgagccugaccgccagaggacgccccaggacaaccagcuggccuacgucgugaucggccuccuguucaugauacugacggucgccgcgaaugagaugggccuccuggagaccacaaagaaggaccuggggaucggccacguggccguggggaaccaccaccacgccgccaugcucgacguugaccugcaccccgccagcgcguggacccuguacgccguggccacgaccaucaucaccccgaugaugcgccacaccaucgagaacaccaccgcgaacaucucgcucaccgcgaucgcgaaucaggccgccauccugaugggccuggacaagggguggcccaucuccaagauggacaucggggugccccuccuggcccucggcugcuacagccaggucaacccccucacacugacggcggccgugcugaugcucguggcucacuacgccaucauugggccggggcugcaggccaaagcgacccgggaagcccagaagcggaccgccgccgggaucaugaagaaccccacuguggacggcaucguggcgaucgaccuggaccccguggucuacgacgcuaaguucgagaagcagcucggccagaucaugcugcuaauccucugcacgucccagauccugcugaugcggaccaccugggcucuuugcgagagcaucaccuuagccacggggccccugaccacccucugggagggguccccggggaaauucuggaacaccacgauugccgugagcauggccaacaucuuccgcggcuccuaccuggcgggcgccgggcuagccuucagccucaugaagucccugggcgggggccggcgcggaacaggcgcccagggcgagacccugggcgagaaguggaagcggcagcucaaccagcuguccaagagcgaguucaacaccuacaagcgcuccgggaucauggagguggaucggagcgaggcgaaggagggccugaaacgcggcgaaacgaccaagcacgccgucucccggggaaccgccaagcuccgcugguucguggagcggaaccuggucaagcccgagggcaaggugaucgaccugggcugcgggcgcggcggcuggagcuacuacugcgccggacugaagaaggugaccgaggugaagggguacacaaagggcggccccgggcacgaggagcccauccccauggccaccuacggcuggaaccucgucaaacugcacuccgggaaggacguguucuucgugccgcccgagaaaugcgauacacugcucugcgacaucggagagagcucccccaacccgaccaucgaggaggggcgaacgcugcgugugcugaagaugguggagcccuggcuccggggcaaccaguucuguaucaagauacuaaaccccuacaugcccagcgucguggagacacuggagcagaugcagcgcaagcacggcgggaugcucgugcgcaacccgcugucgcggaacagcacccacgagauguacuggguguccugcggcaccgggaacaucgucucagcggugaacaugaccucccgcaugcugcucaaccgguuuacgauggcccacagaaagcccacuuacgagcgggacgucgaccucggcgccggcacccgccacgucgccguggagcccgagguggccaaccuggacaucaucgggcagcggaucgagaacaucaagcaugagcacaagagcaccuggcacuacgaugaggacaaccccuacaagacgugggcguaccacggcuccuacgaggugaagccgagcggaagcgccucuucgauggucaacggcgucgugaagcugcugaccaagcccugggacgugaucccaauggugacccagauugccaugaccgacacgacccccuucgggcaacagcgcgucuucaaggagaaaguugacacccgaaccccgaaggccaagcgcggcacggcccagaucauggaggucaccgcgaaguggcuguggggcuuucucucccggaacaagaagccccgcauaugcacccgggaggaguucacccgcaagguucggagcaacgccgcgaucggggccguguucgucgacgagaaccaguggaacuccgcgaaggaagccgucgaggacgagcgcuucugggaucugguccaccgggagcgcgagcugcacaagcagggcaagugcgccacuugcgucuacaacaugauggguaaacgggagaagaagcucggcgaguucgggaaggccaaggguucucgcgccaucugguauauguggcuaggcgcgcgguuuuuagaguucgaggcucucggguucaugaacgaggaccauugguucucccgcgagaacagccuauccggcguggagggugagggccugcacaagcucggguacauccugcgugacaucagcaagauccccggcggcaauauguacgccgacgacaccgccgguugggacacccgaaucaccgaggacgaccugcagaaugaggcucgcaucacggauaucauggagccggagcaugcguuacuggccaaguccaucuuuaaacugaccuaccagaacaaggugguccgcgugcagagacccgcaaagaacggcaccgugauggacgucaucagccggcgcgaccaaagagguuccggacaggugggcaccuacggacucaacacauucaccaacauggaggcccagcugauccgccaaauggaaagcgaaggcaucuucucccccuccgagcuggagaccccuaaccucgcugaacgggugcuggacuggcuggagaaguacggaguggagcgcuugaagcggauggcgaucuccggcgacgacugcgugguuaagccgaucgacgaccguuucgccaccgcacugacagcccugaacgacauggggaagguccggaaggacaucccccaaugggagcccagcaagggauggaacgacuggcagcagguccccuucugcucccaccacuuccaccagcucaucaugaaagacggccgcgagaucgugguccccugccggaaccaggacgagcugguggggagagcccgggugagccaaggcgcgggguggagccugcgggagaccgccugccucggcaaguccuacgcccagauguggcagcugauguacuuccacaggcgggaccugcgccucgccgcgaacgccaucugcagcgccguccccguggacuggauccccaccucacggacuacuugguccauccacgcccaccaucaauggaugacuaccgaggacaugcuguccguguggaaccgagucuggauagaggagaaccccuggauggaagacaagacccacaucagcuccuggggcgacguuccguaccucggcaagcgggaggaucaguggugcggcagccucaucgggcugacggcccgcgcaacaugggccacaaacauccagguggccaucaaccagguccggcgccugaucgggaacgagaacuaccucgacuacaugaccaguaugaagagauucaagaacgagagcgaccccgagggggcccugugguga

SEQ ID NO: 23849 - RNA, 9879 nt, Artificial Sequence
  derived and/or modified CDS sequence (opt11) from DENV-1__HM181948__SS-prME
agcgugaccauguugcugaugcugaugccgacugcacuggcguuucaccucaccacccgcggcggggaaccucauaugaucgugagcaagcaggagcgggggaagagcuuauuauuuaaaaccagcgccggggugaacaugugcacccuuaucgccauggacuuaggcgagcuaugcgaggacacgaugaccuacaagugcccccggaucaccgagguggagccggaugauguggacugcugguguaacgccaccgacacgugggugacuuacgggaccugcucgcagaccggcgagcaccgccgcgacaagcggucaguggcccucgcgccccaugugggucuggggcucgagacgcgcaccgagaccuggaugagcucggagggcgcguggaagcaaauccagcgggucgagacgugggcccuucgccauccaggguucacugugaucgcguuauuccuggcccacgcgaucggcaccuccaucacccaaaaggggauaaucuuuauccuccugaugcucgucacccccaguauggcaaugcgcugcguggguaucggcucucgcgauuucguagaagggcucuccggcgcgacaugggucgacgugguacuggaacaugguucuugcgucaccaccauggccaaggauaagcccacccuggacaucgaacuccucaagacggaggugacuaaucccgccauccugaggaaacucugcaucgaggcgaagaucuccaacaccacgacggacagccgcugcccgacccaaggcgaagccacccucguugaggagcaggaugcuaacuucgucugccgccgaacuuucguggaccggggcugggggaauggaugcggccuguucggaaaggggucccucaucacgugcgcuaaguucaagugcguaacuaagcuggagggcaagauaguccaguacgagaaccugaaguauucagugaucguaacaguacacaccggcgaccagcaucagguggggaacgaguccacugagcacggcaccaccgccaccaucaccccgcaggcgccgacgaccgagauucagcucacagacuacggcgccuugacccuggacugcaguccgcgaacgggccucgacuucaacgaaauggucuuauuaaccaugaaggaaaagagcugguuaguucacaagcagugguuccuagaccugcccuugcccuggacgucaggggccucaaccucacaagagacauggaacagacaggaccuccuggugaccuuuaagaccgcccacgcaaagaagcaagagguuguggugcuuggcagccaggagggagcgaugcacaccgcuuugacgggggccacggagauccagacguccggcaccacgacgaucuuugccgggcaucugaagugccgccuuaagauggacaaguugacccugaaagguaugagcuacgucaugugcacaggcagcuucaagcucgagaaggagguggcugagacgcaacacggcaccgugcugguucagaucaaguacgagggcacagaugcuccuugcaagauucccuucagcacgcaggacgagaagggggugacgcagaacggccgacugaucaccgccaacccaaucgucaccgacaaggagaagcccgugaacauagaagccgaaccgcccuucggugagucuuacaucgugaucggcgccggcgagaaggcgcugaagcucagcugguucaagaaagggucgagcaucgggaagauguucgaggccacugcccgcggggcacggcgcauggcaauccucggggacacugcaugggauuuuggguccauaggcggcguguucacgaguguggggaagcuuguucaucagaucuucgggaccgccuauggcguccuauucuccggcgucucuuggacgaugaaaaucggaaucggcgugcuccugacuuggcuaggccugaauuccagaaguaccucccucucuaugaccuguauagccgucgggcucgucacgcuguacuuaggcgugaugguccaagcagacucugggugcgucaucaacuggaagggccgugagcugaagugugguagcgggaucuucgugacgaacgagguacauaccuggacugagcaguacaaguuccaggcugacagcccgaagcgccugagugcggccaucggcaaggccugggaggaggguguuugcgggauccggagcgccaccaggcuggagaacauaauguggaagcaaauauccaacgagcucaaucacauccugcuggaaaacgauaugaaguucacugucguggucggggauguggccggcauccucgcgcaggggaaaaagaugauccggccccagccaauggaguacaaguacagcuggaaauccugggguaaggccaagaucaucggggccgacgugcaaaacacgacuuucauaauagacggccccaauaccccggaaugccccgacgaccaacgcgcuuggaacaucugggagguagaggacuauggcuuuggaaucuucaccacgaacaucuggcugaagcugcgggacucuuauacccaagucugcgaccaccgccucauguccgccgccaucaaggacagcaaggccgugcacgccgauauggguuacuggaucgaguccgagaagaacgagacguggaagcucgcccgggcgagcuucauagaggucaagaccugcauauggccgaaaucccacacgcuguggagcaacggcgugcucgaguccgagaugaucauccccaagaucuauggcggaccgauaucccagcacaauuaccgcccgggcuacuucacccaaaccgccggcccauggcaccugggcaaacuggagcucgacuuugaccugugcgaggguaccacgguggucguggaugagcacugcggcaaucgagggccaucccugcguacuacuaccgugacuggcaagaucauccacgaguggugcugucggagcugcaccuuaccaccccucagauuuagaggugaggacggcugcugguacgguauggagauccgucccguaaaagagaaggaggagaaccuggugaaguccauggugucggccggcagcggcgagguagacuccuucagccucgggcugcugugcauuucuauuaugaucgaggaggugaugcggagccguuggucccggaagaugcuuaugaccggcacccuggccgucuuccuacucuugaucauggggcagcugacuuggaaugaucuaauccgauugugcauaauggucggggccaacgccagcgaccgcaugggaauggguaccaccuaccuggcccugauggcaaccuuuaagaugcggccgauguucgcgguggggcugcuguuucgacgccuaacgucccgcgaagugcugcugcucacuaucgggcugucccugguugccuccguggagcucccuaacagccuggaggagcugggggacgggcucgcgaugggcaucaugauccugaagcuccucaccgacuuucagucccaccagcucugggccacacugcucagccugacuuuuaucaagaccaccuucucacugcacuacgccuggaagaccauggccaugguccucagcaucgugucccuguuuccgcugugucucagcaccaccucucagaagacaaccugguuacccguacugcucgggagucuggggugcaagccgcugaccauguuucugauagccgagaacaagaucuggggucggcgguccuggccccugaacgaggggaucauggccgucggcaucguaagcauccugcugagcucucugcugaagaaugacguuccacucgccgguccccugaucgccgggggcaugcugauagccugcuacguuauaagcggguccagcgcggaccuuuccuuagagaaagcggccgaggugagcugggaggaagaggccgaacacuccggcgccucgcacaacaucuuaguggagguccaagacgacggcaccaugaagaucaaggaugaggaacgagacgacacccucaccauucugcugaaggcaacccugcuggccgugucaggcguguacccgcugucgauccccgcaaccuuguucgugugguacuuuuggcagaagaagaagcagcgauccggcgugcugugggauacccccagcccgccggagguggaacgggccguguuggacgacggaaucuaccggaucaugcaacggggucuacucggccgcucccaggugggcguugguguauuccaagagaauguguuccauacuauguggcacgugaccaggggggcgguccugauguaccagggcaaaaggcuggagcccagcugggcauccgugaagaaggaccucauuucuuauggaggcgguuggcggcugcaaggcuccuggaacacaggugaagagguacagguaauagccguagagccgggcaagaauccgaagaacgugcagaccgcaccagguaccuucaagacucccgagggcgagguaggcgccaucgcccuggacuucaagcccggaacauccgggucuccaaucgugaaucgugaagggaagaucgugggccuguacggcaaugggguagugacgaccagcgguacuuaugucagcgcgauagcccaggcuaaggcaucgcaggaaggaccgcugcccgaaauugaggacgagguauuccggaagcgcaaccuaacgaucauggaccuccacccaggcagugguaagacccggcgguaucuuccggcgauaguaagggaggcaaucaagcggaagcugcgcacacucauccuugcccccacacgcgugguagccuccgagauggccgaggcucugaagggaaugcccauccgcuaccagacuaccgccgucaaaucggagcacaccggcaaggagaucguugaccucaugugccaugccacauucacgaugcggcuguuauccccgguccgcgugccgaacuacaacaugauuaucauggacgaggcccacuuuaccgaccccucguccaucgccgcacggggguacaucagcaccagaguggguaugggagaagcagccgccauuuucaugaccgccacgccgccgggcuccguugaggcuuuuccgcagagcaaugccgugauccaggacgaggagcgagacaucccggagcgcucauggaacucaggguacgaguggaucaccgacuuccccggcaagaccguuugguucguccccaguaucaaaucaggcaacgacauagcaaacugccuacggaaaaauggcaagcgcgugauccaauuaucgcggaagaccuucgacacggaguaccagaaaaccaagaacaaugacugggauuaugugguuaccaccgacaucagcgagaugggcgccaauuuccgcgcggaccggguaaucgacccgcgucguugccugaaacccgucauccugaaggacggcccugagcgcgucauccuagccggccccaugccgguuacggucgccuccgccgcccagaggcgcgggcggauaggcaggaaccauaacaaggagggcgaccaguacauuuacauggggcaaccgcugaacaacgacgaggaccaugcgcacuggacagaggccaagaugcuccuggacaauaucaacacgcccgagggcauuauacccgcccuguuugagccggagcgugaaaaguccgccgcgaucgacggggaauaccgguugagaggcgaggcgcggaagacuuucguggagcuuaugcgcaggggcgaccuucccguuuggcucagcuacaaaguggccagcgaggguuuucaguacucggaccgccgguggugcuucgauggcgagcgcaacaaucagguccuggaagagaacauggacgucgaaauuuggacgaaggagggggagcgaaaaaagcugagaccuagauggcucgacgcccgcaccuacucugacccccuggcccuucgggaguucaaggaguucgccgcgggccgccggagcgucuccggagaucucauucuggagauaggcaaacucccgcagcaccuaacccagcgcgcccagaacgcccuggauaacuugguuauguugcauaacucugaacagggcgggcgggccuacaggcacgccauggaagaguugccugacacgaucgaaacguuaaugcugcuagcccucauagcggugcucaccggcggugucacccuguuuuuccuaucgggccggggccucggcaagaccaguaucggccugcugugcgugauggccuccuccgugcuuuuauggauggccuccgucgagccccauuggauagcggccucuauaauucuggaguuuuuccucauggugcugcugauccccgagccggaccgccagcggacaccccaggauaaccagcuagccuacguggugaucgggcugcuguucaugauauuaacgguugccgccaacgagaugggcuugcuugagacaacaaagaaagaccucgggaucggccacguugcggucgggaaccaccaccacgcggccaugcuggacguugaccugcacccagcaagugccuggacccuguacgccguggccacaaccaucauaacccccaugaugcgccacaccaucgagaacacgacggccaauauuagccugacggccaucgcgaaccaggcggccauccuaaugggccucgacaaaggcuggcccauuaguaagauggauauuggggucccccugcuugcuuugggcugcuacucacagguaaacccccugacccugacggccgcggugcuuauguuggucgcccacuacgccaucaucgggccgggucugcaggccaaagcgacgcgcgaagcgcagaagcggacggccgccgggauaaugaagaaccccacuguggacggaaucguagccaucgaccucgaccccgucgucuacgacgccaaguuugagaagcagcugggucagaucaugcugcucauacucugcacgucgcagauccuucucaugcggacaaccugggcgcucugcgagagcaucacccuggccacggggccccucaccacccugugggagggguccccggggaaguucuggaacaccacgaucgccguguccauggccaacaucuuccggggcuccuaccuggccggcgcugggcucgccuucucacucaugaaaucccucggcgggggccggcggggaacgggcgcccagggcgagacacuuggggaaaaguggaagcgccagcugaaccaacuuagcaaaagcgaguuuaacacguauaagcggaguggcaucauggaggucgacagaagcgaggccaaggaagggcucaagcggggggagaccaccaagcacgcggucucucgcggaacagcaaagcuacguugguucguggaacggaacuuggucaagcccgagggcaagguuaucgaccugggcugcgggcggggcggaugguccuacuacugcgccggguugaagaaagugaccgaggucaaaggguacacgaaagggggcccaggucaugaggaaccuaucccaauggccaccuacggauggaaccuggugaaacugcacucugggaaggacguguucuucaucccgcccgagaagugcgacacacuccugugcgacaucggcgagucaucccccaaccccacuaucgaggaggggcgcacgcuacgggugcucaaaaugguggagcccuggcugaggggcaaccaauucugcaucaagauauuaaacccuuacaugcccagcguggucgagacccucgagcaaaugcaacgaaagcacggcgguaugcuggugcgcaacccguugucucggaacagcacccacgagauguacugggucuccugcggcaccgguaacaucgucucggccguaaauaugacgucucgaaugcugcugaaccgcuucacgauggcacaccgcaagccaacauacgagcgcgauguugacuugggcgccggcacccgacacgucgcaguggagcccgagguggccaaccucgacauaauaggccagcgcauagagaacaucaaacaugagcauaagagcacuuggcacuacgacgaggacaacccauacaagaccugggccuaccacggaagcuacgaggucaaaccgagcggguccgcgagcagcauggugaacggcgucgugaagcugcugaccaagcccugggaugugauacccauggucacccagaucgccaugacagacacgacccccuuuggccagcaacgcguauucaaggaaaagguggacacccgcaccccgaaggccaaacggggcacggcccagaucauggaagucaccgcaaaguggcucuggggcuucuuaagucggaacaagaagccccggaucugcacccgcgaggaguucaccagaaaggugcgcagcaacgcggccaucggggcuguguucgucgacgagaaccaguggaacuccgccaaggaggcgguggaggacgagcgauuuugggaucugguccaccgugagcgggagcuacacaagcagggcaaaugcgccacgugcgucuacaacaugauggggaagcgcgagaagaaacucggagaguucgggaaggccaaaggcucacgggcaaucugguacauguggcugggcgcuagauuccuugaauucgaggcgcugggguuuaugaacgaggaccacugguuuuccagggaaaacagccugucggguguggagggugaaggacuccacaaguuaggguacaucuugagagacaucagcaagaucccuggcggcaacauguacgccgacgacaccgcggguugggacacccggaucacagaggacgaccuccagaacgaagcacgaaucacagauaucauggaaccugagcacgcccugcuggcgaagucuaucuucaagcuuaccuaccaaaacaaggugguccgcgugcagcggcccgccaagaacggcaccguuauggacgucauaucacgcagagaccagcgagggagcggucaggugggcacauacggacugaauacguucaccaacauggaggcccagcugauccggcagauggagagcgagggcaucuuuucccccagcgaacuagagacgcccaaccuggccgaacgcgugcuggacuggcucgaaaaguacggcguugaacgacugaaacguauggccauauccggcgacgauuguguggugaagccaaucgaugacagguucgcaaccgcccugacggcccucaaugauauggggaaggucaggaaggacaucccccaaugggagccuuccaagggcuggaacgacuggcagcagguaccauucuguucccaccacuuccaccagcugaucaugaaagacggucgagagaucguugucccuugccgaaaccaagacgagcuggugggucgcgcccgggugagccagggcgccggguggagccuacgggagaccgccugccucggcaagaguuacgcacagauguggcagcugauguacuuccaucgccgcgaccugcgccuggccgccaaugcgaucuguagcgccguccccguggacuggauccccaccucacggacuacauggagcauccacgcccaccaccaguggaugaccacggaggauaugcuaagcguguggaaccgcgucuggaucgaagagaaucccuggauggaagacaagacacacaucucuuccuggggcgaugucccguacuugggcaaacgcgaggaccaguggugcggcagcuugaucgggcugacugcgcgggcgacaugggcgaccaacauccagguggccaucaaccaagugcgccggcucauagggaacgaaaauuaucuggacuacaugaccuccaugaagcgcuuuaagaacgagagcgacccugagggcgcccugugguag

SEQ ID NO: 23850 - RNA, 9879 nt, Artificial Sequence
  derived and/or modified CDS sequence (opt11) from DENV-1__HM181949__SS-prME
uccgugaccaugcuacucaugcugaugcccaccgcccuggccuuccacuugacaacccgggguggggagccacauaugauagugagcaagcaggagcgggggaagagccugcuguucaagaccagcgcggggguaaacaugugcacccucaucgcgauggacuuaggcgagcugugcgaggacacgaugacauacaagugcccgcgcauuaccgaggccgagcccgacgauguggacugcuggugcaacgccacggacacgugggugaccuacgggaccugcagccaaaccggcgagcaccggagagauaagcgguccguggcccucgcaccacacguuggccugggccuggagacgaggaccgagaccuggaugagcagcgaaggagccuggaaacagauccagcgggucgaaaccugggccuuacggcaccccggcuucacagugaucgcacuguuccuggcgcacgccaucggcaccagcaucacccagaaagggaucaucuucauccuccugaugcuggugaccccaagcauggccaugcggugcgucgggaucggcagccgcgacuucguggaggggcucaguggcgccaccuggguggacgucgugcuggagcaugggagcugcguuacaaccauggccaaagauaagcccacccuggacaucgaguuacucaagacggaggucaccaaccccgcgaucuugcgcaagcucugcaucgaggccaagaucucuaacaccaccacggacagccgcugcccgacccagggcgaggccacccugguggaagagcaagacgccaacuucgugugccggcgcaccuucgucgaccggggcugggggaacgggugcggucuguucggcaagggcucccucaucacuugcgcuaaguucaaaugcgugaccaagcuggagggcaagauagugcaguacgagaaccugaaguauuccgucaucgugaccguacacacuggcgaccagcaccaggucgggaacgaguccacgggccacgggacgacggcgacaauuacgccgcaggcccccacuacggagauccagcucacugacuacggcgcccugacgcuggacugcuccccccgaacgggucucgacuuuaacgagauggugcugcugacaaugaaggagaaguccuggcucguccacaaacaaugguuccuggaccuuccccuacccuggaccucgggugccagcaccucccaagagacguggaaccggcaggaucugcugguaaccuucaaaacugcccacgcgaagaaacaagagguggucgugcucggcucgcaggagggggccaugcacaccgcccugaccggagccaccgagauccagaccucugggacgacgaccauauucgccggccaccugaagugccgccucaagauggacaaauugacccugaagggcaugagcuacgugaugugcaccggauccuucaagcucgagaaggaggucgcugagacgcagcacggcaccgugcuggugcagaucaaguacgaagggaccgacgcccccuguaagaucccuuuuagcacccaagacgagaagggcgucacgcagaacgggcggcugauuaccgcgaacccgaucgugaccgauaaggagaagcccgucaauaucgaggcggagccgcccuucggugaguccuacauagucaucggcgcgggcgagaaggcgcugaagcucagcugguucaagaagggcuccucaauaggcaagauguuugaagccacagcccgcggcgcccggcgcauggcuauccugggagacacugccugggacuucggcuccaucgguggggucuucaccucggugggcaagcugguccaccagaucuucgggacagccuauggcguacucuucucuggggugucguggaccaugaaaauuggcauaggggucuuacugacguggcucggucugaacagucgcagcaccucccugagcaugacuugcaucgccgugggccuugugacccuguaccugggggucaugguccaggccgacuccgguugcgugaucaacuggaaggggcgggagcucaagugcggcagcgggaucuucguaacgaacgaggugcacaccuggaccgagcaguacaaguuccaggcggacagcccgaagcgcuuauccgccgccaucgggaaggccugggaggagggugugugcgggauccggagugccacacgccuggagaacaucauguggaagcagaucuccaacgagcugaaccacauccugcuggaaaacgacaugaaguucacagucgugguaggcgacguggcggggauccuugcccagggcaagaagaugauucggccccagcccauggaguacaaguacucuuggaaguccuggggcaaggccaagaucauaggggcugacguacagaacacgaccuucaucaucgacggaccgaacaccccggagugcccagaugaccagcgcgcuuggaacaucugggagguggaggacuacggguucggcaucuuuaccacgaacaucuggcugaagcugcgggacagcuacacgcaggucugcgaucaccgucucaugucggccgccaucaaagacagcaaggccgugcacgccgacaugggcuacuggaucgaguccgagaagaacgagacuuggaagcuggcgcgggcuagcuucauagaagugaagaccugcauauggccuaagucccauacguuauggagcaacggggucuuagaguccgagaugaucaucccuaagaucuacggagggccgauuagucagcacaacuaucgccccggcuacuucacccagacggccgggcccuggcaccugggcaaacuggagcucgacuucgaccuaugcgagggaaccaccgugguagucgacgagcacugcgggaaucggggaccaucccugcgcaccaccaccgugacggggaaaaucauccacgaguggugcugccggaguugcaccuuaccgccccugagguuccggggcgaggaugggugcugguauggcauggagauccgccccgugaaggagaaggaggaaaaccuggucaaguccauggugagcgccggcucaggggaagucgacuccuucagucucggccuacugugcaucucuaucaugauagaggaggugaugagaagccgcugguccaggaaaaugcucaugaccgggacccuggcggucuuccugcucuuaaucauggggcagcugacguggaacgacuuaaucaggcugugcaucauggugggggcaaacgccagcgaccgcaugggaaugggcaccaccuaccuggcacucauggcaaccuucaagaugcggccgauguucgcagucgggcugcuguuucgucggcucacgucccgcgagguguuacugcucacaauugggcugagccugguugcauccgucgagcucccuaacagucuugaagaacugggggacgggcucgccaugggcauaaugauccugaagcugcucaccgauuuccagucccaccagcuuugggcgacccuccucagccugacguucaucaagaccacguucucucugcacuacgcauggaagaccauggcgaugguucucagcaucgugucucuguucccccugugccucuccacgacuucccagaaaacaacguggcugccugugcugcucgggagcuuagggugcaagccucugacgauguucuugaucgccgagaacaagaucugggggcggaggagcuggccgcugaacgagggcauaauggcuguagggaucgucagcauuuugcucuccucccugcugaagaacgacgugccccuugcuggcccccugaucgccggcgguauguugaucgcgugcuacgugaucucuggguccagcgccgaccucucccuggagaaggccgccgaggucucuugggaggaagaagcggagcacuccggggcgagccacaacauccucguggaggugcaggacgacggcaccaugaaaaucaaggacgaggaacgagaugacacgcucaccaucuuguugaaagccacccucuuagccgucuccgggguguacccguuaagcauccccgccacacucuucgugugguacuucuggcagaagaaaaaacagagauccgguguccugugggacacccccagcccccccgagguugagcgggcggugcuggacgacgggaucuaccgcauaaugcagcggggguuacucggccguucccagguuggggugggcguguuucaggagaacgucuuucacaccauguggcacgugacccgcggggcggugcugauguaccagggcaagcgucucgagccaagcugggccuccgugaaaaaggaucuuaucagcuacggaggggguuggcggcugcagggguccuggaacacaggcgaagaaguccagguuauagccgucgagccggggaagaaccccaagaacgugcagaccgcacccgggaccuucaagacgcccgagggcgaaguaggggccauagcucuggacuucaagccgggcaccagcgggucccccaucguaaaccgugagggcaagaucgugggccucuacgggaacggcgucgucaccaccagcggcaccuacgugagcgccaucgcccaggccaaggcgucccaggagggcccccugcccgagaucgaagacgagguguuccggaagcgcaaccugaccaucauggaccuccaccccgggagcggcaagacccggcgcuaccugccggccaucguccgggaggccauaaagcgcaagcugcgcacccucauccuggcccccacccgggugguggccagugagauggcggaagcccucaagggcaugccaauacgcuaccagacgaccgccgucaagagcgagcauacggggaaggagaucguggaccuuaugugccacgcuaccuucacaaugcgccugcugucccccgugagggucccgaacuacaacaugaucauaauggacgaggcccacuucaccgaccccucguccaucgcugcgcggggcuacaucagcacccgugugggcaugggcgaggccgccgccaucuuuaugaccgcgacgccuccaggguccguggaggccuucccgcaaagcaacgccgucauccaagacgaggagcgggacauccccgagcgcaguuggaauagcgguuacgaguggaucaccgacuuccccggcaagaccguaugguucgugcccucgaucaagagcgggaaugacaucgccaacugccuccguaagaacgguaagcgcgucauccaguuaucccggaagaccuucgacacggaguaccaaaagaccaagaacaacgacugggacuacguggugacgaccgacaucucggagaugggggcgaauuuccgcgccgacagagucaucgauccucgccggugccugaagcccgucaucuugaaggacggccccgagcgggugaucuuagcggggcccaugccaguuaccguagccuccgccgcgcagaggcgcggccgaaucggccgcaaucauaacaaggagggggaccaguacaucuacaugggccaaccccugaacaaugacgaagaccacgcccacuggaccgaagcaaagaugcuccucgacaacaucaacacccccgaggguaucaucccagcccuguucgagccggagcgcgagaaguccgccgcgaucgacggcgaguaccggcuccgcggggaggcccggaagaccuucgucgagcugaugcgucggggcgaccugccgguguggcucuccuacaagguggcuucugagggcuuccaguacagcgacagacgguggugcuucgacggcgagcgcaacaaccagguccuggaagagaacauggaugucgagaucuggacgaaggagggagagcggaagaagcugcgcccccgguggcucgacgcccggaccuacucagacccccuggcccugcgggaauucaaagaguucgcggccgggcgacggagcguaucgggcgaccucauccuggagaucgguaagcugccgcaacaccucacccagcgcgcccagaacgcacuggacaaccuggucaugcuucacaauagcgaacagggcggacgggccuaccgccacgccauggaagagcuuccagacacgaucgagacguugaugcuccuggcccugauagccgugcucacggggggcgucacccuguucuucuugagcgggcgcggccucggcaagaccagcaucgggcugcugugcgucauggccagcuccgugcuccuguggauggcauccguggagccccauuggaucgccgccagcaucauccuggaguucuuccugaugguccuacugauccccgagccggaccgccagcggacgccccaggauaaccaacucgcguacguugugaucggccugcuguuuaugauccucacggucgccgcgaacgagauggggcugcucgagaccacuaagaaggaccuuggcaucgggcacguggcagugggcaaucaccaccaugcagcgaugcuggacgucgaccugcacccggcguccgcuuggaccuuauaugccguagccacuaccaucaucaccccgaugaugagacacacaaucgaaaacacgaccgccaacaucagcuugaccgccaucgccaaccaagccgccauucugaugggcuuggacaagggguggcccaucuccaagauggauaucggcgugccccugcuggccuuggggugcuacagucaggugaacccccugacccugacggcggccgugcugaugcugguggcgcacuacgccaucaucggaccugggcugcaggccaaggcaacccgggaggcacagaagcggaccgccgccggcaucaugaaaaacccuacggucgacggaaucguggccaucgaccuugauccuguggucuaugacgcgaaguucgagaagcagcuggggcaaaucaugcugcucaucuuaugcacgucccagauccugcucaugcgcaccacaugggcgcugugcgagagcaucacccuggccacgggcccccucacuacccugugggagggguccccgggcaaguuuuggaacaccaccauagccgucagcauggccaacaucuuccggggcucauaccuggcgggagcggggcucgcuuucucccugaugaagucccuggggaggggccggcgcgggaccggcgcucagggcgagacacucggggagaaguggaaaaggcaacuuaaccagcuguccaaguccgaguucaauaccuacaagcgcuccgggaucauggagguggaccggagcgaggcgaaggaggggcuuaaacgcggcgagacgacuaagcacgcagucucgcgggggaccgccaagcugcgcugguuuguagagcggaaucugguaaagcccgagggcaaggucaucgaucugggcuguggccgcggcggguggagcuacuauugcgccggccucaaaaaagucacggagguuaagggguacacgaagggcgguccggggcaugaggagcccaucccgauggccacauacggcuggaauuuggucaagcugcacuccgggaaggauguguucuucauuccuccagaaaagugcgacacccuccugugcgacaucggcgaguccucuccaaacccgaccaucgaagaggggcggacgcugcgcguucucaagauggucgaacccuggcugcggggcaaccaguucugcaucaagauacugaacccauacaugccgagcgugguggagacccucgagcagaugcagcgcaagcacggcgggauguuaguacgcaacccacugucccgcaacucaacucaugagauguacuggguguccugcggcaccgguaacaucguaagcgcggugaacaugaccagccgcaugcuccugaaccgcuucacuauggcgcaccgcaagcccaccuacgaacgggacguggaucugggcgccggcacccggcacgucgcugucgagcccgaaguggccaaccucgacaucauaggacagcggauagagaacaucaagcacgaacacaagagcaccuggcauuacgacgaggacaaccccuacaagacgugggcauaccauggcuccuacgaggugaagccgagcggguccgcgagcaguauggucaacggcguggucaaguugcugaccaagcccugggacgugauccccauggugacccagauagccaugaccgacacaacccccuucgggcagcaacgcgucuucaaagaaaagguggacacccggaccccgaaggcuaagaggggcacggcccagauuauggaagugaccgcgaaguggcucuggggcuuccugucucggaacaagaagccccgcaucugcacccgggaggaguucacccguaaggucagguccaacgccgcuaucggcgccguguucguugaugagaaccaguggaacuccgcgaaggaggcgguugaggacgagcgcuucugggaccuggugcaccgcgaacgggaacuccauaagcaaggcaagugcgcaacgugcguguacaacaugaugggcaagcgggagaagaagcugggcgaguucgggaaggccaagggcagcagagccauuugguacauguggcugggcgcgcgguuccucgaguucgaggcgcuggguuucaugaacgaggaccacugguucagcagagaaaacagccugucuggcgucgagggggaggggcuccauaagcugggcuacauccugcgggacaucagcaagauccccggcggcaauauguacgcugacgacaccgcuggaugggacaccaggaucaccgaggacgaucuccagaacgaggcgcgcaucacggacaucauggaaccggagcacgcgcuguuagccaagagcauauuuaagcucaccuaccagaacaagguggugcggguccagcgcccugcaaagaauggcacagugauggacgugauaagcagacgcgaccagcggggguccggccaagucgguaccuaugggcucaauacguucaccaacauggaggcccagcugauccgccagauggagagcgaggggaucuucuccccuagcgaacucgagaccccuaaucuggcagagcgggugcuggacuggcucgagaaguaugggguggaacgccugaagcggauggccaucuccggcgacgacugcgucgugaagccgauugacgaccgcuucgccaccgcccugacggcccucaacgacaugggcaaagugcgaaaagacaucccucagugggagccuagcaagggcuggaacgauuggcagcagguucccuucugcagccaccacuuccaucagcuaaucaugaaggacgggcgcgaaaucguggugccgugccggaaccaggacgagcuggucggccgcgccagggugagccagggcgccggguggagccuccgcgagaccgcuugccuaggcaaguccuacgcccaaauguggcagcugauguacuuccaucggcgcgaccuccggcuggcggcgaacgccaucugcagcgcugugcccgucgacuggauucccaccucccgcaccaccugguccauccacgcccaccaucaguggaugaccacagaggacaugcuguccguguggaaccgcguuuggaucgaggagaaccccuggauggaggacaagacccacauaagcuccuggggcgaugucccguacuugggcaaaagagaggaccagugguguggcagccugaucgggcugacggcccgcgcuaccugggcgacuaacauccagguggccaucaaccaggugcggaggcucauugggaacgagaauuaccuagacuauaugacguccaugaagcgcuucaagaacgagagcgaccccgagggagcacuaugguga

SEQ ID NO: 23851 - RNA, 9879 nt, Artificial Sequence
  derived and/or modified CDS sequence (opt11) from DENV-1__HM181950__SS-prME
agcgugaccaugcugcucaugcuuaugccuaccgcccuggccuuccaccucaccacccggggcggggagccccacaugaucgugagcaagcaggagcggggcaagucgcugcuguucaagacgagcgccgggguaaacaugugcacccucauagccauggaccugggcgagcugugugaggacaccaugacguacaagugcccccggaucaccgaagcggagcccgacgacguagauugcuggugcaacgccacagauaccugggugaccuacgggaccugcagccagacgggcgagcaccggcgcgacaagcguuccguggcccucgcgccccacgugggccuggggcuggagacgagaaccgagaccuggaugagcuccgaaggcgccuggaagcagauccaacggguggagaccugggccuugcgccaccccggguucaccgugaucgcccuguuccuggcgcacgccaucggcaccagcaucacccagaaggggaucaucuucauucuccuuaugcuggugacccccuccauggccaugcggugcgucggcaucggcagccgagacuucguagaagggcucuccggcgccacguggguggaugucguacuggagcacggcagcugcgugaccaccauggccaaggacaagcccacccuggacaucgagcuccugaagacggaagucaccaaucccgcgauccugcggaagcucugcaucgaggccaagauuuccaacaccaccacggacucuaggugcccgacccagggcgaggccacccugguggaggagcaggacgccaacuucgugugccggcgcaccuucgucgaccggggcugggggaacggcugcgggcuguucggcaagggaagccucaucacgugugccaaguucaagugcgugaccaagcuggagggcaagaucgugcaguacgagaaucugaaguacucggucauagugaccgugcacaccggcgaccagcaccaggucgggaacgaguccacggagcacggcaccaccgcuacuaucacgccccaagccccuacgaccgagauacaacuaaccgacuacggggcccugaccuuggauugcaguccccgcacaggccucgacuucaacgagauggugcugcugaccaugaaggagaaguccuggcuaguccacaagcagugguuccuggaccugccccuccccuggacaucgggugcuagcaccucccaggagacauggaaccggcaggaucugcuggugaccuucaagaccgcccaugcgaagaagcaagagguggucgugcucggcucccaggaaggggccaugcacaccgcccugacgggggccaccgaaauccagaccuccggcaccacgaccauauucgccgggcaccugaagugucgccucaagauggacaagcugacccugaagggcaugagcuacgugaugugcaccggguccuuuaagcucgagaaggaagucgcggagacgcagcacggcacagugcuggugcagaucaaguacgagggcaccgaugcucccugcaagauacccuucuccacacaggacgaaaagggggugacacagaacgggcggcugaucaccgccaacccgaucgugaccgacaaggagaagcccgugaacaucgaggcggagccgcccuucggggaauccuauaucgucaucggcgcuggcgagaaggcccugaagcucuccugguucaagaaggggucaagcauaggcaagauguucgaagccacugcccgcggggcccggcgcauggcgauccugggcgauacggccugggacuucgggucgaucggcggcguguucaccagcguggggaagcugguccaccagaucuucggcgccgccuauggggucuuauucucgggcgugagcuggaccaugaagaucgggaucggcguccuacugacuuggcuuggccugaacucccgcagcacgucccugucuaugaccugcaucgcaguggggcucgugacccuguaccuaggcgucaugguucaagcggacuccgggugcgugaucaacuggaagggccgggagcucaagugcgggagcggcaucuucgugaccaacgaggugcacacguggaccgagcaguacaaauuccaagccgacagcccgaagcgacuguccgcugccauuggcaaagccugggaggagggggugugcggcauuagaagcgcaacccgccuggagaacaucauguggaaacagaucucuaacgagcucaaccacauccugcuggagaacgauaugaaguucacggucguggugggggacgucgccggcauacucgcccaggggaagaagaugauccgaccucagcccauggaguacaaguacagcuggaagucauggggcaaggccaagaucaucggcgccgacguacagaacaccacauucaucaucgacggcccuaacaccccggagugccccgacgaccagcgagccuggaacauuugggaaguggaggacuacggcuuuggcauauucaccaccaacaucuggcugaagcugcgggauagcuacacgcaggucugcgaccacagacuaaugucagccgccaucaaggacagcaaggccgugcacgcggacaugggcuacuggaucgaguccgagaagaacgagaccuggaaacuggcccgggccagcuucaucgaggugaagaccugcaucuggcccaagucacacacccuguggucgaacggcguccucgaguccgagaugaucauccccaagaucuacgggggcccaaucagccagcacaacuaccgacccggguacuucacgcagaccgccggcccauggcaccuggggaagcuggagcucgacuucgaccuuugugagggcaccaccgugguggucgacgagcacugcggcaaccgggggcccucccugcgcacgaccaccgucaccggcaagaucauccaugaguggugcugccggagcugcacccugccgccccuccgcuuccguggggaggacggcugcugguacggaauggagauccgccccgugaaggagaaggaggagaaccuggucaaguccaugguuagcgccggcagcggugagguggauuccuucucacucgggcugcugugcauuuccaucaugauagaggaggucaugcgcagcagauggucccggaaaaugcucaugaccggcacccuggcgguauuccugcucuuaaucauggggcagcugacauggaacgaccucauccgccugugcaucauggugggcgccaacgccagcgaccgcauggggaugggcacgaccuaccuggcgcucauggccaccuuuaagaugcggccgauguucgcuguaggguuauuguuccggcggcucacuucccgcgaggugcucuugcucaccaucggacugagccuuguggccuccgucgagcuccccaacagccuggaggagcugggggaugggcucgcuaugggcaucaugauccugaaacuucucaccgacuuccagucccaccagcugugggcuacgcugcucagccuaaccuucaucaagacgaccuuuagccugcacuacgcuuggaagaccauggccauggugcucagcaucgucucccuuuucccccuaugccucagcaccacgucccaaaagaccaccuggcugcccgugcugcuaggcagccuggggugcaagccucugaccauguuccucaucgccgagaacaagaucuggggccggcguucauggccccugaaugaggggaucauggccguuggaaucgucagcauccuucucagcucccugcucaagaacgacgugccccucgccgggccccugauagcaggcggcaugcugaucgccugcuacgucaucagcgggucgagcgccgaccucucccuggagaaggccgccgaggucaguugggaggaggaggcggagcacuccggcgccucccacaauauccugguagaggugcaggacgacgggacgaugaagaucaaagacgaggagcgggacgacacccugaccauccuguugaaggccacccuccuugccguuuccggcguguacccgcuuagcauccccgccaccuuauucgugugguacuuuuggcagaagaagaagcagcguuccgggguccuaugggauacgcccagcccgcccgagguggagcgggcggugcuggacgacggcaucuaccgcaucaugcagcggggccugcuugggcggucucaagucggaguggggguguuccaggagaacgucuuccacaccauguggcacgugacacggggcgccgugcugauguaccaagggaagcgccuggagcccucgugggccagcgucaagaaggaccucaucagcuacggcggcggguggcgacugcagggcucuuggaacacgggcgaggaaguccaggugaucgccgucgagcccggcaagaaccccaagaacgugcagacggcccccgggaccuucaagaccccugagggcgaggugggcgcgaucgcccuggacuucaagcccgggacuaguggcuccccgauugucaauagagagggcaagauugugggccucuacggcaacgggguggucacgaccagcggcacauacgugagcgccauagcccaagcgaaggccucccaggaggggccguuacccgagaucgaggaugagguguuucguaagcgcaaccugaccaucauggaccuccauccgggcagcgggaagacgcggcgauaccugccggccaucguccgggaggccaucaagcgcaagcugcgcaccuuaauccuggcccccacccgggugguggcguccgagauggccgaggcccugaagggaaugcccauccgcuaccagaccacggccgucaagagcgaacauaccggcaaagagauuguggaccucaugugccacgcaaccuucacaaugcggcugcucucucccgugcgcgucccaaacuacaauaugaucaucauggacgaggcgcacuucacagaccccagcaguaucgcggcccggggcuacaucaguaccaggguuggcaugggggaggccgccgccaucuucaugacagccacgccgcccggcuccguggaagccuucccacagagcaacgccguuauccaggacgaggagcgggacaucccagagcgcuccuggaacagcggguacgaguggaucacggacuuuccagguaaaacagugugguucgugcccuccaucaaaucgggcaacgacaucgcgaacugccuccggaagaacgggaagcgcgucauccagcugucccggaagaccuucgacaccgaguaccagaaaacgaagaacaacgacugggacuacguggugaccaccgacaucagcgagaugggggcuaacuuccgcgccgaucggguuaucgacccgaggcggugccugaagcccgugauccucaaggaugggccggagcgcguaauccuggcuggccccaugccugucaccgucgccuccgccgcccagagacgcgggaggaucggcagaaaccacaacaaggagggagaccaguacaucuauauggggcagccccuuaacaacgacgaggaccacgcccauuggacggaggccaagaugcuccuggacaacaucaacacccccgagggcaucauccccgcccuguucgagccggagcgcgaaaaguccgccgcuaucgacggggaguaucggcuccgcggcgaagcccggaagaccuucguugagcugaugcgccgcggggaccugcccguauggcucuccuacaagguggccagcgagggcuuucaguacagcgaucgccgguggugcuucgacggcgagcgcaacaaucagguccuggaggagaauauggacguggagaucuggaccaaggagggggagcggaagaagcugcgcccccgguggcuagacgccagaacguacuccgacccccuugcgcugcgggaguucaaggaguucgccgccggccgccggagcguguccggggaccucauccuggagauuggcaagcuuccgcagcaccucacccagcgggcccagaacgcgcuggacaaucuggucaugcuccacaacagcgagcagggcgguagggccuaucgccacgccauggaagagcuuccggacacgaucgagaccuuaaugcuccuggcccucauugccgugcuuacgggcggggugacccuauucuuccugucgggccgggggcucgggaagaccagcaucggccugcugugcgucauggcgucuagcgugcuccuguggauggcgaguguggagccccacuggaucgccgccagcaucauacuggaauucuuccucaugguucuccugauccccgagccggaccgucagcggacgccccaggacaaccagcucgccuacguggugaucgggcugcuguuuaugauccucacagucgcagccaaugagaugggccugcuggagacgacgaagaaggaccucgggaucggccacguagccguggggaaccaccaccaugccgccaugcuggacgucgaccugcaccccgcgagcgccuggacccucuaugccguggcgaccacgaucaucaccccgaugaugcgccacaccaucgagaacacgacggcaaacaucagccugaccgcgaucgccaaccaggccgccauccugaugggccucgacaagggauggcccaucucaaagauggacauuggggugccccugcuggcgcucgguugcuacagccaggucaacccccugacacugaccgccgcggugcucaugcugguggcccacuacgccaucaucgggcccggacugcaggcgaaggccacgcgcgaggcccagaagaggaccgccgcagggaucaugaagaaucccaccgucgacgggauuguggcgaucgaccucgaccccgucgucuacgacgccaaguucgagaagcagcugggccagauaaugcugcucauccugugcacuucucagauccugcucaugcggacuaccugggcccugugcgagagcauuacccuggccacugggccccuaaccacccucugggagggcuccccggggaaguucuggaacaccaccaucgcagugagcauggcaaacaucuuccgaggcaguuaucuggcuggcgccgggcucgcauucucacugaugaagucccugggggggggccgccgggggacaggcgcgcagggcgagacccucggggagaaguggaagcgccagcuuaaucaacuguccaaguccgaguuuaacacguacaagcgguccggaaucauggagguggaccgcagcgaggccaaggagggacucaagcggggcgagacgacgaagcacgccguuucccgaggcaccgcaaagcuucggugguucguagagcgcaaccuggugaagcccgagggcaaggucaucgaccugggcugcgggcggggaggguggagcuauuacugcgccggccugaagaaggucaccgagguuaaggguuacaccaagggcggccccggacacgaggagcccaucccaauggcgacuuacggcuggaaccuggucaagcugcauuccggcaaagacguguucuucaucccgcccgagaagugcgacacgcuacugugcgacaucggcgaguccagucccaacccgaccauagaggaggggcgcacccugagggugcuuaagauggucgagcccuggcugcgcggcaaccaauucugcauuaaaauccugaaccccuacaugcccagcguggucgagacgcucgagcagaugcagcggaaacacggcgggaugcugguccgcaacccacugucccggaauagcacccacgagauguauugggucuccugcggcaccgggaacauagugagcgccgucaauaugaccucccgcaugcuccugaaccguuucaccauggcccaccggaagcccacguacgagcgcgacguugaccugggagccggcaccaggcacguggccgucgagcccgagguggcaaaccucgacauuaucgggcaacgcaucgagaacauaaagcacgagcacaagagcaccuggcacuacgacgaggacaaccccuacaagacuugggccuaccacggcucauacgaggugaagccuagcggguccgccagcagcauggucaauggcguggucaagcugcugacaaagcccugggacguaauccccauggugacgcagaucgccaugaccgacaccacgcccuucgggcagcagcgggucuucaaggagaagguggacacccgcaccccgaaggccaagcgcggcaccgcgcagaucauggaagugacggccaaguggcucugggguuuccucucccgcaacaagaagccccggaucugcacccgcgaggaguucacccggaagguccgcagcaacgccgccaucggggcgguauucguggacgagaaccaguggaauuccgcgaaggaggccgucgaggacgagcgguucugggaccuggugcaccgcgagcgggaguugcacaagcagggcaagugcgcgaccugcguguacaacaugauggggaagcgcgagaagaagcugggcgaguucgggaaggcuaagggcagccgggcgaucugguacauguggcuuggggcccgcuuccucgaguucgaggcucugggguucaugaacgaagaccacugguucucccgggagaacagccuguccggcguggagggggaaggccuccacaaacugggguacauccugagggauaucagcaaaauacccggcggcaacauguaugccgaugacacggccgggugggacacccggaucacugaggacgacuugcagaaugaggcgcgcaucaccgacauaauggagccggagcacgcauugcuggccaagucaaucuucaagcucacguaccagaacaaaguggugcgcguccaacggcccgccaagaacggcaccgugauggacgugaucucgaggcgggaccaacgcgggaguggccaggucggcaccuacagccugaauaccuucacgaacauggaggcccagcugaucaggcagauggaguccgaggggaucuuuagccccuccgagcucgaaacccccaaccuggcggagcgcgugcuggacuggcuggagaaguacgguguggagaggcugaagcgcauggcuaucagcggagacgacugcgucgugaagccgaucgacgacagauucgcaacugcgcugaccgcccucaacgacaugggcaaggugcgcaaagacaucccccagugggagcccuccaagggguggaacgacuggcagcagguccccuuuugcucccaucauuuccaccagcugaucaugaaggacggccgggagaucguggugccgugccgcaaucaggaugagcucguaggccgggcacgcguaucgcaaggggccggcuggucccuacgggagacggcaugccugggcaagagcuacgcucagauguggcaacugauguauuuccaccgccgggaucugcgccuggcggccaacgccaucugcucugccgugcccgucgacuggaucccgaccagccggaccaccugguccauccaugcgcaucaccaguggaugacgaccgaggacaugcugagcgucuggaaccgcgucuggaucgaggagaaccccuggauggaggacaagacccacaucuccagcuggggugacgucccuuaccucgguaaacgagaggaccaguggugcggcucacugaucggcuugaccgcgcgggcaacgugggccaccaacauacagguggccaucaaccaggugcgccggcucaucgggaacgagaacuaccuggauuacaugaccagcaugaaacgcuucaagaacgaguccgaccccgagggcgcccugugguga

SEQ ID NO: 23852 - RNA, 9879 nt, Artificial Sequence
  derived and/or modified CDS sequence (opt11) from DENV-1__HM181952__SS-prME
agcguuaccauguuacugaugcugaugccuacugcccuggcauuccaccucacaacccgggguggggagccccacaugaucgugagcaagcaggagcggggcaaaagucuacucuucaagaccagcgccggcgugaacauguguaccuuaauugccauggaccugggugagcuuugcgaggacaccaugaccuacaagugcccuaggaucaccgaggccgaacccgacgacguagacugcuggugcaacgccacggacacgugggucaccuacgguacgugcagccagaccggcgagcacaggcgagagaaacgguccguggcccucgcgccccacguaggccugggccucgagacgcgcaccgagaccuggaugagcuccgagggcgccuggaagcagauccagcgagucgagaccugggcccuccgccaucccggguucacgguaaucgcacucuuccuagcgcacgccaucggcaccagcauaacccagaaggggaucauauucauucucuugauguuagugacccccuccauggccaugcggugcgucggcaucggcagccgcgacuucguggaggggcucuccggugcuacguggguggacgucguucuggagcaugggagcugcgugaccaccauggcuaaggacaagcccacccuggacaucgagcuccuuaagacggaggucaccaaccccgcggugcugcggaagcucugcaucgaggcaaagaucaguaauacaacaacggacagccgaugcccgacccagggcgaggccacccuaguggaggagcaggacgccaacuucgucugucggcgcacuuucguugacagaggaugggguaacggcugcgggcuguuuggaaaagggucccuccugacgugugccaaauucaagugcgucaccaagcucgaaggcaagaucguccaguacgagaaccuaaaguauucagugauugugaccguccacacaggcgaccaacaccaggugggaaaugaguccaccgagcacggaaccaccgcgaccaucacgccccaggcccccacgaccgagauccaguugacagauuacggggcccugacacucgauuguagcccccgcacgggccuggacuucaacgagaugguucugcucaccaugaaggagaaguccuggcugguccacaagcaaugguuccuggaccucccccugccuuggaccagcggagccuccaccucccaggagaccuggaaccgccaggaccugcucguaaccuuuaaaaccgcccacgcgaagaagcaggaagucgugguacugggcucacaggagggagcgaugcacacagcccugacgggggccaccgagauccagaccuccggcaccacuaccaucuucgccgggcaucucaaaugccgauugaagauggacaagcugacucucaagggcaugagcuacguaaugugcaccggguccuucaagcuggaaaaggagguagcggagacacaacacggcaccgugcugguucagaucaaguaugagggcacagacgcccccugcaagauccccuucagcacccaagacgagaaaggugugacgcagaacggccgguuaaucaccgcgaacccgauagucaccgacaaggagaagcccgucaauauagaggccgaaccgccauuuggggaguccuacaucgugaucggcgcgggcgagaaagcacucaaacuaagcugguuuaagaaggggaguagcaucgguaagauguucgaggccaccgcccgcggggccaggcgcauggcuauccucggugacacggccugggacuucggguccaucggcggcguuuucacgagcgucgggaagcucgugcaccagaucuucggcaccgccuacgggguccuguucuccggcgugagcuggaccaugaagaucgggaucggcgugcugcucacguggcuuggccugaacagucgcagcaccucccucagcaugaccuguaucgccguggggcuggucacccucuaucucggcgucauggugcaggcggacuccggguguguuauaaacuggaagggccgggaacuaaagugcgggagcgguaucuucgugaccaaugaaguccacaccuggaccgagcaguacaaguuccaggcggacagcccgaagcgccuuucggccgccaucggaaaggcuugggaagagggggucugcggcauccggagcgcgacccgccucgagaacaucauguggaagcagauuuccaacgagcugaaccauauacugcucgagaacgauaugaaguucaccgugguggucggggacguggcgggcauccuggugcaggggaagaagaugauccggccccagccaauggaguacaaguacagcuggaaguccuggggcaaagccaaaaucaucggcgccgaugugcagaauucuacguucauuaucgacgggcccaacaccccggagugccccgacgaccagcgcgccuggaauaucugggagguggaggacuacggcuucggaaucuucaccaccaacaucugguuaaagcuccgggauuccuacacacaggugugcgaccaucgucucaugagcgccgccaucaaggacuccaaggccguccaugccgacaugggcuacuggaucgagucagagaagaacgagaccuggaagcuggccaaggcguccuucauagaggugaagaccugcaucuggccuaagucacauacccucugguccaacggagugcuagagagcgagaugaucauucccaagauccacggcggcccgaucucccagcacaacuaccggcccggguacuucacucagaccgccggccccuggcaccucgggaagcucgagcuggauuuugaccuaugcgagggcacgacggucgugguggacgaacacugcggcaacagggggccaagccuccggacgaccaccgucaccggaaagaucauccacgagugguguugccgcuccugcacgcugccgccccugcgguuccgcggggaggauggcugcugguaugggauggagauccggcccgugaaggagaaggaggagaaccucgugaaguccaugguaagcgcagggaguggagagguggacagcuucucccuggggcuucucuguaucagcaucaugauagaggagguaaugcgcucccgguggagcagaaaaauguugaugacuggcaccuuagcugucuucuuccuccugaucaugggccaacugaccuggaacgaccucauccgguugugcaucauggugggcgccaacgcgucggaccgcauggguaugggcacgaccuacuuggcccucauggccaccuucaagaugcgaccgauguucgccgucggacugcuguuccggcgccucaccagccgggagguccugcugcuuacgaucggacugucccugguggcaagcguggagcucccgaacucccuggaagagcugggcgacgggcucgcgaugggcauuaugauccugaagcugcuaaccgacuuccagagcuaccagcuaugggccacacuucuaagcuuaacuuucaucaagacgacguucagucugcauuacgccuggaagaccauggcaaugguccuuuccaucgugagccuguucccccugugucucuccaccacgagccagaaaaccaccuggcugcccguucuacucggcucgcuggguugcaagccgcugacuauguuucucauagcagagaauaagaucugggggcgcaaguccuggccccugaacgaggggaucauggccgugggcaucgugagcauacugcucucuagccugcugaaaaaugaugucccucucgccgggccccugaucgccggcggcaugcugauagccugcuacguaauauccgggagcuccgcggaccucagcuuagaaaaggccgcugagguguccugggaggaggaagccgagcacagcggcgccucccacaauauucugguggagguccaagaugacgggacgaugaagaucaaggacgaggagagagacgacacccucaccauccugcuaaaagcgacccuccuggccguaagcggcgucuacccgcuauccauccccgccacccuuuucguguggcacuucuggcagaagaagaagcagcgcagcggggugcugugggacacgccuagccccccugaggucgaacgagccgugcuggacgacggaaucuacaggauaaugcagcggggccugcucggacgcagccaggugggcgucgggguguuccaggagaacguguuccacaccauguggcacgugacccggggcgcagugcugauguaccaggggaagcgccuugagcccucaugggcgagcgugaagaaggaccucaucuccuauggcggcggguggcgguuacagggcagcuggaauaccggggaggaaguccagguuaucgccguggagcccgguaagaacccuaagaacguccagacggcccccgggaccuuuaagaccccugagggugaggugggcgcgaucgcccuggacuucaaacccgggaccuccgggucacccaucgucaaccgugaggggaagaucguuggccucuacggcaacgggguggugacgaccagcggcaccuacgucuccgccaucgcucaggccaaggcaagccaggaggggccgcugccugagaucgaagacgagguguuucggaagcggaaccugacuaucauggaccuccaucccggauccgggaagacgcggcguuacuugccggcgaucguaagggaggccaucaagcgcaagcugcggacccucauccuggcccccacccgcgugguggccagcgagauggccgaggcgcugaagggcaugccgauccgcuaccagaccacggcagugaagagcgaacacaccggaaaagagaucgucgaccugaugugccacgcaaccuucacuaugcggcugcugagccccgugcgcgugccgaacuacaacaugaucaucauggacgaggcccacuucacugaccccuccagcaucgccgcgcgaggguacaucagcacccgcguaggcaugggggaggccgccgcgaucuucaugaccgcuacgccgccggguagcauggaggcauucccgcaguccaaugccgugauccaggacgaggagcgggacauucccgagagaagcuggaacuccggguacgaguggaucacggacuuccccggcaagaccgucugguucguccccagcaucaaggccggaaacgacaucgcuaacugccucagaaagaaugggaagcgcgugauacagcugucccguaagaccuuugacaccgaguaccagaagacgaagaacaaugacugggacuacguggucacgacagacaucagcgagaugggggcgaacuuucgcgccgaccgggugaucgauccucgccggugccugaaacccgugauuuuaaaggacgggcccgagcgcgucauucuggccggcccaaugccggugaccguugccuccgccgcgcagcggagggggagaauuggccgcaaccacaacaaggagggcgaccaguacauauacaugggacaaccccugaacaacgacgaggaccaugcccacuggacggaggcgaagaugcuccuggacaacaucaauacgcccgagggcaucauccccgcccuguucgagccggagcgggaaaaauccgccgcgauugacggggaguaccgacuccgcggcgaggcccggaagaccuucguggagcucaugcgucgcggggaccuccccguguggcucuccuacaaggucgcgagcgagggcuuccaguacucagaccgccgguggugcuucgacggcgaacgcaacaaucaggugcuugaggaaaacauggacguggagaucuggaccaaggagggggagcggaagaagcugcgcccccgguggcucgaugcccgcacguacuccgacccgcuggcccugagagaguucaaggaguucgcggcgggcaggcggagcgucuccggugaccucauccuggagaucggcaagcugccgcagcaccucacacagcgugcccagaacgcucuggauaaccuggugaugcuccacaacagcgagcaaggcgggcgggcguaccgccacgccauggaggagcugccugacaccaucgagacccuuaugcuccuggcccugaucgccgugcucacgggcggggucacccuuuucuuccugucaggcaagggacuaggcaagaccagcaucggucugcugugcgugauggccuccucggugcuguuguggauggcguccgucgagccccacuggauagccgccagcaucaucuuggaguucuuccucauggugcuucugauccccgagccggaccggcagcgcacgccccaggacaaccaguuggccuacguggucauagggcugcuguucaugauccucacgguggccgcgaacgaaaugggcuugcuggagacgaccaagaaggaucucgggaucggacacguggccguagagaaccaccaucacgcggccaugcuugacguggaucugcaccccgccagcgcguggacccucuacgccguggccaccacaaucaucacccccaugaugcggcacaccaucgagaacacgaccgccaacaucucacugacggccauagcgaaucaggccgccauccugaugggguuagauaagggcuggcccauuuccaagauggacaucggcguaccccugcuggcccucgggugcuacucacaaguuaacccccugacccugaccgcagcuguccucaugcugguggcccacuacgcuauugugggcccggggcugcaagccaaggcgacgagggaggcucagaagcggacugccgccggcaucaugaagaaccccaccaucgacgggauuguggccaucgaccucgaccccgucguguacgacgcgaaguucgaaaaacagcugggccagauuaugcugcucauccugugcacaucccagauccugcucaugcgcacgaccugggcccugugcgaguccaucacccuggccaccggccccuugacgacauugugggaggggucaccuggcaaguucuggaacacuacgaucgccgugagcauggccaacaucuuccgaggauccuaccuugcgggggccggccucgcguucagccugaugaaaagccucgggggaggacgcagggggacuggggcccagggcgagacccuaggcgaaaaauggaaacggcagcugaaccagcuguccaagagcgaguucaacaccuacaagcgcagcgggaucauggaggucgaucggagcgaggccaaagaaggacugaaacgcggggagaccacgaagcacgccguuuccagaggcaccgccaagcuccgcugguucguggagcggaaccuggucaaacccgaaggcaaggugaucgaccuuggaugcggucgcgggggcuggagcuacuacugugcgggucucaaaaaaguuaccgaggucaaaggcuacaccaagggcgggccuggccacgaggagcccauccccauggcaacguacggguggaaccuggucaagcugcacuccggcaaggacguguuuuucauaccgcccgagaagugcgacacccuccugugcgacaucggggagagcagucccaaccccaccaucgaagagggccggacacugcgcguccucaaaaugguagagcccuggcugcgggggaaucaguucugcaucaagaucuuaaaccccuacaugcccagcguagucgagacgcucgagcagaugcagcgcaagcacggcggcaugcuuguucggaacccgcuauccagaaacuccacgcacgagauguacugggucucuugcgggaccggcaacauaguuagcgcggugaacaugaccucacggaugcuacugaaucgcuucaccauggcucacagaaagccuacauacgagcgugacguggaccugggggcagguacacgccacgucgccguagaacccgagguggcgaacuuagacaucaucggccagagaaucgagaacauuaagcacgagcacaagagcaccuggcauuacgacgaagacaaccccuacaagaccugggcguaccacggguccuacgaggucaagccgucgggcuccgccagcuccauggugaacggggucgugaagcugcugacgaagcccugggaugugaucccaauggucacccagaucgccaugaccgacaccacgcccuucggucaacagcgcguguucaaggagaagguggacacccggaccccgaaggccaagcgcgggaccgcccagaucauggaggucacggcucgguggcucuggggcuuccugagucgcaauaagaagccccggaucugcacccgcgaggaguucacacgcaaggugcgcagcaacgccgcaauuggcgcaguguucgucgacgagaaccaguggaacagcgcaaaggaggccguugaggacgaccguuucugggaccuaguacaucgcgagcgggagcuccacaagcaagggaagugugcgaccugcgucuauaacaugaugggcaagagagagaagaagcugggggaguucggcaaggccaaagguucgcgcgccauaugguacauguggcugggcgcgcgauuccucgaguuugaggcccugggcuucaugaacgaggaucacugguucucgcgggagaacagccuguccggggucgagggcgaagggcuucacaagcugggauacaucuugcgcgacauaucaaagauccccgguggcaacauguacgcugacgacacagccggcugggacacccggaucaccgaggacgaccuccagaacgaggccaagaucaccgacaucauggagccggagcacgcgcuacuggccaagucaauauucaagcucacuuaccagaacaaggugguccgcguucagcggcccgccaagaacggaaccgugauggauguaaucagccgccgcgaccagcggggcucgggccagguaggcaccuacggccuuaacaccuucacgaacauggaggcccagcuuauccgccagauggagagcgagggaaucuuucucccuaacgagcuggagacccccaaccuggccgagcgggugcuugacuggcuggagaaguacggcgucgagcgccuuaaacggauggcgauauccggggacgacugcgugguuaagccgauugacgaccgcuucgccaccgcguugacagcucugaacgacauggggaagguccggaaggacaucccccagugggagcccagcaaaggguggaacgacuggcagcagguccccuucuguucccaucacuuccaccagcugaucaugaaagacgggcgcgagaucguggucccgugccggaaccaagacgaauuggugggccgcgcccgggugagccagggggcgggcuggucccugcgcgagacggccugucugggaaagucguacgcccagauguggcagcucauguacuuccaccggcgagauuuacggcuggccgcgaacgccaucugcagcgccgucccaguggacugggugcccaccucccgcaccacguggagcauccacgcccaccaccaguggaugacgacagaagacauguuauccgucuggaaccggguguggauugaggaaaaucccuggauggaagacaagacccgcaucagcuccugggaggacgugccguaccugggaaagcgggaggaccagugguguggaagccugauuggucucacggcccgcgcgacgugggccaccaauauccaaguggccaucaaucagguccgcaggcugaucggcaacgagaacuacuccgacuacaugaccagcaugaagagguucaagaacgaguccgagcccgagggggcccugugguaa

SEQ ID NO: 23853 - RNA, 9879 nt, Artificial Sequence
  derived and/or modified CDS sequence (opt11) from DENV-1__HM181953__SS-prME
agcgugacaaugcugcucauguugaugcccacggcgcuagcuuuucacuugacuacccggggcggggaaccucacaugauagugagcaaacaggaacgaggcaagucccuccuguuuaaaaccagcgcgggaguaaacaugugcacgcucauugccauggaucugggcgagcugugugaggacacgaugacuuacaagugccccaggaucaccgaggccgagcccgacgacguggacugcuggugcaacgccacagacacgugggugaccuacgggaccugcucgcagaccggcgagcaccgucgcgacaaacgguccguugcguuagcgccacacguggggcugggucuggagacgaggaccgagaccuggaugagcagugaaggcgcauggaagcagauacagcggguggagaccugggcccuccgccaccccggauucacggugauugcucuauuccuggcccacgccauaggcaccagcauaacccagaaagggauaaucuucauccuauugaugcugguuacccccuccauggccaugcgaugcgucggcaucggcagccgugacuuuguggaagggcucuccggcgcgacuuggguggacgucguacuugagcacgggaguugugugaccaccauggccaaggacaagccgacgcuagauaucgagcucuuaaagaccgaggucaccaaccccgcuauccugcggaaacucugcauagaggccaagaucuccaacaccaccacggacagccguugcccgacucagggcgaggcgacucuaguggaagaacaggacgcuaacuuuguaugccgccgcacguucgucgaucggggcugggggaauggcugcgggcuguucggcaaggggucccuuauaaccugcgccaaguucaaaugcguuacuaaacuugagggcaagaucgugcaauacgaaaaccugaaauacagcgucaucgugaccgugcacaccggugaucagcaccagguggggaaugaguccacggagcacggcaccacggcuaccaucacgccacaggcccccacgacagagauacagcucaccgacuacggggcccugacccuagacugcagcccccgcacgggccucgacuucaacgagaugguucuucugacgaugaaggagaaaucauggcucguccauaagcaaugguuccucgaccugccccuacccuggacaagcggugccucgacuucucaggagacauggaacaggcaggaccugcuuguaaccuucaagaccgcacacgcgaaaaagcaggagguggucgugcucggaucacaggagggggccaugcacaccgcccugaccggcgccaccgaaauccagaccagugguacuacgaccaucuucgccgggcaccugaagugucgguugaagauggauaagcuaacccugaagggcaugagcuacgugaugugcaccggguccuucaagcucgaaaaggaggucgcggagacccagcacggaacggugcugguacaaaucaaguacgagggcacugacgcacccuguaagauccccuucagcacacaggacgagaaagggguaacgcaaaacggccggcugauaacugcgaacccgaucgugacagacaaggagaagcccgugaauauugaagccgagccgccuuuuggagaguccuacaucguaaucggcgccggcgagaaagcacugaagcucagcugguucaagaaggggucaucuaucgguaagauguuugaagccaccgcgcgaggggcccggcgcauggcgaucuugggcgacacggccugggacuucggguccaucgguggcgucuucaccaguguggggaagcugguccaccagaucuucggcaccgccuacgggguccucuucuccggggugucauggaccaugaagauagggaucgguguccugcugacauggcuuggccugaacucucguucuacuucccugagcaugaccugcaucgccguugggcucgugaccuuguaccugggaguaaugguccaggcggacuccggcugcgugaucaauuggaagggccgcgagcucaagugcgggagcggaaucuucguuaccaacgaagugcacaccuggaccgagcaguacaaauuccaggccgacagcccuaaacgccuguccgccgccaucgguaaagcaugggaggaaggcgugugcggcauccggagcgccacccgccuggaaaacaucauguggaagcaaauuuccaacgaguugaaccacauccuguuagaaaaugacaugaaguucaccgucguggugggcgacgucgcgggcauccucguacaggggaagaagaugauccguccccagccaauggaguacaaauacagcuggaagucguggggcaaagccaagaucauaggggcggacguccaaaacacgaccuucaucaucgacgggcccaacaccccggaaugccccgaugaccagcgcgccuggaauauaugggaagucgaagacuacggcuucggaaucuucaccaccaauaucuggcuuaaacuuagggacagcuacacccagguuugugaucacaggcucaugagugcggcgaucaaggauagcaaggcuguacacgccgauauggguuauuggaucgaauccgagaagaacgagacguggaagcuggcccgggcgaguuucaucgaggugaagaccugcauauggccgaagucucacacguuauggucgaacggagugcuagaaucggagaugauuauccccaagaucuacgguggcccgauaucacagcacaacuaccggcccggguauuuuacccaaacagccggccccuggcaccuaggcaagcuggagcuagacuucgaccugugugagggcacaacggucgucguagaugagcacugcggaaaccggggcccgucccuccgaaccaccaccguaaccggcaagaucauccacgaguggugcugccguagcuguacgcugccacccuugcgcuuccgcggugaagacggcugcugguacggaauggagauccguccggucaaggagaaggaggagaaccucguuaaguccauggugagcgccggcagcggcgaggucgacagcuucagucucgggcugcuguguauuuccaucaugaucgaggaggugaugcggagcagauggucccggaaaauguugaugaccgggacccuggcuguguuccugcucuugaucauggggcagcugacguggaaugacuugauccggcugugcaucauggucggcgcaaacgcgagcgaucgcauggggaugggcacuaccuaucuggcccucauggccacguucaagaugcggccgauguucgcagugggccugcuguuccgccggcucacgucgcgagagguucuacugcucaccaucgggcugagccugguggccucaguugagcuccccaauagccuggaggaacuaggugacgggcuggcgaugggcaucaugauccugaaguuacucaccgauuuccagagucaccagcugugggcaacccuguuaagucugacguuuaucaagaccaccuuuagccugcacuaugccuggaagaccauggcgaugguccucagcaucgugagccuguuuccucugugccucagcacgaccucucagaagaccaccuggcugcccgugcugcucggcagccuggguugcaagccacuuacaauguuccucauagcggagaacaaaaucuggggccggcgcaguuggccccugaaugaagggaucauggccgucgggaucgucagcauacuccucagcucccugcuuaagaacgaugugccccucgccggaccgcugauagccggcggcaugcugaucgcaugcuaugucauaagcggguccagcgccgaccucucccuggaaaaggccgccgaaguuucuugggaagaggaggcggagcacuccggugccagccacaacauacucguggagguccaggacgacggaaccaugaagaucaaagacgaggaacgagaugauacccucaccauccugcugaaggcgacacuccuagccgugucuggcguguacccacugagcaucccugccacccucuucguaugguauuucuggcagaagaaaaagcagcgcuccggcgugcuaugggauacccccagcccgccggagguggagagggccguccuggacgacggcauauaccgaaucaugcagcggggccuguuagggcgcagccaggugggugugggggucuuccaggagaacguguuccacaccauguggcacgugacccggggcgccguccugauguaccaagggaagcgccuggagcccucaugggcguccgugaagaaggaccucaucucuuacggaggaggguggcgguuacaagguagcuggaauacgggggaggaggugcaggucauagcaguggagcccgggaagaaccccaagaacgugcaaaccgccccuggcacauucaagacgccggagggagaagucggcgccaucgcucuggacuucaagcccgggaccagcggcucgccuaucgugaacagagaggggaagaucguuggccucuacggcaaugguguggugaccacuucaggcacuuaugugagcgcaaucgcccaggccaaagccagucaggaggggccgcugcccgaaaucgaggacgaagucuuucggaagcggaaccugacaaucauggaccuacaccccggcagcggaaagacccggagauaucugccggccaucgugcgggaggccaucaaacgcaagcugcgaaccuuaauccucgcaccgaccaggguggucgccuccgagauggccgaggcguuaaagggcaugccuauccgcuaucagacgaccgccgucaagagcgagcauaccggcaaggagauuguggaccucaugugucacgccacguuuaccaugcggcugcugaguccuguacgcgugccgaacuauaacaugaucauaauggacgaggcccacuucacagaccccagcucgaucgcugcccggggguauaucagcaccagaguggguaugggggaggccgcagcaaucuuuaugacggcuacgccgcccggcuccguagaggcauucccgcagagcaacgcggugauccaagaugaggagcgggacauaccugagcgcucauggaauagcggcuaugaguggaucaccgacuuccccggcaagacggucugguucguccccuccauaaagagcggcaacgauaucgcgaacugccuucggaagaacggaaagcgcgugauucaacuguccaggaagaccuucgacacggaguaucaaaagaccaagaacaacgacugggauuacgugguuaccaccgacaucucggagaugggagcgaauuuccgagcagacagggugauagacccuaggaggugccucaaaccggugauccuuaaggacgggccugagcgcgucauauuggccggccccaugccgguaacggucgcuucggccgcccaacguagagggcggauuggccgaaaucauaacaaggagggcgaccaguacaucuacauggggcagccacugaacaacgacgaggaucaugcgcacuggacugaggcuaagaugcuccuggacaauaucaacacccccgaggggauuauccccgccuuauucgagccagagcgcgaaaaguccgcggccaucgacggggaguacaggcuccgcggggaggcccggaaaaccuucguagaacugaugcguagaggagaccugcccguuuggcuuuccuacaaggucgcgagugagggcuuucaguacagcgauagaaggugguguuuugacggcgagcgcaauaaccaaguacuugaggagaacauggacgucgaaauuuggaccaaagagggggaacggaagaagcugagaccccgauggcucgaugcucgcaccuacuccgauccccuggcccugcgagaguucaaggaguucgccgcgggccgacgcagcgucucuggugaccucauccuggagaucggcaagcugccucaacacuugacccagcgcgcucaaaaugccuuggacaaccuugucaugcuccacaacucugagcagggcggacgggccuacaggcacgccauggaggaauugccggacaccaucgagacgcugaugcuccuggcccugaucgccgugcucaccggcggggucacccuguucuuucucaguggccggggguugggcaagacaagcaucggccugcuaugcgugauggccuccagcgugcuccuauggauggccuccguugagccgcauuggaucgcggccagcauuauacuggaguucuuccucauggugcuguuaauccccgagccggaccgccagcggacgccgcaggauaaucaacucgccuacgucgucauugggcuucuguucaugauccugacgguggccgcgaacgagaugggccuauuagagacuacgaagaaggaucucgggaucggccacguggccguugggaaccaccaccaugccgccaugcuggacguggaucuccacccugccuccgccuggacccucuacgccguagccacgacaaucauuacuccgaugaugcgccauaccauugagaacacgaccgccaacaucagcuuaacagccaucgcgaaccaggcggcaauccugaugggccucgauaagggcuggcccauuuccaagauggacaucggggucccccugcuugcacucggcugcuacagucaggugaacccccuuacccugacggccgcggugcuaauguuggucgcccacuacgccauuaucggaccugggcuucaggccaaggccacacgcgaggcgcagaagcggacggccgccggcaucaugaaaaauccgaccgucgacggaaucguugccaucgaccucgacccugucguguacgaugccaaguuugagaagcaacugggucagaucaugcugcugauccucugcacgucccagauccugcucaugaggaccaccugggcucugugcgagucuaucacccuugccacugguccccugacuacccuaugggagggcucccccgggaaauuuuggaauacuacgaucgccgugucgauggccaauaucuuccggggguccuaccuagcuggcgcgggucuggccuuuucacugaugaagucccuaggcggaggccgccgggggaccggcgcccaaggcgagacccucggggagaaguggaagagacaguugaaccagcuauccaaacuagaguucaauacguacaagcgaagcggcauaauggaaguagacagguccgaagccaaagaggggcugaagagaggggaaacgaccaagcaugcggugagccgcgggacggccaagcugcggugguuuguugagaggaaccuugucaagccugagggcaaggugauugaccucggcugcggucgugguggauggucauacuacugcgcgggccugaagaaggugaccgaggucaagggguacaccaaaggcggacccgggcacgaagaacccaucccgauggcgaccuacgguuggaaccuggugaagcuccacucaggaaaagacguguucuuuaucccacccgagaagugcgacacccugcuuugcgacaucggggaaucuagccccaauccgacaaucgaggaagggcgaacgcuccgggucuugaaaaugguggagcccuggcugcgcggcaaccaguuuuguaucaaaauccucaaccccuacaugcccuccguagucgagacacuggaacagaugcagaggaagcauggcggcauguuaguacgcaacccguuaagccggaacuccacccacgaaauguacuggguuagcugcggaaccgguaacauagucuccgccguaaacaugacgucucgcaugcugcugaaccgcuucaccauggcgcaccggaagccgaccuaugagagggacguggaccucggugcuggcacccggcacgucgccguagagccggagguggccaaucuggacaucaucgggcagagaauugagaacaucaagcacgagcacaaguccaccuggcacuacgaugaggacaaucccuacaagaccugggccuaccacggcuccuacgaggucaaaccguccgguagcgcguccucgauggugaacggaguggugaagcuccugacaaagccaugggacgugaucccaauggucacccagaucgccaugacagacacgacccccuucgggcagcagcggguguucaaggagaaggucgacacccgcaccccgaaagccaagcguggcacggcccaaaucauggaggucaccgcuaagugguuauggggcuuccuaucucgcaacaagaagccccggauaugcacccgcgaggaguuuaccaggaagguucgguccaacgcggccauaggggccguguuuguagacgaaaaccaguggaacucagcgaaggaagcgguggaggaugagagguucugggaccucguccaccgcgagcgggagcugcacaagcaagguaagugcgccacaugugucuacaacaugauggggaaacgugagaagaaacugggcgaguucgggaaggccaaaggcucccgggcaauuugguacauguggcucggcgcucgcuuccuggaguuugaagcgcuuggguucaugaaugaggaccauugguucagccgcgagaacucccugaguggcguggaaggggaaggacugcacaaacuggguuauauccuccgagacauauccaagauccccggcggcaacauguaugcugacgacaccgcgggcugggacacgcggaucacggaggacgaucuacagaacgaggcccgcaucacggacauuauggagccggagcacgcccugcuagccaagucuaucuucaagcugacuuaccagaacaaggugguccgcguccagagacccgccaagaauggcaccguaauggacgucaucucccgcagagaccaacgcgggucgggucaggugggcacguacgggcugaacacguuuacaaauauggaggcgcagcucauucggcagauggaguccgagggaaucuucagucccuccgaacuagagacccccaaccuggccgagcgagugcucgacuggcuggagaaguauggagucgagcggcugaaacgcauggccaucucgggcgaugauugugugguuaagccgaucgacgaucgguuugcgaccgcccuuacugcgcugaacgauauggggaaaguccgcaaggauauaccgcaaugggagcccucgaaaggcuggaacgauuggcagcagguccccuucugcagccaucacuuccaccagcucaucaugaaggacggacgugagaucguggugccgugccgcaaccaggacgagcuaguggggcgggcccgcgugucgcagggcgcgggguggagccugcgggaaaccgccugucuaggcaagucauacgcccagauguggcagcuuauguacuuccaucgccgugaccuucgucuagccgcgaacgcgaucugcuccgccguacccguggauuggauccccaccucacgaaccacgugguccauccacgcccaccaccaguggaugaccacugaggacaugcucagcguguggaacagagucuggaucgaggaaaaccccuggauggaggacaagacacacauaucaagcuggggcgaugugccguaccugggcaagcgagaggaccaauggugcggcucacugaucgggcucacggcucgggcuacgugggcaacgaauauccagguagcuauaaaucaaguacgccgguugaucggcaacgagaacuaccuggacuauaugaccucuaugaagcgcuucaagaacgaguccgacccggagggggccuuaugguga

SEQ ID NO: 23854 - RNA, 9879 nt, Artificial Sequence
  derived and/or modified CDS sequence (opt11) from DENV-1__KF921933__SS-prME
agcgugaccaugcuucucaugcugaugccuaccgcucuggccuuccacuugacgacccgcggcggagagccgcacaugaucgucuccaagcaggagcggggcaagagccugcuguucaagaccuccgcgggugugaauaugugcacccucaucgccauggaccugggggaguuaugcgaggacacuaugacguacaagugcccccgcaucaccgaggcugagcccgaugacguggacugcuggugcaacgccacugacacgugggucacuuacgggaccugcagccagaccggcgagcacaggcgcgauaagcgguccguggcccucgcgccccacgugggccuggggcuggaaacgcgcaccgagaccuggaugagcuccgagggcgccuggaagcagauucagcgcgucgagaccugggcgcuccgccauccgggguucaccgugauugcccuguuucuggcgcaugccaucggcaccagcauuacccagaaagggaucaucuucauucuccugaugcuggugacccccuccauggccaugaggugcguuggcauuggcucgcgggacuucguggaggggcucuccggggccacguggguggacguggugcuggagcacgggagcugcgugacgaccauggcaaaagacaagcccacccucgacaucgagcuucugaagacggaagucaccaaucccgcgauccugcguaagcucugcauagaggccaagaucuccaacacaaccacggauagcaagugcccgacccagggcgaggcgacccugguggaagaacaggacgcuaacuucgugugccgccggaccuucgucgaccgcggcugggggaacggcugcgggcuguucggcaaggggucacucaucacgugcgccaaguucaagugugugaccaagcuggagggcaagaucguacaauacgagaaccugaaguacagcgucaucgugaccgugcacaccggcgaccagcaccaagucgggaacgaauccacggagcacggaacuaccgcgaccauaacaccccaggcccccacgaccgagauccaacucaccgacuauggggcccugacccuggauugcagcccccguacuggccuugacuucaaugagaugguccugcugaccaugaaggagaaguccuggcuuguucacaagcagugguuucuggaccucccgcuccccuggaccagcggggcaagcaccucccaagagaccuggaaccggcaggaccugcuggugaccuucaagaccgcacacgcgaagaagcaggagguggucgugcucggcagccaggagggcgcuaugcauacagcgcugacgggggccaccgagauccagaccuccggcaccacgaccaucuucgccgggcaccugaagugccggcucaaaauggacaagcugacccugaaaggcaugagcuacguuaugugcaccggguccuuuaaguuggagaaggagguugcugagacgcagcacggcaccgugcuggugcagaucaaguacgaaggcaccgacgcccccugcaagauccccuucagcacccaggacgagaagggagucacgcagaacggccgccugaucaccgcuaacccgauagugaccgacaaggaaaaacccgugaacaucgaggcagagccacccuucggggaauccuacaucguaaucggcgcgggcgagaaggcccugaagcucuccugguuuaagaagggguccuccaucggcaagauguucgaggcuaccgcccgcggggcccgccguauggcaauccugggcgacacggccugggacuucgggucgaucggcggaguguucaccucgguggggaagcugguccaccagaucuucggaacggccuaugggguacucuucucgggcgugagcuggaccaugaagaucgggaucggcguccugcugacguggcucggccugaacucccgcagcaccagccugagcaugaccugcauugcugucgggcuaguaacgcuguaccugggugucauggugcaggccgacuccgggugcgugauaaacuggaagggccgcgagcucaagugcgggagcggcaucuuugucacgaacgaggugcacaccuggaccgagcaguacaaauuucaggcggacagcccgaagcggcuguccgccgccaucggcaaagccugggaagagggggugugcggcauucgcucggccacuagacuggagaacaucauguggaagcagaucuccaacgagcucaaccauauccugcuggagaacgacaugaaguucaccgucgucgugggggacgucgcgggcauccucgcccaggggaagaagaugauccgcccccaacccauggaguauaaguacagcuggaaauccuggggcaaggccaagaucaucggcgcagacgugcaaaacacgaccuuuaucaucgacgggcccaacacccccgaaugccccgacgaccagcgggcguggaacaucugggagguggaggacuacggcuucgggauuuucaccacgaacaucuggcugaaacuucgcgacucauacacccaggucugcgaccaccggcucaugucagccgcuauaaaggacagcaaagcugugcacgcagacaugggcuacuggaucgaauccgagaagaacgagaccuggaagcuggcacgcgcgagcuucaucgaggugaagaccuguauuuggcccaagucccacacgcuguggagcaacggaguccucgaguccgagaugauaauccccaagaucuacgggggcccaaucucucagcacaacuaccggcugggguacuucacccagaccgccggccccuggcaccucgggaaguuagaguuggacuucgaccugugugagggcaccacgguuguggucgaugagcacugcggcaaccgcgggcccucccuccggaccacuaccgugacgggcaagaucauccacgaguggugcugccgcagcugcacccugccgccccugcgcuuccgcggggaggacggcugcugguacgggauggagauccggcccgugaaggagaaagaggagaaccucgucaaguccauggugagcgccggcagcggcgagguggacucuuuuagccuggggcuguugugcaucuccaucaugauugaggaggucaugcgcucgcgguggucccgcaagaugcugaugaccggcacccuggcuguguuccuccuacugaucauggggcagcucacuuggaacgaccuuauccgguugugcaucaugguuggcgcaaacgccagcgaccgcauggggauggggacgaccuaccuggcccucauggccacuuuuaaaaugcgccccauguucgccgucggccuacucuuccggcgccucacgucccgggaggugcugcuccugaccaucggacugagccucguggcguccguagagcuuccaaacagccuggaggagcucggugacgggcuggccaugggcauaaugauacugaagcuccucaccgacuuccagucucaccaacugugggccacucuccugagccugacuuucauuaagacuaccuucucccuccacuaugccuggaaaaccauggcaaugguucuguccauagucucccuguucccccucugccugucgacgaccucccagaaaaccaccuggcugcccgugcuccugggaagccucgggugcaagccucucaccauguuccugauugccgagaauaagaucuggggccgcaggucauggccgcugaacgaggggaucauggccguggguaucgucagcauacuccugucgucccugcucaagaacgacgugccccuggccgggcccuugaucgccggcggcaugcucaucgcgugcuacgucaucaguggguccagcgccgaccugucccuggagaaggcugccgaggucaguugggaggaggaggccgagcacagcggcgcgucucacaacauccugguggaggugcaggacgacggaaccaugaagauuaaggacgaggagcgcgacgacacucugaccauccuguuaaaggccacccuguuagcugucuccggcguguacccccucagcaucccggccacuuuguucguaugguacuucuggcagaagaagaagcagcgguccgggguccugugggacacccccaguccacccgagguagagcgcgccgugcuggaugacgggaucuaucggaucaugcagcgcggucuccuggggaggucccaggucggcguugggguguuccaggagaacgucuuccacaccauguggcacgugacccgcggagcggugcugauguaccaggggaagcgucucgaaccaagcugggccagugucaagaaggaccugaucagcuacggcggcggguggcgccugcagggcuccuggaacacgggagaggagguacaggugaucgccgucgagcccggcaagaaucccaagaaugugcagacugcacccgggacauucaaaacaccggagggcgaagugggcgccauugcccucgacuucaagcccgggacgagcggcuccccaaucgucaaccgggaggggaagaucgugggccuguacgguaacgggguggucaccaccucuggcacguacgugagcgccaucgcccaggccaaggcgagucaggaggggccacugccggagaucgaggacgaaguguucagaaaacggaaucucacgaucauggaccugcaucccggcagcgggaagacccgccguuaccugcccgccaucguccgcgaggccauaaagcggaagcuccgcacccugauacuagccccaacccgcgugguggccucugagauggccgaggcccucaagggcaugcccauccgguaccagacgaccgcugucaagagcgaacacaccggcaaggaaaucguggacuuaaugugccacgccaccuucacgaugcgccugcucucccccgugcggguccccaacuacaacaugaucaucauggacgaagcccauuucaccgacccgagcucgaucgcggcccgcggguacauaagcacccgagugggaaugggugaggccgccgcuaucuuuaugaccgcgacgccacccggauccguggaggccuucccccaaagcaaugccgucauccaggacgaggagcgcgacaucccggagcgguccuggaacagcggguacgaauggauuaccgacuuccccggaaagaccgugugguucgugcccuccaucaagagcggcaaugauaucgccaacuguuuacgcaagaacggcaagcgggugauccagcugagucgcaagaccuucgacacagaguaucagaagaccaagaacaaugacugggacuacguggugaccacggacaucagcgagaugggcgcgaacuuccgggccgaccgcgucaucgacccccggcgcugccucaagccggugauccuaaaggaugggcccgagagggugauccuggcugggcccaugccggucaccguggccucugcggcgcagcgccgggggcgcaucggucggaaccacaacaaggagggagaccaguacaucuacauggggcagccgcucaacaacgacgaggaccacgcccacuggaccgaagcaaagaugcugcuggacaauaucaacacccccgaggguaucauccccgcccucuucgagcccgagcgggagaaaagcgccgcgaucgacggagaguaccgccugcggggagaggcccggaagaccuucgucgagcugaugcggcgcggggaucucccggugugguuguccuacaaaguggccucggagggcuuccaguacuccgaccgccgcuggugcuucgacggcgagcggaacaaccagguccuggaggagaacauggacguagagaucuggacgaaggagggugagcgcaagaagcuccggccccgcuggcuggaugcccggacuuacuccgacccacuggcccuccgcgaguucaaagaguucgcggccggccggcgcagcguauccggggaccugauccucgagaucggcaaacuuccacagcaucugacccagcgggcccagaacgcacuagacaaccucgucaugcugcacaauagcgagcagggcgggcgcgcguaccgacacgcuauggaggagcugccggacaccaucgagacgcucaugcugcuggcccucaucgccgugcucaccggcggggugacccuguucuuccucuccggccgaggccugggaaagaccucuaucggccugcucugcgucauggcuaguagcguacugcuguggauggcguccguggagccccacuggaucgccgccucuaucauccucgaguucuuccugaugguccugcucaucccagagcccgaccggcagaggaccccgcaggacaaccagcuggccuacguggugaucgggcuacucuucaugauccugacggucgcagcgaacgagaugggccugcucgagaccacgaagaaggaccuggggaucggccacguggccguugggaaccaccaccacgccgccaugcuugaugucgaccugcaccccgccuccgccuggacccuguacgccguugccacgaccauaaucacccccaugaugcgucacacuaucgagaacacgacggccaacaucagccugaccgccaucgcgaaccaggccgccauccucaugggccuggacaagggcuggccgaucucaaagauggacaucggggugccgcugcucgccuuaggaugcuacagccaggugaacccccugacccuaacggcggccgugcugaugcugguggcccacuacgccaucauagggcccggccuucaggccaaagcuacccgcgaggcacagaagcgcacggccgccgggaucaugaagaacccgaccgucgacgggaucguggcgaucgaccuggaccccguggucuacgacgcgaaguucgagaagcagcugggccagaucaugcuccugauccuuuguacgucccagauccuccugaugcggacaacgugggcccugugcgagagcaucacccucgccaccgggccccugacgacccugugggagggaagcccggggaaguucuggaauaccacgaucgccgugagcauggcgaacaucuuucggggcuccuaccucgcgggcgcugggcuggccuucagccugaugaaaagccucggcgggggccggcgcgggaccggcgcacaaggcgaaacgcugggggagaaguggaagcggcagcugaaccagcucucuaaaagcgaguuuaacaccuacaagcgcucaggcaucauggagguggaucggagcgaggcgaaggaggggcugaaacgcggcgagacgaccaagcacgcggucucccgggggacugccaagcugcgcugguucguggagcggaaccuagugaagccugagggcaaggugaucgaccucgguugugggcgcggcggguggagcuacuacugcgccggccugaagaaggugacagaggugaagggguacacgaagggcggccccgggcaugaggagcccauccccauggcuaccuacggcuggaaccugguuaagcuccauuccgggaaggacguguucuucaucccgcccgagaagugcgacacccuguuaugcgacaucggcgagagcucccccaaccccaccaucgaggaaggccggacgcuccgcguccugaagauggucgagccguggcugcggggcaaccaauucugcaucaagauccucaaccccuacaugcccagcgugguggaaacccuggagcagaugcagcgcaagcacggcgggaugcugguccggaauccgcugucccgcaacagcacccacgaaauguacuggguguccugcggcaccgggaacaucgugagcgcggucaauaugaccucccggaugcugcugaaccgcuucacgauggcucaccgaaagccgacguacgagagagacguggaccucggcgccggcacccgccacguggccgucgagccugagguggccaauuuagacauuaucgggcagaggaucgaaaacaucaagcacgagcacaagagcaccuggcacuacgacgaggacaaucccuacaagacgugggcguaucauggcuccuacgaggugaagccuagcggauccgcuagcucaauggugaacggcguggucaagcuccucaccaaaccgugggacguaauccccaugguuacccagauagcaaugacagacacaaccccuuucgggcagcaaagggucuucaaggagaagguggacacccggacccccaaggccaaacgcggcacggcccagaucauggaggugaccgcgaaaugguuguggggcuuccugucccggaacaagaaaccgcgcaucugcacccgggaggaguucacccgcaagguccggagcaacgccgccaucggggccguguucguggacgagaaccaguggaacuccgcgaaagaggccgucgaagacggcagauuuugggaccucgugcaccgggagcgcgaacugcacaagcaggggaagugcgccacaugcgucuacaacaugaugggcaagcgggagaagaagcugggggaguucggcaaggccaagggcucgcgggccauuugguauauguggcucggggcgcgguuccuggaguucgaagcccugggcuucaugaacgaggaccacugguucucccgcgagaacagccucucuggggucgagggcgaagggcugcacaaauuaggcuacauccuacgggacaucagcaagauccccggcgggaacauguacgccgacgacacagccggcugggacacccgaaucaccgaggacgaccuacagaacgaggcccggauaacggacauaauggaaccagagcacgcgcugcucgccaagucaaucuucaagcugaccuaccagaauaagguugugcggguccagcgcccagccaagaacgggaccguuauggacguuaucagccggcgcgaccagcgggguucaggccaggucgggaccuacggccucaauacguucaccaacauggaggcccagcucauacgucagauggagagcgagggaaucuucucccccagcgagcuggagacccccaaccuggccgagcggguguuggauuggcuggagaaguacggcguggagcgccugaagcgcauggcgauauccggagacgacugcgucgugaagcccaucgacgaucgcuucgccaccgcccucacggcccugaacgacauggguaaggugcggaaggacaucccgcagugggagcccagcaagggcuggaaugacuggcagcagguccccuucugcucccaccacuuccaccaacugaucaugaaggacgggcgcgagaucguggugcccugccggaaccaggacgagcucgucggacgcgcccgagugagccagggggcgggcuggagcuugcgagagaccgcuugccuagggaaguccuacgcccagauguggcagcucauguacuuccaccgacgugaccugcggcuggccgcgaaugccaucugcagcgcuguaccgguugacuggauccccaccucccgcaccacauggucuauucacgcccaccaucaguggaugaccaccgaggacaugcucucaguauggaaccguguguggauugaggagaaccccuggauggaggacaagacccacaucagcuccuggggcgaugucccguaccugggcaagcgcgaggaccaguggugcgggagcuugaucggccucaccgcccgcgcgaccugggccaccaacauccagguggccaucaaccaggugcggcgccugaucgggaacgagaauuaccuggacuacaugaccuccaugaagcguuucaagaacgagagcgacccagagggcgcccucugguga

SEQ ID NO: 23855 - RNA, 9879 nt, Artificial Sequence
  derived and/or modified CDS sequence (opt11) from DENV-1__HM181954__SS-prME
agcguuaccaugcugcucaugcugaugcccaccgcccuggccuuucaccuuacgaccagaggaggggaaccgcacaugaucgugagcaagcaggagcggggcaagagccugcuguucaagacgagcgccggagugaacauguguacccucauugccauggaccugggggagcugugcgaggacaccaugaccuauaagugcccccguaucaccgaggccgagccggacgacguggacugcuggugcaacgcuacugacaccugggugacguacgggaccugcagccagaccggugagcaucggcgcgacaagcgguccguggcccucgcgccacauguggggcuggggcuggagacacgcaccgaaacauggaugagcuccgagggugccuggaagcagauucagcguguugagaccugggcgcuccggcacccuggguucacggugaucgcccuguuccuggcccacgccaucgguaccagcauuacccagaaggggaucaucuucauccuccuaaugcuggugacccccuccauggccaugcgcugcguuggcaucgguagccgcgacuucguggagggucucuccggcgcaacuuggguggacgucgugcuggagcaugggagcugcgugaccaccauggccaaggauaagcccacccuggacaucgaacucuugaagacggaggucacaaaucccgcuauccugcggaaacuuugcaucgaggcaaagaucuccaauaccaccaccgacagccgaugcccuacccagggcgaggcaaccuuaguggaggagcaggacgccaacuucguguguagacgcaccuucguugaccggggcugggggaacggcugcggacuguuuggcaagggaucacucaucacuugcgccaaguuuaagugcgugaccaagcuggaggggaagaucgugcaauacgagaauuuaaaguacagcgucaucguuaccguccacaccggggaccaacaucaggucgggaacgaguccacggagcacggcaccacugcgaccaucacgccucaggcccccacgaccgagauccaacucaccgacuacggggcccugacccuggacugcagcccccgcacgggccucgacuucaacgagauggugcuucugacgaugaaagaaaagagcuggcucguacacaagcaaugguuccuagaccugccccuccccuggacuccaggggccaguaccucucaggagacguggaaucgacaggaccucuuagugacguucaagaccgcucacgcgaaaaagcaggagguagucgugcucggaucccaggagggagccaugcacaccgcccugacuggugcaacagagauacaaaccagcggcacuacgaccaucuucgccggacaccugaaaugcaggcugaaaauggauaagcugacccugaaggggauguccuaugucauguguaccgggagcuucaagcucgagaaggaaguagcggagacgcagcacggcaccguucugguucaaaucaaguacgaaggaaccgaugcccccugcaagaucccguucuccacccaggaugagaagggggucacgcagaacggccggcugaucaccgcuaaccccaucgugaccgacaaggagaagcccgucaacaucgaggcggagcccccguucggggaaaguuacaucgucaucggggcgggagagaaggcguugaagcucaguugguucaaaaaggggucauccaucggcaagauguuugaggccaccgcccgcggggcacggcgcauggcgauccucggcgauacggccugggacuucgggagcaucggcggcguauucaccuccgugggaaagcugguccaccaaaucuucggcgccgccuacgggguccucuucagcggcguguccuggaccaugaagaucgggaucggcgucuuacuaaccuggcucggacugaacucgcgcagcaccagccugucuaugacaugcauagccguggggcucgucacccuguauuuaggcgucaugguucaggcggacagcggcugcgugauuaacuggaagggccgggaguuaaagugcggauccggcaucuucgucaccaacgaggugcacacguggaccgaacaguacaaauuccaggccgacucacccaaacgucugagcgccgccaucggcaaggccugggaggaggggguuugcgguauccgguccgcgacgcgccuggagaacaucauguggaagcagaucagcaacgaacucaaucacauccuguuggaaaacgacaugaaguucacuguaguggugggggaugucgcgggcauacucgcccaggggaagaagaugauccggccgcagccuauggaguacaaguacuccuggaaguccuggggcaaggccaagaucaucggcgcggacgugcagaacaccacauucaucauagacgggccuaacacgcccgaaugccccgacgaccagcgcgccuggaacaucugggaagucgaggacuacggcuuugggaucuucaccacaaacaucugguuaaagcugcgggacuccuacacgcaggcuugcgaccaccgcuuaaugucggccgccauaaaagacuccaaggcuguccacgccgacauggguuacuggaucgagucagagaagaacgagaccuggaaguuagcgcgggccuccuucaucgaggugaagacauguauuuggcccaagagccacacucugugguccaacggcguauuggaaagcgagaugaucauuccgaagaucuacgggggucccauaagucagcacaauuaucgacccggcuacuucacgcagaccgccgggccguggcauuuagggaaacuggagcucgacuucgaccugugcgagggcacgaccguggugguggacgagcacugcggcaaucgagggcccucucugcgcacgacgaccgucaccgggaagaucauacacgaauggugcugccgguccugcacgcuuccgccccuccguuuccgcggugaggacggcugcugguacgggauggagauucgccccguaaaggagaaggaggagaaucuggucaaaaguauggucuccgcgggcagcggcgagguggacucuuucucccuggggcugcugugcaucucgauaaugaucgaggaggugaugcgaagucgcuggagccggaagauguuaaugaccggcaccuuggccgucuuccugcuccucaucaugggucaauugacuuggaaugaccucauucggcuguguaucauggugggcgccaacgccucggaccgcaugggaaugggcacgacauaccuggcccucauggcgaccuucaaaaugcgccccauguucgccgugggucuguuguuccgccggcucaccagccgggaaguacuguuacuaacuaucgggcugucccucgucgccaguguggagcuucccaacagucuggaggaacugggcgacgguuuggccaugggcaucaugauacugaagcugcucacggacuuccagagccaccagcucugggcgaccuugcugagucugacguucaucaaaacgaccuucagucuucacuacgccuggaagaccauggcuauggucuuaaguaucgugucacuguuuccgcucugcuuaucuaccacgucgcagaagaccacgugguugccgguccugcucggcagccuggggugcaagccgcugaccauguuccucaucgccgagaauaagaucugggggcggcguuccuggcccuugaacgaggguaucauggccguggguaucgucucgauccuacuuucgagcuugcugaagaaugacguuccccuugcgggcccauugauugccggcggaaugcugauugccugcuacgugaucuccggguccagcgccgaccucagccuggagaaagccgcagaagugucaugggaggaggaggccgagcacagcggggcuucacacaauauccucgucgaagugcaggacgaugggacaaugaagaucaaggacgaggagcgggacgacacccucaccauacugcugaaggcaacucuccuagccgugagcggcguauacccccuguccaucccugcgacccuauucgugugguacuucuggcagaagaagaagcagaggagcggggugcugugggacacgccauccccgccggaggucgagcgggccguucuggacgauggcauuuaccgcaucaugcagcggggccugcucgggcgcucacaggugggcgucgggguuuuccaggaaaacguguuccacacgauguggcacgucacucggggcgcagugcugauguaccaggggaagcgucucgaaccgucgugggccagcgucaagaaagaccucauauccuacggcggcggguggaggcugcagggcucguggaacaccggggaggagguacaggugauagccguggaacccggcaaaaauccgaaaaacguccagaccgcgcccgggaccuucaaaaccccugagggcgaggugggagccauugcccuggacuuuaagcccggaaccagcggcagcccaaucgugaaucgugaggggaaaaucgucggccucuacggcaacgggguggugacgacauccggcacuuacgucagcgcuauugcacaggccaaggccagccaggaagggccccugccggagaucgaagacgaaguguuccggaagcgcaaccugacgaucauggaccuccaccccggcuccgggaaaacgcgucgcuaucuaccugcaaucgugcgggaggcuaucaagcguaaacugcguacgcucauacuggcgcccacccgugucguggccagcgagauggccgaagcucugaaaggcaugcccauucgcuaccaaaccacggccgugaagucagagcacaccgggaaggagaucguagacuugaugugccacgcgacuuucaccaugcggcuacuuagcccgguacgcgugcccaacuacaacaugaucauuauggacgaggcucacuuuacggaccccuccucuaucgccgcccggggguacaucuccaccagggucggcaugggagaggccgcagccaucuuuaugaccgccacgccgcccggcucaguggaggcguucccccaaucuaacgccgugauccaggacgaggaacgggacauccccgagaggucuuggaacuccggguacgaguggauuacggacuuucccggcaaaaccgucugguucgugcccagcaucaaguccgggaaugauaucgcaaauugccuccggaaaaacgggaagcgcguaauccaguuaagccguaagaccuucgacaccgaguaccagaagacgaagaauaacgacugggacuacgucgugaccaccgacauuuccgagaugggcgccaauuuucgcgccgaccgggugaucgacccgcgccggugccugaagcccgucauacucaaggacggacccgaacgagugauccucgccggcccgaugcccgugacggucgcgagcgcugcgcagcggcgcgggcggaucgggcgcaaccacaacaaagagggugaccaguacaucuacauggggcagccccuaaacaacgaugaagaucacgcccacuggacggaggccaagaugcuccuggacaacaucaacaccccugagggcaucaucccggcgcuguucgagccagagcgcgagaaguccgccgcaauagacggggaauaccggcuccgcggugaggcccggaagaccuucguggagcuuaugcgccgcggcgaccugccugucuggcucaguuacaaaguggccuccgagggauuccaguacucagaccgccgguggugcuucgauggagagcgcaacaaccaggugcuggaggagaacauggauguagaaauuuggaccaaggagggggaacguaagaaacuccgaccgcgguggcucgacgcccgcacguacagcgacccgcuggcuuugcgggaguucaaggaguucgccgcaggccgcaggagcgugucgggcgacuugauucuggagaucggcaagcugccucagcaccucacccagcgcgcucagaacgcacuggacaaucuggugauguugcacaacuccgagcagggcggcagagccuacagacaugcgauggaggaacugcccgacaccaucgagacacuuaugcuccuggcccugaucgcaguccugacgggcggggugacccuguucuuccugagcggucggggcuuggguaagaccagcaucggcuugcugugcguuauggccaguuccguuuuacucuggauggccagcguggagccacacuggaucgccgcgucaaucauccuugaguucuuccuuaugguccugcugaucccggagcccgaccgccagcggacgccgcaggacaaucagcucgcauacguggugaucgggcugcuguucaugauccugaccguggccgccaacgaaaugggucugcuggagacgacaaagaaggauuuaggcauaggccacgucgccguggggaaccaccaccacgccgcgaugcuggaugucgaccugcacccggccuccgcguggacccucuacgcagucgccaccacgaucauaacccccaugaugagacauaccaucgagaacacuacggcgaacaucucccugaccgcuauugcuaaccaggccgcgauacugaugggccucgacaagggcuggcccaucagcaagauggacauagggguuccauugcuggcccucggcugcuacucccagguaaacccguuaacccugaccgccgccguccucaugcuggucgcccacuacgcaauaauagggcccggcuugcaggccaaggccacgcgcgaggcccagaagcggaccgccgcggggaucaugaagaaccccaccguggacggcaucgucgcuauagauuuagauccugucguguacgacgcgaaguucgagaagcaacugggccagaucaugcugcucauccugugcaccagccagauccugcucaugcgcaccaccugggcccucugcgaguccaucacccuggcaaccggaccgcucacgacccugugggaaggaagccccgggaaauucuggaacaccaccaucgcggucagcauggccaacaucuuucggggcagcuacuuggccggugcagggcucgcguucucccuuaugaagucccuuggcgggggccgccgggggacgggcgcccagggcgagacccucggggagaaguggaagaggcagcugaaccagcugagcaagucggaguucaacacguacaagcggagcggcaucauggaaguggaccgcucagaggccaaagagggacucaagcggggagagaccacuaaacaugccgucagccgcgggacagccaagcugcggugguucguugagcgcaaucuagugaaacccgagggcaaaguuaucgaccugggcugcgggcggggcgggugguccuauuacugcgcggggcuuaagaaggucacagaggugaaaggguacaccaaagggggucccgggcacgaggagccaauccccauggcgacguacggcuggaaccuggugaaacugcacagcgggaaggacgucuucuuuaucccgcccgagaaaugcgauacccuccucugcgacaucggcgaguccagcccgaaccccaccaucgaggaggggcgcaccuuacgggugcucaaaaugguggagccguggcugcgcggcaaccaguucuguaucaagauccugaaccccuacaugccuuccguuguggagacgcucgagcagaugcagcggaagcacgggggaaugcugguccgcaacccgcugaguagaaacaguacucaugaaauguacugggucagcuguggcaccgggaacaucguguccgccgugaacaugaccagccgcaugcuccuuaaccgauucaccauggcccacagaaagcccacguacgagcgcgaugucgaccucggggcuggcacccggcacguagcgguggagcccgagguugccaaccucgacaucaucggacagcgcauagagaacauaaagcaugagcacaaguccaccuggcacuacgacgaggacaacccguacaagacuugggccuaccauggcucuuaugaaguaaagcccuccgggagcgccagcucgaugguuaauggcgucgugaagcugcugacgaagccaugggacguaaucccaauggugacccaaaucgccaugacugauacaaccccguucggucaacagcgagucuucaaggagaagguagacacucgcaccccuaaggcaaagcggggcaccgcccaaaucauggaggugacagccaaguggcuauggggauuccucagccgaaacaagaagccccggauaugcacccgagaggaguucacccggaaggugcgcuccaacgcggcgaucggggccgucuucguggacgagaaucaguggaacagcgccaaagaggccguggaggacgagcgguucugggaucugguccaccgcgaacgggagcuccacaagcagggcaagugugcuaccugcguguacaacaugauggggaagagagagaaaaagcugggagaguuugguaaggccaagggcucucgggccaucugguacauguggcuuggcgcacgcuuccucgaguucgaggcgcugggauucaugaacgaggaccacugguucucucgggaaaauucccugagcggaguugaaggggaggggcuccacaagcugggguacauccugcgcgacaucuccaagaucccgggaggcaauauguacgccgaugacacggcuggcugggacaccagaaucaccgaggacgaucuccagaacgaggcuaggaucaccgacaucauggagccugagcaugcgcugcuggcuaagagcaucuucaaguuaacuuaccagaacaaggucguccgcgugcagcggcccgcaaagaacggcaccgucauggacgugaucagucgccgggaccaacgcgggagcggccaggugggaacuuauggguugaacacguucacgaacauggaggcgcaguugauucggcaaauggagucagagggcauauuuagcccuuccgagcucgaaacacccaaccuugccgagcgcguccuagacuggcuugagaaguacgggguagagcggcugaagcgcauggccaucagcggcgacgacugcguggucaagcccaucgacgacagauuugccacggcccugaccgcgcucaacgacauggguaaggugcgcaaggacaucccacagugggagccauccaagggcuggaaugacuggcagcaggucccguucuguagccaccauuuccaucaauuaaucaugaaggacggccgggagaucgucgugcccugcaggaaccaggaugagcuggugggacgggcccgcgucucacagggcgccggguggagccuccgggagacggccuguuuaggcaagucuuacgcgcaaauguggcagcucauguacuuccaccgccgggaccuccgccuugcugcaaacgccaucugcuccgccgugcccguggauuggauccccacgagccggaccacuugguccauacaugcccaccaccaguggaugacgacugaggacaugcugagcguuuggaacagaguguggauugaggagaacccguggauggaagacaagacccacaucuccucguggggcgacguccccuauuuaggcaagagagaagaccaguggugcggcucucugaucggccuuaccgcccgggccaccugggccaccaacauacaagucgcaaucaaucaggugcgccgcuugaucggcaaugaaaacuaucuggacuacaugacaaguaugaaacgguuuaagaacgaguccgaccccgagggggcacucugguga

SEQ ID NO: 23856 - RNA, 9879 nt, Artificial Sequence
  derived and/or modified CDS sequence (opt11) from DENV-1__HM181955__SS-prME
ucugugaccaugcugcucaugcugaugcccaccgcccuggcauuccacuugacuacccggggcggggaaccccacaugaucguguccaagcaggagcggggcaagagccugcuguuuaagaccuccgcaggggugaacauguguacccucaucgccauggaccugggcgagcugugcgaggacacgaugaccuacaagugcccacgcaucaccgaggccgagcccgaugacgucgacugcugguguaacgccaccgacacguggguaaccuacgggacgugcagccagaccggcgagcaccggcgggacaaacguucgguagcccucgcgccccacguuggccuggggcuagagacgcgcaccgagaccuggaugucaagugagagugccuggaagcagauccagcgggucgagaccugggcccuccgccacccuggcuucacggugaucgccuuguuccuggcucacgccauagggaccuccaucacccagaagggcaucaucuucauccuccuuauguuagugacccccagcauggccaugcggugcgucgggaucggcucccgagacuucguggagggccucagcggggccacuuggguggacgucguguuagagcacggcuccugcguuacuaccauggcgaaggacaagcccacgcuggacauagagcuccugaagacggaagucaccaaccccgcgauacugcggaagcucugcaucgaggccaagauaagcaacaccaccacggacucccgcuguccgacccaaggugaggccacccugguggaggagcaggacgccaacuucgugugccggaggaccuuugucgaccggggcuggggcaacgggugcggccuguucgguaagggcucacucaucacaugcgccaaguucaagugcgugaccaagcuagaggggaagaucgugcaguacgagaaccugaaauacucugucauagugacugugcacacuggcgaccagcaccagguuggcaacgagagcaccgagcacgggacaacggcgacuaucacgccucaggcccccacgaccgagauccaguuaacggacuacggcgccuuaacccuugacugcucgccccggacggggcucgacuucaacgagaugguccugcugaccaugaaggagaagucguggcucguucacaagcagugguuccuggaccugccccuccccuggaccagcggcgccuccaccagccaggagacauggaaccggcaggaccuucugguaacuuucaagaccgcccacgcaaagaagcaggaggugguuguguuggggagccaggagggcgccaugcacaccgcccugacaggcgccaccgagauccagaccucagggaccacaaccaucuucgccggccaccuuaagugucgccuuaagauggacaagcuuacccugaaggggauguccuaugugaugugcaccggcagcuucaagcucgagaaggaggucgcggagacgcagcacggcacagugcuggugcagaucaaguacgagggcaccgacgcccccugcaagauccccuucuccacucaggaugagaagggugucacgcagaacggucggcugaucaccgccaauccgaucgugacagacaaggaaaagcccgugaacaucgaagccgagccaccguucggugaaaguuacaucgucaucggggcgggcgagaaggcccugaagcucuccugguucaagaagggcagcuccaucgggaagauguucgaggccaccgcccgcggcgcccgacgcauggccauccugggggacacggccugggacuucggcucaaucggaggcguguucaccuccguaggcaagcugguccaccagaucuucgggaccgcuuacggcgugcuguucagcgggguaucguggacuaugaagaucggcaucgguguccugcugacauggcucggccugaacagccgcuccaccagccugucaaugaccuguaucgccguaggacucgucacacuguaccugggggucaugguccaggccgacagcggcugcgugaucaacuggaagggacgggagcucaagugcggcucggggaucuucgucacaaacgaggugcacaccuggaccgagcaguacaaguuccaggcggacaguccaaagcgccugagcgccgccaucggcaaagccugggaggaaggagugugcgggauacgauccgccacccgcuuggagaauaucauguggaagcaaaucagcaacgaguuaaaccauauccugcuggagaacgacaugaaguucaccgucguaguuggcgaugucgcgggaauacucgcccagggcaagaagaugauccggccccagcccauggaguacaaguauuccuggaaguccugggggaaggccaagaucaucggcgcugacgugcagaacacgaccuucaucaucgacggacccaacacuccggagugcccagacgaccagcgcgcguggaacaucugggagguggaggacuacggguucggcaucuucacuacgaacaucuggcuuaagcuacgggacuccuacacccaggucugcgaccauagguuaaugagcgcagccaucaaggacuccaaggccgugcacgccgacaugggguauuggaucgaguccgagaagaaugagacauggaaacuggcacgggcauccuuuaucgaggugaagaccugcaucuggccaaagucucacacucuguggucgaacggcguccuagagagcgagaugaucauccccaagaucuacggcgggcccaucucccagcacaacuaccgccccggcuacuucacccaaaccgccggacccuggcaccuggggaaacuggaacucgacuucgaccucugcgaggggacuacagugguggucgaugagcacugugggaaccgggggccgagccugcgcacaaccaccgugacggggaagauuauccacgaguggugcugccgguccugcaccuuaccgccacuccgcuuccggggcgaagacgggugcugguacggcauggagauccgccccgugaaggagaaggaggagaaccuggugaagagcauggucagcgccggguccggcgaaguggacaguuucagucucggacugcuaugcaucagcaucaugaucgaggaggucaugcggucccguuggucccggaagaugcucaugaccgggacccuggugguguuccugcuccuuaucaugggccagcugacguggaacgacuuaauccgccucugcauaauggucggggccaacgcgagugaccgcaugggcaugggaacuaccuaccuggcgcucauggccaccuucaagaugcgaccgauguuugcaguggguuuacuuuucagacggcugacgucccgcgaggugcugcugcucacuaucggccugucccuggucgccagcguggagcuucccaacucccuggaggagcugggugacggacuggcuauggggaucaugauccugaagcugcucacggacuuccagagccaucagcugugggccacccuuuugucccuuacguucaucaagaccaccuuuagccugcacuacgccuggaagaccauggccauggugcuuuccaucgugagccuguuuccccugugcuuguccacgaccagccagaagaccaccuggcugcccgugcugcucggcucccugggcugcaagccacugacgauguuccucaucgcggagaacaagauuugggggcggagaaguuggccccugaacgaggggaucauggccgucgggaucgugucaauccugcucuccagccugcugaagaacgaugucccuuuagccggcccccugaucgccgggggcaugcucauagccugcuacgucaucagcggcagcuccgcggaccucagccuggagaaggccgccgagguguccugggaggaggaggccgagcacagcggggcuucccacaauauucuaguggagguccaggacgacggcaccaugaagaucaaagacgaggagcgggacgacacccucaccauccugcugaaggcgacgcuucuggcggugagcggcguuuacccgcugucgauccccgccacccucuucgucugguauuucuggcagaagaagaagcaacggagcggcgugcugugggacaccccgagcccgcccgaggucgagcgggccguccuggacgacgggaucuaccguaucaugcagcgaggccugcucggccgcagccagguugggguaggcgucuuccaggagaacguguuccacaccauguggcacgugacccgcggagcgguccucauguaccaaggcaagcgccuggagcccuccugggcgucggugaagaaggaccucaucaguuacgggggcggcuggcggcugcaggggaguuggaacacgggagaggagguccaggucaucgccguggagccugggaagaaccccaagaacgugcagacggcccccggcacguucaaaacuccugagggggaggucggcgccauugcccuggacuucaagcccggcacguccggcucucccaucgugaaccgcgagggcaagaucguggggcucuacggcaacggcgucgugacaaccagcgggaccuacguguccgcgauagcccaggccaaggccucgcaggagggcccgcugcccgagaucgaggacgaggucuuccguaagcgcaaccugacgauaauggaccuccaccccggguccggcaagacacgccgcuaucugccggcgaucgugcgggaggccaucaagcgcaagcugcgcacccucauccuggcccccacccggguagucgccuccgaaauggccgaagcgcugaaagggaugccuauccgcuaccaaacgaccgccgugaaguccgagcacaccggcaaggagaucguggaccucaugugccacgcgaccuucacgaugcggcugcugagcccuguccgcgugccaaacuacaacaugaucauaauggacgaggcccacuucaccgaccccucuagcaucgccgcgcggggcuacaucucuacgcgcguggggaugggcgaggccgcagccaucuuuaugaccgccacgccgcccggcagcgucgaggcuuucccgcaguccaacgccgucauucaagacgaggagcgcgacauccccgagcgcagcuggaacuccggcuaugaauggaucaccgacuuccccgggaagaccgugugguuuguccccagcaucaagagcggcaaugacaucgccaacugccuccggaaaaacggcaaacgcgugauccagcugagccggaaaaccuucgacacggaauaccagaagaccaagaacaacgacugggacuacguggucaccaccgacaucuccgagaugggggccaacuuccgcgccgaccgggugaucgacccgcgcagaugccuaaagcccgugauccucaaagacggccccgagcgcgucaucuuagccgggcccaugcccgugacgguagcguccgcggcucagcgucgcggcagaaucgggagaaaccacaacaaggagggcgaccaguauaucuacauggggcaaccccugaacaacgacgaggaccacgcgcacuggaccgaggccaagaugcuccuggauaauaucaacacucccgaagggaucauccccgcucuuuucgagccugaacgcgaaaagagcgccgccauagauggcgaguaccggcugcgcggggaagcgcguaaaaccuucguggagcuuaugcgccggggcgaccugcccgucugguugagcuacaagguagccucggaaggguuccaguacuccgaucgcagaugguguuucgauggcgagcgcaacaaccaaguacucgaggagaacauggaugucgagaucuggacgaaggaaggcgagcggaaaaagcugcgaccccgguggcucgacgcccgcaccuacagcgacccucuggcacuacgggaguucaaggaguucgccgccggucgccggucugucagcggcgaccucauacuggagaucgggaaguugccucagcaccugacccagcgcgcacaaaacgcgcuggacaaccuggugauguuacacaacagcgagcaaggcggccgcgccuaccgacaugcgauggaggagcugccagacaccaucgagacacugaugcuucuggcccugaucgccgugcucaccgggggaguaacccucuucuuccugagcggccguggccuugggaagaccuccaucggucugcuuugcgugauggccucuuccgugcuacuuuggauggccagcguagaaccccauuggaucgcagccagcaucauccuggaguuuuuccucauggugcugcugauccccgagccggaccgccagcggacgccccaagauaaccagcuagccuaugugguuaucggccugcuguucaugauccucacugucgcugccaacgagauggggcugcuggagaccaccaagaaagaccucggaauugggcacguggcaguuggcaaccaccaccacgccgccaugcuugacguggaccuccaccccgccagcgccuggacucuauacgcgguagccacuaccauaaucaccccgaugaugaggcacaccauugagaauacgacagccaacaucucccugacagccauugccaaccaggcagccaucuugauggggcucgacaaaggcuggcccaucagcaagauggacaucggcgucccccuucuggcccucgggugcuacucccagguaaacccccugacucuuacggccgcggugcucauguuggucgcccacuacgcuaucaucggaccggggcugcaggccaaggccacucgugaggcgcagaagcgaacugccgcgggcaucaugaagaaccccacgguggaugggaucguggccaucgaccucgaucccgucguguacgacgccaaguucgagaagcagcuggggcagaucaugcugcucauccugugcacgagccagauccugcucaugcgcaccaccugggcgcugugcgaguccaucacccuggccacgggcccucugaccaccuuaugggagggguccccgggcaaguucuggaacaccacgaucgccgugaguauggcgaauaucuuccgggggagcuaccuggccggcgccggccucgccuucagcuugaugaaaucccucggcggcgggcguagagggaccggcgcccagggcgagaccuugggcgagaaguggaagcgccagcugaaccaauugagcaaaagcgaguucaacacguauaagcggagcgggaucauggaggucgaccgcucugaggccaaggaaggguuaaagcgcggggagacgaccaagcaugcggugagccgaggcacagcuaaacugcggugguucguggagcgaaauuuggucaagccugaggggaaggugauugaccugggcugcggccgcggcgggugguccuacuacugcgcgggucuuaagaaagugaccgaagucaagggcuacacgaaaggcgggcccggccacgaagagcccauuccgauggccaccuacggauggaaccuggugaaguugcacucaggcaaagacguguuuuucauaccgcccgagaagugcgacacgcugcugugcgacaucggagagucuagccccaacccuaccauugaggagggccgcacgcugcgggugcucaagaugguggagcccuggcugcgcgggaaccaauucuguaucaagauccugaacccguauaugcccuccguggucgaaacccuugagcagaugcagcggaagcacggcggcaugcuggugcgcaacccucugagccggaacuccacccacgagauguacugggugagcugcgguaccggcaacaucguuucggcugugaacaugaccagccgcaugcuccugaacagauucacgauggcacaccggaagcccacguacgagagggacguggaccugggggccgggacacggcacgucgccguggagcccgaggucgccaaccucgacaucaucggccagcggauugagaacaucaagcaugaacacaaguccaccuggcacuacgacgaggacaaccccuacaagacgugggccuaucaugggagcuacgaagugaagccauccggcucggcguccuccauggucaacggggucguuaaacugcugacgaaacccugggacgucauacccauggucacccagauugccaugaccgacacuacccccuucggccagcaacggguguucaaggagaagguggauacccgcaccccgaaagccaagcgagggacggcgcagaucauggaggucaccgccaaguggcucuggggcuucuuaagccgaaauaagaagccccggaucugcacccgcgaggaguucacccggaaggugcggucuaacgcggccaucggcgccguguucgucgacgaaaaccaguggaacucagccaaggaggcgguggaggaugagcgcuuuugggauuuaguucacagggagcgggagcugcacaagcaggggaagugcgcuacgugcgucuacaacaugaugggaaagcgcgagaagaaacugggggaguucgggaaggccaaggggucccgggccaucugguacauguggcugggcgcccgcuuccucgaguuugaagcauugggcuucaugaacgaggaccacugguucagccgggagaacucacugucggggguggagggcgagggucuccacaagcugggcuacauucugcgcgacaucuccaagauccccggaggaaacauguacgccgacgacaccgccggcugggacacccggauaaccgaagacgaccuccagaacgaggcccgcaucaccgacaucauggaaccggagcacgcccuguuagccaagagcaucuucaaguuaaccuaccagaacaaggugguccgcgugcagcggcccgccaaaaaugguacggugauggacgucaucucccgccgggaccagcgcggcagcggccaggugggaacguauggccugaacaccuuuaccaacauggaggcccagcugaucagacagauggagagcgaggggaucuucagccccucagagcucgagacccccaaccuggccgagagggugcuggacuggcuagagaaguacggcguagagcggcugaagaggauggcgaucagcggggaugacugcguugugaagccgaucgacgaccgguucgcgaccgcccugacggcacucaacgacauggggaaggucagaaaagauaucccccaaugggagcccuccaagggguggaacgacuggcagcagguccccuucugcagccaccauuuccaccaacugaucaugaaggacggucgagaaaucgugguacccugucgcaaucaggacgaacugguggggcgggcacgugugagccagggggccggcuggucccuccgggagaccgcgugccugggcaaaagcuaugcccagauguggcagcugauguauuuucaccgccgcgaccucaggcuagcggccaacgcgaucugcuccgccguccccguggacuggauccccaccagccgaacaacaugguccauccacgcccaucaccaguggaugaccaccgaagacaugcugagcguguggaaccgcgucuggauugaggagaaccccuggauggaagacaagacccacaucuccagcuggggcgacgugccguaccucgggaagagggaggaccaguggugcggcuccuuaauaggccugacggcccgggccaccugggcgaccaacauccagguggccaucaaccaaguccggcggcucauuggcaacgagaacuaucuggacuacaugaccagcaugaagcguuucaaaaacgaguccgaucccgagggugcccuuugguga

SEQ ID NO: 23857 - RNA, 9879 nt, Artificial Sequence
  derived and/or modified CDS sequence (opt11) from DENV-1__HM181959__SS-prME
agcgugaccaugcuucuaaugcuuaugcccaccgcccuggcauuccaucuaacgacccgaggaggggaaccccauaugaucgucucgaagcaagaacgggguaaaucccuacuauucaagacgagcgcugggguaaacaugugcacccugaucgcaauggacuuaggggaguuaugugaagacaccaugacauacaaaugcccacgcaucacagaagcagaacccgacgacgucgacugcuggugcaacgcaacagacacguggguaacauacggaacgugcucccaaacaggggaacaccggcgagacaaacguagcguagcacuugcgccgcacgucggauugggucuagaaacccgcacagaaacguggaugucaagugaaucggcguggaaacagauccagcgaguagaaacuugggcacuucgacacccgggguucacagucauugcccuguuccuugcccacgcaauaggcacaagcauuacucaaaaaggcaucauauuuauccuccugaugcuggucacccccucuauggccaugcgaugugucggcaucgguagccgggacuucguugaagggcuauccggggcuacaugggucgacguaguacuagaacacgggagcugcguuacaaccauggcgaaagacaagccaacacuagauauugaacugcucaaaacugaagugaccaacccagcaauccuccgcaagcuaugcauagaagcaaagauuucaaauacgacgacggacucacgaugcccuacgcaaggggaagccacccugguggaagaacaggacgcaaacuuugucugucgccggacuuucgucgaccguggauggggcaacggcugcggccuuuucgguaagggauccuugaucacgugcgcaaaauucaagugcgugacaaaacuagaaggaaaaaucguccaauacgaaaacuugaaguauucugucaucgugacaguucacacaggagaucagcaccagguggggaacgagucaaccgagcacggaaccacugcuacgauaacaccgcaagccccgacgaccgaaauccagcucacagacuacggggcucuaacccuagacugcaguccaagaaccggccuagauuucaaugaaaugguccuacugacaaugaaagaaaaaucauggcucguacauaagcagugguuucuagaccugccacugcccuggaccucaggcgccucgacaagccaggagacguggaaccgccaagaccuccuggugacguuuaaaacagcacacgcgaaaaagcaagaagucgucguacuuggaucucaagagggugccaugcacaccgcccucacgggggcaacagaaauccaaacaucggggacuacaaccaucuuugcgggccaccuuaagugcaggcuaaagauggacaagcugacucuaaagggcaugagcuaugucaugugcacgggcuccuucaaacucgagaaggaaguagcggaaacccaacauggaacaguccugguccagaucaaauaugaaggcacugacgcgccauguaaaauccccuuuagcacgcaagacgaaaaggggguaacccaaaacggacggcugauuacggcaaaccccauaguuacggauaaggagaagcccgucaacaucgaggcagaaccacccuucggcgaauccuacauugucauaggggcaggagagaaagcacuaaaacuuucaugguucaaaaagggcucaagcaucggaaagauguuugaggccacggcacgaggggccagacguauggcgaucuuaggagacaccgcuugggacuucggguccauaggaggcgucuucacgagcguuggcaaacucguccaccaaaucuucggaacagccuacggcguacuauucagcggggucucuuggaccaugaaaaucggcaucgggguacuauugaccuggcugggccuaaacagccgcucuacaagccucagcaugacaugcaucgcaguaggccugguuacucuuuacuugggagucauggugcaggccgauagcggaugcguuauaaacuggaaaggccgcgaauuaaagugcggcagcgggaucuucguaacaaacgaaguccauaccuggacugaacaguacaaguuccaagccgacucgcccaaacgguugagcgcagcgauaggaaaggccugggaggaaggaguaugcggcauccgaagcgcaacgagguuggagaauaucauguggaagcaaaucagcaaugaauuaaaccacauuuuacuggaaaacgacaugaaguucaccguagugguaggcgacguugccggcauccuagcgcagggcaagaaaaugauccgaccacagccuauggaguacaaauacaguuggaagucuugggggaaggcaaaggucaucggagccgacguccaaaacacaacauuuaucauagauggaccgaacacgccugagugccccgacgaccaacgagccuggaacauaugggaaguagaagacuacggcuucggcauuuuuacgacgaacauuugguuaaagcuccgcgacagcuacacucagguaugugaccaucggcugaugucggcugcaauuaaagacuccaaagcuguacaugccgacaugggcuacuggaucgaauccgaaaagaacgaaacguggaaguuagcacgggccagcuucauagagguaaaaaccugcaucuggccaaagagucacacucuaugguccaacggaguccuagaaucugaaaugauaauuccgaaaaucuacggaggaccgauaagccagcauaacuacaggcccggauacuucacgcagacugcggggccauggcacuuaggcaaacuugagcucgacuucgacuuaugcgaaggcaccacgguugucguagacgaacacuguggcaaucgaggcccgagcuuacggacgacgaccguaaccgggaaaauaauacaugaauggugcugcaggucgugcacacuacccccacucagguuuagaggggaagacggcuguugguacggcauggaaauacgcccagugaaagagaaggaggagaaccuagucaaaucgauggugucugcaggaaguggagaaguggacagcuucucccuaggccuccuaugcauaaguauaaugauagaggaaguaaugagaucgcgauggucccgaaaaaugcuuaugaccgggacccucguaguauucuugcuacuaauaaugggacagcuuaccuggaacgaucuaauacgacuaugcaucaugguaggagcgaacgcaucugaccggaugggaaugggaacaacuuauuuagcucugauggcaacauuuaaaaugagaccaauguucgccgugggccucuuauucaggcggcugacgucccgggagguacuccuccucacgaucgguuuaagccuaguagcaucgguagagcucccuaauucccuggaagaacugggcgacggccucgcaauggguauaaugauccuuaaacuacugacagacuuucaaucccaccaacucugggcaacacuucugagccucacguucaucaaaacaacauucagccuucacuacgcguggaaaaccauggccaugguucuaagcaucguaucucucuucccucugugccuaagcaccacuagccagaaaaccacauggcucccaguccugcucggaucccucggauguaaaccacuaacaauguucuugaucgccgagaacaagauauggggcagaagauccuggccacugaacgagggaauaauggccgugggcauagucucgauucuucuauccagccugcucaaaaaugacguaccgcucgcgggcccccugaucgcggguggaaugcucaucgccuguuaugucauuuccggcagcucagcagaccucagcuuagaaaaagcagcggaaguuucaugggaagaagaagcggagcacagcggcgcaucgcacaacauauuaguugaaguccaagacgacgggacgaugaaaauaaaagaugaggaacgggacgauacacuaaccauacuccucaaggccacacugcucgcgguauccggggucuauccgcugagcaucccagcaacacucuucguaugguauuucuggcaaaagaaaaagcagcggucaggcgugcuuugggacacaccgucgccaccggaaguggaacgcgcaguacuggaugacgggaucuaccgaaucaugcagcguggccuacuaggccgcucccaagucggaguaggagucuuccaagaaaacguauuccacacaauguggcacgucacaaggggugcggucuugauguaccaaggaaaacggcucgaaccauccugggcaucugucaagaaagaccugaucaguuacgggggaggauggcgccuccaggggaguuggaacacaggugaagagguccaaguaaucgcaguugaacccgggaaaaacccgaaaaacguucaaacagccccaggaacguucaaaacgccggagggggaggugggcgcuauugcacuggacuucaaaccugggaccuccggcuccccaaucguaaacagagaaggaaaaauaguaggacuguaugggaauggcguggucaccacgagcgggacauacguuucggcgaucgcgcaagcuaaggcgagccaggaaggaccgcuucccgagaucgaagacgagguauucagaaaacguaaccucacgauuauggaccugcauccaggguccggaaaaacaaggagauacuuaccugcgauagugcgagaagccauuaagcguaaacuccgcacguugauacuagcuccgacaagagugguagccagugaaauggccgaggcgcucaagggcaugccaauaagauaucagacgacagcagucaagagcgaacacacaggaaaagaaauugucgacuugaugugucaugcaacauucacgaugcgccugcuaagcccgguccgcgucccaaacuacaauaugauaauuauggaugaggcgcacuucacagacccgagcucuauugcugcccgaggcuauaucagcacacgaguaggcaugggagaagcggccgccaucuucaugaccgcaacaccacccggaaguguggaggcuuuuccccaaagcaaugcggucauacaagacgaagaacgcgacauucccgagcgaucauggaacagcggauaugaguggauaaccgacuucccaggcaaaacaguaugguucgucccguccauaaagucgggaaaugacaucgccaacugucugaggaaaaacggcaaaaggguuauccagcucagccgaaagaccuucgacacggaauaccaaaagacgaagaacaacgauugggacuauguugugacaacggacaucucagagaugggcgcgaacuuucgcgcagacagaguaauagacccccggcgcugucuaaagcccguaauacuaaaggacggaccagaacgcgugauacuagcuggcccaaugccaguaacggucgccucugcggcgcagcguagaggcagaauaggucggaaccacaauaaggagggagaccaauacauauacauggggcagccccugaacaacgacgaggaccacgcacacuggacagaagcgaaaaugcuacuggacaacaucaacacacccgaagggauuaucccagcacuauuugaacccgaacgcgagaaaagcgcagccaucgacggcgaguacaggcuccgaggggaggcgcggaagaccuuugucgagcuaaugcggcgcggcgaccugccagucuggcuuucuuacaaaguagccagcgagggguuccaauacucagaucgacguuggugcuuugacggcgagagaaacaaccagguacuagaggaaaacauggauguugaaauauggaccaaagagggcgaaagaaagaaacuacgacccagauggcucgaugcacgaacguacucagacccacuggccuuacgagaauuuaaagaguucgcagcaggacgacguucaguuucaggcgaccucauacuggagaucggaaaacuaccucagcaccuuacccaaagggcccagaacgcauuggauaacuuaguaaugcugcacaacucagagcaagggggccgcgccuacagacacgccauggaggaacugcccgacacgauagaaacacuaaugcuacuugcauugauagcaguucucacgggcggggugacacuguucuuccucagcggucguggacucggaaaaaccagcauaggacugcuaugcguaauggcgagcaguguucugcuauggauggcguccgucgaaccccacuggauagcugcaagcaucauccucgaauuuuuccucaugguacuuuugauccccgagccggaccgccaacgcacaccccaagacaaccaacuggcguacgucgugauaggccucuuauuuaugauacucacaguggcugccaacgaaauggggcuccuagaaacaacgaagaaagacuuaggaaucggccacguggccguaggcaaccaucaccaugccgccaugcuugacguggaccuccaccccgcgucagcauggacccucuacgccguggcgaccaccauuaucaccccgaugaugagacacaccauagaaaacacaacagcuaauauuucccugacagcaauagcaaaucaagcggcgauccugaugggccuagacaaggguuggccaauuuccaagauggacaucggcguaccccuucuggcauuagggugcuacucacaagugaacccgcuaacacucacugcggcaguacuaaugcugguagcacacuacgccauaauaggaccgggccuccaagcgaaagcaaccagagaggcacaaaagaggacggccgcugguaucaugaaaaacccaacaguggacggaauuguagcaauagaucucgacccagucguauacgacgcgaaauucgagaagcaauugggacaaauaaugcuccucauccucuguacuucccaaauacuccuuaugaggacgacuugggcacuaugcgaaucgauaacgcucgcgaccggcccgcuuaccacacuuugggaagggucaccaggaaaauucuggaacaccacaaucgcaguaagcauggcgaacauauuucgaggcucguaccuagccggagcaggauuagcuuucucccuaaugaaaagccucgguggagggcgcagagggacaggugcacaaggagaaacauuaggagaaaaauggaagaggcaacuaaaccaacucaguaaaagcgaguuuaacacauacaaacguagcggaauuauggagguggaccggagcgaggcaaaagaggggcugaagcguggagaaaccacaaagcacgcaguaucccggggcacagccaaacuaaggugguucgucgaaagaaaccuggugaaacccgagggcaaagucaucgacuuaggaugcggccggggcgguuggucguacuacugcgcgggacucaagaaaguaacggaggucaagggguacacgaaaggugggccgggccacgaagaacccaucccaauggcgacuuacggauggaaccuagugaaacuacacagugguaaagauguguuuuucauuccuccggaaaaaugcgauacgcuuuugugugauauaggcgaaagcuccccgaauccgacgauagaagaaggccguacguuacguguacucaaaauggucgagccgugguugcgcggcaaucaguucugcauaaagauacucaacccuuacaugccaagcguugucgaaacccucgagcagaugcaaagaaaacacggcgguaugcuggugaggaacccccuaagcagaaacagcacucacgagauguacuggguaagcugcgggacgggaaacauaguauccgcaguuaacaugacuucccgaaugcuauugaaccgcuucacuauggcgcaccgaaagccaacauacgagcgggauguugaucuaggagccggcaccaggcauguggcgguggagccggaagucgcgaaccuagacaucauaggccagaggaucgagaacaucaaacacgaacacaaaaguaccuggcacuacgacgaggacaaccccuauaaaacaugggccuaucacggaagcuacgagguaaaacccagcgggagugcaagcagcauggugaacggggucgugaaacucuuaaccaaacccugggauguuauacccauggucacccaaauagccaugacugacaccacccccuuuggacaacaaagaguguucaaagaaaaaguggacacuagaacgcccaaagccaagagagguacugcccaaaucauggagguaaccgcuaaauggcuauggggguuccucucccgcaacaagaaaccgaggaucugcacgcgggaagaguucacacggaagguacggagcaacgccgccauuggggcuguauucguagacgaaaaccaguggaacagcgccaaggaagcaguagaagacgaacgauucugggaucuuguccacagggaacgagagcuucacaaacagggaaagugcgcgacgugcguauauaauaugaugggaaagcgagagaagaaauugggagaguuuggcaaagccaaagggagucgggcaauaugguacaugugguuaggagcccguuucuuagaguucgaagcacuaggguucaugaaugaggaccauugguuuucacgagagaacagccuuucaggcgucgagggggaagggcuccacaaauuaggcuacauccuacgagauaucucaaaaauccccggcgguaauauguacgcggaugacacagccggaugggauacaaggauuaccgaggacgaucugcaaaaugaagcccggauuacugacaucauggagccggaacacgcgcuucuggcaaaaaguauauucaaacugaccuaccaaaacaaagucguucgaguccaacggcccgccaaaaacgggacggucauggacgucaucagcagaagagaucagcgagguucuggccagguagggacauacggccucaauacguuuacaaacauggaagcccaacucaucagacaaauggagucagaagguaucuucucaccauccgagcuagaaacccccaaccuagcggagcgggucuuggacuggcuagaaaaauacggaguggaaagguuaaaaagaauggccaucagcggagacgacugugucguaaaaccuaucgacgaccguuuugcuaccgcgcucacggcgcucaacgacauggggaagguacgcaaggacauaccucaaugggaaccgagcaaaggauggaaugacuggcaacaggucccauucuguagucaccacuuucaucaauuaaucaugaaggacggucgagagauugucgugccgugcagaaaccaagacgagcuaguugggagggcacgcgucucccaaggugcuggauggagcuuacgggaaaccgccuguuuaggcaaaucguacgcucaaauguggcaacuaauguacuuccauagacgagaccugcggcuggcugcaaacgcaaucugcagcgcagugccuguagacuggauccccaccagcaggacaacauggagcauccacgcccaccaccaguggaugaccaccgaagauaugcuuagcguuuggaauaggguguggauagaagaaaaccccuggauggaagacaagacccacaucuccaguuggggagaugucccuuaccucggcaaacgcgaagaccaauggugugguucucuaauaggucuaaccgcccgugccaccugggcaacaaacauacaaguagccauaaaccagguaagaagacuaauugggaacgaaaauuauuuagacuacaugacauccaugaaacgcuucaaaaacgaaagcgaccccgagggggcccucugguga

SEQ ID NO: 23858 - RNA, 9879 nt, Artificial Sequence
  derived and/or modified CDS sequence (opt11) from DENV-1__JF937651__SS-prME
agcgugaccaugcugcugauguuaaugcccacagcccuagcguuccaccuaaccacccggggcggggagccccacaugauccuguccaaacaagaacgggggaagagccucuuguucaaaaccuccgcgggggugaacaugugcacccugaucgcaauggaccugggugaacucugugaggacaccaugaccuacaagugcccaaggauaaccgaagccgaaccggacgacguggacugcuggugcaacgccacagauacgugggugacuuacgggaccugcagccagaccggagagcaccguagagacaagcggucagucgcccuggcgccccacgucggccuggggcucgaaacucgcaccgagacauggaugagcuccgaaggcgccuggaagcagauucagcggguggagaccugggcccugcgccacccgggcuucacaguuauugcccuguucuuagcgcacgccauaggcaccagcaucacccagaaggggaucauuuucauccugcucauguuagugacucccuccauggcaaugcggugcguugguauuggcagccgcgacuucgucgagggguuguccggcgcuacuuggguggaugugguccuggagcacgggagcugcgugacaaccauggccaaggacaagccgacuuuggauaucgagcuguugaagacggaggucaccaacccagcgauccucaggaagcugugcaucgaggccaagaucuccaacaccaccacggacagucgcugcccaacccagggcgaggccacccuggucgaggagcaggacgcaaacuucguaugccggcgcacauucguugaucggggcugggggaacgguugcggccuguucggcaaagggucccucaucacgugcgccaaguucaagugcguuacuaagcuggaaggaaagauugugcaguacgagaaucucaaauacucagugaucgugacagugcacaccggcgaccagcaccagguggggaacgaaucuacugagcacggcaccacggcgaccaucacgccccaggcccccacgaccgagauucaacucaccgacuacggggcccuaacccucgauuguagcccccgcacaggccuggacuucaacgagaugguucuacuuaccaugaaggaaaaguccuggcuggugcauaaacaaugguuccuggaccucccccugcccuggaccagcggggcauccaccucccaagaaacguggaaccggcaggaccugcucguaaccuucaagaccgcgcacgcaaagaagcaagaggugguagucuuagggagccaggaaggcgccaugcacaccgcuuugacgggggccaccgagauccaaaccuccggcaccacgaccaucuucgcuggucacuugaaaugucgucugaagauggauaaguuaacccucaaaggcaugagcuacgugaugugcaccggguccuucaagcuggagaaggagguggccgagacgcagcacggcacaguccucgugcagaucaaauaugagggcaccgacgccccuuguaagauuccguucagcacccaggacgagaagggugugacgcagaacgggcgccugaucaccgcaaacccgaucgucaccgacaaagagaaaccagugaacaucgaggccgagccgcccuuuggggaguccuacaucgugaucggcgcaggcgagaaggcccuaaagcuaucaugguucaagaaggguucgagcaucggcaagauguucgaggcuaccgccagaggagccagacguauggcaaucuuaggcgacacggccugggacuucggguccaucggcggcguauucacgucugugggaaagcucauccaccagauuuuugguaccgcuuacgggguccuguucaguggcgucagcuggaccaugaaaauagguaucggcgugcugcucacguggcugggcuuaaacucucgcagcacuagccucaguaugaccuguauagccguggggcuggucacccuguaccucggcgugaugguccaggccgacuccgggugcgucaucaacuggaagggccgggaguugaaaugugguagugggauuuuugugacgaacgagguccauaccuggaccgagcaguacaaguuucaggcggacagcccgaaacgacuguccgccgccaucgggaaggcgugggaagaggggguuuguggcauucguagcgccacgcgcuuagagaacaucauguggaagcagauauccaacgaacugaaccacauccugcucgagaacgacaugaaguuuaccgugguggucggggacguggcgggcauuuuggcccaggggaagaaaaugauccggccccagcccauggaguacaaguacucguggaagucauggggcaaagccaaaauaaucggcgcggauguacagaacacgaccuucaucauagacggccccaacaccccggaaugcccagacgaccagcgcgcguggaacauuugggaggucgaggacuacggauucgguaucuucacaacgaacauuuggcugaagcuacgggacagcuauacgcaaguuugcgaccacaggcucauguccgccgcuauuaaggacagcaaggccgugcacgccgacaugggcuauuggauugaauccgagaagaacgagacauggaagcuugcgcgugccagcuuuaucgaggucaaaaccuguaucuggcccaaaucccacacgcucuggagcaacggcgugcuagaguccgagaugaucauucccaaaauauacgggggaccgaucagccagcacaauuaccgccccggguacuucacccaaaccgcugggccauggcaccuuggcaaacuugagcuggacuucgaccucugcgagggaaccacgguggucguggacgagcacuguggcaaucggggaccgucccuccggaccacuaccgugacggguaaaauuauccacgagugguguugcagaagcugcacucugccgccccugcgcuuccgcggagaggacggcugcugguacgggauggagauccgccccgucaaggaaaaagaggagaaucucgugaaguccauggugagcgccggcagcggcgaggucgacuccuucagccugggccugcucugcauauccaucaugaucgaggaggugaugcguagccgcuggucccgcaagaugcuaaugaccgggacccuggccgucuucuuacugcugaucauggggcagcucacguggaacgaccugauacgacugugcaucaugguuggagcgaaugccugcgaucgcaugggcaugggcaccaccuaccucgcccugauggcaacguucaagaugagaccuauguucgcugucgggcuuuuauuccgccgccugaccagccgcgagguucugcuccugaccaucggguugucccuuguugccagcguggagcugcccaacucccuggaggagcucggugaugggcuggccaugggcaucaugauccugaagcuccugacagacuuccaaagcuaucaacugugggcgaccuuacugagucucacguucaucaaaaccacguucucguuacacuaugccuggaagaccauggcuaugguccuguccaucgucucgcuguucccacuaugccuguccacgaccagucagaagaccaccuggcugcccgugcuccugggaucccugggguguaaaccgcucacgauguuccugaucgccgagaacaagauauggggcagacgcuccuggccccugaacgaggggaucauggccgugggcauaguguccauacuccugagcagccugcucaaaaaugacgugccgcuugccgggccccugaucgccggaggcaugcuuauagcguguuaugucaucuccgggagcuccgccgaccuuagccuggaaaaggccgccgaagucuccugggaggaggaggcagagcacaguggcgcgagucacaauauccucguggaaguccaagacgacggaaccaugaagaucaaggaugaagagcgggacgacacccuuaccauccuccucaaggccacccugcuagcugugucgggcguguacccgcuguccaucccugcuacacucuucgugugguacuucuggcagaagaagaagcagcgcagcggggugcugugggacacgccaagcccgcccgagguagagcgggccguucuggacgauggcaucuaccgcaucaugcagaggggccuccuggggaggagccaggugggcguggggguguuucaggagaacguguuccauacuauguggcacgugacccggggcgcugugcugauguaccaagggaagcgccucgagccguccugggccagcgucaagaaggaccugauaucauacggcggcggguggcggcugcaaggcagcuggaacacuggggaggaggugcaggucaucgccguggaacccggcaagaaccccaagaacgugcagaccgccccagggacauucaagacccccgagggcgaagugggcgccaucgcgcucgacuucaagccagggacgagcggcagccccaucguaaaccgcgaggggaaaaucgugggacuguaugguaacggugucgugaccaccuccggcaccuacgucagugccauagcccaggccaaggcaucucaggaagggccucugcccgagaucgaggacgagguauuccggaagagaaaucugacgaucauggaccuccaccccggcucagggaagacacggcgcuaccugccggccauagugcgggaggcuaucaagcgcaagcucaggacccucauccuagcacccaccagagucgucgccagcgagauggcggaggcccucaagggcaugcccauccgcuaccagacgacugcagugaagucugagcacacagggaaggagaucguggaccuuaugugccacgccaccuucacgaugcggcugcucagccccguccgcguuccgaacuacaacaugaucauuauggacgaggcccauuucaccgacccguccagcauugcggcccgggguuacaucucaacucgaguaggcaugggggaggcagccgccaucuucaugaccgcgacgccgcccggcucggucgaggccuucccccaguccaacgccgugauccaggacgaggaaagggacauccccgagaggagcuggaauuccggguacgaauggauaaccgauuucccggguaaaaccgugugguuuguccccaguauuaaguccggcaacgacaucgccaacugccuccggaagaaugggaagcgcgugauccagcugagccggaagaccuucgacaccgaauaccagaaaaccaagaacaaugacugggacuacgugguaacuaccgacaucuccgagaugggcgcuaacuuccgcgcagaccgggugaucgacccacgccgguguuugaaacccgugauuuuaaaagacggacccgagcgcgucauccuggccggcccaaugccgguaacgguggccagcgccgcgcagcggcgcggucggaucggccgaaaccacaacaaggagggcgaccaguacaucuauaugggccaaccccucaacaacgacgaggaccacgcccauuggaccgaggccaagaugcuacuggacaacaucaacacucccgagggcaucaucccagcccuuuucgaaccggaacgcgagaaguccgcggcgaucgacggggaguacagacugcgcggggaagcccggaagacguucgucgaguugaugcgccgcggagaucuccccguauggcucagcuacaaggucgcgucagagggcuuccaauacagcgaccgccgcugguguuucgacggcgagcgcaauaaccaggucuuagaggagaacauggacguggagaucuggacgaaggagggugagcgcaagaaacuccgcccccgguggcucgaugcccgcacguacucagacccccuugcccucagggaguuuaaggaguucgcggccggccgcagguccgucucgggggaccugauccuagagaucgguaaacucccacagcaucuuacccaacgcgcccaaaacgcccuggacaaucucgugaugcugcacaacuccgagcagggcgggcgggcuuaccgccacgcuauggaggaacugcccgacacgaucgagacguugaugcugcuggcccucaucgcugugcugacaggcggggucacgcuuuucuucuugucugggcgggggcugggcaagaccuccaucggccugcugugcgugauggccagcucgguccugcucuggauggcuagcgucgagccccacuggaucgcagccuccaucauccucgaauucuuccugaugguacuucucauacccgaaccggaccgccagaggaccccccaggacaaccagcuggccuacguugucaucgggcuccucuucaugauccugacgguggccgcgaacgagaugggccugcucgagaccacgaagaaggaccuagggauuggccacguggccgucgggaaccaccaccacgccgccaugcuggacguggaccuucaccccgccagcgcguggacacuguacgcaguggccacuaccaucaucaccccgaugaugaaacacaccaucgagaacacgaccgccaacaucucccuuaccgcgaucgcgaaccaggccgccauccucaugggacucgauaagggcuggcccaucagcaagauggacaucgggguuccccugcucgcacuggguugcuacucccaggugaacccccugaccuuaacggcggccgugcugaugcuagucgcccacuaugcuaucaucggcccgggcuuacaggccaaggcgaccagggaggcccagaagcgcaccgcagcagggauaaugaagaaccccacgguggacgguaucguggcaaucgaucuggacccaguuguguacgacgcgaaauucgaaaagcaacugggucagaucaugcuccugaucuuaugcacaagccagauccuccugaugcggaccaccugggcccugugcgagagcaucacccuggcgacggguccccugacuacguugugggaggggagcccggggaaauucuggaacaccacaaucgccguguccauggccaacaucuucagggggagcuaccuugccggcgcggggcucgccuucucccugaugaagucccucgguggggggcggagggggaccggcgcccagggcgagacccugggggagaaguggaagcgacagcuuaaccagcucagcaaguccgaauucaacacuuacaagcgcucgggaauaauggaggucgacagaucagaggccaaggagggucugaagcgcggcgagacaaccaaacacgcgguuagccgagggaccgccaagcugcgcugguucguagagcgaaaccuagucaagcccgagggcaagguaaucgaccucggcugcgggcgcggcgggugguccuacuacugcgccggucuaaaaaaagugacggaagucaagggguauacgaagggcggcccgggacacgaggagcccaucccgauggcaaccuacggcuggaaccuggugaagcuccauagcggaaaggauguauucuuuaucccgcccgagaagugcgacacccugcugugcgauauaggagagucuagccccaacccgacuaucgaggaggggcggacgcuccgcguccugaagaugguggaacccuggcugcggggcaaccaauucugcauaaaaauucugaaccccuacaugcccagcguggucgagaccuuagaacagaugcagcgaaagcacggcgggaugcuggugcggaacccacucagccgcaauuccacccacgagauguacuggguauccuguggcaccgggaacaucgucuccgcagugaacaugaccagcaggaugcugcugaacagauucacgauggcccacaggaagcccaccuacgagcgggacguugaccucggagccggcacccgccacgucgccguggagcccgagguggccaaccuggacaucaucgggcagaggaucgagaacaucaagcacgagcacaaauccacguggcauuacgacgaagacaacccuuauaagacgugggcguaccacggcagcuacgaggucaagccguccggaagcgcgucuagcauggugaacggcguggucaagcuguugaccaagccgugggacgugauccccauggucacccagauagcaaugaccgacacuacccccuucgggcagcagcgcguguucaaggagaaggucgacacccggacuccgaaggccaagcgugguacugcccagaucauggaggucaccgcaaaguggcuguggggcuuucugucacggaacaaaaaaccacgcaucugcacucgggaggaguucaccgggaaggugcgcuccaaugcugccaucggagccguguucgucgacgagaaccaguggaauagcgcgaaggaggcaguggaggacgagcgguucugggaccucguccaccgcgagcgugagcugcacaaacaggggaagugcgccacgugcguguacaacaugaugggcaagcgcgagaagaagcugggugaguucggcaaggccaagggcucgcgggccaucugguacaugugguuaggcgcccgcuuccuagaguuugaagcccuuggcuucaugaaugaggaccacugguuuagccgggagaacucccucagcggaguggagggcgaggggcugcacaagcugggguauauacuccgcgacauaucgaagauccccggcgggaacauguaugcggacgacacagcagggugggacacccggaucaccgaagacgaccugcagaacgaggcccgcaucacggacauaauggagcccgagcacgcgcugcucgccaaaagcauuuucaagcuuaccuaucaaaacaaggugguccgggugcagagacccgcuaagaacgggacugugauggaugucaucucucgccgggaucagcgcgggaguggccaggugggaaccuacggccugaacacauucaccaauauggaggcccagcucauccgucagauggagagcgagggaaucuucagccccucggagcuggagacccccaaccuggccgagcgcguucucgacuggcuggaaaaguauggcgucgaaaggcugaagcguauggcgauuuccggggacgacugcgugguaaagccgauagacgaucgauucgccaccgcccucacggcccugaacgacaugggcaagguccgcaaggauaucccucagugggagcccuccaagggcuggaaugacuggcaacagguccccuucuguucccaccauuuccaccaacucauaaugaaggacgggcgggaaaucguggucccgugccgcaaccaagaugagcuugugggccgagcccgcguaucccaaggggccggcuggucccuccgggagaccgccugccucggcaaaaguuacgcccagauguggcagcucauguacuuccauaggcgggaccuucgcuuagcagccaacgcgauaugcuccgccguucccguggacuggauucccaccucccggaccacgugguccauccaugcccaccaccaauggaugacuaccgaggacaugcuauccguguggaacagagucuggauugaagagaacccauggauggaggauaagacccacauauccucguggggggaugugccguaccugggcaagagagaggaucaguggugcgggucccuuaucggucuuaccgccagagcgacaugggcaaccaacauucagguggccaucaaccaggugcgccggcugaucgggaacgagaacuaccuggacuauaugacaucuaugaagcgcuucaagaaugaguccgacccaaagggcgcccucugguga

SEQ ID NO: 23859 - RNA, 9879 nt, Artificial Sequence
  derived and/or modified CDS sequence (opt11) from DENV-1__GU131956__SS-prME
ucggugaccaugcuccucaugcugcugcccaccgcacucgccuuccaccugacgacucggggcggggagccucacaugaucgugaguaagcaggagcgcggcaagucccuucuguucaagacgagcgcgggggugaacaugugcacgcugaucgccauggacuuaggcgagcucugcgaggacacgaugaccuacaagugcccucagaucaccgaggccgagcccgacgacguggacugcuggugcaacgcuaccgacacgugggugaccuacgggaccugcucgcagacuggcgagcaccgucgggacaagcgguccguggcccuggcgccacacguggggcugggccucgagacgcggaccgagaccuggaugagcuccgagggcgccuggaaacaaauccagagagucgagaccugggcauugcggcaccccggguucacugugaucgcccuguuucucgcgcacgccaucggaaccagcaucacccagaaggggaccaucuucauacuccucauguuggugacgccguccauggcgaugcgcugcguuggcaucggcaaccgggacuucguugagggguuaagcggcgccaccuggguggaugucguccuggagcacgggaguugcgugaccaccauggcaaagaauaagcccacgcucgacauugagcuucugaagaccgaggucaccaaccccgcgauccuccgcaagcugugcaucgaggccaagaucagcaacaccacgaccgauucucgaugccccacgcagggcgaggcgacccugguggaggagcaggaugccaacuucguaugcagacggacguucgucgaccgcggcuggggaaacgggugcgguuuauucggcaaggggagccugcugaccugcgccaaguucaagugugugaccaagcucgagggcaagaucguccaauacgagaacuugaaguacuccguaaucgugaccgugcauacgggcgaccagcaucaggucgggaacgagaccaccgagcacggcaccaucgcgaccauaacgccccaggcgcccaccagcgagauccagcugaccgacuacggggcccucacccucgacuguagcccccggacuggccuugacuucaacgagauggugcuccucaccaugaaggagaaguccuggcugguccacaagcaaugguuccucgaccugccgcugccuuggacaucgggagcgagcaccucacaggagacguggaaccgucaagaccuccuggugacuuucaagacagcccacgccaagaaacaggaggucgucguucuuggcucccaggagggcgccaugcacacugcccucacgggggccaccgagauccaaacuagcggcaccacgaccaucuucgccgggcaucugaagugucggcugaaaauggauaagcuaaccuuaaaggguaccuccuacgugauguguacggggagcuucaagcuggagaaggaggucgcggagacgcagcacggcacgguucucgugcaggucaaguacgagggcacagacgccccgugcaagaucccuuucuccacgcaagacgagaagggagugacccagaacgggcgccuaaucacggccaauccgaucguuaccgauaaggagaagcccgucaacaucgagacggagccgcccuucggcgagucguauaucgucgugggcgccggcgagaaggcgcugaaacuguccugguucaagaaggggagcucaaucggcaagauguucgaggccaccgcccgcggggccaggcggauggccauccuaggggacacugccugggauuucgggagcauaggcggggucuucacauccgugggaaagcuggugcaccaggucuucggcacggccuacggggugcuguucagcggcgugucuuggaccaugaagaucgggaucggcauccuccugaccuggcugggccucaacagcagauccacaagccuguccaugacgugcaucgccgucgguauggugacuuuauaccucggcguaaugguccaagccgacagcgggugcguaaucaauuggaagggccgcgagcugaagugcgggucgggaaucuucgugaccaacgagguccacaccuggacggagcaguacaaguuccaggcagacagcccgaagagacugagcgcggccauagguaaagccugggaggaaggggugugcggcaucagaucggccacgcgacucgagaacaucauguggaagcaaaucucaaacgagcugaaucacauccugcucgagaaugacaugaaguucaccgucgucgugggagacgccaauggcauccuagcccaagguaagaagaugauccgcccucagcccauggagcacaaguauuccuggaagucuuggggcaaggccaaaauaaucggcgccgacauacagaacaccaccuucaucaucgacgggccggacacgccggagugccccgacaaccagagagccuggaacauuugggaggucgaagacuacggcuucgggaucuucacaaccaacaucuggcugaagcuccgcgacuccuauacccagaugugcgaucaccggcuuaugagcgcggccaucaaagacuccaaagccguccacgccgacaugggcuacuggaucgagagcgaaaagaacgaaacuuggaaacuggcccgcgcguccuucaucgaggugaagaccugcacuuggccuaagagccacacacucuggucuaacggcgugcuggaaagcgagaugaucauccccaagaucuacgggggcccgauaucucagcauaauuaccggcccggguacuucacgcagaccgcuggcccauggcaccuggggaagcucgaguuagacuucgaccugugcgaaggcaccacugucguaguugaugagcacugcggaaacagggggccgagccuccguacgaccaccgucaccggcaagauuauccacgaguggugcugccgcucuugcacgcugccgccgcucagauucagaggggaagauggcugcugguacgggauggaaaucaggcccgugaaagagaaagaggagaaccucgugcguagcauggucuccgccggcagcggcgagguggacaguuucucccuggggauccugugcgcaucuaucaugaucgaggaggugaugcguucacgcuggucccggaagaugcuaaugaccggcacccuugccgucuuccuguuacuggugauggggcaacugaccuggaacgaucucauccgccugugcaucauggugggcgcgaacgccuccgaccgcauggggauggguaccacauaccuggcccucauggccaccuucaagaugcgaccaauguucgccgucggccugcuguuccgccggcugaccagccgcgagguucugcugcucacgaucgggcuaucccugguugcgagcgucgagcuccccaacucccuggaggagcuuggcgacggacucgccaugggcaucaugaugcugaagcuguuaacggaguuccagccccaccagcuuuggaccaccuuacuaucacugacguuuauuaagaccacccugagucucgacuaugccuggaagacaacggccauggcgcugagcaucgugucccuuuucccccucugucuuaguaccaccucucagaaaacgaccuggcugccgguccuccugggcagcuuugggugcaagccccugacgauguucuuaauuaccgagaacaaaauuuggggacggaaguccuggccccucaacgaggggaucauggccaucgguaucgugagcaucuugcucuccagcuuacugaagaacgacguuccccucgccgggccgcugauagccggcggcaugcugaucgcaugcuacguaaucagcggauccagcgcggaccucuccuuggagaaggccgccgaagugagcugggaacaggaggccgaacacuccggcaccagccacaacauccugguggagguccaggacgacgggaccaugaagaucaaggacgaggagcgcgaugacacguuaaccauccuuuugaaggcaaccuuacuggcgguguccgggguguaccccaugagcaucccagccacccuauucgucugguacuucuggcagaagaagaaacagcgguccgggguucucugggacacgcccagcccucccgagguggagcgcgccguccuggacgaugguauauaccggauccugcagcgcggccugcucggacggucccaggugggcgugggcgucuuccaggacggcguauuccauaccauguggcacgugacccgcggcgccguccugauguaccaaggaaagaggcuggagcccagcugggccuccgugaagaaggaucucaucucuuacggcgggggcuggcgcuuccaaggaagcuggaacaccggcgaggaggugcaggucaucgcgguggagccugguaagaacccgaagaacguucagacaacccccggcaccuuuaaaacccccgagggggagguaggggccaucgcccuggacuucaagccgggcacgagcgggucgccgaucgugaaccgggagggcaagaucgugggccuauacgggaacggcguuguuaccacgucggggaccuacgugucggcgaucgcccaggcgaaggccagucaggagggcccgcuccccgagaucgaggacgaggucuucaagaagcgcaacuuaacgaucauggaucugcauccggggagcggcaagacccggcgcuaucuccccgcgauggugagggaagcaaucaagcgcaaacuucggacccugauacucgcucccacccgcgugguugccuccgaaauggcugaggcgcugaagggaaugcccaucagauaccagacgaccgccgugaaaagcgagcacaccgggagggagaucguggaccugaugugccacgcgacguucacgaugcgucuccuguccccuguccggguucccaacuauaacaugaucaucauggacgaggcccacuucaccgaucccgcuagcauagcggcccgcggguacaucaguacccgggugggcaugggcgaggcggccgccaucuucaugaccgccacuccgccggguagcguggaagccuucccccagagcaacgcggugauccaggacgaggagcgcgauauccccgagcgcagcuggaacuccggcuacgacuggauaacagacuuucccggcaagaccgugugguucgucccgagcaucaaguccgggaacgacauugcuaacugcuuacgaaagaacggcaagagagugauccagcucagccgcaagacauucgacacggaguaccagaaaaccaagaacaacgacugggacuacguggucaccaccgacauaagugagaugggggccaauuuccgggccgaccgcgugaucgacccccggaggugccugaagcccgugauacugaaagacggcccggagcgggucauucucgcggggccaaugccggugacgguggcaagcgcggcccaacgccggggcagaaucggccgaaaccagaacaaggagggggaucaauaugucuacauggggcagccccugaacaacgacgaagaucacgcccacuggaccgaggcgaagauguugcucgauaauaucaacacuccugagggcaucaucccggccuuguucgagcccgaacgagagaaaagcgccgcgauagacggcgaauaccgccugcgcggagaggcccgcaagaccuucguggagcuuaugcggcgcggcgacuuacccgucuggcuaagcuacaagguggcguccgagggcuuccaguacagcgaccggcgguggugcuucgacggggagcggaacaaucaggugcucgaggagaacauggaugucgagaucuggacaaaggaaggcgagcgcaagaagcuacggccacgcugguuggacgcacgaacguacuccgacccgcucgcccugcgcgaguucaaggaguucgcagccgggcggcgcucugugagcggcgacuuaauacucgaaaucggcaaguuaccucagcaccugaccuugcgggcgcagaaugcccuggacaaccuggugauguugcacaacuccgagcagggcgggaaagccuacagacacgccauggaggaguuacccgacacuaucgagaccuugaugcugcuggcgcugaucgccguccucaccggcggggugacccuguucuuucugagugggaagggguugggcaagaccuccaucgggcuguugugcgugacugcgagcuccgcccuccuguggauggccagcguagagccccacuggauugcggccaguaucauccuggaguucuuccucauggugcugcugaucccagagcccgacaggcagcgcacaccccaggauaaccagcuagccuacgucgucauuggccugcuauucaugauccucaccguagcugccaaugaaaugggacugcuugagacuaccaagaaggaucucgguaucgggcacguggcggccgagaaccaccagcacgccacgaugcuggacguagaucugcgcccggccucagccuggacucucuacgcgguggccaccaccgugaucacucccaugaugcgccacaccaucgagaacaccacggccaacaucuccuuaacugccauugccaaccaggcggcgauccugaugggccucgacaagggcuggcccaucagcaaaauggacauaggggucccgcuucuggcccucgguuguuacucucaggugaacccgcugacacugaccgcagcggugcucaugcuggucgcccacuacgcuaucaucgggcccggccugcaagcuaaagccacucgggaggcgcaaaagagaacggcagccgggaucaugaagaaucccacuguggacggcaucguagccauugaccucgaccccgucguguacgacgccaaguucgagaagcagcugggacagaucaugcugcuaauccugugcacaagccagauccugcucaugcgcaccacgugggcgcugugcgaauccaucacccuggcuaccgguccacucaccacgcugugggagggcagccccgggaaguucuggaauaccacuaucgccguguccauggccaacauauuccggggcucuuaucuggccggcgcugggcucgccuucucucugaugaagucccucggcgggggccggcggggcacaggcgcccagggcgagacgcucggggagaaguggaagcgccagcugaaccagcuguccaagagcgaguucaacaccuauaagcggagcggaaucauggaggucgaccgguccgaggcgaaggaaggguuaaagcggggcgagacuaccaagcacgcggugagccgcgguaccgccaagcugaggugguucgucgagagaaaccuggucaagcccgagggcaagguuauagacuuaggcuguggacggggcgggugguccuacuacugugccggccucaagaaggucacggaggucaagggguacacgaaaggcggccccgggcacgaggaaccgauccccauggcaacguaugguuggaaccugguaaaacugcacagcgggaaggacguguucuucaugccucccgagaagugcgacacccuucugugcgacaucggcgaguccagcccgaaccccacgaucgaggaggggcgcacgcugcggguccucaagaugguggaacccuggcugcgcggcaaucaguucugcaucaagauccugaaccccuacaugccguccguggucgagacccucgagcagaugcagcggaagcacggcgguaugcuggugcgcaacccccugagcagaaauucaacccaugaaauguacugggugucaugcggcaccggaaauaucguuuccgccgugaauaugaccagccgcaugcuccucaaccgguucacuauggcgcaucgaaagcccacauacgagcgagacguagaccugggcgccggaacgaggcacgucgcaguggagcccgagguggccaaccucgacaucaucgggcagcgaaucgaaaacaucaagaacgagcacaagagcaccuggcacuacgacgaggacaauccguacaagacgugggccuaccacggcagcuacgaggucaagccauccgggagcgcguccagcauggugaauggcgugguccggcugcuaaccaagcccugggacgugauccccauggucacucagaucgccaugaccgacaccaccccguucggucagcagcgcguguucaaggagaagguggacacgagaacuccccgggccaaaagaggcaccacccagaucauggaggucacggccaaauggcucuggggcuuccugucgcgcaauaagaaaccccggaucugcacccgcgaggaguucacccgcaaggugcgcagcaacgcagcgaucggggccguuuucgucgacgagaaccaguggaacagcgccaaggaggcuguggaagacgagcgguucugggaucuugugcaccgcgaacgggagcuacacaagcagggcaagugcgcgaccugcguuuacaacaugauggggaaaagggaaaagaagcugggcgaguuugggaaggcgaagggcucccgggccaucugguacauguggcugggcgcccgcuuccucgaguucgaggcccugggguuuaugaacgaggaccacugguucucccgcgaaaauucccugagcggcguggagggggagggcuugcacaagcugggguacauccugcgcgacaucucaaagauaccgggcggcaacauguacgcggacgacaccgccgggugggauacucggaucaccgaggacgaccuccagaacgaggcgaagaucaccgagaucauggagcccgagcacgcuuugcuggcuacgagcaucuucaagcucacguaccagaauaaagugguccgcgugcagcggccagcgaagaacggcaccgugauggacgugaucucccggcgcgaccaacggggaagcggucaaguggguaccuacggacugaacacguucaccaacauggaggugcaacugauccgucaaauggaguccgagggcauauuucuccccagcgagcuggaaaccccgaaccuggcagagcggguccucgacuggcuggagaagcacggggccgagcgccugaaacggauggccaucucaggcgacgacuguguggugaagcccauagacgaucguuucgcaacagcgcucaccgcgcugaacgacaugggcaagguccggaaagacauuccccaaugggagcccagcaagggauggaacgauuggcagcaaguaccguucugcucccaucacuuccaucaguuaaucaugaaggacggccgcgagaucgugguaccgugucggaaccaggacgagcucguggggcgcgcccguguaagccagggcgccggguggucucugcgcgagacggccugccugggcaagagcuacgcgcagauguggcagcuaauguauuuccauaggcgcgacuugcggcuggccgcgaacgcaaucugcuccgcggugccuguggauugggugccgaccagcaggacaacguggagcauccacgcccaccaccaauggaugacgaccgaagacaugcucucugucuggaaccggguguggaucgaggagaacccguggauggaggauaaaacccacgugagcuccugggaggagguccccuaccuggggaagcgcgaggaccaguggugcggcaguuuaaucggccucacagcccgcgccacgugggcuaccaauauccagguggcgaucaaccaggugcggaggcugaucgguaacgaaaacuaccuggacuacaugaccuccaugaagcgguucaagaacgagagcgaccccgaaggcgcccucugguga

SEQ ID NO: 23860 - RNA, 9879 nt, Artificial Sequence
  derived and/or modified CDS sequence (opt11) from DENV-1__GU131958__SS-prME
agcgugaccaugcugcugaugcuccugcccaccgccuuggcauuccaccugaccacucggggaggggaaccccauaugaucgugagcaaacaagagcggggcaaaucacuccuguuuaaaacuucagcaggggucaauaugugcacccuuaucgccauggaccugggugaacugugcgaggacaccaugacuuacaagugcccccagaucaccgaggcagaaccagacgacguggacugcugguguaacgccaccgacaccuggguuaccuacggaaccuguagccagaccggggagcauagacgggacaaacgaucugucgcacucgcgccccacgugggccuggggcucgagacccggaccgagaccuggaugagcagcgaaggcgccuggaagcagauacagcgcgucgagaccugggcccuucggcacccaggguucacggugaucgcucuguucuuggcgcacgcgaucggcaccagcaucacucagaaaggcaucauuuucaucuuauugaugcucguaacccccuccauggcuaugcggugcgugggcaucgggaaccgagacuucguggaggggcugagcggugccacguggguggacguagucuuagaacacggguccugcgucaccacaauggcaaagaacaagcccacccuagacaucgaacugcuuaaaacugaggucaccaaccccgcgaucuugcgcaagcugugcaucgaggcaaagaucucgaauaccacaaccgacagucgauguccgacgcagggcgaggccacccugguggaggaacaggacgcuaacuuugugugccgucgcaccuuugucgaccgcggaugggggaacggcugcggcuuauucggaaaggggagccugcuuacgugcgcaaaguuuaagugcguuacgaaguuggagggcaaaaucguacaauacgaaaaccugaaguacuccgugauugugacugugcacaccggcgaccagcaccaggugggaaacgagacgaccgagcacgggacaaucgcgaccaucacgccacaggccccuacgagcgagauacagcuaacagauuacggggcccucacccuggacugcagcccgcggaccggccucgacuucaaugagauggugcuccuaacgaugaaggagaaaagcuggcugguccauaaacagugguuccucgaccugccgcugcccuggacuuccggagcgagcacaagccaggagaccuggaaccgccaagacuuguuagugacguucaagaccgcccacgccaaaaagcaggagguggucguguuaggcucucaagagggcgccaugcacaccgcccucaccggcgccaccgagauucagaccagcgggaccacgacaauauucgccggucaccugaagugccgacugaagauggacaaauuaacgcugaagggcaccuccuaugugaugugcaccggcagcuucaagcuggagaaggaaguagcggagacgcagcauggcaccgugcuaguccaagucaaguacgagggcaccgacgcccccuguaagauucccuucuccacccaggaugagaagggggucacgcaaaauggccgccucauuacugcgaaucccaucgugaccgauaaggaaaaacccgucaacaucgaaacagagccgcccuucggcgagagcuacaucguggugggcgccggcgagaaggcgcuuaagcugucgugguucaagaaaggcagcuccaucggaaagauguucgaggccacggcacgaggggcccgucgcauggccaucuuaggggacacggcgugggacuuugguagcaucggcggugucuucacaagugugggaaagcuaguucaucaggucuucggcaccgcauauggugugcuguucagcggugugucuuggacgaugaagauuggaauugggauccuucugacuuggcuuggccuaaacagccggucuacuagccuguccaugacaugcaucgccgucgguauggugacgcuuuacuuaggcgugaugguccaggccgacagcgggugcgucaucaacuggaagggccgugagcugaaaugugggucagguauuuucgugaccaacgagguacacacuuggacggagcaguacaaauuccaggccgacagcccgaagcgccuguccgcugccaucggcaaggccugggaggaggggguuugcggcaucagauccgccacucgccucgagaacauaauguggaaacaaaucucgaacgagcucaaucacauauuacuggaaaacgacaugaaguucacaguggucguaggagacgccaacggcauccuugcccaggguaagaagaugauucgcccccagcccauggagcauaaguacuccuggaaauccuggggcaaggccaagauaaucggcgcggacauccagaacaccacauucaucaucgacgggcccgauaccccggagugccccgacaaccaacgggcauggaacaucugggaaguggaagacuacggguucgggaucuucacgaccaacaucuggcugaagcucagagauuccuauacccaaaugugcgaccauagauugaugagcgcggccaucaaggacucaaaagccguccacgcagacauggguuauuggaucgagagcgagaagaacgagacguggaagcuggcucgcgcguccuucaucgagguuaaaaccugcaccuggccgaagucccauacacucugguccaauggaguguuggaaagcgagaugauuaucccuaagaucuacggagggccgaucagccagcacaacuacagacccggguauuucacccagacggcagggcccuggcaucucgggaagcuggaguuggacuucgaccugugcgaggguacgaccgucgugguagacgagcauugcggaaaucgcggaccuucucuccgcaccacuacggucaccggaaagauuauccacgagugguguugccgcuccugcaccuuaccgcccuuacgguuucgcggggaagauggcugcugguacgggauggagauccgucccguuaaagaaaaggaggagaaucucgugcgcaguaugguguccgccggaagcggcgagguggacagcuucagucuggguauucucugugccuccauaaugaucgaggaggugaugcggagccgcuggagcagaaagaugcuuaugacgggcacacuagccgucuuucuccucuuaauuauggggcaacugacauggaacgaucuuaucagacugugcauaauggucggugcgaacgcauccgaucgaauggggaugggcaccacuuaccuagcgcucauggccacauuuaagaugcgacccauguucgccgugggauuacuuuuucgccggcucacaucucgcgaaguccugcugcuaaccaucgggcuaucccugguggccagcguagagcucccuaauucccuggaggaguugggagauggucuggccaugggcaucaugaugcugaaacugcucacggaguuucagccccaccaacuguggaccacacuguugagcuuaaccuucaucaagacgacccugagucucgacuaugccuggaaaacgaccgcaauggcgcuuucuaucguguccuuguuuccucucugccugucgacgacaucccaaaagaccaccugguuacccgugcugcucgggucuuucgguugcaagccccugacgauguuucucaucacagaaaauaagauauggggucggaagucuuggcccuuaaaugagggaaucauggccaucggaauugucagcaucuugcucuccagccuacugaagaacgacgugccucucgccggcccgcuuaucgcuggaggaaugcuaaucgccugcuaugugaucucuggguccagugcggaucuaucccuggagaaggccgccgagguuagcugggagcaggaggccgagcauagcggcaccucucacaacauccugguggaggugcaggacgacggaaccaugaagauuaaggacgaagagagagacgacacgcucacgauccuacugaaggcaacccuccuggcggucuccggcguguaccccaugaguauucccgccacccuuuuugugugguacuucuggcaaaagaagaagcagcggucugggguccucugggauacacccagcccgcccgagguggagagggccgugcuagacgauggcauuuaucggauccugcagcgcggucuucucggacggucccaaguaggcgugggcguguuccaagacggcgucuuucacacgauguggcacgugacuaggggagcugugcuaauguaccaaggcaagcggcuagagccgagcugggcgagugucaagaaagaccucaucagcuacggcggaggcuggcgguuccagggguccuggaacacgggcgaagagguccaagugaucgcuguggagccugggaagaacccgaagaacguccagaccacacccgguaccuucaagacccccgaaggcgaggugggggccauagcucuggacuucaaacccggcaccucagguuccccuaucgucaaccgggagggaaaaaucguaggucuguacgggaacggcguagucacuaccagcgggaccuacguguccgcaauugcucaggcgaaggccagccaggaagggccccuucccgagauagaggaugaagucuuuaagaaacgcaauuugaccauaauggaccugcacccggguagcggcaagacgagacgcuaccuaccugccauugugcgagaggccauaaagaggaagcuccggacccugauccuagcgccaacccgcgugguagccucagagauggcagaagcccugaaggguaugcccauccgguaucagaccaccgccgucaagucugaacacacggggagagaaaucguggaucugaugugccaugcgacauucaccaugcgucuccuuagcccgguucgcgucccaaacuacaacaugaucaucauggacgaggcccacuucacggacccugccagcaucgcggcacgaggcuacauaaguacgcgcguggggaugggagaagcggcugccaucuuuaugaccgcgacgccuccuggcagcguagaggccuucccccaguccaacgcggucauccaggacgaggagagggacauucccgagcgaagcuggaacucaggcuacgacuggaucacggacuuuccgggaaagaccguuugguucgugcccagcaucaagucggguaacgauaucgccaauugucugcgcaaaaacgguaagcggguuauacagcuuucacgcaaaaccuucgacaccgaauaccagaagacgaagaacaaugauugggacuacguugugacaaccgauaucagcgagaugggagccaauuuccgggcugaccgcguaauugacccacggcgcugccugaagcccguaauccuaaaggaugggcccgagcgcgugauucuugcggggccuaugcccgucacuguggccucagcugcccaaagacgcggccgaaucggacgcaaccagaauaaggagggagaccaguacguguacaugggccagccucugaacaacgaugaagaccacgcccacuggacggaggcaaagaugcugcuagauaacauuaacacgcccgaggguaucauuccggcauuauuugagcccgagcgagagaagucagcugcgauagacggugaguaucgccugcgaggggaggccagaaagaccuucgucgagcucaugagacgcggcgaccugcccguguggcugucauacaaggucgccuccgagggcuuccaguauagugaccgucgcuggugcuucgauggcgagcggaauaaccaagugcuggaggaaaacauggacguggagaucuggaccaaggaaggcgagcgcaagaaguugcguccucguuggcuggacgcccggacguauuccgacccccucgccuugcgggaguuuaaggaauuugcagcaggccggcguucggucagcggcgaccuuauuuuggagaucggcaagcugccccagcaccugacgcugcgggcucagaacgcccuggacaaccucgugaugcuccacaacuccgagcagggcgggaaagccuaccgccaugccauggaggagcugcccgacaccaucgagacguugaugcuucuggcacugauugcgguguuaacagggggcgucacucuauuuuuccugucugggaaaggccuuggcaagaccuccauuggucugcugugugugaccgcaucauccgcccuccucuggauggccagcgucgagccacacuggaucgcggcaucaaucauucuugaguucuuucucaugguccugcucaucccugaaccggaucggcagcgcacgccgcaggacaaccaacucgcuuacgucguuauaggccugcuguucaugauccucacuguagccgcuaacgagauggggcugcuggaaacuacgaagaaggacuuaggcaucgggcauguggcagccgagaaccaucaacaugccaccaugcuggacguugaccugcgaccagcgagcgccuggacgcucuacgcugucgcaaccaccguaaucacccccaugaugcgccacacgaucgagaauacaacugccaacauauccuuaaccgccauugccaaccaggcggcgauccuaaugggccucgacaagggcuggccuauaagcaaaauggacauuggcguaccccugcuugcccucgggugcuacagucaggucaauccgcuuacgcugaccgcagcggugcucaugcugguggcacauuacgcuauuauagggccgggccugcaggcgaaggccacaagggaggcgcaaaaacgcacggccgcagguaucaugaagaaccccacggucgacggcaucguggccaucgaccucgaccccgugguauacgacgccaaauucgagaagcaacugggccaaaucauguuacucaucuugugcaccagccagauauuauugaugcgcaccaccugggcgcugugugagucuaucacgcuggcgacugguccgcucacgacccucugggagggcucaccggggaaguucuggaauacaaccaucgcugucuccauggccaacaucuuccggggcagcuacuuagccggugcgggccucgcuuuuucccugaugaagagucugggcggaggucgccgggggacgggggcccaaggcgaaacccucggagagaaguggaagagacaacugaaccagcuaaguaagagcgaauuuaacacguacaagcggaguggcaucauggaaguugaccguagcgaagccaaggaggggcugaaacggggcgaaaccaccaagcacgcgguuagccgcgggacggccaaguugcggugguucguggagcgcaaccuagugaaacccgagggcaaggucaucgaccugggcugcgggcggggcggaugguccuacuacugcgccggccuaaagaaagugacggaggucaagggguacacgaaagggggcccagggcacgaggagccuauccccauggcaaccuacggcuggaaucuggucaagcugcacagcgggaaggauguguucuucaugccgccagagaagugcgacacgcuacugugugacaucggcgaguccagcccgaaccccacuauagaggagggacgcacguuacgggugcucaagauggucgagcccuggcugcgcggcaaccaguuuugcauaaagauccuuaacccguauaugccgagcgugguggaaacacucgagcagaugcagcggaagcacggugggaugcugguccgcaacccccuaagccguaacagcacccacgagauguacuggguguccugcggcaccgggaacaucguaagcgccgucaacaugacgagucgcaugcuucugaaccgguucaccauggcccaccgcaaaccuaccuuugagcgcgacguggaccuuggcgccggcacgcgacacguugccgucgagcccgagguugcgaaccucgacaucaucgggcagcggauagagaacauaaagaacgagcacaagucuacguggcacuaugacgaggacaacccguacaaaaccugggccuaccauggcagcuaugaaguuaaacccucugggagcgcaaguagcaugguuaacggcgucguacgccuccugaccaaacccugggacgucauacccaugguuacccagaucgccaugacggacaccaccccguucggccagcagcgcgucuuuaaggagaaaguagauacccgaacgccccgugccaaaagaggcaccacccagauaauggaaguaaccgccaaauggcucuggggcuuuuuaucgcggaauaagaaaccacggaucugcacucgcgaggaguucacucggaaaguccguucaaacgccgcgauuggggcgguguuuguggacgagaaccaguggaauagcgccaaggaggccgucgaggacgaacgguucugggaccuggugcaucgcgaaagagagcuccacaagcaaggaaagugcgcgaccuguguguacaacaugauggguaagagagagaagaaacucggcgaguuugggaaagcaaagggaucccgagcgauuugguacauguggcugggcgcucgcuuccucgaguucgaagccuuagguuucaugaacgaggaccacugguucagcagggaaaauucgcuaaguggcgucgagggcgagggucuccacaaacuugguuauauccugagggacaucuccaagauuccuggcgguaacauguacgccgaugacacagcugggugggauacgcggaucacagaggaugacuugcagaacgaagcuaaaaucaccgacauuauggagcccgagcacgccuuauuagccaccagcauauucaaacucacguaccagaauaagguagugcgcguccagagacccgcgaagaacgggacggucauggacgugaucucccggcgugaccaacggggguccgggcaaguugggaccuacgggcugaacaccuuuaccaacauggaggugcaguugauccggcagauggagucugaaggcauauuucuccccuccgaacuugagacaccgaaccucgcagaacgaguguuggauugguuagaaaagcacggggcagaacgcuugaagagaauggccaucuccggcgaugacugcgucgugaagccaaucgacgaccgcuuugccaccgcccuaaccgcccugaacgacaugggcaaggugcggaaggacaucccgcagugggagcccucgaagggguggaacgacuggcagcaggucccguuuugcucccaccauuuccaccagcugaucaugaaagauggucgcgagauuguggugcccugccggaaccaggacgaacucgucggacgcgcacgggugagccagggcgccggcuggucauugcgugagacggcaugucugggcaagucguaugcgcagauguggcaacucauguacuuccaccgucgcgaccuacggcuggcggccaaugccaucugcuccgcggugcccgucgacuggguacccacgucucgcaccacauggagcauacaugcccaccaccaauggaugaccacagaggauaugcucuccguguggaaccgggucuggaucgaagaaaacccguggauggaggacaagacccacguuagcuccugggaggaggugcccuaccuggggaagcgcgaagaucaguggugcgggagccugauaggccugacugcccgcgcuaccugggccacgaauauucaggucgcgaucaaccagguucggcgccugauaggcaacgagaauuaccuggauuacaugaccucaaugaagagguucaagaacgagagcgacccagaaggcgcccucugguga

SEQ ID NO: 23861 - RNA, 9879 nt, Artificial Sequence
  derived and/or modified CDS sequence (opt11) from DENV-1__GQ868499__SS-prME
agcguaaccaugcugcucaugcuccugccgaccgcccuugccuuucaccugaccacccggggcggggagccccacaugaucgugagcaagcaggagcgggggaagagccugcucuuuaaaaccagcgccggggugaacaugugcacccugaucgcaauggaccugggcgaguuaugugaagacacuaugacuuauaaaugcccucagauuaccgaggccgagcccgaugacguggacugcuggugcaacgccaccgacaccugggugaccuacggaacaugcucucagacaggcggccaccgccgugagaagcgcuccguggcccucgcuccucaugugggccugggccucgagacucggaccgagaccuggaugucauccgagggggccuggaagcagauacagcggguggagaccugggcgcugcgacaccccggguucacgguaauagcccuguuccucgcgcaugcuauaggaaccagcaucacacaaaaggguaucauuuucauccugcugauguuagugacccccucaauggccaugcgcugcgucggaaucggaaacagggacuucguggagggccugaguggagccaccuggguugaugucgugcuagagcauggguccugcgugacuaccauggcaaaaaacaagcccacccucgacaucgagcugcugaaaacagaagucaccaaucccgcggugcucaggaagcuguguauagaggccaagaucaguaacaccacuaccgacucgcggugcccgacccaaggcgaggccacacuuguggaggagcaggacgccaacuucgucugccgccguacauucguggacagaggguggggcaacgggugcggucucuucgggaaaggcagccuucucacaugugccaaguucaagugugucaccaagcucgagggcaagauuguccaguacgaaaaucucaaauauuccgugauuguuacaguccacacgggggaccagcaccagguuggcaacgagacgaccgagcacgggaccaucgcgaccaucacgccgcaggccccgacgagcgagauucaacugaccgacuacggcgcacucacccuggacugcagccccaggacagggcuggacuucaaugagauggugcuguuaacgaugaaggagaaguccuggcuaguucacaaacagugguuccucgacuugccgcuaccuuggaccuccggcgcuucaaccagccaggaaaccuggaaccgccaggaccugcuagucacguucaagaccgcccacgccaagaaacaggaggucgugguacugggcucccaggagggggccaugcacacggcgcucaccggagccacagagauccagaccagcgggaccaccacgaucuucgccggccacuugaagugccggcuaaagauggauaaacucacccuuaaagggaccuccuacgugaugugcaccggcagcuucaagcuugagaaagagguggcggaaacgcagcacgggaccgugcuaguccaggucaaguacgaggggaccgaugcacccugcaagauccccuuuuccacccaggaugagaagggcgugacgcagaacgggcgccuuaucaccgcgaaccccauaguaaccgacaaggagaagccaguuaauaucgagaccgagccgcccuucggcgagucauacauaguggugggcgccggggagaaggcguugaagcuaucaugguucaagaagggcucuuccaucgggaagauguucgaggcgaccgcccggggcgcccgccggauggcaauucucggggacaccgcuugggacuucggcagcauuggcggcguuuucacauccgucggcaagcugguccaucaaguguucgggacagcuuacggcgugcuuuucagcggagucuccuggacgaugaagaucggaaucggaauacuucuaaccuggcugggauugaacagccgcaguaccucucuguccaugaccuguaucgccguggguauggugacgcuguaucucggggucauggugcaggcggacaguggcugcgugaucaauuggaaggggcgcgaauugaaauguggguccggcaucuucgucaccaaugaggugcacacauggaccgagcaguauaaguuccaagccgacagcccgaagcgguugagcgcggcuaucgggaaggcaugggaagaaggggucugcgggauccgcuccgccacucgguuagaaaacauaauguggaagcagauuagcaacgaacugaaucacaucuugcucgaaaacgacaugaaauuuacuguuguggugggcgacgccaacgguauccuagcccagggcaagaaaaugauccgcccccagccaauggagcacaaguauuccuggaaguccuggggcaaggccaagaucaucggagccgacauccagaacaccaccuucaucauagacggccccgacacuccggagugcccggacaaccagagagccuggaacaucugggagguggaggauuauggguucggcaucuucacgacaaacauuuggcuaaaguuacgugauuccuacacccagaugugcgaccaccgguugaugagcgcggcuaucaaggacucaaaggccgugcacgcugacaugggcuacuggauugagagcgagaagaacgaaaccuggaagcuggcccgagcauccuucauugaggugaagacuugcacuuggcccaaaagccacacccucugguccaauggaguccuggagagcgagaugaucauucccaagaucuacggcgguccaaucucccagcacaacuaccggcccggauacuucacccaaaccgccgggcccuggcaccuaggcaagcuugagcuugacuuugaccugugcgagggcacuacugucguggucgacgagcacugugggaaccgcggcccgagucuccgcacgacgaccgucaccgggaagaucauucacgaguggugcugccgcuccugcacacugccgccucuacguuuucgcggagaggacggaugcugguacggcauggaaauccgucccgugaaggagaaggaggagaaccuugugcgcagcaugguuucggcgggcagcggggagguugacagcuuuuccuugggcauccugugcgccagcauaaugaucgaggaagucaugagaucccgcuggucccguaagaugcucaugaccggcacccuagccgucuucuuacuccugaucaugggccagcucaccuggaaggaucuuauccgacuaugcaucauggugggggcgaaugccuccgaccgcaugggcauggguaccaccuauuuggcauuaauggcaaccuucaaaaugagaccgauguuugccgucggccuccuguuccgccguuuaacaagcagggagguuuuacugcucaccaucggccucucccucguggcgagccucgagcugcccaacucacuagaggagcucggcgacggacuggcgauggguaucaugaugcuaaaacucuugacggaguuccagccccaccagcuguggaccacccuacugucccugacuuuuaucaagacaacccucucccuggacuaugccuggaagacaaccgcaauggcgcugaguaucgucucgcucuuuccccugugccuuuccacaaccucccagaagacgaccuggcucccgguucugcuuggaagcuucgguuguaaacccuuaacgauguucuuaaucacggagaauaagaucuggggccguaaguccuggccccuuaacgagggcaucauggccaucgggaucgucagcaucuuacuguccagccuguugaaaaacgaugugccccuggccggcccgcugaucgcaggcggcaugcuuauugccugcuacgugaucagcgguuccagcgcggaccugucucuugagaaggucgccgaggugaguugggagcaggaggccgagcacuccggaaccagccacaacauccuaguggagguucaggacgacgggacgaugaagauaaaggacgaagagcgcgacgacacauugacgauccugcugaaggccacacuguuggcgguguccgggguguaucccaugagcauucccgcgacccuguuugucugguacuucuggcagaaaaagaagcagcgguccggcguacucugggacacucccucaccgcccgagguggagcgcgccguccuagacgacggcaucuaccggauccuacaacgggggcugcucggccggucccagguggggguaggcgucuuucaggacgggguguuucacacgauguggcacguaaccagaggcgccguccugauguaccaggggaagcggcucgagccgucaugggcguccgugaagaaggaucugauuagcuacgggggcggcuggcgcuuucagggcaguuggaacacgggcgaggaggugcaggucauagcuguagagcccggcaagaacccgaaaaauguacagaccacacccggcaccuucaagacccccgagggggaggucggcgcgaucgcccuggauuuuaaaccaggaaccagcgguuccccgaucgucaaucgugaaggcaagauaguuggcuuguacgguaaugggguaguaacuaccagcgggaccuaugucuccgcaaucgcccaggccaaggcuucccaggaggggcccuugcccgaaaucgaggaugagguguucaagaagcgaaaccugacaauuauggaucuccacccaggcagcggcaagacucggcgcuaucugccugccauaguucgggaggccaucaagcguaagcugcggacccucauacuggcuccgacccgcguaguggcaucagagauggccgaggcccugaaagggaugcccauccgcuaccagaccacggcggucaagagcgagcacacgggacgcgagaucguugaccucaugugccacgccaccuucaccaugagacugcugucccccgugcgggugcccaauuacaauaugauaaucauggacgaggcacacuucacggaccccgccagcaucgccgcccgaggcuacauauccacucggguuggcaugggugaggccgcggcgaucuuuaugacagccacgccgcccgggagugucgaggcuuucccgcaauccaacgccguuauucaggacgaggagcgcgacaucccagagagaagcuggaacuccggguacgacuggaucacggacuuccccgguaagaccgugugguucguaccuagcaucaaguccggcaaugacaucgcgaauugccucagaaagaacggaaagcgaguaauccaguuaagccgcaagaccuucgacacagaguaccagaagacuaagaacaacgauugggacuacguggucaccaccgacaucuccgaaaugggggccaacuuccgggccgaccgcgucaucgaucccagacggugccugaagcccgugauccucaaggacgggccggagcgggucauccuggcuggcccgaugcccgugaccguagcgagcgccgcccaaagacggggccgcauugggcggaaccagaacaaggaaggcgaucaguacgucuauauggggcagccccugaacaacgaugaggaccacgcccacuggacggaggccaagaugcuccuggacaacaucaacaccccggagggcaucaucccggcccucuucgaacccgagagggagaaguccgccgccaucgauggggaguaccgccuccggggcgaggcgcgcaagacuuucguggagcugaugcggcgcggcgaccugccgguauggcucagcuauaagguggccuccgagggguuccaauauagcgauagacgcugguguuucgauggcgagcggaacaaccaagugcucgaggaaaacauggacgucgagauauggacuaaggagggggagcguaagaagcugcgcccccgcuggcucgacgcacggacguacuccgacccacuggcucugcgcgaguucaaagaguucgccgcgggccggcgcagcgugagcggagacuugaucuuagagauagggaaguugccacaacaucucacuuugcgggcccagaacgcguuagacaaccucguuaugcugcacaacagugaacaaggagggaaagccuaucgacacgcaauggaggagcugcccgacacgaucgagacguuaaugcugcuggcccucaucgccguccugaccggcggggugacgcuauucuuccucucaggaaagggccugggcaaaacuuccaucggucugcucugcguuaccgcgagcuccgcccuccuguggauggccagcgucgagccccacuggaucgccgcuucuaucauccucgaguuuuuccuuauggugcuauuaauaccggagcccgaucggcaacgcaccccucaggacaaccagcuggcguacgugguaaucggccuucuguucaugauucugaccguggccgccaacgagaugggccuguuagagacuaccaagaaggaccuggggauuggccacguggccgcggagaaccaucagcaugcgaccaugcuggacgucgaccugcggccagccagcgccuggacccuguacgccguggcgacgaccgugaucaccccgaugaugcgccauaccaucgaaaacacaacggccaacaucucccugacagccauugccaaccaggccgcuauucucaugggacucgacaagggguggcccauuagcaagauggauaucggcgugccccugcuagcgcuggggugcuacucacaggugaacccauuaacccucaccgccgcaguacugauguuggucgcucacuacgccaucauuggccccggauuacaggccaaagccaccagggaggcccagaagcgcacugcggcaggcaucaugaagaaucccacgguggacgguaucguugccaucgaucuggaucccgucguauacgaugcaaaauucgagaagcagcuggggcagauuaugcuucugauccuguguaccagucagauacuccugaugcguacaaccugggcacuuugugaauccaucacauuagcaacaggcccgcuuacgacacugugggaggggagcccaggcaaguuuuggaauaccaccaucgccgugucgauggcgaacaucuuccgcggcagcuaccucgcaggggccgggcuggcguuuucccugaugaagucccucgggggcgggcgcaggggcaccggggcccagggggagacccucggcgagaaguggaagagacagcugaaccagcuaucaaagagcgaguuuaacacguacaagcgguccggaaucauggaagucgaccgcagugaggcuaaggagggccugaagagaggggagaccaccaaacaugccgugagccgcggcacagcuaagcugcggugguucguugaacguaaucuggucaagccagagggcaagguuauugauuuggggugcggccgcggcgguugguccuacuauugcgcaggacugaagaaggugaccgaggucaaaggcuacacaaaaggcgggcccgggcaugaggagccgauccccauggccacguacggauggaaccucgugaagcugcauaguggcaaggacguguuuuucaugccucccgagaagugugacaccuuacugugcgacauaggcgagucgagcccgaaccccaccauagaagagggccgcacccuccggguccugaagaugguggaaccauggcugaggggaaaccaguucugcaucaagauucucaacccauacaugccgucgguggucgagacgcuggagcagaugcagcggaagcauggaggcaugcuggugcgcaacccccucucucgaaacuccacgcacgagauguacugggugagcugugggacgggaaacauagucagcgcagugaacaugacgagccgcaugcugcucaaccgguuuacaauggcccaccgcaagcccacguacgaacgcgacguggaccucggggcgggcacacggcauguggccguggaaccggaggucgccaaucuggacaucaucggucagcgcaucgagaacaucaaaaacgagcacaagucaaccuggcacuaugaugaagacaacccguacaagacgugggccuaccaugggaguuacgaggucaagcccuccggcagcgcuucaagcauggucaacggcguuguccggcugcugaccaaaccgugggacgugauccccauggugacccaaaucgcgaugacggacacaacgccguucggccaacaacguguuuuuaaggagaagguggauacccggacuccccgcgcuaaacgaggcacgacccaaaucauggaaguuaccgcgaaguggcugugggguuuccuguccaggaacaagaaacccagaaucugcacucgcgaggaguucacccguaagguccgcagcaacgcagcgaucggcgcgguguucgucgaugagaaccaguggaacagcgccaaggaagccguggaggacgaaagguuuugggaccucgugcaccgcgagagggaacugcacaagcaggguaagugcgcuaccugugucuauaacaugaugggcaagcgcgagaagaagcugggggaguucggcaaggcaaagggcucccgggccaucugguacaugugguuaggugcccgcuuccuagaguucgaggcccugggcuuuaugaacgaggaccacugguuuucacgggagaauucccucagcggggucgagggcgaggggcugcacaagcucggcuacauccugcgagacaucuccaaaaucccgggcgggaacauguacgccgaugacaccgcuggcugggauacgcggaucaccgaagacgaccugcaaaacgaggcgaaaaucaccgacaucauggagccugagcacgcccugcuagccacaaguauauuuaagcugacguaccagaacaaggugguccgggugcagcgccccgccaagaacgggacugucauggacguaauuucccggcgcgaccagaggggcucuggacagguggggaccuacggacugaacacauucacgaacauggaagugcaacucauccgccagauggaguccgagggaauauucuugccgagcgaacuggagaccccgaaccucgcggaacgcgucuuagacugguuagagaagcacggugcggagcgccugaagcggauggccaucuccggagacgauugcguagugaagccuaucgacgacagauucgcgacagcucugaccgcgcucaaugacaugggcaaaguccggaaggauaucccccaaugggaaccuagcaagggcuggaacgacuggcagcaaguaccguucugcucccaccacuuccaccagcucauaaugaaggauggacgggagaucguggucccgugccgaaaucaggaugaguuggugggccgggcccggguaagccaaggagcgggcuggucacugcgugagaccgccugucucggcaaaagcuacgcccagauguggcaguuaauguacuuccaccggcgcgaccugcggcucgccgccaaugcgaucugcuccgccguccccguugacuggguccccacgagcagaacuaccuggagcauccacgcgcaccaucaguggaugacaacggaggauauguugucgguauggaaucguguuuggaucgaggaaaaucccuggauggaagacaagacccacguuagcuccugggaggaaguucccuaccugggcaagcgcgaggaccaguggugcggcagcuuaaucgggcugacggccagggccaccugggccacgaacauccagguagcuaucaaccagguucggcgccugaucggcaacgagaauuaucucgacuacaugacguccaugaagcgguucaagaaugagagcgaucccgaaggggcguugugguaa

SEQ ID NO: 23862 - RNA, 9879 nt, Artificial Sequence
  derived and/or modified CDS sequence (opt11) from DENV-1__GQ868500__SS-prME
agcguuaccaugcugcucaugcugcugcccaccgcccucgccuuucaccugaccacccggggcggggagccccacaugaucgugagcaagcaggagcggggcaagagccuccuguucaagaccucagcgggggugaacaugugcacccugaucgcaauggaccuaggcgagcucugcgaggacaccaugaccuacaagugcccccagaucaccgaggccgagcccgacgauguugacugcuggugcaacgccacugacaccugggucaccuacgggacgugcucucagaccggagagcaccgccgggacaagcgcuccguggcgcuggcgccucacguaggucuggggcuugagacccggaccgagacauggaugucguccgagggcgccuggaagcagauccagcgugucgagaccugggccuuacggcaccccggguucacgguaaucgcgcuguuccuggcucaugcuauuggcaccagcaucacacaaaagggcaucaucuucauccugcugaugcucgugacccccaguauggcgaugcgcugugugggcauuggcaaccgggacuucguugagggcuuaagcggcgcuacguggguagacguugugcuggagcacggguccugcgugaccaccauggccaagaacaaacccaccuuggacaucgagcugcugaagacggagguuaccaaccccgcgauccuccgcaagcugugcauugaggccaagaucagcaacaccaccaccgacucccgcugcccgacccaaggcgaggccacccugguggaggagcaggacgccaauuuuguaugccgccggaccuucgucgaccgcggcugggggaacggcugcggccucuucggcaaggggagccugcugacgugcgcgaaguucaagugcgugaccaagcucgagggcaagaucgugcaguacgagaaccugaaguacuccgucaucgugaccgugcacaccggcgaccagcaccaggucgggaacgaaacuacggaacacggcaccaucgcgacuaucacgccucaggcccccacuagcgagauccagcucaccgacuacggugcccucacccuggauugcagcccccggaccggccuggacuuuaacgagauggugcuccugacgaugaaggagaaguccuggcugguccacaagcagugguuccuggaccucccguuacccuggacuuccggagccagcaccagccaggagaccuggaaccgccaggaccuccuagugacguucaagaccgcccaugcgaagaagcaggaaguggucgugcugggcucccaggagggcgcuaugcacaccgcacucaccggcgcaacggagauccagaccagcgguacuaccacgaucuucgccgggcaccugaagugccggcugaagauggacaagcucacucugaagggcaccucuuacgugaugugcaccgggucuuucaagcuggagaaggaggucgcggaaacgcagcacggcaccgugcuggugcaggucaaguacgagggcaccgaugcccccugcaagauccccuucaguacccaggacgagaagggugugacgcagaacggucgucuaaucaccgccaaccccaucgugaccgauaaggagaagcccgucaacauagagaccgagccgcccuucggggaaagcuacaucgugguaggcgccggagagaaggcgcugaagcuguccugguucaagaaggggucuuccaucggcaagauguucgaggccacggcacgcggcgcccgccggauggccauccucggcgacaccgcgugggacuucgggagcaucggcggcgucuucaccagcguggggaagcuggugcaccaggucuucggcaccgcauacggggugcuguucagcggcgugucuuggacgaugaagaucgggauuggcauccuacugaccuggcugggccuaaacagccgcucaaccagucuguccaugaccugcaucgcugucgggauggugacgcuguacuugggugugaugguucaggcggacagcgggugcgugauaaacuggaagggucgcgagcugaagugcgguuccggcaucuucgugaccaaugaagugcacaccuggaccgagcaguacaaguuccaggccgacuccccgaagcggcuaagcgcggccaucggcaaggcuugggaggagggggugugcggaauccgcuccgccacccggcucgagaacaucauguggaaacagauuagcaacgaacugaaccacauccugcucgagaacgacaugaaguucacggugguagugggggaugccaacggcauccucgcacaggggaagaagaugaucaggccccagcccauggaacacaaguacuccuggaaauccugggggaaggccaagaucaucggggcagacauccagaacaccaccuucauaaucgacgggcccgacaccccggaaugccccgacaaucagcgggccuggaacaucugggagguggaggacuacggcuucgggaucuucacgacuaacaucuggcugaagcuccgcgacaguuacacccaaaugugcgaccaucggcugaugagcgcggccaucaaggacuccaaggccguacacgccgacaugggcuacuggaucgaaagcgagaaaaacgagacguggaagcuggcccgugcgaguuucaucgagguuaagacaugcaccuggcccaagagccacacccucugguccaacggcgugcuggaaagcgagaugaucauucccaagaucuacggagggcccaucucccagcacaacuaccggcccggguacuucacgcagacugccggccccuggcaccuggggaaguuagagcuggacuucgaccugugugaaggcaccacagucguaguggacgagcacugcggcaaccgcgggccaagccuccggaccacgacggucaccggcaagaucauccacgaguggugcugccgcuccugcacccugccgccccuacgguuucgcggggaggacggcugcugguacgggauggagauccggcccgugaaggagaaggaggagaaccuaguacgcagcaugguauccgccggaagcggcgagguggacagcuucucccuggggauccugugugcaagcaucaugaucgaggaggugaugcggucccgcuggagccggaagauguugaugacggggacacuggcagucuucuugcuccuggugauggggcagcuaaccuggaacgaccucaucaggcugugcaucauggugggcgcgaacgccuccgaccgcauggggaugggcaccacauaccuggcccucauggccaccuucaagaugcgaccgauguucgcggucgggcugcuguuccgacggcucaccucacgcgaggugcugcugcucaccaucgggcuuucccugguagcaagcgucgagcuccccaacucucuggaggaacugggggacgggcuugccaugggcaucaugaugcugaagcugcucacggaguuccagccccaccagcuguggaccacccugcucagccugacauucaucaagacgacccugucgcucgacuacgcguggaagaccaccgcuauggcgcugagcaucgugucccuguucccccuuugccugagcacgaccucccagaagaccaccuggcugccgguccuccugggcucauucgggugcaagccccugaccauguuccugaucacggagaacaagaucuggggccggaaauccuggccccugaacgagggaaucauggcaaucggcaucgugagcauccugcucuccagccugcugaaaaacgacgugccccuugccgggccgcugaucgccggcggcaugcugaucgccugcuaugugaucucugggucgagugcggaccucucccuggagaaagcagccgaggugagcugggagcaggaagccgagcacuccggaacgagccacaacauacugguggagguccaggacgacgggaccaugaagaucaaggacgaggaacgcgacgacacccuuacgauccuguugaaggccacccuccuggccguauccggaguauaucccaugagcauccccgccacccuguucgucugguacuuuuggcagaaaaagaagcaacggucugggguauugugggauacccccagcccucccgagguggagagggccguccuggacgacggcaucuaccggauccugcagcgcggccuguuagggcggucccaggugggcgucggggucuuccaagacggaguguuccacacaauguggcacgugacccgcggggccguccucauguaccagggcaagcggcuggagcccagcugggccuccgugaagaaggaccucaucaguuacggcggggguuggcgcuuccaggggucguggaacaccggcgaggaggugcaggucaucgcaguggagcccgggaagaacccgaagaacgugcagaccacgcccggcaccuucaagacccccgagggcgaggucggggccaucgcccuggacuucaaacccggcaccagcggguccccgaucgugaaccgggagggcaagaucgugggccuguacggaaacggcgucgugacgaccagcgggaccuacgugucugccaucgcccaggcgaaggccagccaggagggcccgcuccccgaaaucgaagacgaggucuucaagaagcgcaaccugaccaucauggacuugcacccugggucgggcaagacgcggcgcuaccuccccgcuauggugcgggaggcgaucaagcgcaagcugcggaccuugauccucgcgccaacgcgcgucgucgccuccgagauggccgaggcccugaagggcaugcccauccgcuaccaaaccacggccgucaagagcgagcacaccgggcgggagaucguggaccugaugugccacgcgaccuuuaccaugcgccuccuguccccugucagagugcccaacuacaacaugaucaucauggacgaggcccacuucacggaccccgccucgaucgccgcccguggcuacaucuccacgcggguggggaugggcgaggcggccgccauauucaugaccgccacgccgcccgguucuguagaagcguucccccagagcaacgcggugauccaggacgaggagcgcgacaucccagagaggagcuggaacuccggcuacgacuggaucacggacuuccccggcaagaccgugugguucguccccagcaucaaaagugguaacgacaucgccaacugccugcgcaagaacggcaagcgggugauacagcucagccgcaagaccuucgacaccgaauaccagaagacgaaaaacaacgacugggacuacgugguuaccacugacaucuccgagaugggggccaacuuccgggcugaccgcgugaucgacccccggcgcugccucaagccugugauccugaaggacgggcccgagcgggugauccucgcuggaccgaugcccgugaccguggccucagccgcccagcgccggggccgcauaggaagaaaccagaacaaggagggggaccaauacgucuauaugggccagccauuaaacaacgacgaggaccacgcccauuggacggaggcgaagaugcugcucgacaacauuaacacaccagaggggauaaucccggcucuguucgagcccgagcgcgagaaguccgccgccauagacggcgaguaccgccugcgcggggaggcccgcaagaccuucguggagcucaugcggcgcggcgaccugcccgucuggcugagcuacaagguggcguccgagggcuuccaguacagcgaccggcgcuggugcuuugacggagagcggaacaaccagguucucgaggagaacauggacgucgagaucuggaccaaggagggcgagcgcaagaaguuacggccucgcuggcuggacgcucgaaccuacuccgacccgcucgcccugcgcgaguucaaggaguucgccgccgggcggcgcagcgugagcggcgaccugauccucgagaucggcaagcuaccccaacaccuaacccuccgggcgcaaaacgcgcuggacaaccuggugaugcuccacaacucugagcagggcgggaaggccuaccggcacgcaauggaggagcugcccgauacaaucgaaacccugaugcuccuggcgcugaucgccguccucaccgggggcgugacgcuguucuuccugagcgggaagggucucggcaagaccuccauuggguugcugugcgugaccgccucauccgcccugcuguggauggccuccgucgaaccccacuggaucgcggccucuaucauccucgaguuuuuccuuauggugcugcugaucccggagcccgaccggcagcgcacgccccaggacaaccagcuggcuuacguggucauaggccugcuguucgugauccucacgguugccgccaaugagauggggcugcuggagaccaccaagaaggaccugggcauagggcacgucgcggcugagaaccaccaacacgcgaccaugcuggacguggaccugcggcccgccagcgccuggacgcuauacgcgguggccaccaccgucauaacccccaugaugcgccacaccaucgagaacaccaccgcgaauaucucuuugaccgccaucgccaaccaagcggccauccugaugggccucgacaaaggcuggccgaucagcaagauggacaucggggugccccugcuggcccucgggugcuacucccaggugaauccguuaacguuaaccgcggcgguccucaugcugguggcccacuacgccaucaucgggcccggccugcaggccaaggccacccgggaggcgcaaaagcgcaccgccgcugggaucaugaaaaacccuacgguggacgggauugucgccaucgaccucgacccagucguguacgaugccaaguucgagaaacaguugggccaaaucaugcugcuaauccugugcacuagccagauccugcucaugcgcaccaccugggcgcugugcgaguccaucacgcuggccacagggccgcucacaacccugugggagggcagccccggaaaauucuggaacacgaccaucgccgucucuauggccaacauauuccggggcagcuaccuugccggcgcggggcucgccuucuccuuaaugaagucgcugggcggagggcgccgggggaccggcgcccagggggagacccucggggagaaguggaaacgccaguugaaccagcugucaaaaagcgaguucaacacuuacaagcggucgggcaucauggaaguggaucgcuccgaggccaaggaggggcucaagcggggcgagacuaccaagcaugcagugagccgcgggaccgccaagcugcggugguucguggagaggaaccuggugaagcccgagggcaaggugauugaccugggcugcgggaggggcgggugguccuacuauugcgccggacuaaagaaggucaccgaggugaagggguacacgaagggcggucccgggcaugaggagccgauccccauggcaaccuacggcuggaaucuagugaagcuccacagcgggaaggacgucuucuucaugccgcccgagaagugcgacacccuccugugugacaucggcgagaguagcccgaaccccaccaucgaggaggggcgcacguuacgagugcucaagaugguggagcccuggcugcggggcaaccaguucugcauaaagauccucaaccccuacaugccuuccguuguggagacccucgaacagaugcagagaaagcacggcgggaugcuagugcgcaacccccuaagccggaacuccacccacgagauguacugggucagcugcggcacugggaacaucguguccgccgugaacaugaccagccgcaugcuccugaaccgcuuuaccauggcgcacagaaagcccaccuacgagcgcgacgucgacuuaggcgccgggacccggcacguggccguugagcccgaggucgccaaccucgacaucauugggcagcgcaucgagaacaucaagaacgagcacaaguccacguggcacuacgacgaggauaacccauacaagaccugggccuaccacggcagcuacgagguuaagcccuccgggagcgcguccagcauggugaacggggucguacggcugcuuaccaagcccugggaugucauucccauggucaagcaaaucgccaugaccgacacaaccccguucggacaacagcgagucuucaaggaaaagguggauacccggacgccccgggccaagcgaggcacgacgcaaaucauggaggugaccgccaaguggcucuggggcuuccugagccgcaacaagaagccccggaucugcacccgugaggaguuuacgcggaaggugcgcagcaacgccgcuaucggggccgucuucgugggugagaaccaguggaacagcgccaaggaggccguugaggacgagcguguuugggaccugguacaccgcgagcgcgagcuccacaagcaggggaagugugcaacaugcgucuacaacaugaugggcaagcgagagaagaagcugggggaguucggcaaggcuaagggcucacgggccaucugguauauguggcugggggcccgcuuccucgaguucgaagcccugggcuucaugaacgaggaccacugguucagccgggagaacucccugagcgggguggagggcgaggggcugcacaagcuaggcuacauccugcgcgacaucuccaaaaucccgggcgggaacauguacgcggacgauaccgccggcugggacacgcggaucaccgaggacgaucuccagaacgaggccaagaucaccgaaaucauggaacccgagcaugcgcugcuggccaccagcaucuucaagcucaccuaccagaacaagguggugcgcguccagcgccccgcgaagaacgggacggugauggacgugauaucccggcgcgaccagcggggcagcggccaggucgggaccuauggacugaacacuuucaccaacauggaagugcagcugauccgccagauggaguccgaggggaucuuccuccccagcgagcuggagacgccgaaccuggcugaacggguccucgacuggcuggagaagcacggcgccgagcgccugaagcggauggccaucuccggggacgauugcgucgugaagcccaucgacgaccgcuucgccaccgcgcucacggcgcugaacgacaugggcaaggugcggaaggacauaccacagugggagcccagcaagggcuggaacgacuggcagcagguaccguuuugcucccaccacuuccaccaguugauaaugaaggacgggcgcgagaucguggugcccugccggaaucaggacgagcucguaggccgcgcccgggugagccagggugccggguggucccugcgcgagaccgccugccugggcaagucguacgcgcagauguggcagcugauguauuuccaccggcgugaccugcggcuggccgccaacgccaucugcuccgcuguacccgucgacugggugcccaccagucgcacgaccuggucaauccacgcccaucaccaguggaugacuaccgaagacaugcucuccguguggaaccgggucuggaucgaggagaacccguggauggaggacaagacccacguaucaucaugggaggaggugcccuaccuuggcaagcgcgaggaucaguggugcggcagcuuaaucgggcucaccgcccgcgccacgugggccaccaacauccagguugcgaucaaccaggugagaaggcugaucggcaacgagaacuaccuugacuacaugacgucuaugaagcgguucaagaacgagagcgaccccgagggggcccucugguaa

SEQ ID NO: 23863 - RNA, 9879 nt, Artificial Sequence
  derived and/or modified CDS sequence (opt11) from DENV-1__GU131961__SS-prME
agcgugaccaugcugcucaugcugcugcccacugcucucgccuuucaccugacuacucggggcggggagccccacaugaucguguccaaacaggaacggggcaagagccuccuguucaagacgagcgcgggggugaacaugugcacccuuaucgcuauggaccugggugagcucugcgaggacaccaugaccuacaagugcccacagaucaccgaagcagagcccgaugacgucgacugcugguguaacgccacggauaccugggucacauacgggaccugcagccagaccggagagcacagacgggauaagcggaguguugcauuggcgccccacguggggcucgggcucgaaacgcggaccgagaccuggaugagcucugagggcgccuggaagcagauccagagagucgagacuugggcccugcggcaccccgguuucacagugaucgcccuguuccucgcacacgccauaggcacauccaucacccagaagggcaucauauuuauccugcugaugcucgugaccccuucaauggcaaugcguugcgugggaauuggcaaccgggacuucguggaggggcugaguggcgccacuuggguggauguuguguuggagcacggguccugugugaccacaauggccaagaacaagccaacccucgacauagagcugcugaagacggaagucaccaaccccgcuauccuccgcaagcugugcaucgaggccaagaucagcaacacuaccacggacucccggugcccgacccagggcgaggcgacccugguggaggagcaggacgcaaauuucgugugccgccggaccuucguggaccgaggcugggggaacggcugcggucucuucgguaaggggagccugcucacgugcgccaaguucaagugcgugaccaagcucgaaggcaagaucgugcaguacgagaaccugaaguacuccguuaucguaacggugcacaccggcgaccagcaccaggucgguaacgagacgacugagcacgguaccauagcgaccaucacgccccaggcgccgacgucggagauccaguuaaccgauuacggggcucuaacguuggacugcagccccagaaccggccuggacuucaacgagauggugcuccugaccaugaaggagaaguccuggcuugugcacaagcagugguuccuggaccugccguuacccuggacauccggggccagcaccagccaggagaccuggaaccgccaggaccuccuggugaccuucaagaccgcacacgccaagaaacaggaggugguaguccugggcucucaggaaggcgccaugcacaccgccuugaccggcgccacagagauacaaacuagcggaaccacgacuaucuucgccggucaucugaaaugucggcuaaagauggacaaacucacguugaaaggcaccucauacgugaugugcaccggauccuuccgccuugagaaggaggucgcggagacgcagcacgguacgguguuggugcaagucaaauacgaggguaccgacgcccccugcaagauccccuucucgacacaggacgagaagggcgugacucagaacgggcggcucaucacggccaauccgaucgugacggacaaggagaagcccgucaacaucgagacagagccgcccuuuggggagucuuacaucguggugggagccggggagaaggcucugaagcugucgugguucaagaagggcagcagcaucggcaagauguucgaggccacggcaagaggggcacggcgcauggccauccucggcgacaccgcgugggacuucgggagcaucgggggagucuuuacauccguugguaagcuggugcaccaggucuucgggaccgcauacgggguacuguuuagcggcguguccuggacaaugaagauagggaucggcauccugcugaccugguuaggccugaacagccgcuccaccagccuguccaugaccugcaucgcgguggggaugguuacgcuguaucugggggugaugguccaagccgacagcgggugcgucaucaacuggaagggacgggagcugaagugcggguccggcauauucgucaccaacgaggugcacaccuggacagagcaguacaaauuccaggcggacucuccgaagagacuaagcgcggccauuggcaaggccugggaggagggcgugugcggcauccgguccgccacgcgccucgagaacaucauguggaagcagauaagcaacgagcugaaucacauccugcuggaaaacgacaugaaguucacggugguagucggggacgcuaacggcauccuggcgcagggaaagaaaaugauucggccccagcccauggagcauaaguauucguggaaguccugggggaaggccaagauaaucggugcugacauucagaacacuaccuucaucaucgacgggccagacacaccggaaugcccugacaaccaacgcgccuggaacaucugggaaguggaggacuacggcuucgggaucuuuacgaccaacauauggcugaagcuccgggauucguacacccaaaugugcgaccaccgccugaugagcgcggcaauuaaggacuccaaggccguucacgcugacaugggcuacuggaucgagucagagaaaaacgaaaccuggaagcucgcucgggcguccuucaucgaggugaagacgugcaccuggcccaagagccacacccuuugguccaacggcguacuggagagugagaugaucauccccaagauauacggaggcccgaucucccagcacaacuaccgcccuggguacuucacccagacggcaggacccuggcaucuggggaaacuugagcuggacuucgaucugugcgagggcaccaccguggugguugacgaacacuguggcaaccgggggccgagccuccgaaccacgacugucaccggcaagaucauccacgaguggugcugccgguccugcacccugccgccccugagguucagaggggaagauggcugcugguacggcauggagauccgccccguuaaggagaaagaggagaaccucgugcgaagcaugguuuccgcgggcagcggagagguggacagcuuuucccugggaauccugugcgccagcaucaugauagaggaagugaugagaucccgguggagccgcaagaugcucaugacaggcacauuagccgucuuccugcuccugaucaugggucagcucaccuggaacgaccucaucagacuguguaucauggugggcgcgaacgcauccgacaggauggggaugggcacuacguaucucgcccucauggcuaccuucaagaugcgccccauguucgccgugggucugcuguuucggcgccucacuagccgggagguccugcugcucaccaucggccugucccugguggcgagcgucgaguugccuaacucgcuggaagaacugggugauggcuuggcuaugggcaucaugauguuaaagcugcucacagaauuucagccgcaccagcuguggaccacccugcucagccugacauucaucaagacgacucucuccuuagacuacgccuggaaaaccacggccauggcgcuaagcauaguaucccuguucccccugugccuuagcacgaccucccagaagacaaccuggcugccgguguuacugggcagcuucgguugcaagccccugaccauguuccugaucacggagaauaagaucuggggccgcaaguccuggccccucaacgaggguaucauggccaucggcauugucagcauccuguuauccucucugcugaaaaacgacgucccccucgccggcccucugauugccgguggcaugcugaucgccugcuacgugaucagcgggucuucggcugaccucucacuggagaaggcagcggaagucuccugggagcaggaggccgaacacagcggcacgucgcacaacauccuaguggaagugcaggacgacggcaccaugaagaucaaggacgaagaacgggacgacacccucacaaucuuacuuaaggccacccuucuggcagucucgggcguguauccgaugagcauacccgccacucuguucguaugguauuuuuggcagaagaaaaagcagcgauccgguguacuuugggacacuccuuccccgcccgagguggagcgggccgugcuagaugacggcauauaccgcauuuuacagcggggccugcucgggcgaucucaggucgggguggggguguuccaggacggcguguuccacacuauguggcaugugacacgcggggcugugcuuauguaucaaggcaaacgccuggagcccagcugggccuccguaaagaaggaccucaucagcuacggagggggauggcgguuccagggguccuggaacacgggcgaggagguccaggugauugcggucgagcccggcaagaacccaaagaacgugcagaccacgccugggacguucaagacucccgagggagaagugggggccaucgccuuagacuuuaagcccggcacaagugguucaccgaucgucaaccgcgagggaaagaucgugggccuguaugggaauggcguugucacgacaagcggaaccuacgugucugcaauugcgcaggcaaaagccagccaggaaggaccccuccccgagaucgaggacgagguguucaagaaacggaaccugaccaucauggaccugcauccaggcucaggcaaaacgcgccgguaccuacccgcuaucguccgcgaggccaucaagcggaagcugcgaacgcugauccucgcacccacccgugugguggccuccgagauggccgaggcccugaaaggaaugcccauccgguaccaaaccacggcgguuaaaagugagcacacaggccgagaaaucguggauuugaugugccacgcgacuuucaccaugcggcuccuguccccggugcgugucccgaauuacaacaugauuaucauggaugaggcacacuucacggaccccgccagcaucgccgcccggggcuacauuuccacccgcgugggaaugggcgaggcggccgcaaucuucaugacugccacuccacccgggucuguugaggccuucccacaaagcaacgcggucauucaggacgaggagcgcgacaucccugagcgcagcuggaacuccggcuacgacuggaucacggacuuuccaggcaagacugugugguucgugcccagcaucaaauccgguaacgauaucgccaacugccugcgaaagaacggcaagcgcgucauccaacugucccggaagaccuucgacaccgaauaccagaagacaaagaacaaugacugggacuacguggugaccaccgacaucuccgagaugggggccaauuuucgcgccgaccgggucaucgaucccagacguugccugaagccuguaauccugaaggaugggcccgagagggugauucucgcggggccgaugcccgucaccguugccagcgcagcucagcgccgcggcaggaucggccggaaucagaacaaggagggggaccaguacguguacaugggccaaccgcugaauaacgacgaggaccacgcccacuggacagaggcgaaaaugcuacucgacaacaucaauaccccugaagggaucaucccggccuuauucgagccugagcgcgagaaguccgccgccaucgacggcgaguaccgacugcguggggaagcccggaaaaccuucguugaauugaugagaagaggugaccugccaguuuggcugucguauaaggucgccucagagggauuccaguacagcgaccgccgguggugcuuugacggggagcguaacaaccagguuuuggaggagaacauggacguggagaucuggaccaaggagggcgaacggaaaaagcugcgcccccggugguuggacgcccgcacauacuccgacccucucgcccucagagaguucaaagaguucgccgccgggcggcggagcgucuccggcgacuuaauccucgagauaggcaaacugccgcagcaccugacacuccgagcgcaaaacgcccuggacaaccuggugauguuacacaacuccgagcaagggggaaaggccuaccggcacgccauggaggagcugccugacaccaucgagacccugaugcuccuggcguuaaucgccguguugaccgguggagucacgcuauuuuuccugagcggaaagggacucggcaagaccaguauuggucuguuaugcgugacagccagcagugcgcucuuguggauggccagcguggagccacacuggaucgcagccuccaucauucuggaguucuuccuaauggugcuccugaucccggagcccgaucgacaacggacaccccaggacaaccagcucgccuaugucgugaucggccuacuguucaugauccucacgguggccgccaacgagaugggacuguuggagaccaccaagaaggaccucgguaucgggcacguggcggcugaaaaccaccagcacgcaacaaugcucgauguggaccugcgcccggccucugccuggacccucuacgcgguugccaccacggugaucacccccaugaugcggcauacuaucgaaaauaccaccgcuaacaucucccugaccgccauagcuaaccaggccgcgauucugaugggcuuagauaaggguuggcccauuagcaagauggacauagggguuccgcuccucgcccucggcugcuauucccagguuaacccgcugacgcucaccgcugcaguacucauguugguggcccacuacgccauuaucgggccggggcugcaggcaaaggccacgcgcgaggcccagaaacguacggcagcagggaucaugaagaaccccacugucgacggaaucguggccaucgaccuagaccccguuguauacgacgccaaguuugaaaaacagcugggccagaucaugcuacucauccuaugcacuagccagauccugcuaaugcggaccacuugggcgcugugcgagagcaucacgcuagcuaccggcccgcucacgacccuuugggaggggagcccggggaaguucuggaacacgaccaucgccguguccauggccaacaucuuucgcgggucuuaccuggccggcgcggggcuugcguucucccuaaugaagucccugggcgggggucggcgcgggaccggcgcccagggcgagacccucggggaaaaauggaagcggcagcugaaucagcucuccaagagugaguucaauacguacaagcgcaguggcaucauggagguugaccgguccgaggccaaggaggggcucaagaggggcgaaaccaccaagcacgcggucuccagggggaccgccaaacugaggugguucguggagcggaaccugguuaagccggaggguaaggucaucgaccugggcugcgggcgcggcgggugguccuauuacugcgccggccucaagaaggugaccgaagugaagggguacacgaagggaggccccgggcaugaggagccaauccccauggccaccuauggcuggaauuuagucaagcugcacagcgggaaggauguguucuucaugccgcccgagaagugcgacaccuuacugugcgacaucggggagaguagcccgaaccccacuaucgaggaagggcggacgcugcgcguccucaagauggucgaacccugguugcggggcaaccaguucugcauaaagauucugaaccccuauaugccaucagugguggagacccucgagcagaugcaacgcaaacacggcgggaugcugguacgcaacccucugagucgcaauucaacacacgaaauguauugggugucuugcgggaccgguaacauaguguccgccguuaacaugacgucgcggauguugcucaaccgcuucaccauggcgcacagaaagcccaccuucgagcgggauguggaccugggcgccgguacccgucacguugccgucgagccagagguggcaaaccucgacaucauagggcagcggaucgagaacaucaagaacgaacacaaguccacguggcacuaugaugaggauaacccguauaagaccugggccuaucacggaagcuacgagguaaagcccuccgggagcgcguccagcauggucaacggaguggugcgccugcugaccaagcccugggacgucauaccuauggugacccaaaucgccaugacggacaccaccccguuugggcagcagcgggucuuuaaagagaagguugacacucgcacgccccgggccaagcguggcacuacucagaucauggaggugaccgccaaauggcucuggggcuuccuguccagaaacaaaaagccccgaauuuguacgcgagaggaguucaccaggaaggugcggagcaacgccgcgaucggggcuguguucguagaugagaaccaauggaacagcgccaaggaggccgucgaagacgaacgcuucugggacuuggugcaucgcgagcgcgaacuccacaaacagggcaaaugcgcgacgugcguguacaacaugauggggaagcgggagaagaagcugggcgaguucgggaaggcgaagggcucccgcgccaucugguacauguggcugggcgcccgguuccucgaguucgaggcccugggguucaugaacgaggaucacugguucagccgggaaaauucucugagcggugucgagggggagggccuccauaaacugggguacauccugcgggacaucuccaagaucccgggcggcaauauguacgcggacgacaccgccgggugggacacgcguaucaccgaggaugaccuccagaaugaggccaagaucaccgacaucauggagcccgagcacgcccugcuagccaccucuauuuucaagcucacguaccagaauaaggugguccguguacagcggcccgcgaagaauggaaccgugauggaugugaucucccgccgggaccagcggggaagcggccaaguugggacauacgggcugaacaccuucacuaacauggagguccagcuaauccggcagauggaguccgagggcaucuuccuccccagcgagcuggagaccccaaacuuagccgagagggugcucgauuggcuggaaaagcauggugccgaacggcugaagcggauggcaaucuccggcgacgacugcguugugaaacccauugacgacagguucgccaccgcgcucaccgcccugaacgacauggggaaggugcgcaaggacaucccccagugggaaccgucgaaaggcuggaacgacuggcagcaggucccguucugcucccaccacuuccaucaacugaucaugaaagacggcagagagaucguugugcccugcaggaaccaggacgaguuagucggacgugcccgcgugagccagggcgcaggguggucccugcgggagacggccugcuuaggcaagagcuacgcccaaauguggcagcucauguauuuucaccgccgggaucugcgccuugccgccaacgcaaucugcuccgcggugccugucgauugggugcccacaagccgaaccacuuggagcauccacgcccaccaccaguggaugacgacggaggauaugcucuccguguggaaccgcguuuggaucgaggagaaccccuggauggaggauaagacccacguaagcuccugggaggaggugcccuaccuggggaagcgcgaagaccaguggugcggcagcuuaaucgggcuuacagcucgagccacaugggccacgaacauccagguagcgaucaaccagguccgccggcugaucgggaacgagaacuaucuggacuacaugaccuccaugaagcgcuuuaagaacgaguccgacccugagggggugcuaugguga

SEQ ID NO: 23864 - RNA, 9870 nt, Artificial Sequence
  derived and/or modified CDS sequence (opt11) from DENV-1__GU131962__SS-prME
agcgugaccauguuacucauguugcuccccaccgcccucgccuuccaccugaccacucggggcggggagccccauaugaucgugagcaagcaggagcgggguaaaagccuccucuucaagaccagcgccggugugaacauguguacccugaucgcaauggacuuaggugaacucugcgaggacaccaugaccuacaagugcccccaaaucaccgaggccgagccagacgauguggacuguugguguaacgcgaccgauaccugggucaccuacgggaccugcagccaaaccggcgaacaccggcgggauaagcgcucaguggcccucgcuccccacguggggcuggggcuggagacgcggaccgaaaccuggaugagcagcgagggcgccuggaagcagauccagcgcguugagaccugggcccugcggcacccagguuucacggugaucgcgcuguuccucgcacacgcuauagggacgagcaucacgcagaaggggauaauauuuauccugcuuaugcucgucacccccuccauggccaugaggugcgugggcaucggaaaccgugacuucguggagggucuaaguggcgcgacguggguggacgucgugcuggagcacggcuccugcgugaccaccauggcgaagaacaagcccacccucgacaucgaguugcuaaagaccgaagugaccaacccggcgauccuccguaaguugugcauagaggcuaaaaucucuaacaccaccaccgacucccguugcccgacccaaggagaggccacacuggucgaggagcaggacgccaacuuuguuugccgccggaccuucgucgaccgcggcugggggaacggcugcggccucuucggcaaggggagccuguuaacgugcgcuaaguucaaaugcgugaccaaacuugagggcaagaucgugcaguacgagaacuuaaaguacuccgucauagucaccgugcacacgggcgaccaacaucaagucgggaacgagacgaccgagcacggcaccaucgcgaccaucaccccucaagcgcccaccagcgaaauucagcugaccgacuacggcgcccuaacucuugacugcagcccccggaccggccuggacuucaacgagaugguccucuuaacgaugaaggaaaagagcuggcugguccacaaacagugguuuuuggaucucccgcugcccuggaccucaggagcuagcaccagccaggagaccuggaaccgccaagaucuauuggugacguuuaagaccgcccaugcgaaaaagcaagagguggucguacugggcucucaagaaggggccaugcacaccgcacucacuggggccacggagauccagaccaguggcacgacuacuaucuucgcagggcaccugaagugccggcugaagauggacaaacucacauugaagggaaccuccuaugugaugugcaccgggagcuucaagcuagagaaggaggucgcggaaacgcagcacggcaccgugcuggugcaggucaaguacgaaggcaccgacgcaccgugcaagauacccuucuccacccaagacgagaaaggggugacgcagaacggccgccucauuaccgccaacccgaucgugaccgacaaggagaaaccugucaacaucgagaccgagccgcccuuuggggagucuuauauuguggugggcgccggugagaaagcgcugaaacugucaugguucaagaaagggagcucuaucggcaagauguuugaggcaacggccagaggggcucgacggauggccauucugggagacaccgcgugggauuucggaagcaucggaggcgucuucaccuccgugggaaaacuggugcaucaaguuuucggaaccgccuacggggugcucuuuagcggcgugagcuggacgaugaagaucgggaucggcauccuccugaccuggcugggacucaacagccgaucgaccucccuguccaugaccugcaucgccgucgggauggugacguuauaccucggcgugaugguccaggcggacucggggugcgugaucaacuggaagggccgggagcugaaaugcgggucuggcaucuuuguaacuaacgaaguccacaccuggaccgagcaguacaaguuccaggccgauagcccuaagagacugagcgcggccaucgguaaggcuugggaggagggggugugcggcauccgcuccgccacgcggcucgagaacaucauguggaagcaaaucagcaacgagcugaaccauauccugcucgagaacgacaugaaguuuaccgucgucguaggagacgcuaacgguauccuggcgcaagggaaaaagaugauacguccccagcccauggaacauaaguacuccuggaaauccuggggcaaggccaaaauaauaggggccgacauccagaacacuaccuuuaucaucgaugggcccgacaccccagagugccccgauaaccagcgggccuggaacaucugggaaguagaggacuauggcuucgggaucuucacuaccaacaucuggcugaagcuccgagacuccuacacccagaugugcgaucacaggcugaugagcgcggccaucaaagacuccaaagccguccacgccgacaugggcuacuggaucgagagcgagaaaaacgagaccuggaagcuggcaagagcgagcuucaucgaaguaaaaaccugcaccuggccgaaaucacacacacucuggucgaauggcguccuggagagcgagaugaucauucccaagaucuacgggggaccaauuucccagcacaacuaccggcccggguauuucacccagacagcagggcccuggcaucuggggaagcucgagcuggacuucgaucugugcgagggcaccaccgucgugguggacgaacacugcgguaaccgcgggccgagccuacggaccacgaccgucacaggcaagauuauccacgaauggugcugccgcuccugcacccugccgcccuuacgauuccgcggggaggacggcuguugguacgggauggagauucggccuguuaaagaaaaggaagaaaacuuggugcggagcauggucucugcaggcagcggagagguugacuccuuuagccuggggaucuuaugcgugagcaucaugaucgaggaggucaugcggagccgcuggagucggaaaaugcucaugacgggaacccuggcaguguuccugcuccuggugaugggacagcugaccuggaacgaccucauccgccugugcaucauggucggcgcgaacgcguccgaccgcauggggauggggacuacguaccuagcccugauggccaccuucaaaaugcggccgauguuugcgguuggguuacuguucagaagacucacuucccgcgagguacugcuguugacuaucggacugagccugguggccagcguugagcucccaaacuccuuagaggaacucggcgacgggcucgcgaugggcauaaugaugcucaagcugcucaccgaguuucaaccccaccagcuguggaccacccugcucagccugaccuucaucaagacgacccucaguuuagacuaugccuggaagacuaccgcaauggcccuuagcaucgucucccuuuucccccuuugucuuagcacgaccucccagaaaacgacguggcugccgguacucuugggcagcuucgggugcaagccccugacuauguuccuuaucacggagaauaagaucuggggaagaaagagcuggccucuuaacgaggggaucauggcgaucggcauugugagcauccugcucuccagccugcugaagaaugacgucccccucgccgggccgcugaucgccggcggcaugcugaucgccuguuacgugaucagcggauccagcgcugaccucucccuugaaaaggcugcggaggugagcugggagcaggaggccgaacacuccggcacgagccacaacauccuggucgaaguccaggacgaugggaccaugaagauaaaagacgaggagcgcgacgacaccuuaacgauccugcucaaggccacccuccuggccguguccggugucuacccuaugagcaucccugcgaccuuguuugugugguacuucuggcagaagaagaaacaacggucuggggugcucugggacacucccucgccaccggagguagagagagcuguguuggacgacgguauuuaccguauacugcagcgcgggcugcucggccgcucccaggugggugucgggguguuccaagacggcguguuccacacgauguggcacgucaccagaggggcagugcugauguaccagggcaagcggcuggaacccagcugggcguccgucaagaaagacuugauuucguacggcggaggcuggcgcuuccaggggucguggaacaccggagaggaggugcaagugaucgccguagagcccggaaagaacccgaaaaacguccaaacaacgccagguaccuuuaagaccccggagggcgaggugggggccauagcccuggacuucaaacccggcaccagcgggucaccuaucgugaaccgggagggcaagauaguaggccuguacgggaacggcguugugacgaccucgggaacuuacgucuccgccaucgcccaggccaaggcgucccaggagggcccccucccagagauugaggaugagguguuuaagaaacgcaacuuaaccaucauggauuugcacccggggagcgguaaaacccgucgcuaccuccccgccaucguucgggaggccaucaagcgcaagcuccgcacacugauccucgccccgacucgcgucguggcuuccgaaauggcugaagcgcugaagggcaugcccauacgcuaucagaccacagccgucaaaagcgagcacaccgggagagagaucguugaucugaugugccacgccacauuuaccaugcgccugcuguccccggugcgggugcccaauuacaacaugaucaucauggacgaagcgcacuuuacugaccccgccagcaucgcugccagaggcuacaucuccacccgaguagggaugggcgaggccgcggcaauuuucaugaccgcuacgccgccuggcucuguggaggccuucccgcaguccaacgccgugauccaggacgaggagcgcgacauaccggagcgaaguuggaacaguggguacgacuggaucacggacuucccgggcaaaaccgucugguucgugccuuccaucaaguccgggaaugacaucgcgaacugccugcgcaagaacggcaaaagggugauccaguuaagccggaagaccuucgauaccgaauaccagaaaacgaagaacaaugacugggacuacguagugaccaccgauauauccgagaugggugccaacuuccgggccgaccgcgugaucgacccgcggcgcugccugaagccggucauacugaaggacggcccggagcgggugauccucgcggggcccaugcccgugaccguagcguccgccgcccagcgccgggggcgcaucggacggaaccagaacaaagagggggaccaguacguguacaugggucagccgcugaacaacgacgaggaccacgcacacuggacggaggccaagaugcugcucgauaacaucaacacacccgaggggauaaucccggcccuguuugagcccgagcgggagaaguccgccgcgauagauggugaguacagacugcgcggagaggccagaaaaaccuucgucgagcucaugcggcgcggggaccugcccguguggcuaagcuacaagguggcuuccgagggauuucaguacucugaccggcgauggugcuucgacggggagcggaacaaccagguccucgaggagaacauggacguggagaucuggacgaaggaaggcgagcgcaagaaguuacguccccgcuggcuggacgcgcgcacuuacuccgacccgcucgcccuacgcgaguucaaggaauuugccgccgggaggcgcagcgucagcggcgacuugauccuugagauaggcaaguugccccagcaccuuacgcuccgugcacagaacgcccuggacaaccuugucaugcuccacaacuccgagcaaggcgggaaggccuauaggcacgccauggaggagcugccugacaccaucgagacccucaugcucuuagcucugaucgcgguacucacuggaggggugacgcuauucuuuuugagcggaaaaggccucggcaagaccucuauaggccugcugugugugaccgccagcucggcccucuuauggauggccagcguggaaccacacuggaucgccgcguccaucauacuggaauuuuuccucaugguccuccugauuccggagccugaccggcaacgcacaccccaggacaaccaauuagcguacguugugaucggccugcuguuuaugauuuugacuguugccgccaacgagaugggacuguuggaaaccaccaagaaggaucucggcaucgggcacguggccgcugagaaccaccaacacgcaaccaugcuggacguggaccuccggcccgccagcgccuggacccucuacgcaguggcaaccaccgucaucacaccgaugaugcggcacacgaucgagaauaccacggccaacaucucccugaccgccaucgcaaaccaggccgcgauacugaugggccucgauaagggcuggccuaucagcaagauggauaucggcgugccucuuuuagcccucggcugcuacucacaggugaacccgcuuacacugacagccgcuguccucaugcugguagcgcacuacgcgaucauuggcccaggccuacaggccaaggcaacacgggaggcccagaagcgaaccgcggccggaaucaugaagaaucccacgguggauggcaucgucgcuaucgaccucgaccccgugguguacgacgccaaguucgagaaacaacugggccagaucaugcugcucauauugugcacuucucagauccuguuaaugcguacaaccugggcccugugugaaucaauaacgcuggcgaccgggccccugaccacacucugggagggcagccccgguaaguuuuggaauacuaccaucgccguauccauggccaacaucuuccggggcagcuaucucgccggagccgggcucgccuucucccugaugaagucccugggcgguggccgccgggggacaggcgcccagggcgagacccuaggcgagaaguggaaacgccaguuaaaccagcuguccaagagcgaguucaacaccuacaaacguagcggcauaauggagguggaccgcuccgaggcgaaggaggggcugaagcggggcgaaaccaccaagcacgccguaucccgcggaaccgcgaaacugcggugguucgucgagcgaaaccugguuaagcccgagggcaaggugauagaccugggcugcggacggggcgguugguccuacuacugcgccggccuaaagaaggucacggaguacgccuccgccgggcuggccaucaucgugccccugccgcucgacaccuacggucgcaaucggcuaaaaauccauuccggcaaggacguguucuucaugccacccgagaagggggacacccugcuuugcgacaucggagagucaucccccaacccgacgaucgaggaggggcgaacccugcgcguccugaagaugguggagcccuggcuucgcgggaaccaguucugcauaaaaauccugaaucccuacaugccuuccgugguagaagcgcuggagcagaugcaacguaagcacgggggcauguugguucgcaacccgcugucucggaauagcacgcaugagauguacugggucuccugcgguacuggaaacaucgucagcgccgugaacaugacuucgcguauguugcucaacagauucaccauggcccaccggaagccuacuuaugagcgagacguggaccuaggcgccgguacccggcacgucgccguugagccugagguagcaaaccucgacaucauaggccagcgcaucgagaauaucaagaacgagcacaaguccaccuggcacuacgacgaggacaaccccuacaagaccugggcauaccacggguccuacgaggucaagccgagcggguccgccagcuccaugguuaacggcgugguucgccuccugacgaagcccugggaugugauacccaugguaacacagaucgccaugaccgacacuacgccauucgggcagcagcgcguauucaaagagaagguggacacccggaccccgcgcgcgaagcggggcacaacccagaucauggagguuaccgcgaaguggcuguggggguuccuaagccgcaacaaaaagccccggaucuguacccgugaggaguuuacccgcaagguucgaucuaacgccgccaucggagccguguucgucgacgaaaaccaauggaacuccgcgaaggaggccguggaggacgagagguucugggacuuagugcaccgugagcgagagcugcacaagcagggcaaaugcgcgacuugcgucuacaacaugauggggaagcgcgaaaagaagcucggggaguucgguaaggccaagggcagccgggccaucugguacauguggcugggggcacgcuucuuagaguuugaagcacucggcuucaugaacgaggaucacugguucucacgugagaauagccugaguggcgucgagggggaaggccugcauaagcugggguacauccugagagacauaucuaaaauccccggagggaacauguacgccgacgacaccgccgguugggacacgcgcaucacggaggaugacuuacagaaugaggccaaaauuacggagaucauggagccggagcaugcccuccucgccacuuccaucuucaaguugaccuaccaaaacaaggugguaaggguacaacgcccggccaagaacggcaccgugauggaugucaucagccggcgcgaccagagaggguccggccaagucggcacguacggccucaacaccuucaccaauauggagguccaacucauccgccagauggagagcgagggcaucuucuugcccuccgaguuagagacccccaaccuggcugagcggguucuagacuggcucgaaaagcacggcgcugagcgccuuaagcggauggcgaucagcggcgaugacuguguggugaaaccgauugaugacagguucgccacggcuuugaccgcccuaaacgacauggggaaaguacggaaggauaucccccagugggagcccucuaagggcuggaacgauuggcagcagguacccuucuguucacaucacuuccaccaacugaucaugaaggacgggcgugagaucguggugccgugccggaaccaggacgaacuggugggccgcgccagggugucccaaggcgcaggauggagccucagggaaaccgccugccugggaaaguccuaugcccagauguggcagcugauguacuuccaccggcgugaccucaggcuggccgcgaaugccaucugcagugccguccccguggauugggugccaacgucuaggaccacguggucuauucacgcgcaccaccaguggaugaccacugaggacauguuguccgucuggaaccgcguuuggaucgaggagaaccccuggauggaggauaagacccacguauccucgugggaggaggucccguaccucgggaagagggaggaccaguggugcgggucccugaucggguugacggcccgcgccaccugggccaccaacauccagguggccauuaaucaaguucgucgccucaucgguaaugagaauuacuuggauuacaugaccagcaugaagagauucaagaacgaguccgaccccgagggagcccugugguag

SEQ ID NO: 23865 - RNA, 9879 nt, Artificial Sequence
  derived and/or modified CDS sequence (opt11) from DENV-1__GU131963__SS-prME
agcguuaccaugcuacucaugcugcugccuaccgcccucgccuuccaccuuaccacccggggcggggagccccacaugauugugagcaaacaagagcggggcaagagccuccucuucaagaccagcgcgggggugaacauguguacccugauagccauggaccugggcgagcucugcgaggacaccaugaccuacaagugcccccagaucacggaggcugagcccgacgacguggacuguuggugcaacgccaccgacacuugggugacguacggcaccugcagccagaccggcgagcaccgccgggacaagcgguccguggcccuggccccacaugugggguuaggcuuagaaacgcggaccgaaaccuggaugagcagcgagggugcguggaagcagauucaacgcguggagacuugggcccuacggcaccccggguuuacgguaaucgcauuuuuccucgcccacgccaucggcaccagcaucacgcagaaggggaucaucuucaucuuacugaugcuggugacccccucgauggcuaugagaugcgucggcaucggcaaccgggacuucguggaaggucucagcggcgccacauggguggacgucgugcuggagcauggguccugcgugaccaccauggccaagaacaagcccacccuggauauagagcuccugaagacggaggugaccaaccccgcuauccugcgcaagcucugcauugaggccaagaucagcaacaccaccacggacucccggugcccgacucaaggcgaggcgacgcugguggaggagcaggaugccaacuucguuugucgccggaccuucgucgaccgcggaugggggaacggcugcggacuguucggcaaggggucccuccugacgugcgccaaguuuaagugcguuaccaaguuagagggcaagaucguacaguacgaaaaccugaaguacuccguaaucgugaccgugcacaccggcgaucagcaccaggucgguaacgagaccacggagcauggaacuaucgcgaccaucacgccccaagcucccacgucggagauccagcugaccgacuacggggcucugacccucgacugcagccccagaaccggucuggacuucaacgaaaugguacuccucacgaugaaggagaaguccuggcuggugcauaagcagugguuccuggaccucccgcugccuuggaccucgggggccagcaccagccaagaaacauggaaccgccaagaccugcucgugacguucaagaccgcccacgcgaagaagcaggagguggucguucuaggcucccaggagggcgccaugcacaccgcccucaccggagccacggagauacagaccagcggcaccaccacgaucuucgccgggcaccucaagugccggcugaagauggauaagcugacccuaaagggaaccuccuacgugauguguaccgggagcuucaagcuugagaaggaagucgccgagacgcagcacgggaccgugcugguacaggucaaguacgaaggcaccgacgcccccugcaagauucccuucuccacccaggacgagaagggggucacgcagaacggccgccugauaaccgcgaauccgaucgugacugacaaggagaagccgguaaauauugagaccgagccgccguucggggagagcuauaucguggugggcgccggcgagaaggcccucaaacugucuugguucaagaaggggucauccaucggcaagauguucgaggccacggcucgcggugcgcgccguauggccauccugggcgauacugcgugggacuucggcagcaucggcggugucuucaccuccguugggaagcucgugcaccaggucuuuggcaccgcuuauggagugcuguuuagcggcguguccuggacgaugaagaucgggauuggaauccugcucaccuggcugggccugaacagccgcuccacgagccucuccaugaccugcaucgccgucgggauggugacgcuguaccugggcgugaugguccaagcggacagcgggugcgugaucaacuggaagggcagagagcucaagugcggauccgguaucuucgugaccaacgaggugcacaccuggacggagcaguacaaguuccaagccgacaguccgaagcgacucuccgccgccaucggcaaggccugggaggagggggugugcggcauccgcucugccacucgacuggagaacaucauguggaaacaaaucagcaacgagcucaaccauauccucuuagagaacgacaugaaguucacgguggucgugggggaugcgaacggcauccuggcgcaggggaagaaaaugauccgcccccagcccauggagcacaaguacuccuggaaguccuggggcaaggccaagaucaucggcgcggacauccagaacacgaccuucauaaucgacgggcccgauaccccggagugccccgacaaccagcgggcuuggaacauaugggaaguggaggauuacggcuucggcaucuuuacgaccaacaucuggcugaagcugcgggacuccuauacccagaugugugaccacagacucaugagcgcggccaucaaggauuccaaggccguacacgccgacaugggcuacuggauugagagcgaaaagaacgagaccuggaagcuggcucgcgcguccuucauagaggugaagacgugcaccuggcccaaaagccacacccuguggucaaacggcguacuugaaagcgagaugaucauccccaagaucuacgggggcccgaucagucagcauaacuaccggccuggcuacuucacccagacggcaggacccuggcaucuggggaagcuggagcucgacuucgaccugugcgagggcacaaccguugugguggacgagcauugcggcaaucgcgggccuagccugcggaccaccaccgucaccggcaagaucauccacgaauggugcugccgauccugcacucucccgccccugcgguuucgcggagaggacggcugcugguacgggauggaaauccggccugugaaggagaaggaggagaaccuggugagaagcauggucucggccgggucaggcgagguggacucauucucacucgggaucuugugcgugagcaucaugaucgaggaagucaugcggucccgcuggagccggaagaugcugaugacgggcaccuuggccguguucuugcugcucgugauggggcagcugacuuggaacgaucugauacgccucugcaucauggucggcgccaacgcgucggaccgcaugggcaugggcaccacguaccuggccuuaauggcaaccuuuaagaugaggccuauguuugccgugggccuccuguuccgucggcugacaagucgcgaggugcuacugcugaccauagggcucagucuggucgccagcguggagcugcccaacucccucgaggagcuaggcgacgggcuggccaugggcaucaugaugcucaagcuucuaacggaguuccagccccaccaacucuggacuacacugcugagccuaacauucaucaagacgacccugucccuugacuacgccuggaagaccaccgcgauggcccuuagcaucgucucccuguucccccuuugccucagcacgaccucccaaaagaccaccugguugcccgugcugcugggcagcuucgggugcaagccccugaccauguucuugaucacggagaacaagaucuggggccggaagucguggccccucaaugaggggaucauggcuauuggcaucgugagcauacugcugaguucacuucuuaagaacgacgucccccuggccgggccgcugaucgccggcggcaugcugaucgcaugcuacgugauaagcggguccagcgcagaccuguccuuggagaaggcggccgaagugagcugggagcaggaggccgagcacuccggcaccagccacaauauucuggucgagguucaggaugacgggacuaugaaaauuaaggacgaggaacgcgacgacacccugacgauccuacugaaggccacccuacucgcuguguccggcguuuauccgaugagcauccccgcuacccuguuugucugguauuucuggcaaaagaagaagcagcgguccggugucuuaugggacacgcccagcccgcccgaggucgagcgcgcggugcuggacgacggcaucuaccggauacuacagcgcggucugcuggggcggucccagguuggcgucggaguguuccaggauggcguguuccacaccauguggcacgucacccgcggggccguacucauguaucaaggcaagcggcuggaacccagcugggccucgguuaagaaggaccugaucucuuauggcggcggguggcgguuucagggguccuggaauaccggcgaagagguccaggugauagcuguugagcccgggaaaaacccaaagaacguccaaaccacuccugggacguucaagacccccgaaggcgaagugggagcgaucgcccucgacuucaaacccgggaccagcggguccccaaucgugaaccgggagggcaagaucguaggccuguacgggaacggcguggugacgacgagcgggaccuacgucucugccaucgcccaggccaaggcgucucaggaggguccccugcccgagaucgaggacgaaguguuuaagaagcgcaaucucaccauuauggaccuacacccaggaagcggcaagacgcggcgcuaccugcccgccaucgugcgggaggccaucaagagaaagcuccggacgcugauccuggcccccacgcgcgucguugccucugagauggccgaggcccucaagggcaugcccauccgcuaccagaccacggccgucaaguccgaacacaccggucgggaaauugucgaccugaugugccacgccaccuucaccaugcgacugcuuuccccggugcgagugcccaacuacaauaugaucauaauggaugaggcgcauuucacggacccggccucuaucgcagcccgcggguauaucuccaccagaguagggaugggcgaggccgcagccaucuucaugaccgccacgccgcccgggagcguggaggccuuuccgcaguccaacgccguuauccaggaugaggagcgcgacauccccgagcggagcuggaacuccggcuacgacuggaucacggacuucccuggcaagaccgucugguucgugcccuccaucaaauccgggaacgauaucgcgaauugccuucgaaagaacggcaagcgagugauccagcugagccgcaagaccuucgauaccgaguaccagaaaacgaagaacaacgacugggauuacguagucaccaccgacaucuccgagaugggggccaacuuccgugccgaccgcguaaucgacccacggagaugccuuaagccagucauccugaaagacggccccgagcgggugauccuggcagggccgaugcccgugaccguugcuagcgccgcccagcgccgggggcgcaucggccggaaccagaacaaggagggggaucaguacguguacaugggccagccccugaauaacgaugaggaccacgcgcacuggacggaggccaagaugcugcuggacaacaucaacaccccugaggggaucaucccagcacucuucgagccggagcgugaaaaguccgccgccaucgacggggaauaccgccugcguggggaggcccgcaagacauucgucgagcuuaugcggagaggcgaucuccccguguggcucagcuacaagguugcgucugagggcuuccaguacagcgaccgacgcuggugcuucgacggggagcgcaacaaccaaguucuggaagagaauauggacguggaaaucuggaccaaggagggcgagaggaaaaaguuacggccccgcuggcuggacgcgagaaccuauuccgacccuuuagcccuccgcgaguucaaggaguucgccgcagggcggcgcagcgugagcggcgaucugauacuggagaucggcaagcucccgcagcaccugacguuacgugcccagaacgcacucgacaacuuagucauguuacacaacuccgaacaaggcgggaaggccuacagacacgcgauggaggagcuccccgacaccauugagacccugaugcugcuugcacugaucgcgguccugaccgggggcguaacccuauucuucuuaagcggaaagggcuugggaaagaccuccaucgggcugcuuugcgucaccgcgaguuccgcgcuguuauggauggccagcguggagccccacuggaucgccgcguccaucauccuggaguucuuccugauggugcuccuuaucccggagcccgacaggcagcgcacgccccaggacaaccagcuggccuacgucgugaucggccuccuguucaugauucugacgguggcugccaacgagauggggcucuuggagaccacgaagaaggaucugggcaucgggcacgucgccgcagaaaaccaccagcacgccaccauguuggacguggaccugcggccggcgagcgcguggacccuguacgccguggcgacaaccgucaucacccccaugaugcgccacacgauagagaacaccaccgcgaacaucucacucaccgccaucgccaaccaggccgcgauauuaaugggccuagacaagggcuggcccaucagcaaaauggacaucggggugccucuccuggcccugggcugcuacucccaggugaacccgcucacgcuaaccgccgccguacucaugcucguggcgcacuacgccaucaucggucccgggcugcaagccaaagccacccgggaggcacagaagcgcaccgcggcggggauaaugaagaaccccacuguggacggcaucgucgccaucgaucuggaccccgugguauacgacgccaaguucgaaaagcaacucggccagaucaugcuucugauccucugcaccagccagauccugcugaugcgcacaaccugggcccucugcgaguccaucacgcuagcgaccggcccgcugacaacccugugggagggcagccccgggaaguucuggaacacgaccaucgccguuuccauggccaauaucuuccgagggucauaccuggccggcgccgggcuggcguucucccucaugaaguccuuaggcgggggccgcagagggaccggcgcgcagggcgagacccuaggggagaaguggaagcgccagcucaaccagcuguccaagagcgaauucaacacuuacaagcggagcgguaucauggagguggaccguuccgaggccaaggagggucugaagcggggcgagaccaccaagcacgcagugagucgcgggaccgcgaagcuccggugguucgucgagcgcaaccuugugaagcccgaaggcaaggugaucgaccugggcugcgggcggggcgggugguccuacuauugcgccggccucaagaaggucacagaggugaaggguuauacgaagggcggccccgggcacgaggagccgauccccauggccaccuacggcuggaaccucgugaagcugcacagcgggaaggacguguucuucaugccgcccgaaaaaugcgacacucugcuaugcgacaucggcgaauccagcccgaauccaaccaucgaagagggccgcacgcugcggguucugaaaaugguggagccguggcuccgaggcaaucaguuuugcaucaagauccugaacccuuacaugccgagugugguggaggcgcuggagcagaugcagcggaagcacggcgggaugcucgugcgcaauccccugagccggaacuccacccacgagauguacuggguuagcugcggaacggggaacauagucucggccgugaacaugaccagccgcaugcugcucaaucgguucacgauggcgcaccgcaagcccaccuacgagcgcgaugucgaucugggcgccggcacccggcacguggcagucgagcccgaagucgcgaaucuggacaucaucgggcaacgcaucgagaacaucaagaacgaacacaaguccaccuggcacuacgacgaggacaaccccuacaagaccugggcuuaccaugguagcuacgaggugaagcccuccgggagcgcguccucaauggugaacggcgucguucggcuccucacaaagcccugggacgucauccccauggugacccagauugccaugaccgacacuaccccguucggccagcagcgcguguucaaggagaaggucgacacccggacgccccgggccaagcggggcacgacccagaucauggaggugaccgccaaguggcuguggggcuuccucucccgcaacaagaagccccggaucugcacccgggaggaguucacgcggaaagugcgcagcaacgccgcgauuggggccguuuucguggacgagaaccaguggaacagcgccaaggaggcaguggaggacgagcgguucugggaccugguacacagagagcgugagcugcacaagcagggcaagugcgcgacaugcguguacaacaugauggggaagcgcgagaaaaagcuaggcgaguucgggaaggccaagggcucccgggccauaugguacauguggcugggcgcccgcuuccuggaauucgaggcccucgguuucaugaaugaggaucacugguucucacgggagaacucccugagcggcguggagggagagggccugcacaagcucggguacauccugcgcgacauuuccaagaucccgggcggaaauauguacgcggacgacaccgccggcugggacacccggaucacggaggacgaccuucagaacgaggccaagaucaccgagauuauggagccggagcacgcccuccuggccaccagcaucuuuaaacugaccuaccagaacaaagugguacgcgugcagcgccccgcaaaaaacggcacaguuauggacgucaucucccggcgggaccagcggggcuccggacaggugggaaccuacgggcucaacacauuuaccaacauggagguccagcugaucaggcagauggaguccgagggaauuuuccugccaucugagcuugaaacgccgaaccuggccgaacgugugcuggauuggcucgagaagcacggggccgagcgccugaagcggauggccauauccggcgacgacugcguggucaagcccaucgaugaccgguuugcgaccgcgcugacggcccucaacgacauggggaaggugcggaaggacauuccccaaugggagccuagcaaggguuggaacgacuggcaacaaguccccuucuguucccaccacuuccaccagcugaucaugaaagacggucgcgagauagucgugcccugucggaaccaggacgaacugguugggcgcgcgcggguaagccaaggcgcaggauggucccuacgcgagacggccugucuugguaagucuuacgcacagauguggcagcugauguacuuucaccggcgcgaccuccggcuggccgccaacgcuauuuguuccgcggugccaguggacuggguccccacuucacgcacgacguggucuauccacgcccaucaccaguggaugacaaccgaggauaugcugucaguguggaaccggguguggaucgaggagaacccuuggauggaggacaaaacucaagucucuuccugggaagaggucccauaccugggaaagcgcgaggaccaguggugcggcagccuuaucggucugaccgcgcgcgccaccugggccaccaacauccagguggcgaucaaccagguccggcgccucaucggcaaugagaacuaccuggacuacaugacauccaugaagcgguucaaaaacgagagcgaccccgagggagcccugugguga

SEQ ID NO: 23866 - RNA, 9879 nt, Artificial Sequence
  derived and/or modified CDS sequence (opt11) from DENV-1__KF955442__SS-prME
agcguuacgaugcugcucaugcugcugccaaccgcccucgccuuccaccucaccacccggggcggggagccccacaugaucgugagcaagcaggagcggggcaagagccuccuguucaagacuagcgcgggagugaacaugugcacccugaucgccauggaccugggagaacugugcgaggacaccaugacauacaaaugcccccagaucacugaggccgaacccgaugacguggacugcuggugcaaugccaccgacacaugggucaccuacgggaccugcucccaaaccggcgaacaccggcgggacaagcgcuccguggcucuagcgccacacgugggucuggggcucgagacgaggaccgagaccuggaugagcuccgagggcgccuggaagcagauucagcgcguagagaccugggcgcugcggcaccccggcuucacugugaucgcccuguuucucgcgcacgccaucggcaccagcaucacccagaaggggaucaucuucauccugcugaugcuagugaccccauccauggccaugcgcugugucggcaucggcaaccgggacuuuguggaggggcugagcggcgccacguggguggacguuguucuggagcacggguccugcgugaccaccauggccaagaacaagcccaccuuagauaucgagcuucuaaagacggaggucaccaacccagcgauucuccggaaacugugcauagaggccaagaucagcaacaccaccacggacuccaggugcccgacccagggcgaggccacgcugguggaagagcaggacgccaacuucgugugccgccggaccuucguagaccgcggcugggggaacggcugcggccucuucgguaaggggagccugcugacgugcgccaaguucaagugcgugaccaagcucgagggaaagaucgugcaguaugagaaccugaaguauucagucaucgugaccguacacacuggagaccagcaccaggucggaaacgagaccaccgagcacggcaccaucgcgaccaucacgccucaggcccccacgagcgagauucagcuuaccgacuacggggcccucacucuggauugcaguccccggaccggccuggacuuuaacgagauggugcuccugacgaugaaggagaaguccuggcugguccauaagcagugguuccucgaccuccccuugcccuggaccuccggggcuagcaccagccaggagaccuggaaccgccaggaucuccuugugacguucaagaccgcccacgcgaagaagcaggagguggucgugcugggcucccaggagggcgccaugcacaccgcacucaccggggccacggagauccagaccucgggcaccaccaccaucuucgccgggcaccuaaagugccgguugaagauggacaaguugacccucaaaggcaccuccuacguuaugugcaccgggagcuucaaacuggagaaggaggucgcggagacgcagcacggcaccgugcugguccaagucaaguaugagggcacggacgcccccugcaagaucccguucuccacccaggacgagaagggggugacucagaacggccgccucaucaccgccaaccccaucgugaccgacaaggagaagcccguuaacaucgagaccgagccgccauucggggaguccuacaucguggugggcgcaggcgagaaggcgcugaagcuguccugguucaagaaggggagcuccaucggcaagauguucgaggccacggcccguggggcccgccguauggccauccucggcgacacugcaugggacuucgggagcaucggcggcgucuucaccuccguggguaagcuggugcaccaaguuuucggaaccgccuauggggugcuguucagcggcgugucauggacuaugaagaucgggaucggcauccuccugaccuggcugggccucaacagccgcucaacgucccuguccaugaccugcauagccgucgggauggugacgcuguaucucggcgugaugguccaggccgacagcgggugcgugaucaacuggaagggccgcgagcugaagugcggguccggaaucuucguaaccaacgagguccacaccuggaccgagcaguauaaguuccaggccgacucgccgaaacgguuaagugcugccauaggcaaagccugggaggagggagugugcggcaucagguccgccacaaggcuagagaauaucauguggaagcagaucagcaacgagcugaaucacauccugcucgagaacgacaugaaguuuacgguggucgugggggacgccaacggcauccuggcgcaggggaagaagaugauccgcccccagcccauggagcacaaguacuccuggaaguccuggggcaaggccaagauuaucggugccgacauacagaacaccaccuucaucaucgaugggcccgacaccccggagugccccgacaaccaacgggccuggaauaucugggagguggaggacuacggcuucgggaucuucacgaccaacaucugguugaagcucagagacucguacacccagaugugugaccaccggcugaugagcgcggccauaaaggacuccaaggccguccacgccgauaugggcuacuggauugagagcgagaagaacgagaccuggaagcuggcccgcgcaagcuucauugaggugaagacgugcaccuggcccaagagccacacccuuugguccaacggggugcuggagagcgagaugaucauccccaagaucuacgggggcccgaucucccaacacaacuaccggccgggauacuucacccagacggccggucccuggcaccuggggaagcucgagcuggacuucgaccugugugacggcaccaccgucgugguggacgagcacugcggcaacagagggccgagccugcggaccacgaccgucacgggcaagaucauccacgaguggugcugccgcuccuguacgcugccgcccuuacgguuccgcggggaggauggcugcugguacgggauggagauccggcccgugaaggaaaaggaggagaaccucgugcgcagcauggucuccgccggcagcggcgagguggacagcuucucgcucgggauccugugcgccagcaucaugaucgaggaggugaugcggucccgauggagccggaagaugcucaugacgggcaccuuggccgucuuccugcuccugaucaugggccagcugaccuggaacgaccucauccgccugugcaucauggugggcgcgaacgccuccgaccgcauggggaugggcaccacguaccuggcacucauggccaccuuuaaaaugcggccgauguucgccguggggcugcuguuccgccggcucaccagccgcgaggugcugcugcucaccaucggucugucccucguggcgagcguggaacuccccaacucccuggaagaguugggcgacgggcucgccaugggcaucaugaugcugaaacugcucacggaguuccaaccccaccagcuguggaccacccugcucucccugaccuucaucaagacgacccugucccucgauuacgcuuggaagaccaccgccauggcgcugagcaucgucucccuguucccccucugccugucgacgacuucgcagaagaccaccuggcugccggugcuccugggcagcuucgggugcaaaccccuuaccauguuccucaucacggagaacaagaucuggggccggaagagcuggccacuuaacgaggggaucauggccaucggcaucgucaguauucuguuguccagccugcugaaaaacgacguuccccucgccgggccgcugaucgcugguggcaugcugaucgcuugcuacgugaucagcggguccagcgcggaccucucacucgagaaagccgccgaggucagcugggagcaggaggccgagcacuccggcacaucacacaacauuuuaguagaggugcaggacgacggaacuaugaagaucaaggacgaggagcgcgacgacacccucaccauccuccugaaggcgacccuccuggcggucuccggcguuuaccccaugaguauccccgccacccuguucguaugguacuucuggcaaaagaagaagcagcgguccgggguccucugggacacccccagcccuccugagguggagcgcgccgugcuagacgaugguauauaccggaucuuacaacggggccugcucgggcggagccaggucggcguggggguguuccaagacggcgucuuccacacgauguggcacgugacccgcggggcagugcugauguaccagggcaagcggcuggaacccucuugggccuccguuaagaaggaccucaucagcuacggcgggggcuggcgcuuccagggguccuggaauaccggcgaggagguccagguaauugcggucgagcccgggaagaacccgaaaaacguucagacaacgcccggcaccuucaagaccccggagggcgaagugggggccaucgcccuggacuucaagcccggcaccagcggguccccgaucgucaacagggagggcaagaucguuggccuguacgggaacggcguggucacgaccagcggcaccuacgucuccgccaucgcccaggcgaaggccagccaagagggcccacuccccgagaucgaggacgagguguucaagaagcgcaaccuaaccaucauggaccugcacccggggagcggcaagacgcggcgcuaucugcccgccaucguccgggaggccaucaagcgcaagcugcggacccugauccucgcucccacccgcgugguggccuccgagauggccgaggcgcugaagggcaugcccaucagguaucagacaacggccgucaagucugagcacaccgggcgggagaucguggaucugaugugccacgcgacuuuuaccaugcggcuccuguccccggugcgggucccaaacuauaacaugaucauaauggacgaggcccacuucacagaccccgccaguaucgcggcccgcggcuacaucuccacccggguagggaugggcgaggcagccgccaucuucaugacggccacgccccccgguagcguggaggcguucccccaguccaacgcgguaauccaggacgaagaacgcgacauucccgagcgaagcuggaacuccggcuacgacuggaucacggacuuccccggcaagaccgucugguucgugcccagcauuaaaagcgggaacgacaucgccaacugccugcgcaaaaacggaaagcgggucauccagcucagccgcaagaccuucgacacggaguaccagaagacuaagaacaacgacugggacuacguggugaccaccgacauuuccgaaaugggcgccaacuuccgggcagaccgcgucaucgauccccggcgcugccugaagcccgugauccugaaggacggccccgagcgggugauccucgcggggccgaugcccgucaccguagccagcgccgcccagcgcaggggccgcaucggucggaaccagaacaaggagggggaucaguacgucuacaugggccagccccugaacaacgacgaggaccacgcccauuggacugaggccaagaugcuccucgacaacaucaauacccccgaggggauuaucccggcccuguucgagccugagcgcgagaagucugccgccaucgacggcgaguaccgccugcgcggggaggcccgcaagaccuucgucgagcucaugcggcgcggggacuugcccguguggcugagcuauaaggucgcguccgagggguuccaguacagcgaccggcgcugguguuucgauggggagcggaauaaccaggugcucgaggagaacauggauguggaaauuuggaccaaggagggcgagcgcaagaaacuacggccccgcuggcuggacgcccggaccuacuccgacccgcucgcccugcgcgaauucaaggaguucgccgccgggcggcgcagcgucagcggcgaccugauccuggagaucggcaagcugccgcagcaucugacgcuucgggcgcagaacgcccuggacaaccuagugaugcuccacaacucagagcagggcgggaaggccuaccgccacgccauggaggagcugcccgacaccaucgagacccugaugcuccuagcgcugauagccgugcucaccgggggcgugacgcuguucuuccugucgggcaagggccuaggaaagaccucgaucgggcugcugugcgugaccgccagcuccgcgcuauuguggauggcuagcguggagccccacuggaucgcugccuccaucauacuugaguucuuccucaugguacugcugaucccggagcccgaccggcagcgcacgccacaggacaaccagcucgccuacgugguaaucggccugcuguuuaugauucucacugucgcggcgaacgagauggggcugcuggagaccacuaagaaagaccucggcaucgggcacgucgcugccgagaaccaccagcacgccaccaugcuugacguugacuuacggccggccagcgccuggacucucuacgcggucgccaccaccgugauaacccccaugaugcgccauacgaucgagaacaccaccgcgaacaucucacugacugccaucgccaaccaagcggccauccugaugggacucgacaaaggcuggcccaucagcaaaauggauaucggggugccccuguuggcuuuaggcugcuacucucagguuaacccgcugacgcugaccgccgcggugcuuaugcugguggcccacuaugccaucauagggcccggccugcaggccaaggccacccgggaggcgcaaaaacgcaccgccgccgguaucaugaagaaccccacgguugacgggaucguggccaucgaccucgaccccgugguauacgacgccaaguucgagaaacagcugggccagaucaugcugcuaauccugugcaccucucagauccugcucaugcgcaccaccugggcccugugcgaguccaucacgcuggccaccgggccgcucaccacucugugggagggcagcccggggaaauucuggaacacgaccaucgccguguccauggccaauaucuuccggggcagcuaccuggccggcgcggggcucgccuucucacugaugaaguccuugggcgguggcaggagagggaccggggcucagggcgagacacuaggggagaaauggaagcgccagcugaaccagcuguccaagagcgaauucaacacguauaagcggagcggcauaauggaggucgaccgcagugaggccaaggagggccucaaacggggagagaccaccaagcacgcggucagccgcgggaccgccaagcugcggugguuuguagagcgcaaccuggugaagcccgagggcaaggucaucgaccugggcugcggacggggcgggugguccuacuauugcgccggccucaagaaggugaccgaggugaagggguauaccaagggaggccccgggcacgaggagccgauccccauggccaccuacggcuggaaccucgucaaacugcacagcgggaaggacguguucuucaugccgccagagaagugcgacacccuccugugcgacaucggugaguccucaccgaaccccaccaucgaggaagggcgcacgcugcggguucucaagauggucgagcccuggcuacgcggaaaccaguucugcaucaagauccugaaccccuacaugccguccguuguggaaacuuuagagcagaugcagcggaagcacggagggaugcuggucagaaacccgcuaucacggaacuccacccacgagauguacuggguaagcuguggcaccgggaacaucguuuccgccgucaauaugacgagccgcaugcuccuuaaccgcuucaccauggcgcaccgcaaacccacguucgagcgggacguagaucugggcgccggaacccgucacguggccgucgagcccgagguggccaaccucgacaucaucgggcagcgcaucgagaacauaaaaaacgagcacaagucgacguggcacuacgacgaggacaacccguacaagaccugggcguaucacggcuccuacgaagugaagccuuccgggagcgcuuccagcauggucaacgguguggugcggcugcugacgaagcccugggacgucauccccauggugacucagaucgccaugacggacaccacuccguucggucagcaacgcguauucaaggagaagguggauacccguacaccccgcgcaaagcggggcaccacccagaucauggaagugaccgccaaauggcuuuggggauuccugucacgcaacaaaaagccccguaucugcacgcgcgaggaguucacccggaagguacggagcaacgccgccaucggugccguguucguggacgagaaccaguggaacagcgccaaggaggccgucgaggaugagcguuucugggaccuugugcaccgcgagcgggagcuccacaagcagggcaagugcgcgaccugcguguacaacaugauggggaagcgcgagaagaagcugggggaguucggcaaggccaagggcagucgggccaucugguacauguggcugggcgcccgcuuucuggaauucgaagcgcuggguuuuaugaacgaggaccacugguuuagccgggaaaacucccugagcggugucgagggggagggccuccacaagcugggguacauucugcgcgacauuuccaagauuccgggcggcaacauguacgcggacgacaccgccgggugggauacgcggaucacugaggacgaccuccagaacgaggccaagaucaccgacaucauggagcccgaacacgcgcugcuggccaccagcaucuucaaguuaacguaccagaacaagguggugcgcguccagcgccccgcgaagaacggcaccgucauggacguaaucucccggagggaccaacgugggagcggccaggucggcaccuacgggcugaacaccuuuacgaacauggagguacagcugauccgccaaauggaguccgagggcauuuuccugcccagcgagcucgagaccccgaaccuggccgagcgcgugcucgacugguuggagaagcacggugcagagcgguugaagcggauggccaucuccggcgacgacugcgucgugaagcccaucgacgaccguuucgcuaccgcgcuaacagcccugaaugauauggggaaggugcggaaggacauaccccagugggagcccagcaagggcuggaacgacuggcaacaggucccguuuugcucccaccacuuccaccagcuuaucaugaaggacggccgcgagaucgucgugcccugccggaaccaggacgagcucguggggcgcgcaagaguuagccagggcgcaggguggucccuacgcgagaccgccugucugggcaagagcuacgcgcagauguggcaguuaauguacuuccaccgccgcgaccugcggcuggccgccaacgccaucugcuccgcagugccggucgacugggugccaacgagccgcaccaccuggagcauccacgcccaccaccaguggaugaccacagaggacaugcucuccguguggaaccgggucuggaucgaagagaacccguggauggaagacaagacacacgugagcaguugggaggaggugccguaccuggggaagcgcgaggaccaguggugcggcagcuuaaucgggcucacggcccgggccaccugggcgacgaacauccaagucgccaucaaccaagugcggcgccugaucgggaacgagaacuaccuggacuacaugaccuccaugaagcgguucaagaacgaaagcgaccccgagggcgcacucugguga

SEQ ID NO: 23867 - RNA, 9879 nt, Artificial Sequence
  derived and/or modified CDS sequence (opt11) from DENV-1__GU131965__SS-prME
agcguaaccaugcuucuaaugcuucugccaaccgcacuagccuuucaccugaccacccggggcggggagccccacaugauugugaguaagcaggaacggggcaagagccuccuguucaagaccucggcgggggucaacaugugcaccuuaauugccauggaucugggcgagcuuugcgaggacaccaugaccuacaaaugcccccagauuaccgaggccgagcccgaugacguggauugcugguguaacgccaccgacaccugggucaccuauggcaccugcagccagaccggcgaacaccggcgcgacaaacgcuccguggcccuggcgccacacgugggccugggacucgaaacgcggaccgaaacuuggaugagcuccgagggcgcauggaaacagauucagcggguugagaccuggguucuccggcaccccggguucacagugaucgcccuguuccucgcccacgcaaucggaacgagcaucacccaaaaggggauuaucuucauccugcugaugcucgucacccccuccauggcgaugcgcugcguggguaucggcaaccgggauuucguggagggguuaagcggagcuacgugggucgacgucgugcuggagcauggaagcugcgucaccaccauggcaaagaacaagccaacccucgauaucgagcugcugaagacggaggugaccaaucccgcgauccuccggaaacuguguauugaggcgaagaucucuaacaccaccacggauucccgguguccgacccagggcgaggccacccugguggaggagcaggacgcuaacuuuguguguaggcgaaccuuuguggacagaggcugggggaacggcugcgggcucuucgggaagggauccuuacugacgugcgccaaguucaaaugugugaccaagcucgagggaaagaucguccaguacgagaaccugaaguacuccgucaucgugacaguccacaccggcgaucagcaccagguggggaaugagacgaccgaacauggcacuaucgccaccauuacgccccaggcgccuacgucggaaauccaacugaccgacuacggggcgcucacccuugacugcucaccccggaccggccuggacuucaacgagaugguacuccugacgaugaaggagaagucuuggcugguacacaaacaaugguuccucgaucugccgcugcccuggaccuccggcgccagcaccagccaggagaccuggaaccgccaggaccuccugguuacguucaagaccgcacacgcuaagaagcaggagguuguuguauuagggucccaggagggcgcuaugcacacugcccucaccggggccacggagauccagacgagcggaaccacaacgauuuuugcagggcaccucaagugcaggcuuaagauggacaagcugacccugaagggcacuuccuaugucaugugcacggggagcuucaagcucgaaaaagagguggccgagacgcagcacggcaccguacuuguucaggugaaguacgagggcacggacgcgcccugcaagaucccuuucuccacccaggaugagaagggggucacacagaacggucgucucaucaccgccaacccgauaguaaccgacaaggagaagccugugaacaucgagaccgagccgcccuucggggagagcuacaucguggucggcgccggcgagaaggcgcugaagcuuuccugguucaagaaggggaguaguauaggcaagauguucgaagcgacggcucgcggagcccgccggauggccauccucggagacaccgccugggacuucgggagcaucgggggcguauucacuuccguggggaagcugguccaccagguguucggcacggcguacgggguauuauucagcggcgucuccuggacuaugaagauagggaucggcauccuccugaccuggcugggccuuaauagucgcaacaccucccugagcaugacuugcaucgccguggggauggucacgcuguacuuaggcgucaugguacaggccgauagugguugcgugaucaacuggaagggccgcgagcugaagugcgggagcggcaucuucgucaccaacgagguacauaccuggaccgagcaguacaaguuccaggcagauaguccuaagcggcugucagccgcgaucggcaaggcgugggaggaggguguauguggaauccgcagcgccacccggcucgagaacauuauguggaagcagaucucuaacgagcugaaccacauucugcuugagaacgacaugaaguucacggucgugguaggggacgccaacggcauccuagcacaggggaagaagaugauccgcccgcagcccauggagcacaaguacagcuggaagagcuggggaaaggcaaagaucaucggcgccgauauccagaacacgaccuucaucaucgacgggcccgacaccccggagugcccugacaaccagcgggccuggaacauuugggagguagaggacuacggcuuuggcauauucacgacuaacaucuggcugaagcuccgcgacagcuacacucagaugugugaccaccggcugauguccgcggcgaucaaggacucgaaggccgugcacgcugauaugggcuacuggaucgaguccgagaagaacgagaccuggaagcuggcccgcgccagcuucaucgaggugaagacgugcaccuggcccaagucacacacccucuggagcaacggcguccuagagucugagaugauuauccccaagaucuacggggguccgaucucccagcacaacuaccggcccggguauuucacccagaccgcgggcccauggcaccucgggaagcucgagcuggacuucgaccugugugaagggaccaccgugguggucgacgagcacugcggcaaccgcgguccgucgcugcggaccacgaccgccaccggcaagaucauccacgaauggugcugcagauccugcacccugccgccccugcgguuuagaggagaagacgggugcugguacgggauggagauccggccggucaaggagaaggaggagaaccucgugcgguccauggucagcgcgggauccggcgagguugacagcuucucacuggggauacugugcgcgaguauaaugauagaggaggugaugcggagccgguggucccggaaaaugcuuaugacgggcacccuggccgucuuccuccuccuggugauggggcaacugaccuggaacgaccucauucgccugugcaucauggugggcgccaacgccagcgacagaauggggaugggcacaacguacuuagcccugauggccaccuucaagaugcgcccgauguucgccgucgggcuucuguuccgcagauugacuucucgcgagguacugcugcucacaaucggacucagccucguggcgagugucgagcucccgaacucacuggaagagcugggcgauggacucgcgaugggcaucaugaugcugaagcugcucacagaguuccagccccaccagcuguggaccacgcuguugucccugaccuucaucaagacgacgcugucgcucgacuacgccuggaagaccacugccauggcucuguccaucgucucgcuguucccucucugucugucaacgacaucgcagaagaccacuuggcuccccguccuccuggguucguucgggugcaagccccucacuauguuccucaucacggaaaacaaaauauggggccgcaagucauggccccugaaugaggggaucauggcaaucggcaucguguccauccuuuuaagcucuuugcugaaaaacgacgugccacucgccgguccgcugaucgccggcggcauguuaaucgcuuguuaugucaucagugggucguccgcugaccucucccuggagaaggccgccgaggucuccugggagcaggaagccgagcauagcggcacuucucauaacauccugguggagguccaggacgacgggaccaugaagaucaaggacgaggaacgcgacgacacccucacaauucuguuaaaggccacgcuacuagcggugucaggcguguacccuauguccauccccgccacgcuauuuguaugguacuucuggcagaagaagaagcaacggagcgggguacuaugggauacccccaguccgccggagguggagagggccguccuugacgacggcauauaccggauacugcagcguggccugcucggacggagccagguuggcgucggggucuuccaagacggcguguuccacacgauguggcauguuacccgcggggccguccuuauguaccagggcaagcggcuggagcccucaugggccuccgugaaaaaggaccucauauccuacggcgggggguggcgcuuccaggggagcuggaacaccggcgaggaggugcaagugaucgcgguagaacccggcaagaacccaaagaauguccagaccacgcccggcaccuucaagacucccgaaggcgaggucggugccaucgcccuggauuucaaacccgguaccucaggcucucccauagucaaccgugaaggcaagaucgugggccuguauggaaauggcgucgugacgacauccgggaccuacgugagcgccaucgcccaggcaaaggccucccaggagggcccccugcccgaaaucgaagacgaggucuucaagaaacgcaaccuaaccauaauggacuuacacccggggucaggcaaaacgcggcgcuaucuacccgccauagugcgggaggccaucaaacgcaagcugcguacccuaauacucgcgccuacccgaguggucgccagcgagauggccgaggcucugaagggcaugcccauccgcuaccagacgacggccgugaaguccgagcacaccgggagggaaauuguugaccugaugugccacgcgacuuucacaaugcgccugcugagcccaguccgugugcccaacuauaacaugaucauaauggacgaggcccacuucacggacccagccuccauagcagcccgcggcuauauuagcacccggguggggaugggcgaggcggccgccaucuuuaugacagcuacgccgccgggguccgucgaggccuuuccccaaagcaacgcggugauccaggacgaggagcgcgauaucccagagcgguccuggaacagcggguaugacuggaucacggacuucccaggcaagaccgugugguucguccccucgaucaaguccgggaacgacaucgccaacugccugcgaaagaacgguaagcgggugauucagcuaucacggaagacguucgacaccgaguaucagaagacaaagaacaacgacugggacuacguggucaccacagacaucagcgagaugggggccaacuuucgggccgaccgcguaauugacccccggcgcugccugaagcccgucauccugaaggacggccccgagcgggucaucuuggccggcccuaugccagugaccguggccagcgcggcgcagcgacggggccgcaucggccggaaucagaacaaggagggggaccaguacguguacaugggccagccccugaacaacgacgaggaccacgcccacuggacggaggcgaagaugcugcuagacaauaucaacacaccggagggaaucaucccggcccuuuuugaacccgaacgcgaaaagagcgcagccaucgacggcgaguaccgccuacgcggggaggccaggaagaccuucgucgagcuaaugcggcgcggugaccuuccaguauggcugucauacaagguggcgagcgagggcuuccaauacuccgaccggcgcugguguuucgacggagagcggaacaaccaagugcuagaggagaacauggacguugagaucuggaccaaggaaggcgagcguaagaagcuacgaccuagauggcucgaugcccggacuuacagcgacccgcucgcccugcgcgaauucaaggaguucgccgcggggcgccgcagugugagcggcgaccugauccuugagaucgguaagcugccgcagcaccuaacgcuaagagcgcaaaacgcccuggacaaucuggugaugcuccacaacagcgagcagggcgggaaggccuaccgacaugcgauggaagaauugcccgauacaauugagacccugaugcuacuggcgcugauugccgucuuaaccggggggguaacucuauucuuccuguccgggaagggcuuaggcaagacuaguaucggccugcucugcgugaccgccuccagcgcccuccuguggauggccucagucgagccccacuggaucgcggccagcaucaucuuagaauucuuccucauggugcuguugauccccgagcccgaucggcagcgcacgccgcaagacaaccaacucgccuauguggucaucggccugcuguucaugaucuugacuguagccgccaacgagauggggcugcuggaaacaaccaaaaaggaccucgggaucgggcauguggcagccgagaaccaccagcacgcgacgaugcuggacgucgaccuuaggccggccuccgcuuggacauuguacgcggucgccaccaccgucaucacucccaugaugcgacacacgauagagaacaccaccgccaauaucagccugaccgccaucgcgaaccaggcggcgauccugaugggccucgacaagggcuggccuaucuccaagauggacaucggggugccacugcuggcgcucggcugcuacagccaggugaauccgcugacgcuaacggccgcgguacucaugcuugucgcgcacuacgccaucaucgggcccggccugcaggccaaggccacccgggaagcgcagaagaggaccgccgccgggaucaugaagaaccccacgguggacggcauaguagcaaucgaccuugaccccgugguguacgacgcuaaauucgagaaacagcuaggccagaucaugcugcugauccuaugcacgucccagauacugcucaugcgcacuaccugggcccugugcgaaaguauuacgcuggcuaccgggccgcucaccacccugugggagggguccccaggaaaguucuggaacacgacgauagccgugagcauggcgaacauauuccgaggauccuaccuggccggcgccgggcucgcuuuuagccugaugaagucucugggcgggggccgccgggggaccggcgcucagggcgaaacgcucggggagaaguggaagcgccagcuaaaccaguuaagcaaguccgaauucaacacauauaagcgguccgggaucauggaagucgaccgcagcgaggcaaaggagggccucaaacgaggagaaacaaccaagcacgcugugucacgcgggaccgccaagcugcggugguucguggagaggaaccuagucaagcccgagggcaaggugauugaccugggcugcgggaggggcggguggaguuacuacugcgccggcuuaaagaaggugaccgaggucaagggguacaccaaaggcggcccgggacacgaggaaccgauuccgauggcgacauauggcuggaaccuggugaagcugcacuccgggaaagacguguucuucaugccgcccgagaaaugcgauacccuucugugcgauaucggcgagagcuccccgaaccccaccauagaagaggggcgcacgcugcgcguccucaagaugguagagcccuggcugcgcggcaaccaguucugcaucaagaucuugaaccccuacaugccgagcguggucgagacguuggagcagaugcaacggaagcacggcgggauguuggugcguaacccccugucgcggaacagcacccacgagauguacuggguaagcuguggcaccgggaacaucgugucggcugugaacaugaccucgcgcaugcuccuaaaccgguuuaccauggcccaccgcaagcccacuuacgagcgagacguggaucugggcgccggcacccggcacgucgccguagagcccgagguggccaaccucgacauuaucgggcagcgcauugagaauauuaagaacgaacauaagaguacuuggcacuacgaugaagacaacccguacaagaccugggccuaccacggcuccuacgaggucaagccgagcggguccgcgucuucgauggugaacggcgugguccggcuacugaccaagcccugggacgugauccccauggucacccagauagcuaugacggacaccacccccuucggccagcagcgcguguucaaggagaagguggacaccagaacgccucgcgccaagcgggguaccacccagaucauggaggucaccgcgaaguggcuaugggguuuccucagccggaacaagaaaccucggaucugcacgcgugaggaguucacccggaaaguacgaucuaacgccgcgauuggugccguauucguggacgagaaucaguggaacagcgccaaggaggccguggaggaugaacgauucugggacuuagugcaccgcgaacgggagcuccauaagcaggguaagugugcgaccugcgucuauaacaugaugggaaagcgcgaaaagaagcuaggagaguucgggaaggcgaaaggcagccgggccaucugguauauguggcugggagcccgcuuccucgaauucgaggcccugggguuuaugaacgaggaccauugguucucccgugagaacucgcuguccggcguggagggggagggccuccacaaguugggguacauccugcgcgacaucuccaagauccccggcggcaacauguacgcggacgacacagcggggugggacacgcggaucaccgaggacgaccuccagaacgaggcaaaaaucaccgaaauaauggagcccgagcacgcccugcuagccaccuccauauuuaaacucacguaucagaacaaggucguccgggugcaacggcccgcuaagaacggcaccgucauggacguaauaagccggcgcgaucaaagaggaucuggucaagugggcaccuacgggcugaacaccuuuacgaacauggagguccagcugauccgccagauggagucggagggcaucuuccuccccagugagcuggaaacuccgaaccuggccgagcggguacucgacuggcuggagaagcacggggccgagcgccuuaagcggauggccaucagcggcgacgacuguguugugaagcccaucgaugaucgauucgccaccgcgcuuaccgcccugaacgacauggggaaaguccggaaggacaucccccagugggaacccucuaagggcuggaacgacuggcagcagguaccguucugcucgcaccauuuucaccagcugaucaugaaagacggccgcgagaucgugguccccugccggaaccaagacgagcucguagggcgcgcccgggugucgcaaggagccgguuggagccuucgcgagacugccugccugggcaaauccuacgcacagauguggcagcucauguacuuccaccggcgcgaccugaggcuggccgccaacgccauuugcucugccgucccggucgacugggugccuacgagccgcaccacauggagcauccacgcucaccaccaguggaugaccacagaggauaugcucucugucuggaaccgaguauggaucgaggagaacccguggauggaggacaagacccacguguccagcugggaggagguccccuaccugggaaagcgcgaggaccaguggugcggcucccucauaggacucaccgcccgcgccaccugggccacgaacauccaggucgcgaucaaucaggugcggcgccugaucgggaacgaaaacuacuuggauuacaugacgagcaugaagcgguuuaagaacgaguccgaccccgagggcgcccucugguga

SEQ ID NO: 23868 - RNA, 9879 nt, Artificial Sequence
  derived and/or modified CDS sequence (opt11) from DENV-1__GU131966__SS-prME
agcgugacgaugcuccucauguuacuuccuaccgcacucgccuuccaccugacuacgcgaggaggggaaccccacaugaucguaagcaagcaagagaggggcaaaagccuccuguuuaagaccagcgcaggagugaacaugugcacccucaucgccauggaucugggcgaauugugcgaggacaccaugaccuauaagugcccccagaucaccgaagcggagcccgacgacguggacugcugguguaacgccaccgacaccugggucaccuacgggacgugcucacagaccggcgagcaccggcgggacaaacgguccguggcccuugcaccccacgucggccuggggcucgagacgcggaccgagacuuggaugucauccgagggcgcguggaaacagauucagcgggucgagaccugggcccugaggcaccccggauucacgguuaucgccuuguuccucgcgcaugccaucggcaccagcauaacccagaagggaaucauuuucauccuacugaugcucgugacccccuccauggccaugcgcugcgucggaaucggcaacagggauuucguagaggggcuuagcggugcaacguggguagacgucgugcuggagcacggguccugcgucaccacgauggccaagaacaagcccacacuggacaucgaacugcugaagacggaggugaccaaccccgcgaucuugcgcaagcugugcaucgaggccaagauuaguaacaccacuacggacucccggugcccgacgcagggcgaagccacccuagucgaggagcaggacgccaacuucgugugucgccggacguucgucgaccgcggcugggguaauggcugcggccuuuucggcaaaggcagcuuauuaacgugcgcuaaguuuaaaugcguaaccaagcucgaaggcaagauagugcaguaugagaaccugaaauacagugucaucguuacaguacacaccggggaccagcaccaggucgguaacgagacgaccgagcauggcaccaucgcgaccaucacaccccaggcccccacguccgagauucagcugaccgacuacggcgcccucacccuggacuguagcccucggaccggcuuggacuucaacgagauggugcuacugacgaugaaggagaagaguuggcugguccauaagcagugguucuuggaccugccucugcccuggaccuccggagcaagcaccagccaggagaccuggaaccgccaggaccuccuggugacguuuaagaccgcacacgcgaagaagcaggagguggucgugcuggggucccaagagggcgccaugcacaccgcccucaccggggcgacggagauccaaaccagcggcaccaccacgaucuucgccgggcaccugaaaugccggcugaagauggauaagcucacccucaaagguacgaguuacgugaugugcaccgguagcuucaagcuggagaaggagguggcggagacucagcacggcaccguccuggugcaaguuaaguacgagggcaccgacgcccccuguaagauacccuucuccacccaggacgagaaagggguuacgcagaacggacgccucauuaccgccaacccuaucguuaccgacaaggagaagcccgucaacaucgagaccgagccacccuucggggaaucuuauaucgugguaggcgccggcgaaaaagcacugaaguugaguugguucaaaaaggggucuuccauaggcaagauguucgaagcaacagcccgcggcgcucgccggauggccauccucggcgacaccgcgugggacuuuggcucaaucgggggcgucuuuaccuccgucgggaaacugguacaccaggucuucggcacggccuacggggugcuguucagcggcguaucauggacaaugaagaucgggaucggcaucuugcugaccuggcugggacucaacagccgcuccacgagucuguccaugaccuguauugcgguagggauggugacccuguaccucggcgugaugguccaggccgacagcggaugcguaaucaacuggaagggcagagagcugaagugcgggucugggaucuucgugaccaacgagguccacacguggaccgaacaguauaaguuucaggcggacagcccgaagagacugucagcggccaucggcaaagcaugggaggaaggugugugcgggauccgcuccgccacucggcucgagaacaucauguggaagcaaaucagcaaugagcugaaucacauucugcuggagaacgauaugaaguucacggugguagucggggacgcaaauggcauacuggcgcaagggaagaagaugauccgcccccagcccauggagcacaaauacuccuggaaguccuggggcaaggcuaagaucauuggcgccgacauccagaacaccaccuucaucaucgacgggcccgauacccccgagugucccgacaaccaacgggccuggaacauuugggagguggaggacuauggcuucgggauuuuuacgaccaacaucuggcugaagcuccgcgacuccuauacccagaugugcgaccauaggcugaugagcgcggcgauuaaggacaguaaggcuguccaugcugauaugggcuauuggaucgagucugaaaagaaugaaaccuggaagcucgcccgggcguccuucauagaggugaagacgugcacguggccgaaaagccauacuuuaugguccaauggaguucuggaaagcgagaugaucaucccuaagaucuacggaggccccauuucccagcauaauuaucggcccggcuacuucacacaaacggccgggcccuggcaucuggggaaguuagagcuugacuuugaucugugcgaaggcaccaccguggugguugacgagcacugcgguaaccgcgggccaagccuccggaccacgaccguuacuggaaagauaauccacgaguggugcugucgcuccugcaccuuaccgccccuacgguuccgcggggaggacggcugcugguacgggauggagauucggccggugaaggagaaggaggagaacuuagugcgcagcauggucagcgcuggaaguggugaagucgacucguucagucucgggauccugugcgcgagcaucaugauugaggaagucaugaggucccgcuggagccggaaaaugcucaugacgggcacacuggccguauuuuuacuguugaucauggggcagcugaccuggaacgaucucauccgccuuugcaucauggugggcgcuaaugccuccgaucgcauggggaugggaaccaccuaccuggcccuuauggcaacguucaagaugcggccgauguucgccguugggcugcuguucagaagacugaccagccgcgaggugcugcugcucaccaucggucugucccugguggcgucuguggaguuacccaacucccucgaggagcugggcgacgggcucgccaugggaaucaugaugcugaagcuguuaacugaguuccaaccacaccaacuguggaccacccugcucagcuuaaccuucauuaaaacgacccugucacucgauuacgccuggaagaccaccgccauggcgcugagcaucgucucccucuucccccuaugccuguccacgaccagccagaagaccaccuggcuuccggugcuccugggcucauucgguuguaagccccugaccauguuccucaucacggagaacaaaaucugggguaggaagucuuggccucuaaacgagggcaucauggccauaggcauugucuccauacuucucagcagccuucugaagaacgacgugccacuugccgggccguugauugcggguggaaugcucaucgcaugcuacgucauuagcggguccucggcggaucugucccuggagaaagccgcggaggucagcugggagcaggaggccgaacacaguggaaccagccacaacauccugguggaagugcaggacgaugguaccaugaaaaucaaagacgaggaacgcgaugacacgcucacgauccugcugaaggccacccuccuggcgguguccggcguguacccuaugucgauuccugccacccuguucgugugguacuucuggcagaagaagaagcaacgauccgggguccucugggacacccccagcccgccagaaguugagcgcgccgugcuggaugacggaaucuaccggauccuccagcgcggcuuacuggggcggucccagguaggcguggggguguuucaggacgggguauuccacacgauguggcacgugacucgaggcgccguucugauguaucagggcaagcggcuggaacccagcugggccuccgucaagaaggaucucaucaguuauggcgggggcuggcgcuuccagggguccuggaauaccggcgaggagguccaggugaucgcggucgagcccgggaaaaacccgaagaacguacagacgacgcccggcaccuucaagaccccggaaggggaggugggggccaucgcccuggauuucaaacccggcaccagcggguccccgaucguaaaccgggagggcaagaucguggggcuguacgggaacgguguggugacgacuagcgggaccuacgugagcgccauagcccaggcaaaggccagccaggagggcccacuacccgaaaucgaggacgaggucuucaagaagagaaaccugaccaucauggaccugcacccggggucgggcaagacgaggagauaccuccccgccaucgugcgggaggcaaucaaacgaaagcugcggacgcugauucucgcgcccacccgugucguggccuccgagauggccgaggcguuaaagggcaugcccaucagguaucagaccacggcggucaaaagcgagcacaccggccgugagaucguggaucuuaugugccacgcgaccuucacgaugagacuccuguccccagugcggguccccaacuacaacaugaucaucauggacgaggcccacuuuacggaucccgccagcaucgccgcucggggcuacaucuccacccggguggggaugggugaggcggccgccauauucaugaccgccacgccgccagguagcguugaggcauucccccaaagcaacgcggucauccaagacgaagaaagggacaucccggagcggaguuggaacuccggcuacgacuggauuacggacuucccagggaagacugugugguucgugcccagcauaaaguccggcaacgacaucgccaacugccugaggaagaauggcaaacgggucauccagcuuagucgcaagacuuucgacaccgaguaccagaagacgaaaaacaaugauugggacuaugucgugaccaccgacaucuccgagaugggggccaacuuccgagcggacagggucaucgacccccggaggugccugaagcccguaauccugaaggacggccccgagagaguaauacucgcggggccgaugcccgucaccguggccagcgccgcccagcggcggggccgcaucggccggaaccagaacaaggagggggaccaguacguguacaugggccagcccuuaaacaaugacgaggaccaugcccauuggacugaggcgaaaaugcugcucgacaacauaaauaccccagaagggauaaucccugccuuguucgaaccugagcgcgagaaguccgccgccaucgauggcgaauaccgacuucguggggaggcccgcaagaccuucguggagcucaugcggcgcggcgaccugccuguguggcugucuuacaaggucgccuccgagggcuuccaguacagcgaucggcgcuggugcuuugacggggagaggaacaaucaagugcucgaggagaacauggacguggagaucuggaccaaagagggcgagcgaaagaagcuacgcccucgauggcuggacgcccggaccuacuccgauccgcucgccuuaagagaauuuaaagaguucgccgccgggcggcguagcgucagcggcgaccuaauccucgagaucggcaagcugccccaacacuugacgcuucgggcgcaaaacgcccuggacaaccuggugaugcuccacaacucugaacaggguggcaaggccuacagacaugccauggaagaacuccccgacaccaucgagacccucaugcuccuggcgcugauugccgugcuaaccgggggaguaacacuguucuuccucagcgggaaaggccucgguaagaccuccaucgggcugcugugcgugacggccaguuccgcccuccuguggauggcgagcguggagccccacuggauugcggcauccaucauccuggaguucuuuuuaauggucuuauuaauuccggagcccgaccggcaacgcacaccccaggacaaccaguuagccuacgugguaauaggccuguuauuuaugauccucacggucgccgcaaacgagauggggcugcucgagaccaccaagaaggaccuagggaucgggcacguggcggccgagaaccaucagcacgcaacaaugcuagacguggaccugcggccggccagcgccuggacacuauacgcggucgccacuaccgugaucaccccgaugaugcgccacacgaucgagaacaccaccgccaacauuucccugacugccaucgccaaucaggcagccaucuugaugggacuggacaagggcuggccuauuucgaagauggacaucggggugcccuuacuagcccucggcugcuacucccaggugaacccgcugacucugaccgccgccgugcucaugcuggucgcccauuacgcgauaaucgggccuggccugcaggccaaggccacccgcgaggcgcagaaacggaccgccgccgggaucaugaaaaauccuacugucgauggcaucguggcgaucgaccucgaccccguggucuacgacgccaaguucgagaagcaauugggccagaucaugcuccucauccugugcaccagccagauacuucucaugcguacaacuugggcgcugugcgaauccaucacacuggcgaccggaccgcucacaacccugugggagggcagccccggaaaauuuuggaacacuacuaucgccgugucgauggccaauaucuuucgggguuccuaucuggccggcgcggggcucgcuuucuccuugaugaagucccugggcgggggccgccggggaacuggcgcccagggcgagacacugggcgagaaguggaagcggcaacugaaccagcuguccaaaagcgaguucaacacguaucggcguucaggcaucauggagguagaccgguccgaggccaaggaggggcucaagagaggggaaacaaccaagcacgcggugucacgagggaccgccaagcugcggugguucguggagagaaaccuggugaagcccgagggaaaggucaucgaucuuggcugcggacgcggggguugguccuauuacugcgccggccucaagaagguuaccgaagugaagggguacacgaagggcggaccugggcaugaagaaccgaucccuauggccaccuacggcuggaaccuggucaagcugcauagcgggaaggacguguucuucaugccgccugagaagugcgacacgcuccugugcgacaucggagaguccaguccaaacccaacaaucgaagagggucggacgcugcgcguacucaagauggucgagccuugguugcgggggaaccaguucugcaucaagauccugaacccauacaugccguccgugguggagacccucgagcagaugcaacgcaagcacggcggcaugcugguucggaacccccugagccgaaacuccacccaugagauguauugggugagcugcggcaccgggaacauaguuagcgccgucaacaugacgagcagaaugcucuuaaaccgcuuuaccauggcucacaggaagcccaccuucgaacgggacguggaccugggcgccgguacgcgccacguggccgucgagcccgaaguggccaaccucgacaucaucgggcagcggaucgaaaacaucaagaaugagcacaaguccacguggcacuaugacgaggacaacccguacaagaccugggccuaucacggcagcuacgaggugaagcccagugggagcgccuccucuauggucaacggcgugguuagauuacugaccaagccaugggacgucauccccauggugacccagauagccaugacggacacuaccccguucgggcagcagcgggucuucaaagagaagguugacacccgcacgccacgggccaagcgcgguaccacccagaucauggaaguuaccgccaaguggcucugggguuuccugucccggaacaagaagccccgcaucuguacgcgggaggaguucacgcgaaagguccggucaaaugccgcgaucggcgccguguucgucgacgagaaccaguggaacagcgccaaagaggccgucgaggaugagagguucugggaccuggugcaccgggagcgcgagcuccacaaacagggcaagugugcgacguguguguacaauaugauggggaagagggagaaaaagcucggcgaguucggcaaggcuaagggcagccgcgccaucugguacauguggcugggcgcccgguuccuugaguuugaggcgcugggguuuaugaacgaggaccacugguucucacgggagaacuccuugagcggagucgagggggagggcuuacacaaacuuggguacauccugcgggauauauccaagaucccgggcgguaauauguacgcagacgacaccgccgggugggacacgcgaaucaccgaggacgaucuccagaacgaggccaagauaaccgacaucauggagcccgagcaugcccugcuggccacguccauuuucaagcugacauaccagaacaagguggugcgcguccagcggcccgcgaagaacggcaccgugauggacgugaucucccgccgggaccagcgcgggagcggccaagugggcaccuacggccuaaacacauuuaccaacauggaggugcagcugauccggcagauggagagcgagggcaucuuccuccccagcgagcuggagacccccaaccuggccgagcgugugcucgacuggcuggagaaacauggugccgagcggcugaagcgcauggccaucuccggcgaugauugcgucgugaagcccauagaugaccgguucgccaccgcguuaaccgcccugaacgacauggggaaggugcgcaaggacauaccccagugggagccgagcaagggcuggaacgauuggcagcagguaccguucugcagccaccauuuccaccagcugaucaugaaggacggccgggagaucguggugcccugccgcaaccaggaugagcucguugguagggcacgcgugagccagggcgccggguggucccugcgugagaccgccugccucggcaaauccuacgcucagauguggcagcucauguauuuccacagacgggaccuucgccuagccgccaacgcuaucugcucugcgguacccgucgauuggguacccaccagccggacuaccuggagcauccaugcacaccaccaguggaugaccacugaggauaugcucaguguguggaaccgcgucuggaucgaggagaacccguggauggaggacaagacccacgugagcuccugggaggaagugcccuaccuggggaaacgcgaggaucaguggugcgguucgcugaucggcuugaccgcgcgggccaccugggcgacgaauauacaggucgcgaucaaccagguccgcagauuaaucgggaacgagaacuacuuagacuacaugaccucgaugaaacgcuucaagaacgaaagcgaccccgagggcgcccucugguga

SEQ ID NO: 23869 - RNA, 9879 nt, Artificial Sequence
  derived and/or modified CDS sequence (opt11) from DENV-1__GQ868501__SS-prME
ucgguuacaaugcuauugaugcugcucccgaccgcacuugcauuucaucuuacaacccgaggcggggaaccccacaugauaguaucaaaacaggaacgcgggaaaagccuacuuuucaaaaccagcgcaggaguuaauaugugcacccuuauagcaauggaccugggugaacuaugugaagacacaaugaccuauaaaugcccacagaucacagaagcagaaccagacgaugucgauuguugguguaaugcuacugauaccugggucaccuacgggaccugcucacagacgggagagcacagacgggacaaacgaucugucgcccuugcgccgcacgugggguuaggacucgagacucgaaccgaaacuuggaugagcucggaaggggcguggaaacaaauccaaagaguagaaacaugggcccuccgccaccccggauucacagucaucgcucuauucuuagcccacgccauaggcacaucgauaacucagaaagggauuauauucauuuugcuuaugcuuguaacgcccuccauggcuaugcgaugugucggcauaggcaaucgcgauuuugucgagggacucaguggcgcaacauggguagacguggugcuagaacacgggaguuguguaaccaccauggccaaaaacaagccaacacuggacauugaacuccuuaaaacggaaguuacgaacccggccauccuccgcaaacuuuguauagaagccaagauuaguaacaccacgaccgauucaaggugccccacccaaggcgaggcgacacucguagaggagcaagaugccaacuucguaugcaggcgaacauucguggauaggggaugggggaacgguugcggacucuucggcaaagggagucuccuaacaugcgcgaaauucaaaugcguaacaaagcuagagggaaaaaucgugcaauaugagaauuuaaaauacuccguaaucgucacagugcacacuggugaccaacaccaagucgggaacgaaacuacugagcacgguacgauagcgaccaucacgccccaagccccaacgucggagauacaacucacggacuauggugcgcucacacucgacuguagcccgagaaccggacuggacuucaacgagaugguccuacuaacgaugaaggagaaaagcuggcuuguacacaagcagugguuccuugaccugccacucccguggacguccggcgccagcacuagccaagaaacauggaaucgacaggacuugcucguaacauucaaaacggcucaugccaagaaacaagaaguaguaguccucgggucacaggaaggggcaaugcacaccgcgcuaaccggagccaccgaaauccagacgagcggaacaacaaccaucuucgcaggacaccugaaaugucgacucaagauggauaaacuaacgcugaagggaacaucauauguaaugugcacuggaucguucaaacucgaaaaagaaguagcagaaacucaacacggcacggucuuaguccagguuaaauaugaaggcacagacgcacccugcaagaucccuuucuccacacaagacgaaaagggcgucacccagaacggacggcuaauuacagcaaauccgauuguaacggauaaggaaaagcccguaaacauagaaacagaacccccguuuggugaauccuauaucgugguaggcgcaggggagaaagcccuaaaauuguccugguucaagaaggguucguccauaggaaaaauguucgaagccacagcccggggagcgcgcaggauggccauucuaggagacacagcaugggacuucggcagcaucggcggagucuucacauccguaggaaaacucguccaccaagucuucgggacagcauauggcguacuuuucagcggcgucaguuggaccaugaaaauaggcauugggauucugcugaccuggcuuggccugaauagccguuccacaucauuaaguaugacaugcaucgcagugggcauggucaccuuguaccucggagugaugguccaagcagacucagggugugucauaaauuggaaaggcagagaacucaagugcggcagugggauauucgucaccaaugagguacacacauggacagaacaauacaaauuccaggcggacucaccuaagcgccuaucagccgccaucggaaaggcuugggaagagggagucugcgggauucguucagcaaccaggcuugaaaauaucauguggaaacaaauaagcaacgaacuaaaccacauccuccuggaaaacgacaugaaguucaccguagucgugggcgacgccaacgggauccuggcucaaggaaagaagaugauaagaccacaaccaauggaacacaaauacagcuggaaaagcuggggaaaggcaaaaauuaucggcgccgacauacaaaacaccaccuucauaauagacggcccugacacacccgaaugcccggacaaucagcgagcauggaacauaugggaaguggaagauuacggauucggcauauucacgaccaacaucugguuaaaacuaagagacagcuacacgcagaugugcgaccaccgacuaauguccgcagccaucaaggacucgaaggcgguacacgcagacaugggcuacuggauugaaagcgaaaagaaugaaacuuggaagcuggcucgggccagcuucauugaggucaagacauguacauggcccaagagccacacgcuuugguccaaugguguccuggagagcgagaugaucauaccaaaaauuuauggcgggcccauaagccagcacaacuaccgaccaggguacuucacccaaacggccgguccauggcauuuaggcaaacuagagcuggacuuugaccucugcgagggcacaaccguggugguagacgaacauugcggcaaccguggaccgagucucaggacgaccacagucacaggaaagauaauacacgaguggugcugccgaaguugcacccuucccccacugcgcuuuagaggggaagacgggugcugguacggaauggagauaagacccgucaaggaaaaagaggaaaaccuaguucguagcaugguaucagcgggaucgggcgaaguagauagcuucagccugggcauccugugugcgagcauaaugaucgaagaagucaugagaucgagauggaguagaaaaauguugaugacugggacccuggcaguuuucuuguugcuaaucaugggacagcuaacauggaacgaucucauccgacucugcauaauggucggggcgaacgcaagcgacaggauggggaugggaaccacuuaccucgcccuaauggcaaccuucaagaugaggcccauguucgcggucggccuccuguucagaaggcuuaccucgagagagguacuacuacuaacaauaggucuaucgcucguggcgaguguggagcugccuaauucacuugaggaguuaggagacggguuagcaauggguauuaugaugcucaagcuccucaccgaauuucagccacaccaacuauggaccaccuuauuaucacugacguuuauaaaaacuacgcucuccuuagacuacgcguggaagacgacagccauggcacugagcaucguaucccuauucccacugugccucaguaccacgagucaaaagacuacgugguugccaguacuccucggaucauucgggugcaagccacuaacgauguuucugaucacagaaaaccaaauauggggacguaaaucauggccccucaaugaaggaaucauggcgaucggaauagugucgauccuccugucaagccuguugaaaaacgauguaccacuagcaggaccucugauagcaggagggauguugaucgccugcuacgucaucucagggagcagcgcggaucugucacuagaaaagacggccgaaguaaguugggaacaagaagcggaacacagcggaaccucgcacaacauccuuguagaaguacaagaugacggaacaaugaaaauuaaggaugaagaacgagacgauacccuuacaauacuguugaaggcgacacuuuuagccguuaguggaguguacccgaugagcauacccgcaacucuauucguaugguauuucuggcagaagaagaaacaaagaagcgggguccugugggacacaccaagcccgccggaggucgaacgcgcaguacuggacgacggcaucuaccggauacuccaacgaggcuuguuaggacgaagucaaguaggaguuggaguauuccaagauggagucuuccacacaauguggcacgugacacgcggagccguucucauguaucaaggaaaacgccucgagccauccugggcaaguguaaagaaagaccucaucucuuacgggggcggauggcguuuccagggaucauggaacaccggggaggagguacaggucaucgcuguagaacccggcaaaaaccccaaaaacguccagaccacacccggcacguucaaaacgcccgagggcgaagucggggccaucgcucuggacuuuaaaccgggaaccucuggcucaccaaucgucaaccgggagggcaaaaucguuggccuuuaugggaacggggucguaaccacgucgggaacuuacguaagcgccauagcccaagcgaaggcaucacaggaagggccacuuccugaaauagaggacgagguuuucaagaaacgcaaccucacgauaauggaucugcacccaggcagcggaaaaacaagacgguaucugccagcaauaguccgagaagcuaucaagcgcaaguugcgcacacuaauccucgcaccgacccgggucguggcaagcgagauggccgaagcccuaaagggaaugccgauaagauaccaaacaacagcagucaaaucggaacacacaggaagagagaucguggaccugaugugccaugccacauucaccaugcgguuauuaucgccgguacgcguacccaacuacaauaugauaauaauggaugaagcacacuucaccgacccagcaucaauagcggcucggggcuacauaucuaccagaguagggaugggcgaagcagcagcaauauuuaugacagccacaccacccgggucaguggaagccuucccacagagcaacgccguaauacaagacgaagaacgagauauccccgagaggucuuggaacucaggauacgauuggauaacagacuucccaggcaagaccgugugguuuguaccaagcauaaaaucaggcaaugacaucgcaaacugccuaaggaaaaaugggaagcgaguaauacaauuaucccgcaagacuuucgauaccgaauaccagaaaacgaaaaacaacgacugggauuacguggucacgacggauauaagcgaaaugggcgcuaacuuucgugccgauagggucaucgacccaagacgaugccuuaaaccaguaauauuaaaagacggaccagaacgcgucauauuagcgggcccaaugccaguaacugucgcuagcgcagcacagcgcaggggucgcauaggccgaaaccaaaacaaggagggagaucaguauguauacaugggccaaccccucaacaacgacgaagaccaugcacacuggacagaagcaaaaaugcuguuggacaacauaaacaccccggaggggaucauuccugcccucuucgaaccugaaagggaaaaguccgcagcuauagacggggaguacagguuacgaggggaggcuaggaaaacauucguagaacuaaugcgccgcggcgaccuccccguauggcucagcuacaagguagccucagagggcuuccaauauagcgaucggcgcuggugcuuugauggugagagaaauaaucaggugcucgaggagaacauggauguagagauauggacaaaagagggggagaggaagaaacuacgaccuagauggcucgacgcacgaacauauucggacccacuagcccuuagagaauuuaaggaauuugcagcagggcgacgcuccgucucaggagaucucauucuagagaucggaaagcucccucaacaccucacccuucgagcacaaaacgcucuagacaaccuaguuaugcuccauaacucagaacaaggagggaaggcguauagacacgcgauggaagaacucccagacacgauagaaacccugauguugcuagcacucaucgcaguccucacaggcggaguuacccuauuuuuccuaucgggaaagggacuagggaaaaccagcauuggacuacugugcgugacagccagcagcgcucugcuauggauggcuuccguagaaccgcauuggaucgccgcgaguauaauccuagaguucuuucuaaugguacuacuuauaccagaaccagaucggcaacguaccccgcaagauaaccagcuugccuacguugucaucggguuacuguucaugauacucacgguugccgcaaaugagaugggacuguuggaaacaaccaagaaagaccuagggauuggacacguagccgcugaaaaccaucaacacgccacaaugcucgacguagacuuacgacccgcguccgcguggacgcuguacgccguggcgaccacaguaaucacucccaugaugcgacacacaauagaaaacacaacggccaacauaucguuaacagcaaucgccaaucaagcggcuauacuaaugggucucgauaagggguggccaauaucgaagauggacaucggcgugccgcugcuagcucuaggaugcuacagccaggucaacccccucacgcugacggcagcaguccucaugcuagucgcgcacuacgcaaucauuggaccgggacuccaagccaaagcgacucgagaagcacaaaaacgcaccgcugcaggaauuaugaaaaaccccacugucgacggcauaguggccauagaccuugauccagucguuuacgacgcaaaauucgaaaagcagcuaggccaaauuaugcuccuaauccuguguaccagccagauccuauuaaugaggacaaccugggcguuaugcgaaucuauaacccucgcaacaggcccgcucacaacccuaugggagggcucaccgggcaaauucuggaacaccaccauagccguuucgauggcaaacauauuucgcgggagcuaucuagccggcgcaggccucgccuuuagucugaugaaaucccucgggggcgggcggcgaggcaccggcgcgcaaggagaaacucuaggagaaaaauggaagagacagcugaaccaacugucaaagucggaguuuaacacuuacaaaaggagcggaaucauggaaguagauagaagugaagccaaagagggucugaaacgaggagaaacgacaaagcacgcugucucacgggggacagcgaaacuucgcugguucguagaaagaaaccuagugaagccggaaggcaaaguaauagacuugggaugcggacguggcggguggucguauuacugugcaggccucaagaaggucaccgaggugaagggcuauacuaagggcgguccggggcacgaagaaccgauccuaauggccacuuacggguggaaccuaguagagcuacacagugguaaagacguguucuucaugccuccagaaaaaugugacacccuucuuugcgacaucggagaaagcucaccuaacccaaccauagaggaaggcaggacacucagaguacucaagaugguagaacccuggcuacgagggaaucaguucugcauaaaaauacucaaccccuacaugcccucggucgucgagacucuagaacaaaugcagcgcaaacaugguggcaugcuaguacgcaauccgcuaucccggaauagcacucaugagauguauugggugagcugcggcacggguaacaucgugagcgccgugaacaugaccucgagaaugcuccuuaaccgcuucacaauggcccaccggaaacccacauucgaacgagacguggaccuaggcgcagggacgaggcacgucgcgguggaaccggaggucgcaaaccucgacaucaucgggcaacgcaucgaaaauaucaaaaacgagcacaaguccaccuggcauuaugacgaagacaacccauauaagacaugggcauaccauggaucauaugaagucaagccuuccggaucggcgucgagcauggugaacggugucguacggcuccuuacaaagccaugggacguaauucccaugguaacucaaauagccaugaccgacacaaccccauucggccaacaacgggucuucaaagaaaagguagacaccagaacaccgagagccaaaagaggcaccacacagaucauggaagucacagccaaauggcucuggggauuuuuaucgagaaacaagaaaccacgaauaugcacacgcgaagaguucacccggaaaguacgaagcaaugcagcuauuggugcggucuucguagacgagaaccaguggaacagugcaaaagaggccgucgaggacgaacgguuuugggacuuaguccaucgggaacgagaauuacacaagcaggggaagugugcuacuuguguauacaacaugaugggcaagcgugaaaagaagcucggagaguucgguaaggccaaaggcucacgcgccauaugguacaugugguuaggggcaagauuccucgaguucgaggcucuaggcuuuaugaaugaagaccacugguucagucgcgaaaacucguugucggggguugagggcgaaggacuccacaaacuaggcuauauauuaagggacauuagcaagaucccuggugggaacauguacgcugacgacacugcgggcugggauacgaggaucaccgaagaugaccugcaaaaugaagcgaagauaaccgacauaauggagcccgaacacgcacuacucgccacaucaaucuuuaaacuuacguaccagaacaaagucguaaggguccaacgcccggccaaaaacggaaccguaauggaugucauuucaagacgagaucaaagagggagcgggcagguuggaacauacggccuaaauacauuuaccaacauggagguacagcucauuagacagauggaaagcgaggggauuuuccuaccguccgagcucgagaccccuaaccuagcagaacgugugcuagacuggcucgagaagcacggcgccgaacggcuuaagagaauggccauaucaggggacgacugcgucguaaaacccaucgacgaucgcuuugcuacggcgcuaacugcgcuaaaugacaugggcaagguacgcaaagauaucccgcaaugggaacccucaaaaggauggaaugacuggcagcaggucccguuuugcagucaccacuuccaccaacuaaucaugaaagauggacgugaaaucguugugccaugcagaaaccaagaugaacuuguaggccgcgcuagagugucacaaggagccggguggagucuccgggagaccgccugucucggaaaaagcuacgcgcaaauguggcaguuaauguacuuucaccgacgagaccuacguuuagcagcaaaugccauauguagugccgugccgguagacuggguaccaacuucccguacgacaugguccauccacgcucaccaucaguggaugacaacggaggacaugcuuuccguguggaacaggguauggaucgaagaaaacccguggauggaagacaaaacgcacgucucaagcugggaagaggugcccuaccucggcaagcgcgaagaccaaugguguggcagucucauaggacucaccgcgagggcgacaugggcaacgaacauccagguagccaucaaucagguacggcgucucauagggaaugagaacuacuuggacuacaugacuucaaugaagcgcuucaagaacgagucagauccggaaggagcauuaugguaa

SEQ ID NO: 23870 - RNA, 9879 nt, Artificial Sequence
  derived and/or modified CDS sequence (opt11) from DENV-1__HQ166035__SS-prME
agcgugaccaugcugcucauguuacugcccaccgcccucgccuuccaccugaccacccgggggggggagccucacaugaucgucucaaagcaggagcggggcaagagccuccuguucaagaccuccgcggggguaaacaugugcaccuuaaucgccauggaucugggggagcucugcgaggauacaaugaccuacaagugcccccagauuaccgaggccgagcccgaugacguggacugcuggugcaacgccaccgacaccugggucacauacggaaccugcagccagacgggcgagcaccgccgugacaaacguuccguggcccuugcuccccacgugggccuggggcuugagacgcggaccgaaacguggaugucauccgagggagcguggaagcagauccagcgcgucgaaacgugggcccugcgccaccccggguucacggugaucgccuuguuccucgcgcacgccaucggcaccuccaucacacagaaggggaucaucuucauacuucugaugcucgugacccccuccauggccaugcgcugcgucgggaucggcaaucgggacuucguugaggggcugagcggcgcaacgugggucgacgucguccuggagcacggguccugcguaacgaccauggccaagaauaagccgacccucgauaucgaacugcugaagacggaggucaccaacccugcgauccuacgcaagcuuugcauagaagcaaagauaagcaauacaaccacugacucccggugccccacucagggcgaggccacgcugguggaagagcaggacgccaauuucgugugccgccggaccuucgucgacaggggcugggggaacggcugcggacuguucggcaaggggagccugcuuacaugcgccaaguucaagugugugaccaagcuagagggcaaaauagugcaguacgaaaaccugaaguacuccguaaucgugaccgugcacaccggagaccagcaccaagucgggaacgaaacgacggaacacggcaccaucgcaaccaucacgccccaggcccccacgagcgagauccguuugaccgacuauggggcgcucacucuggauugcagcccccggaccggccuggacuucaacgagaugguguuacugacgaugaaggagaaauccuggcugguccacaagcagugguuccucgaccugccuuugccauggaccagcggggccagcaccagccaggagaccuggaaccggcaggaccuccuggugacguucaaaaccgcccacgcgaagaagcaagaggugguuguccucggaagccaggagggcgccaugcacaccgcccucacuggugccacggagauacagaccagugggaccaccacuaucuucgccgggcaccugaagugccgccugaaaauggacaagcucacccugaagggcaccucguacgugaugugcacugggagcuucaagcuggagaaggagguggcggagacccagcacgggaccguccugguacaggucaaauacgagggcaccgacgcccccugcaagauccccuucaguacccaggacgaaaagggggugacucagaacggccggcucaucacggccaacccaaucgugaccgacaaggagaagcccgucaauaucgagaccgagccacccuucggagaaagcuacaucgugguaggcgccggcgagaaggcguuaaagcucuccugguucaagaagggaucgagcauaggcaagauguucgaggcaacggcccgcggggcccggcguauggccauucucggcgauaccgcgugggacuucggaagcaucggaggugucuucaccuccguugggaagcuggugcaccaggucuucggcaccgccuacggggugcuguuuaguggggugucguggacgaugaagaucggcaucgggauccuccugaccuggcugggccuuaacucgcgcucgaccagccugagcaugaccugcauagccgucgggaugguuacguuauaccucggcguuaugguccaggccgacagcggaugcgugaucaacuggaagggccgggagcugaagugcggguccggcaucuucgugacuaacgagguccauaccuggaccgagcaauacaaguuccaggccgacuccccgaagagacugagcgcggccaucggaaaggccugggaggaaggggucugcggcauccgguccgccacccgccuagagaauaucauguggaagcagaucucaaacgagcugaaccacauccugcucgaaaacgacaugaaguucacuguagucgugggggaugcaaacggcauccuggcgcaggggaagaagaugauccgcccacagcccauggaacacaaguauagcuggaagucguggggcaaagcuaagauuaucggcgcugacauccagaacaccacauuuauaaucgaugggcccgacaccccggagugccccgacaaucagcgcgccuggaacauuugggagguggaagacuacggcuucgggaucuucacgaccaacaucuggcugaagcucagggacagcuacacccagaugugcgaucaccgcuuaaugagugcagccaucaaagacuccaaggccguccacgcggacaugggauacuggauugaaagcgagaagaacgagaccuggaaguuggcucgugcguccuucaucgaggugaaaacgugcaccuggcccaagagccacacccucugguccaacggcgugcuggagagcgagaugaucauccccaagaucuacggcggccccaucucccagcauaauuauagaccuggguacuucacccagacagcgggccccuggcaccugggcaagcuagaacuggacuucgacuuaugcgaggggaccaccgucgugguggacgagcacugcggaaaccggggcccuagccucaggaccacgaccgucaccggcaagaucauacacgaauggugcugccgguccugcacccugccgccccuucgcuuccgaggggaggauggcuguugguaugggauggaaauccgcccaguuaaggaaaaagaggaaaaccucguucggagcauggucucagcgggaagcggagaaguggacagcuuuucccuuggaauccucugcgugagcauaaugaucgaggaggucaugcgcuccagauggagcaggaagaugcugaugacggguacccuggccguguuccuucuccucgugauggggcagcuaaccuggaacgaccucauccgccugugcaucauggucggcgccaacgccuccgaccgcaugggaaugggcacuacauaccuggcccuaauggccaccuucaagaugcgccccauguucgccguggggcugcuguucagacgccucaccagcagagagguucugcugcucaccaucgggcucucccuggucgcgagcguggagcuccccaacuccuuagaggagcugggugacggccucgccaugggcaucaugaugcucaaguugcucacugaguuccagccccaccagcuguggacaacacuguuaagccucacauuuauaaaaacgacgcugagccucgacuaugccuggaaaaccacugcgauggcccugaguaucguuucccuguucccgcucugccugagcacgaccagucaaaagaccaccuggcugccggugcuccugggcaguuucggguguaagcccuuaacgauguuucucaucacggaaaacaagauauggggcaggaaguccuggccccugaaugagggcaucauggcgauuggcauuguuagcauccuucucuccagccuuuugaagaaugaugucccccuagcgggcccgcuuaucgcgggagguauguuaaucgccugcuaugugaucagcggguccagcgccgaccucucccuggagaaggcggccgaggugucuugggaacaggaggccgagcacuccggcacaagccauaacauacugguugaggugcaggaugacgggacgaugaagaucaaagacgaggagcgggacgacacccucacgauccuguuaaaggccacuaugcucgccgugucaggcgucuaccccauguccaucccugcgacuccguucguaugguacuucuggcagaagaaaaagcagcgcauucgugugcugugggauacgccgagcccgccagaaguugaacgcgcagugcuggacgacgggaucuaccggauccuccagcgcggccugcugggaaggagccaagugggggugggcguauuccaggacgguguguuccacacgauguggcacgucacccgcggcgccgugcugauguaccaggggaagcggcucgagcccuccugggccagcguaaagaaggaccugauuuccuacggcggcggguggcgauuucagggcagcuggaacaccggggaggagguccaggugaucgccguagagccgggcaagaacccaaagaauguccagacuacgccuggcaccuuuaagacccccgagggcgaggugggcgcgaucgcccuggauuucaagccggggacaucgggcucacccaucgugaaccgggaggagaagaucguagggcuguauggcaacggcguggugacgaccuccgggaccuaugucagcgccaucgcccaggccaaggcgagucaagagggcccccugccggagauugaagacgagguguucaaaaagcgcaaccugaccaucauggaccuucacccagggucuggcaaaacgcggcgguaucugccagccaucgugagagaggccaucaagcgcaagcugcgcacccucauccuggcucccacccgcgucguggcuucugagauggccgaagcccugaaggggaugccgauccgcuaccagacuacggcggugaaauccgagcacaccggccgcgagauugucgaccucaugugccacgccaccuucaccaugcggcugcucagccccgugcgggugcccaacuacaacaugaucauuauggacgaggcccacuuuacggaccccgcguccaucgccgcccgcggcuacaucucaacccgggucgggaugggcgaggccgcggcgaucuucaugaccgccacaccgccugggagugucgaggcuuucccucagagcaacgcggucauccaggacgaggaacgggacauucccgagcguagcuggaacagcggcuacgauuggaucacggauuucccggggaagaccgucugguucguacccuccaucaagagcggcaacgacaucgcgaacugucuccggaagaacggcaaacgcguaauucagcuguccaggaagaccuuugacacggaguaccagaagacgaagaacaaugacugggacuauguugugaccaccgauaucucagagaugggagcgaacuuccgcgccgaccguguaaucgaucccaggcggugucugaagcccguuauccuaaaagacggcccggagcgcguaauccuggccggacccaugccggugaccgucgcguccgccgcacagcgucgggguaggauugggcgcaaucagaacaaggagggcgaccaauacguguacaugggacagccucugaacaaugacgaggaucacgcccacuggacggaggccaagaugcuccuggacaacaucaacacaccggaggggauaauacccgcgcucuuugagccggagcgggagaaaagugccgcaaucgacggcgaguacagacugcgcggggaggcccgcaagacguuugucgagcuuaugcgucgcggcgaccuucccguuugguuauccuauaagguggccagcgaaggguuccaguacuccgaccggcgcuggugcuucgacggcgaacggaacaaccagguccuggaggagaacauggauguggaaaucuggaccaaggaaggcgagagaaaaaaguugcggccgcgauggcucgacgcgcgaacauacagcgacccccuggcuuuacgcgaauucaaggaauucgccgccgggcggcgcuccgugagcggcgaccucaucuuagaaauagggaagcugccccagcaccucacgcuucgggcgcagaacgcguuggacaaccucgucaugcugcacaauagcgagcaggguggcaaagccuaccgccacgccauggaagaauugccagacacaauugagacccucaugcugcuggcccucaucgcgguguuaacuggcggugugacgcuguucuuucucuccgggaagggucuggguaaaaccagcaucggccuccucugcgugaccgcuuccagcgcccucuuauggauggccuccguggagccgcacuggauugcagcuagcaucauccucgaauuuuuccuaaugguguugcucauccccgagcccgaccgacagcgcaccccgcaggacaaccagcuagcguacguggucauugggcuccucuucaugaucuuaacgguggccgccaacgagaugggucugcucgagacuaccaagaaggaccuggggaucgggcacgucgccgcggaaaaucaccagcacgcaacuaugcuggacguugaccuacgucccgccuccgccuggacgcuguacgcagucgcgaccaccgucaucacccccaugaugcgccacacaaucgagaacaccaccgcgaacaucuccuugaccgccaucgccaaucaggcagccauucucaugggguuggacaagggguggcccaucuccaagauggauaucggcgugccgcugcucgcuuuagggugcuacucgcaggugaacccccucacccucacagccgccguccugaugcuuguggcgcacuaugcuauaauagggcccgggcuccaggccaaggccacccgcgaggcacagaaacggaccgcagcggggaucaugaagaaccccacgguggacgguaucguggccaucgaucuagacccggugguauacgacgcaaaguucgagaagcagcuggggcagaucaugcuccuuauccuuuguaccagccagauacuccugaugcgcaccaccugggcccuuugcgagagcaucacgcucgcgacgggcccccugaccacccugugggaaggcucgccagggaaguuuuggaacacaacuauugcgguuagcauggccaacaucuuccgggggaguuaucucgcaggggcgggccuggcguucagccugaugaagucccuuggcgggggccgccgggggaccggcgcgcaaggagagacacugggcgaaaaguggaagcgccagcugaaccaacuaagcaagagugaguucaauacuuacaagcggagcggcaucauggaaguggacagaagcgaggccaaggagggguugaagcggggcgagaccacuaaacacgccgugagucgcgggaccgcgaaguugcguugguucgucgagcgaaaccucgugaagcccgagggcaaggugaucgaccuuggguguggccggggaggguggagcuacuacugcgccggcuugaagaaggucaccgagguaaaggguuacacgaaaggcggacccggccacgaggagcccauccccauggccacuuacgguuggaaccuggugaagcuacacuccggcaaggaugucuucuucaugccccccgaaaagugcgacacccugcucugugacauaggcgagagcucccccaaucccaccaucgaggaggggaggacgcuccggguucugaagaugguggagcccugguugcgcggcaaucaguucugcaucaagauccugaacccguacaugcccagcgucguugaagcccuggagcaaaugcaaaggaagcauggggggaugcuggugcguaacccccucucgcgcaacucaacccacgaaauguauugggucuccugcggcacggggaauauagugagcgccgugaacaugaccagccgcaugcugcugaaccgcuucacgauggcgcaccggaagcccaccuacgaacgcgacgucgaucucggcgccgggacccggcacguggccguggagccggaggucgccaaccuggacaucaucggccagcgcauugagaauauuaagaacgaacacaaaaguacuuggcacuacgacgaggacaaccccuacaagacgugggccuaccacggcuccuacgaaguuaagccuagcgggagugcgagcucgauggugaauggagucguccggcugcucaccaagccuugggacguuaucccgaugguaacacagauagccaugaccgacacuacgcccuuugggcagcagcgaguguuuaaagagaaaguggacacgcggacgccccgggccaagcggggcacgacgcaaaucauggaagucaccgccaaguggcuguggggguuucugagccgcaacaagaagccgaggaucugcacccgcgaggaguucaccaggaaggugcguuccaacgccgcgaucggcgcugucuucguagacgagaaucaguggaacagcgcuaaggaggccguugaggacgaaagauucugggaucucguccaccgggagcgggagcugcacaagcagggcaaaugcgcgaccugcguguacaacaugaugggaaagcgagagaagaagcugggcgaguucgggaaagccaaggguagccgggccaucugguacaugugguugggggcccgcuuccuggaguucgaggcccugggcuucaugaacgaggaccacugguucucccgggagaacagccucagcggcguggagggugagggccugcacaagcugggguauauccuccgcgacaucagcaagauccccggggggaacauguaugcggaugacacagcaggcugggacacacgcauaacugaggacgaccugcagaacgaggccaagaucaccgagaucauggagcccgagcaugccuuacucgccaccuccaucuucaaguugaccuaccagaacaaggucgugcgcgugcagcgccccgccaagaacggcaccgucauggacgucaucucacggcgggaccagcggggguccggacagguggggaccuacggccugaacaccuuuacuaacauggaaguccagcucauccgucaaauggagagcgagggcaucuuccuuccgagugagcuggagacgcccaacuuagcggagcgugugcuugacuggcuggagaagcacggggcagagcgccucaagcguauggcaaucagcggcgacgacugcguugucaagcccaucgacgaccgcuucgccaccgcguuaaccgcucugaacgacauggggaagguacgcaaggacaucccccagugggagccgaguaagggcuggaacgauuggcagcaagucccguuuugcucgcaccauuuucaccagcucauaaugaaggacggucgcgagaucguugugccuugucguaaccaggacgagcuggugggucgcgcccgcgucucucaaggugccggguggagccugcgcgagacagcgugucugggcaaguccuacgcacaaauguggcagcucauguacuuucaucggcgcgaccugcgucucgcggcaaacgccaucugcagcgcuguucccguagacuggguuccgaccucccguacgaccuggagcauccacgcccaucaccaguggaugacgaccgaggacauguuaagcguguggaaccggguguggaucgaggagaacccuuggauggaggacaagacgcacgucuccagcugggaggaagugccuuaccuagggaagcgggaggaccagugguguggcagccucaucggguugacugcccgcgccaccugggccaccaauauacagguggcgaucaaccaggucagacgccugaucggcaacgagaacuaccucgacuacaugacgucgaugaagcguuucaagaacgaauccgaucccgagggcgcauuaugguga

SEQ ID NO: 23871 - RNA, 9879 nt, Artificial Sequence
  derived and/or modified CDS sequence (opt11) from DENV-1__GQ868502__SS-prME
agcgugaccaugcugcucaugcugcugcccaccgcccucgccuuccaccugaccacacggggcggggaaccccacaugaucgugagcaagcaggaacggggcaagagccuccuguucaagacaagcgcgggugugaacaugugcacccuaaucgccauggaccugggcgagcucugugaggacacuaugacguacaaguguccccagaucaccgaggccgagcccgacgacguggacugcuggugcaacgccaccgacaccugggugaccuacgggaccuguagccaaacgggcgagcaccgccgggacaagcgcuccguugccuuagcgccccacgucggccugggacucgagacucggacggagaccuggaugagcagugagggugccuggaagcagauccagcgcgucgagacaugggcucugagacaccccggauucacggugaucgcccuguuccucgcgcacgccaucggcacaagcaucacccaaaaggggaccaucuucaucuuacugaugcucgcgacucccuccauggccaugaggugcgugggcauuggcaaccgggacuuugucgaggggcugagcggggccacguggguggacgugguccuggagcacggguccugcgugacgacaauggcgaaaaacaagcccacccuugacaucgagcugcugaagaccgaggugaccaaccccgccauccucagaaagcuguguaucgaggcgaagaucaguaacacgacuacggauuccagaugcccgacgcagggcgaggccacccuggucgaagagcaggacgccaacuucgugugucgccggacguucguggaccgcggaugggggaaugguugcgggcucuucggcaaggggagccugcuaacgugcgcgaaguucaaaugcgucaccaagcucgaaggcaagaccgugcaguaugagaaccugaaguacuccgugaucgucacgguccacacuggcgaccagcaucaaguggguaacgagaccaccgagcacggcaccaucgccacgaucacgccccaggcccccaccagcgagauccagcugaccgauuacggggcccucacgcuggacugcagcccuaggacaggccucgacuucaacgagaugguccuccugaccaugaaggagaaguccuggcuagugcauaagcagugguuccucgaccugccgcugccuuggacuuccggggccucaacgagucaggaaaccuggaaucgacaggaccuccuggucaccuucaagaccgcgcacgccaagaagcaggagguggugguccugggcucccaggaaggcgccaugcacacggcguuaaccggggccacugagauccagaccucgggaacgaccaccaucuuugcggggcaccugaagugccggcuuaagauggacaagcucacucugaagggcacguccuaugugauguguacugggagcuucaaacuggagaaagagguggcagagacccaacacgggaccguucugguccaggugaaguacgagggcacggacgcgcccugcaagauccccuucuccacccaagacgagaagggggucacacagaacggccgccucaucacagccaacccgaucgugacagacaaggagaagcccgugaacaucgagaccgagccgcccuucggagaaagcuacaucgucgugggcgcgggcgagaaggcgcugaagcugagcugguucaagaaggggagcuccaucggaaaaauguuugaagccacggcgcgcggggcccgccggauggcgauccucggcgacaccgcgugggacuucgggagcauaggcggcguguuuacuuccgucgggaagcuugugcaccaggucuucgggaccgccuaugggguccuguuuagcggcguguccuggacuaugaaaaucgguaucggcauacuccugaccuggcugggccucaacagcagguccacgagccugagcaugaccugcaucgccguggggauggucaccuuguaccuuggcgugauggugcaggccgacagcgggugcgucauuaacuggaagggccgcgagcucaaaugcggguccggcaucuucgugaccaacgaagugcacacauggacagagcaguacaaguuccaagcugacagcccgaaacggcuuucagccgcgauaggaaaggccugggaggagggcguuugcggcauccgcucugccacccggcucgagaacaucauguggaagcagaucagcaaugagcugaaucacauacuacucgagaacgacaugaaguucaccguuguggucggagacgcaaacggcauacuggcccaggggaagaaaaugauccgcccucagccaauggagcacaaguacuccuggaaguccuggggcaaggccaagauaaucggcgccgacauccaaaauaccacguucaucaucgacgggcccgacaccccagagugccccgacaaucagcgggcauggaacaucugggagguggaagauuacggguucgggaucuucacgaccaacaucuggcugaaguuacgcgauuccuacacgcagaugugcgaccaccggcuaaugagcgcggccaucaaggacuccaaggccgugcaugcggacauggguuauuggauagagucagagaagaacgagaccuggaagcuggcaagagccuccuucaucgaaguaaagaccugcaccuggcccaagagccauacgcugugguccaacggcgugcuggagagcgagaugaucauccccaagaucuacgggggaccgaucucccagcauaauuaccggcccggguacuucacccagaccgccggacccuggcaccuggguaagcucgagcucgacuucgaucugugcgagggcaccacgguugucgucgacgagcacugcgggaaccgcgguccgagccuccggaccaccaccgugacgggcaagaucauccacgagugguguugccguagcugcacccuuccgccccugcgguuucgcggggaggacggcugcugguacgggauggagauccggcccgucaaggaaaaggaagagaacuuagugcgcagcaugguguccgccggcagcggugagguggauagcuuuucccuggggauccugugcgccagcaucaugaucgaggaggugaugcgguccagguggagccggaaaauguuaaugaccggcacccuggcggucuuccugcuccuggucauggggcaacugacguggaaugacuuaauaaggcugugcaucauggugggugcgaacgccuccgaccgcauggggaugggcaccaccuaccuggcccucauggccaccuucaagaugcggccgauguuugcgguagggcuguuguuucgccggcucacgagccgcgagguccugcugcucaccaucggacugucccuuguggcaagcguggagcuccccaauucccuggaagagcugggugacgggcuagccaugggcaucaugaugcuaaaguugcucaccgaauuccagccccaccaguuauggaccacgcugcucagccuaacguucaucaagaccacccugucccucgacuacgcauggaagacgacagcgauggcccugagcaucgucucccucuucccucucugccuguccacuacgucccaaaagaccaccuggcugccggugcuccuuggcagcuucggcugcaaaccccugacaauguuccugaucaccgaaaacaagauuuggggccggaaguccuggccccugaacgaggggaucauggccaucggcaucguaagcauucugcucuccagccugcugaaaaaugacgugccccucgccgggccacugauagccgggggcaugcucauagcaugcuacgugaucagcggguccagcgccgaccucucccuggagaaggcugccgaggucagcugggagcaagaggccgaacacuccgguaccucccacaacauccuaguggaggugcaggacgacggaacgaugaagaucaaggacgaggagcgcgacgacacccucaccauccugcugaaggcgacccuccuggccgucuccggcguguaucccaugagcauccccgccacgcuguucgugugguacuucuggcagaagaagaagcagcgguccggaguacucugggacacccccagcccgcccgagguggagcgcgccgugcuggacgauggcauauaccggaucuuacaacgcggccugcucgggaggucccaggucggcguggggguuuuucaagacgguguuuuucacaccauguggcacgugacccgcggggccgugcugauguaccagggcaagcggcuggagccaagcugggcgagugucaagaaggaccuaauaagcuacggcgguggcuggcgcuuucaaggguccuggaauacgggcgaggagguccaggugaucgccgucgagcccgguaagaacccgaagaacgugcaaaccaccccgggcaccuucaagacgcccgagggcgagguaggggccaucgcccuggacuucaagcccggcacaagcggauccccgaucgucaaccgggagggcaagaucgucggacuuuauggaaacggcguagucaccacaagcgggacauacguguccgccaucgcccaagccaaagccagccaagagggcccccuacccgagaucgaggacgagguguucaagaaaagaaaccugaccauuauggaccugcauccugggagcggcaagacgcggcgcuaccuccccgcuaugguccgggaggcgauuaagcgcaagcugcggacacugauccuggcacccacgcgcgugguggccuccgaaauggccgaggccuuaaagggcaugccuauacgcuaccagaccacagcggucaaaagcgagcacaccgggcgggagaucguggaccuaaugugccacgccacguucaccaugcggcuucuuuccccggugcguguccccaauuacaacaugaucaucauggacgaggcccacuucaccgaccccgccagcaucgccgcccgcggcuacaucuccacccguguaggcaugggggaagccgccgccaucuucaugacagccacgccucccgggucaguggaggcguucccucagucuaacgcugucauacaagaugaggagcgcgacauucccgagcggaguuggaacuccggguacgacuggaucaccgacuuccccggcaagaccgugugguucgugccuagcaucaagucagggaacgauaucgcuaacugcuugcgcaagaauggcaagcggguuauucagcugucucgcaagacguucgacaccgaguaccagaagaccaagaacaacgacugggacuacguggugacaacggacaucuccgagaugggcgcuaacuuccgggcggaccgcguuaucgauccccggcgcugcuugaagcccguuauacugaaggacgggcccgagaggguaauccuugccgggccgaugcccguuaccguggccagcgccgcccagcgccggggccgcaucggccggaaccagaacaaggagggagaccaauacguguacaugggacaaccccugaacaacgacgaggaccaugcgcauuggaccgaggccaagaugcuuuuggacaauaucaacacaccagaggggaucaucccggcccuguuugagcccgagcgcgaaaaguccgcagccaucgacggagaguaccguuuacgcggggaagcgcgcaagacauucgucgaacucaugaggcgcggcgaccugcccguguggcugucauauaaggucgccuccgagggcuuccaguacagcgaccggcgcuggugcuucgacggggagcgaaacaaccaggugcucgaagagaacauggauguggagaucuggacuaaagagggcgagcgcaagaagcuucggccgcgcuggcuggacgcgagaaccuacuccgacccccucgcccuccgggaguucaaggaguuugccgcggggcgucgcagcgucagcggcgaccugauucucgagaucggcaaacugccccagcaccugacccuacgagcccagaacgcccuggauaaccuugugaugcuccacaacuccgagcagggcgggaaggcauaccgccacgcgauggaggagcugcccgacaccaucgagacgcugaugcuccuggcccugauugccguccucaccgggggcgucacguuguucuuccugagugggaagggacucgguaagaccuccaucgggcuguuaugcgugacggccuccucggcccuccuguggauggcgagcguggaaccccacuggaucgcagccuccaucauccuggaguucuuccucaugguccugcugauccccgagcccgaucggcagagaacgccucaggacaaccagcucgccuacguagugaucgggcugcuguucaugauucucaccgucgccgcgaacgagauggggcugcuggagacgacgaaaaaggaccucggcauagggcacguggcugccgagaaccaccagcacgccaccauguuggacguggaccugcguccggccagcgcguggacccucuacgcugucgccaccacagugauaacccccaugaugcgccacaccaucgagaacaccacggccaacaucucauugaccgccauagcgaaccaggccgccauccugauggguuuagacaagggcuggcccaucagcaaaauggauaucggagugccacugcuggcccucggcugcuauucccaggucaauccgcuuaccuuaaccgcggcugugcugauguugguggcccacuacgccaucaucggacccggccugcaagccaaggcgacacgggaggcccagaagcgaacggccgccgggaucaugaaaaaccccacagucgacgguauuguggccaucgaccucgaccccguggucuacgacgcgaaauucgagaagcagcugggccaaaucaugcuccucauccuuugcacaucucagauccugcucaugaggacgaccugggcacuaugcgaguccaucacccuggccacggguccgcucacgacccuuugggagggcagccccgggaaguucuggaacacgaccaucgcgguguccauggccaacauuuuccggggcagcuaccuggccggcgccgggcucgcguucucucugaugaaguccuugggugggggccgccgggggacgggcgcacagggcgagacccuaggugagaaguggaagcgccagcucaaccagcuauccaagagcgaguucaauaccuauaagcgguccggcauuauggaaguagaucguuccgaggccaaggagggccucaagcguggugagaccaccaagcacgcgguaucucgcgggacggccaagcuacggugguucguggaacgcaaccuggugaagcccgagggcaaggucaucgaccugggcugcgggcggggcgggugguccuauuacugcgcugguuugaaaaaggugaccgaggugaagggguacaccaagggcggccccgggcacgaggagccgauucccauggccaccuacggcuggaaccuggugaagcugcacagcggcaaggacguguucuuuaugccgccagagaagugcgauacguuacugugcgacaucggagaguccucaccuaaucccacgaucgaggaggggcgcacccugcggguucucaagauggucgagcccuggcugcgaggcaaccaguucugcaucaagauacugaauccuuacaugccguccgugguggagacuuuagagcagaugcagcggaagcacggcgguaugcuggucagaaauccucugagccggaauucaacgcacgagauguacuggguaagcugcggcacagguaacaucguguccgcuguaaacaugaccagccgcauguugcugaaccgguucaccauggcucaccgcaagcccacguacgagcgcgacguggaccugggcgccggcacucggcacguggccgucgagcccgagguggccaaccuagauaucauaggucaacgcauugagaacaucaagaaugagcauaaauccaccuggcacuacgacgaggacaacccauacaagaccugggcguaucacggcuccuacgagguuaaacccuccggaagcgcuuccuccauggucaacggcguggugaggcugcuaacgaaaccaugggacgucauccccauggugacccagaucgccaugacggacaccacgccuuucgggcagcagcgcgucuuuaaggagaagguagacacccggaccccccgggccaagcggggcaccacgcagauaauggaggucaccgccaaauggcucuggggcuucuuaucgcgaaacaagaagccccgcaucugcacccgagaagaguucacccggaaaguacgcucuaacgcggccauaggggccguguucguggaugagaaccaguggaacagcgccaaggaggcggucgaagacgagcgguucugggaccuggugcaucgcgagcgggagcuucacaagcagggcaagugugccacgugcguguacaacaugauggggaagcgugagaagaagcugggcgaguuugggaaagccaagggcucccgggccaucugguacaugugguugggcgcuagauuccucgaauucgaggcgcugggguuuaugaacgaggaccacugguucagccgcgagaacucccuguccggcguagagggagagggacuccacaagcuggguuacauccugcgcgacauauccaagauaccgggcggcaacauguacgcagacgacaccgccgggugggacacucggaucacagaggacgaccugcagaacgaggcgaagaucacggagauaauggagccagagcaugcccugcuggcgaccagcaucuucaaguugaccuaccagaacaaaguugugcgcguccaaaggcccgccaagaacggaacugugauggacgugaucuccagacgcgaccagcgagggagcggccaggucggcacguacgggcugaacaccuucaccaacauggaggugcagcugauccgccagauggagucagagggcaucuuccuacccuccgagcuugagaccccgaaccuggccgagcggguguuggauuggcuggagaaacacggggccgagcgccuaaagcggauggccaucuccggcgacgauugcgucgugaagccgaucgacgaccgcuucgcgaccgcacuuacggcccugaacgacauggggaaggugcggaaggacauuccccagugggagcccagcaagggcuggaacgauuggcaacaggugccguucugcucccaccacuuccaccaguuaaucaugaaagacggccgcgagaucguaguacccugccgcaaccaggacgagcucgucgggcgcgcccgggugagccagggugcaggguggucccuucgcgagaccgccugucugggcaagagcuacgcccagauguggcagcuuauguacuuccaccggcgagaccuucggcuggcggcgaaugccaucugcucggccgugcccgucgacuggguccccaccagccguaccacuuggagcauccacgcccaccaccaguggaugaccaccgaggauaugcuguccgucuggaaccgggucuggaucgaggagaacccguggauggaggacaagacucacgugucuucuugggaagaggugccuuaccuggggaagcgcgaggaccaauggugcggcucgcugaucggucugacagcccgcgccaccugggcgaccaacauccaggucgccaucaaccaagugcggcgccugaucgguaacgagaacuaccuggacuacaugaccaguaugaagcgguucaagaacgagagcgacccugagggugcccucugguaa

SEQ ID NO: 23872 - RNA, 9879 nt, Artificial Sequence
  derived and/or modified CDS sequence (opt11) from DENV-1__GQ868503__SS-prME
agcguaaccaugcugcucaugcugcugccuaccgccuuggccuuccaccugaccacccggggcggggagccacauaugaucgugagcaagcaagagcggggcaagagccuccuguucaagaccuccgccggggugaacaugugcacgcugaucgccauggaccugggcgagcucugcgaggacaccaugaccuacaaguguccccagaucaccgaggcagagcccgacgacguggauugcuggugcaacgcaacagacacgugggucaccuacgggaccugcagccagaccggcgaacaccgacgggacaagcgcaguguggcccuggcgccccacgugggccuggggcucgaaacccggacagagaccuggaugucauccgagggcgccuggaagcagauccagcgcgucgagaccugggcccuacggcaccccggguucacggugaucgcccuguuccucgcgcaugcuauugggacuuccauuacccagaaggggaucaucuucauccugcuaaugcucgucaccccaucuauggccaugcgcugcgucggcaucggcaaccgggacuucguggagggacugagcggcgcuacguggguggacgucgugcuggaacacggguccugcgucacaacgauggcgaagaacaaacccacccucgacaucgagcugcugaagacggaggucaccaaccccgcgaucuugcgcaaguugugcauugaggccaaaaucucgaacaccaccacggacucccggugcccgacgcagggggaggccacucugguggaggagcaggaugccaacuucguuugcaggcggaccuucgucgaccgcggcugggguaaugguugcggccucuucggcaaggggagucugcugacgugcgccaaguuuaagugcguaaccaaguuggaaggcaagaucgugcaguaugagaaccugaaauacucggucaucgugaccgugcacaccggcgaccaacaccaggucggaaacgagacgaccgagcacggcaccauagcgaccaucacgccccaagcgccaacgagcgagauccagcugaccgacuacggugcacuuacgcuggacugcagcccacggacgggccuggacuucaacgagaugguucuccugacgaugaaggagaagaguuggcugguccauaagcagugguuuuuagacuuaccccugcccuggacuuccggggccagcaccucgcaggagaccuggaaccgccaggaucuccugguaacguucaagaccgcgcacgccaagaagcaggaggucgucgugcugggcucucaggagggcgccaugcacaccgcacucacaggggcgacggagauccaaacuagcggcaccaccaccaucuucgccgggcaccugaagugucggcugaagauggacaagcucacacugaagggaaccuccuacguuaugugcaccggaucuuucaaguuagagaaggaaguugccgagacccagcacggcacugugcuggugcaggucaaguacgagggcacagacgcccccugcaaaauccccuuuucuacccagaacgagaaaggggucacgcagaacggucgccucaucaccgccaaccccaucgugaccgacaaggagaagcccgucaacaucgaaaccgagccgccauucggggagagcuacaucguggugggcgccggcgagaaggcgcugaagcuguccugguucaaaaagggguccuccaucggcaagauguucgaggccacggccagaggggcccgccggauggcaauccucggcgacaccgcgugggacuucgggagcauuggcggcgucuucacuuccguggguaaguuagugcaccaagucuucggcaccgccuacggagugcuguucagcggcguguccuggacgaugaagaucgggaucggcauccuccugaccuggcugggccucaacagccgguccaccagccugucgaugaccuguaucgcagucgggauggugacgcuguaccucggcgugaugguccaggccgacagcgggugugugaucaacuggaagggccgcgaacugaaguguggauccggcaucuucgugaccaacgagguacacaccuggaccgaacaguacaaauuccaggccgacucgccgaagcggcugagcgcggcgaucggcaaggccugggaggagggggugugcggcauccguagcgcuacccggcucgagaauaucauguggaagcagaucagcaacgagcugaaccacauacugcucgagaacgacaugaaguucacggugguggugggggacgccaauggcauucuagcgcaggguaagaaaaugauuagaccccagcccauggagcauaaguacuccuggaagucgugggggaaggcaaagaucaucggcgcagacauccagaacaccacguucaucaucgauggccccgacacuccggaaugccccgacaaccagcgggccuggaacauuugggagguggaggacuauggcuucggcaucuucacgaccaauaucuggcucaagcuccgcgacuccuauacacagaugugcgaccaccggcugaugucugcggccaucaaggacuccaaggccgugcacgccgacaugggcuacuggaucgagagugaaaagaacgagaccuggaagcuggagcgggccuccuucaucgaggugaagacgugcaccuggcccaagagccacacccucugguccaacggcguucuugaaucugaaaugaucauacccaaaaucuacgggggcccgaucucacagcacaacuaccggcccggauacuucacccagacggcagggccguggcaccugggaaagcucgaacuggauuucgaucugugcgagggcaccaccguagugguggacgagcacugcggcaaccgcgggcccagcuuacggacuacgaccgucaccggcaagaucauccacgaguggugcugccgcuccugcacacugccgccccucagauuccguggggaagacgguugcugguaugggauggagauccgucccguuaaggaaaaggaggagaaccucgugcgcaguauggucucagccggaagcggggaaguggauagcuucucccugggcauucugugcgcaagcaucaugaucgaggaagugaugcggucccgcuggucacggaagaugcucaugacgggaacucuggcggucuuccugcuucugaucauggggcagcugacauggaacgaccucauccgccuuugcaucaugguaggcgcuaacgcguccgaccgcaugggaauggguacaacguaccuggcccucauggccacguuuaagaugcggccgauguucgcgguggggcugcuguuucgccggcucaccagccgcgagguccuccugcucaccaucggguuaucccugguggccagcguagagcucccgaauagucuggaggagcugggcgacggucuugcgaugggcaucaugaugcugaagcugcucacggaguuucagccccaccagcuguggaccacccugcucagccugaccuucauuaagacgacccugucccuagacuacgccuggaagacaaccgcaauggcccugagcaucgucucccuguuccccuugugccugucgacgaccucccagaagaccaccuggcugccgguguuacuggggagcuucgggugcaagccgcugaccauguucuugaucacggaaaacaaaaucuggggucguaaguccuggccccuuaacgaggggaucauggcgaucggcaucgucucaauauuacucuccagccugcucaagaacgacgugccccuagccgggccguuaaucgccggcggcaugcugaucgcaugcuaugugaucagcgggagcagcgccgacuugucccuggaaaaggccgccgagguaagcugggagcaggaggccgagcacuccggcaccucccacaacauccuugucgaggugcaggacgacgguacuaugaaaaucaaggacgaggaacgcgacgacacgcucacgauucugcugaaggccaccuuacuugccgucuccggcguguacccuaugagcaucccagccacccuguucgugugguacuucuggcagaagcggaagcagcgcagugggguccucugggacaccccuaguccgcccgagguggagcgggccguucuggacgacgguaucuaccgcauccuucagcggggccuacucgggcgcucccaggucggcguggggguguuccaggauggcgucuuccauacgauguggcacgugacccgcggggcagugcugauguaccagggcaagcggcuggagcccagcugggccuccgugaagaaggaccucauaagcuacggcggcggcuggcgguuccagggguccuggaacaccggcgaggagguacaggugauagccgucgagcccggcaagaacccgaagaacgugcaaacgacgccaggcaucuuuaagacccccgagggcgaggugggugcgaucgcacucgacuucaagccgggcaccagcgggaguccgaucgucaaucgcgaggggaaaaucguuggccuauacgggaacggcguggucacaacgagcgggaccuacguguccgccaucgcccaggcgaaggcgagccaggaaggcccccuccccgagaucgaggacgaaguguucaagaaacggaaucuuaccaucauggacuugcacccgggcagcggcaagacccgccgauaccuccccgcuaucguccgcgaggccaucaagcggaaacugcgcacgcugauucucgccccaacgcgggugguggcgagcgagauggccgaggcccugaagggcaugcccauccgguaccagaccaccgccgucaaaagcgagcacacggggcgcgagaucguggaccugaugugccacgccaccuucacuaugcggcuccugucaccugucagaguccccaacuacaacaugaucaucauggaugaggcgcacuucaccgaccccgccagcaucgccgcccggggcuacaucagcacgcgcguggggaugggcgaggccgcugccaucuucaugacggcaacuccgccugggagcgucgaggccuuuccccaguccaaugccguaauccaggacgaggagcgggacauucccgagcgcagcuggaacuccggcuaugacuggaucaccgacuuccccggcaagacgguaugguucgugccgagcaucaaguccgggaacgacaucgcgaacugccuccggaagaacgguaaacgcgucauccaguuaucucggaagaccuucgacaccgaguaccagaagaccaagaacaacgacugggacuauguggucacgaccgacaucuccgagaugggggccaacuuccgcgcggaccgggucaucgacccucgccggugccugaagccggugauccugaaggauggcccagagcgggugauccucgccgggccgaugccggucacggucgcgucggcagcccagcgacgcgggaggaucggccgcaaccaaaacaaggagggggaccaguacguguacaugggccagccccucaauaacgacgaggaccacgcccacuggaccgaggccaagauguuacucgacaacaucaacacgcccgagggcaucauuccggcucuguucgagcccgagcgcgagaagucggccgccaucgacggugaguaccggcugcgcggggaggcccggaagacauucgucgaacucaugcgcaggggcgaccugcccguguggcugagcuauaaggucgccuccgaaggauuccaguacucggaccgcagauggugcuucgauggggagcgcaauaaucaggugcucgaggaaaacauggacguggagaucuggaccaaggagggagaacggaagaagcugaggccccgguggcuggacgcgcgcaccuacuccgacccgcucgcucugcgugaguucaaggaguucgccgccgggcgucguagcgucaguggcgaccugauauuagagaucggcaagcuaccgcaacaccugacccugcgcgcccagaacgcgcuggauaaucuggugaugcuccacaacuccgagcagggcgggaaggccuaccggcacgcaauggaggaacugcccgacacgaucgagacgcugaugcuccuggcccugaucgcgguccucaccggaggggucacccuauucuuccuguccgggaaaggccuuggcaagacguccaucgggcuguugugcguuaccgccagcuccgcccuccuguggauggcuagcguggagccccacuggaucgccgccucgaucauccucgaguucuuccuaaugguccugcugaucccugagcccgacagacagcggacgccucaggacaaccagcucgccuacguggugaucggcuuauuguucaugauccucaccgucgccgccaacgagaugggguugcuugagacgaccaagaaagaccucggcaucgggcacguggccgcggagaaccaucagcacgcaaccaugcuggacguggaccugcgcccggccuccgccuggaccuuauacgcaguagcuacgaccgugaucacccccaugaugcgccacaccauagagaacacgaccgccaacauaucccugaccgccaucgccaaccaagccgcgauccuaaugggccucgacaagggcuggcccaucuccaagauggacaucggggugccccugcuggcacucggcugcuacucccaggucaacccgcugaccuugacggccgccgugcucaugcugguggcgcacuaugccaucaucggucccggccuacaggccaaggcgacccgugaggcccagaagcgcacggcggcggggaucaugaagaaccccacaguugacggcaucguggccauagacuuggaucccguggucuacgacgccaaguucgagaagcagcugggccagaucaugcugcucaucuugugcaccucacaaauccugcucaugcggaccaccugggcccugugcgaguccaucacccuugcgacugguccacucacaacccugugggaggguagccccgggaaguucuggaacaccacgaucgccguguccauggcgaacaucuuucgcggaucauacuuggccggagccggacucgcauucucacugaugaagucuuugggcggaggucggagagggaccggugcgcagggcgagacccuaggggaaaaguggaagcggcaauugaaccagcuguccaagagcgaguucaacaccuacaaacgcagcggcaucauggagguggacagaagugaggccaaggaaggccucaagcgcggcgagaccaccaagcacgccgugagcagggggaccgcgaagcugcgcugguuuguggagcggaaucuggugaagccugagggcaaggucaucgaucugggcugcgggcggggcggguggucauauuacugcgccggccugaagaaggugaccgaagugaagggguacaccaaagggggccccgggcacgaggagccgauccccauggccacuuacggcuggaaccuggucaaacugcacagugggaaagacguguucuucaugccucccgagaagugcgacacccuccugugcgacaucggcgaguccaguccaaaucccaccaucgaggaggggcguacccugcgugugcucaagauggucgaacccugguugcggggcaaucaauucugcaucaagauccugaaccccuacaugccgagcgugguggaaacgcuagagcagaugcagcgcaaacauggagggaugcugguccggaacccccugucgcgcaacuccacccaugaaauguacugggugaguugcggcacggggaacaucgucuccgccgucaacaugaccagccggaugcuccugaaccgguucacgauggcgcaccgcaagcccaccuucgagcgggaugucgaccugggcgccggcacccgacacguggccguagaaccagaagucgcuaaccucgacaucaucggccagcguaucgagaacaucaagaacgagcacaaguccaccuggcacuacgacgaggacaacccuuacaagacgugggccuaccacggcagcuacgaggugaagccuucggggucggccuccagcauggucaacggcguggugcgcuuacugaccaagcccugggacgucauccccauggugacgcaaaucgcgaugaccgacacgacgccguucggucagcaacgggucuucaaggagaagguagacacgcgcacgccccgggccaagcgagggacuacccaaauaauggaaguaacagccaagugguuauggggauuccugucccggaacaagaagccgcgcaucugcacucgagaggaguucacucgcaagguccggagcaacgcggcuauaggcgcgguuuucguggaugagaaccaguggaauagcgcaaaggaggcagucgaggacgagcguuuuugggaccuagugcacagagagcgcgagcuccacaagcagggcaaaugcgcuacgugcguguauaacaugauggggaaacgggagaagaagcugggcgaguucgggaaggcgaagggcuccagagccaucugguauauguggcugggcgcacgguuccucgaguucgaggcucugggguuuaugaacgaggaucacugguucagccgugaaaauucccugagcggcgucgagggcgagggccuacauaaacuuggcuacauccugagggacauauccaagaucccgggcggcaauauguacgccgacgacaccgcgggaugggacacccgcaucacugaggacgaccuccagaacgaagcgaagauaaccgacaucauggagcccgagcacgcccuguuagccaccagcaucuucaagcugaccuaccagaacaagguggugagaguacaacggccggccaagaacggcacggugauggacgucaucucacgccgggaccagcgggggagcgggcaggucggcaccuacgggcugaacaccuucacuaacauggagguacagcugauacggcagauggaguccgaggggaucuuccuccccagcgaacuggagacgccgaaucuggcggagcgcguucucgacuggcuugagaagcauggggccgagcggcugaagcgcauggccaucuccggcgacgacugcgucgucaagcccaucgacgaccgguucgccaccgcacucacagcgcugaacgacauggggaaggugcgcaaggacaucccccagugggagcccagcaagggcuggaaugauuggcaacaggucccguucugcucacaccacuuccaccaauuaauuaugaaggacggccgggagaucguggugccaugccgcaaccaggacgaguuggucgggcgggcgcgagugagccagggcgcgggguggagccugcgggaaacagccugucugggcaagagcuaugcccaaauguggcagcugauguacuuccaccgccgggaccugcgccuagcggccaacgcgaucugcuccgccgugcccgucgacugggugcccaccagccggacgaccuggucaauccacgcgcaccaccaguggaugaccaccgaggacaugcucucaguguggaaccggguuuggauugaggagaacccuuggauggaggacaagacgcacgugagcucaugggaggaggugcccuaucuggggaagcgcgaggaccaguggugcggcagccuaaucggccucaccgcccgggccaccugggccaccaacauccaggucgcgauuaaccaggugagacggcuuauagggaacgagaacuaccuggacuacaugacgagcaugaagcgcuucaagaacgagagcgaucccgagggcgcccucugguga

SEQ ID NO: 23873 - RNA, 9879 nt, Artificial Sequence
  derived and/or modified CDS sequence (opt11) from DENV-1__GQ868504__SS-prME
agugugacaaugcugcucaugcugcugccgaccgcucucgccuuccaucucacgacucggggcggggaaccgcacaugaucgugaguaagcaggagaggggaaaguccuugcuguucaagaccagcgccggugugaacauguguacacugaucgccauggaucugggugagcucugcgaggacacgaugaccuacaaguguccccagauuaccgaggccgagcccgacgauguagacugcuggugcaacgccaccgacacuuggguaacauacgggaccuguagccaaacgggcgagcacagacgcgacaagcgguccguggcccuggcgccccacgugggccuggggcucgagacucggaccgagaccuggaugucuucggagggcgcuuggaagcaaauccagcgggucgaaaccugggcuuuaaggcaccccggguucacggucaucgcccuauuucucgcucacgcgauagggacaagcaucacccagaagggaaucaucuuuauccuucugaugcucgugacccccucuauggcaaugcgcugcgucggcaucgguaaucgggacuucguggaaggguugagcggcgccacgugggucgaugucgugcuggagcauggauccugcgugaccaccauggccaagaauaagcccacccuugauauagaacugcuaaagacggaggucaccaacccggcaauccugcgcaaacugugcaucgaggccaagaucuccaauacgaccacggacucgcguugcccgacccagggugaagccacccugguggaggagcaggacgcaaauuucgugugccgccgcaccuucguagaccgcgguuggggaaacggauguggccuguuuggcaaggggucacuguuaaccugcgccaaguucaagugcguuaccaagcucgagggaaagaucgugcaauacgagaaucugaaguacuccgucaucgucaccgugcacaccggcgaccagcaccaggucgggaacgagacgaccgagcauggcaccauagcgaccaucacuccucaagcccccacuagcgagauucagcugaccgacuauggugcacuuacccuagacugcagcccacggaccggccucgauuucaacgagauggugcuguugacgaugaaggagaagucauggcugguccacaagcagugguuccucgaccugccgcuucccuggacguccggugcaagcaccagccaggaaacauggaaccggcaggaucuucuggucacguucaagaccgcccacgcgaagaagcaagagguggucguucugggcucccaggagggggccaugcacaccgcacucaccggggccacugaaauacagaccagcgggaccaccacgauauucgccggucauuuaaagugccggcugaagauggacaagcucacccugaaagguaccuccuacguaaugugcaccggcucguucaaacuggagaaggaagucgcagagacgcagcacggcaccguacucgugcagguuaaauacgagggcaccgacgcccccugcaagauccccuucuccacccaggacgagaaggggguuacgcaaaacggcaggcucauuaccgccaacccgaucgugaccgauaaggagaaacccguaaauauugagacugagccgcccuucggugagucuuacaucguggugggugccggcgagaaggcgcugaagcuguccugguucaagaaggguagcuccaucggcaaaauguuugaggccacggcccggggggcccgccgaauggcaauccucggggacacagcgugggacuucgggagcaucggcggcgucuucaccucuguagggaagcugguacaccagguguucggcaccgccuauggggugcucuucagcggcgucaguuggaccaugaagauugggaucggcauauugcugaccuggcugggccuaaacagccgcagcacuucgcuguccaugaccugcaucgccgucgggauggugacgcuguaccucggggucaugguccaagccgacagcggguguguuaucaacuggaagggccgcgagcugaagugcgguuccggaaucuucguuaccaaugagguccauacguggaccgagcaguacaaguuucaggcggacucaccgaagcggcugucggcugcuaucggcaaagccugggaggaagggguguguggcauucgaagcgcuaccagacuggagaacaucauguggaagcagauuaguaacgaacugaaccacauccuucucgagaaugacaugaaguucacugucguugucggggacgcuaacggcauccucgcgcaggggaagaaaaugauucgcccccagccgauggagcauaaauacagcuggaagagcugggggaaagcaaagaucaucggugccgacauccagaacaccaccuucaucaucgacgggcccgauacuccggagugccccgacaaccagcgcgccuggaauauaugggagguugaggacuacggcuucgggaucuucacgaccaacaucuggcugaagcuccgcgauagcuacacccaaaugugcgaccaccgacugaugucggcugccaucaaggauuccaaggccguucacgccgacaugggcuauuggauugagucugagaagaacgagacauggaagcuggcucgcgcgagcuucaucgaagucaagacgugcaccuggcccaagagccacacgcucuggucuaacggcgugcuggagagcgagaugauaauccccaaaaucuacggaggcccgaucucgcagcacaacuaccgcccgggguacuucacccagacggcaggaccauggcaccuggguaagcucgagcuugauuucgaccugugcgagggcaccacggucgugguggacgagcacugcgggaaccgcgggccgucccugcggaccacgaccgucacaggcaagaucauucacgaauggugcugccgauccugcacuuugccgccacuaagguuccgcggagaagacgguuguugguacgggauggagauccggccggugaaggagaaggaagaaaacuuggugcgcagcauggugucugcaggcagcggcgaaguggacucuuucucccuggggauccugugcgucucaauaaugaucgaggaggucaugcggucccgcuggagcaggaagaugcucaugacgggcaccuuagcuguguuccuacuacuggugaugggacagcugacguggaacgaccucauccgccugugcaucaugguuggugccaaugcguccgacagaauggggaugggcaccacguacuuagcccucauggccaccuucaagaugcgccccauguucgccgugggccugcuguuccgccggcucaccagccgugagguucugcugcucacaaucggguuaucccugguugccagcguggaacugcccaacucccuggaggaacuaggcgacgggcuagcgauggguauaaugaugcugaaacugcucacggaguuucagccccaccaguuguggaccacccugcucucguugaccuucaucaagacuacccugucuuuggacuacgcguggaagaccaccgccauggcccugagcaucguaucccuguuuccguugugccugagcacgaccucccagaaaaccacuugguuaccggugcuccuggggagcuucgggugcaagccuuugacuauguuccucaucacggagaacaagauuuggggccggaaguccuggccccuaaacgaggggaucauggcgaucgggauugucagcauacuucucuccagccugcuuaaaaacgacgucccguuagcugggccucugaucgccggcggcaugcugaucgcgugcuaugugaucucggggucaagugccgaccuuucccuggaaaaggcggccgagguuagcugggagcaggaggcggagcacuccggcacuucacacaacaucuuagucgaggugcaggaugacggaaccaugaagaucaaggacgaggagcgcgacgacacccucacgauccugcucaaggccacguuacuggccguguccggcgucuaucccaugagcaucccggcuacacuguucgucugguauuuuuggcagaagaagaaacagcgguccggugugcucugggacacucccucaccaccggaggucgagcgcgccguacuggacgacggcaucuaccgcauucugcaaagggguuuacucggucguucccaagugggcguagggguuuuccaagacggcguauuccacacgauguggcacgugacccgcggcgccgugcuaauguaccaaggcaagaggcuggaacccagcugggccagugugaagaaggaccucaucagcuacggcgggggauggcgguuccagggcuccuggaacaccggcgaggagguccaggugauagcaguugaaccugggaagaauccuaagaacguccagaccacgcccggcaccuucaagacgccagaaggcgaggugggggcgauugcccuggauuuuaagccgggcaccagcggguccccgauaguuaauagagaggggaagaucgugggccucuacgguaacggcguugugacgaccagcgggaccuacguguccgccaucgcacaggccaaagccucgcaagaaggcccguugccagaaauugaggacgaaguguuuaagaagaggaaccucaccauuauggaccuucacccgggaagcggcaagacgcggcgcuaccuccccgccaucgugcgagaggcaaucaagcgcaagcugcggacacugauccucgccccgacccgcgucguugcguccgaaauggcggaagcccugaagggcaugcccauccgcuaucagaccacggcagucaaaggcgagcacacagguagggagaucgucgacuuaaugugccacgccacuuuuacgaugcgccuccugagcccaguccgggugcccaauuacaacaugaucaucauggacgaggcgcacuuuacggauccagccuccaucgccgcccgcggguacauuucgacucgcgucggcaugggggaagcugcggccaucuucaugaccgccacgccgccggguucuguggaggccuucccccaaagcaacgcugucauucaggaugaggagcgcgacaucccggagcgaucuuggaauagcgguuacgauuggaucacggauuucccaggaaagaccgucugguuuguccccagcaucaagagcggcaacgacauugcuaacugccugcgcaagaacgggaagcgggugauccaacucagucgaaagaccuucgauaccgaguaccagaagacgaagaacaacgacugggacuacgucguaacgaccgacauaagcgagaugggggccaacuucagggcagauagggugaucgacccccggcgcugccugaagccagucauacugaaggacgggccagagcggguaauccucgccggcccgaugcccgugacggucgcguccgccgcccaacgccggggcagaaucgggagaaaccagaacaaagagggcgaccaauacguguacauggggcagccucugaauaacgacgaggaccacgcccacuggacggaagccaagauguuacucgacaauaucaacacgcccgagggcaucauaccggcacuuuucgagcccgaacgcgagaaguccgcugccaucgacggggaguaccgccugaggggcgaggcccgcaagaccuucguagaacuuaugcggcgcggagaucugcccguguggcucuccuacaagguggcaagcgaggguuuccaauacccugaccggagguggugcuuugacggcgagcggaacaaccaagugcucgaggagaauauggacguggagauauggacaaaggagggggagcgcaagaagcugcguccgcgcuggcuggacgcccgcaccuacucugacccccucgcccugcgcgaauucaaagaguucgcagcuggccggcgcagcguguccggcgaccucauucucgagaucggcaagcugccccagcaucugacccuccgggcccaaaacgcguuagacaacuuagucaugcuccacaacagcgagcagggcgggaaagccuauaggcacgccauggaagaacuaccggacaccaucgaaacgcugaugcuccuggccuuaaucgcggugcucaccggugggguuacgcuguucuuucugagcggaaagggccuugggaagaccagcaucggccugcugugcguaacggcaagcuccgcacucuuauggauggccagcguagagccgcacuggaucgccgcguccaucauccuggaguuuuuccucauggugcuccugauccccgagcccgaccggcagcgcaccccccaggacaaccagcucgccuaugucgugaucgggcugcuguucaugauccucacaguugccgccaacgagaugggccucuuagagaccaccaagaaggaccucgggaucggccaugucgcggcggagaaccaucagcaugcaaccaugcuagauguggaccuaagaccggccagcgccuggacucuuuacgccgucgcgaccaccgucauaacccccaugaugcgccacacgaucgagaauaccaccgcuaacauaucccucaccgccaucgccaaccaggccgcgaucuugaugggauuagacaaaggguggcccauaagcaaaauggacaucggcgucccgcuacuggccuugggcugcuacucccaaguuaacccgcugacgcuaaccgcagcaguccucaugcuaguggcacauuacgccaucaucggccccggguugcaagccaaagcuacccgggaggcccagaaacgaaccgcggcaggcaucaugaagaauccaacaguagacggcauagucgccauagaccuagacccagugguuuacgacgccaaguucgagaagcagcugggucagauaaugcugcucauccugugcacgucgcaaauccugcugaugcggacuaccugggcccucugcgaguccaucacacuggcgaccggcccccucacaacacugugggaggggucgccaggcaaguucuggaacacgacaaucgccguuuccauggcgaacaucuucaggggauccuaccuagccggggccggacucgcguucucccugaugaagagccucgggggcggacgccgggggaccggcgcccagggugaaacccucggggaaaaguggaagcgucagcugaaccagcucuccaagagcgaguucaacacguauaagagguccgguaucauggagguggaccgcagcgaggcaaaggaaggccucaagcguggugaaaccacgaaacacgccgugagccgcggcaccgcgaagcugcggugguucgucgagcgcaaccugguaaagccggagggcaaaguuaucgaccuggggugcggccgcggcggaugguccuauuacugcgccggccugaagaaggugacugaagugaaaggcuauacgaaggggggcccgggccaugaagagccgauccccauggccaccuacggguggaaccugguaaagcuccacagcgguaaggacgucuuuuucaugcccccggaaaagugcgacacccuccugugcgacaucggggaauccagccccaaucccacaaucgaagaggguaggacgcugaggguucucaagaugguggagcccuggcugcgcggcaaccaguuuugcauaaagauccugaacccguacaugcccagugucguggaggcccuagaacagaugcagcggaagcacggggguaugcuagugcgcaacccccugagucggaacuccacccacgagauguacugggucucaugcgggaccggcaacaucguauccgccgugaacaugaccucccgcaugcuccucaaccgguucacgauggcgcaccggaaaccgacauacgagcgggacgucgaccugggcgccggcaccagacauguggccguagagccggaggucgccaacuuagacauaaucggccaaagaaucgaaaauaucaaaaacgagcacaaguccacauggcacuacgacgaggacaaccccuacaagacaugggcauaccacgggagcuacgagguaaagcccuccgggucagcguccagcauggugaacggggucgugcggcuucugaccaaacccugggaugugaucccgauggugacccagaucgccaugaccgacacgacccccuucgggcagcagcgaguguuuaaggaaaaggucgacaccaggacgccacgugccaagagaggcacgacccagaucauggagguuacggccaaguggcucuggggauuucugagccgcaacaagaagccaagaaucugcacgcgggaggaauucacccggaaagugcgcagcaacgccgcgaucggugccgucuuuguggacgagaaccaguggaauucugccaaggaggccgucgaggaugaacgguuuugggaucuggugcaccgugagcgugagcuucauaagcagggaaagugugcgaccugcguguacaacaugaugggcaagagggaaaagaaguuaggggaauucggaaaggcuaagggcagccgugccaucugguacaugugguugggggcccgcuuccucgaauuugaagcccugggcuucaugaacgaggaccauugguucucaagagagaacucccugagcggcguggagggugaggggcugcauaaacugggguacauccuccgcgacauuagcaagaucccgggggggaacauguaugcggacgacaccgccggaugggacacucggaucacagaggacgaccuccagaaugaggccaaaauaaccgaaauaauggagccggagcaugcccugcuugccacgagcaucuucaagcucacuuaccagaacaaggucgugcgcgugcagcgccccgcgaagaacgggaccgucauggacgugaucucacggcgcgaucagcgggguagcggccaaguggggacguacggccugaacacuuucaccaacauggagguccagcugauccggcagauggagucggagggcaucuucuugccgagcgaguuggagacgcccaaccuggccgagcgaguucucgacuggcuggagaaacacggggcggagcgcuuaaaacggauggccaucuccggggacgacugcguggucaaacccaucgacgaucgcuucgccaccgcguuaacagcacugaaugauaugggcaaggugcgaaaggacaucccccagugggagccgagcaagggcuggaacgacuggcagcaagucccauucugcagucaccacuuucaccagcugaucaugaaggacgggcgcgagaucgucgugcccuguagaaaccaggacgagcucgugggccgcgcccgggucagccaaggugccggauggucccuccgcgaaaccgccugcuuaggcaaaagcuacgcgcagauguggcagcucauguacuuccaccguagggaucugagguuagccgcuaacgcuaucuguuccgcugugcccguggauuggguuccgaccucccgcacgaccuggucaauccacgcccaccaccaguggaugaccaccgaggacaugcuaagcguguggaaccgagucuggaucgaggagaaucccuggauggaggacaagacgcaugucaguuccugggaagaggugcccuaccugggcaagagggaggaucaguggugcggcagccugaucggacucaccgcccgggccaccugggccaccaacauacagguggcgauuaaccagguccggcgucugauaggcaaugaaaacuaccuggacuacaugacaagcaugaaacguuucaagaaugagagcgaccccgagggggcgcucugguga

SEQ ID NO: 23874 - RNA, 9879 nt, Artificial Sequence
  derived and/or modified CDS sequence (opt11) from DENV-1__GU131967__SS-prME
agcgugaccauguuacucaugcuguuacccaccgcucucgccuuucaucucacgacccggggcggcgagccccacaugauaguuaguaagcaggagaggggaaagagccuccuguucaagacuagcgcaggggugaacaugugcacccugaucgccauggaccucggugaguugugcgaggacacgaugacauacaaaugcccucagaucaccgaggccgagcccgaugauguagauugcugguguaacgccacggacacgugggugaccuacggcaccugcagccagaccggagagcaccgccgggacaagcgcuccguggcccuugcgccacacgugggccuggggcucgagacgcguaccgagacuuggaugagcagcgagggcgcauggaagcagauccaacgcgucgagaccugggcgcugagacaccccggguucacggucaucgcccuguuccucgcccacgcgaucggcaccagcaucacccagaaggggaucaucuucauccugcuaaugcucguuacccccucuauggccaugaggugcgucggcauaggcaaucgggacuucguagaggggcuguccggcgccacguggguggacgucgugcuggagcacggauccugcgugacuaccauggccaagaacaagcccacacucgauaucgagcucuuaaaaacggagguuaccaaucccgcgauccuccgcaagcugugcauugaggccaaaaucucuaacaccaccacggacucccgauguccgacccagggcgaggccacccuggucgaggagcaggaugcuaacuucgucugcagacgaacauuugucgaucggggcugggggaaugggugcggccuuuucggcaaggggagccuguugacgugcgcaaaauucaaaugcguaacuaagcucgagggcaagauugugcaauacgagaaccugaaauacuccgucauagugaccguacauaccggcgaccagcaccaggucggcaacgagacgaccgagcacggcaccauugcaacaaucacgccccaggccccgacauccgaaauccaacugaccgacuauggcgcguuaacccuggacuguagcccgcggacuggacuggacuucaacgaaauggugcuccugacgaugaaggagaaguccuggcucguccacaagcagugguucuuggaccugccgcugcccuggacguccggagccagcaccucucaagagaccuggaaccgccaggaccuccuaguuacguucaaaaccgcucacgcgaagaaacaggagguggucgugcuaggcucgcaagaaggcgccaugcauacggcccucaccggggccacggaaauccagaccagcggcaccacuacuaucuucgccggacaccugaaaugccgguuaaagauggauaagcucaccuugaagggaaccuccuacgugaugugcaccggaagcuucaagcucgagaaggaggucgcggagacccagcacggcaccgugcugguccaggucaaguacgaggggaccgacgcccccugcaagauccccuuuuccacccaagacgagaaaggggugacgcagaacggcagguuaaucacugccaacccgaucgugaccgauaaggaaaagcccgucaacaucgaaaccgagccgcccuucggggagagcuacaucguggugggagcuggcgagaaggcacugaaacuguccugguucaagaaggguagcucaauaggcaagauguuugaagcuacagcucgcggcgcucgucggauggccauccugggggacacggcgugggacuuugggagcaucgguggcgucuucaccagugugggcaagcuggugcaccagguguucggcaccgcauacggggugcuguucagcggcguguccuggacgaugaagauuggcauaggaauccucuuaaccuggcuaggccucaacucacgcucuaccagccuguccaugaccugcaucgccgucgggauggugacgcuguaucucggcguuaugguccaggccgacagcgggugugugauuaacuggaagggucgcgaacugaagugcggcuccggcaucuucgugaccaacgagguccacaccuggacggagcaguauaaguuccaggccgacagcccgaagcggcucagcgcggccaucggaaaggccugggaagagggagugugcgguauacgaucugccacccgucucgagaacaucauguggaagcagaucagcaaugagcuuaaccacauccugcucgagaacgacaugaaguucacggucguugugggggaugccaauggcauccucgcacaggguaagaagaugauccgaccccagccaauggaacauaaguacuccuggaagagcuggggcaaggccaagauaaucggcgccgauauccaaaauacuaccuucauaaucgauggacccgacaccccugaaugcccagacaaccagcgggcguggaacaucugggagguggaggacuacggauuuggcaucuuuacgaccaauaucuggcuaaagcugagagacucauacacacaaaccugcgaccaccggcugaugagcgcagcuauaaaggauuccaaggcuguccaugccgauaugggcuacuggauugagagcgagaagaacgagacguggaagcuggccagggcguccuucaucgagguaaagaccugcaccuggcccaaaagccacacccucugguccaacggugugcuugaaagugagaugaucauccccaagaucuacgggggcccgaucucgcagcacaacuaccggccgggguacuucacacagaccgcgggcccauggcaccuggggaagcucgagcuggacuucgaccugugcgaaggcaccaccgucgugguagacgaacacugcggcaaccgcgggccgagucuccggaccacgaccguuaccgggaagaucauccacgaaugguguugccgcuccugcacgcugccaccacuucgauuucgcggggaggacggcugcugguacgggauggagauccgacccgugaaggagaaggaggagaaccucguccgcagcauggucuccgccgguagcggcgagguggacagcuucucccugggaauuuuguguguaagcaucaugaucgaggaagugaugagaagccgcuggagccggaagaugcucaugaccggcacccuggcaguguucuugcuccuggugauggggcaacugaccuggaacgaccugauccgccugugcaucauggugggggccaacgcguccgacagaauggggaugggaacgacuuaucuugcgcucauggcaacuuucaagaugcggccgauguucgccgugggguugcuguuucgccggcucaccagccgggaagugcugcugcucacgaucggucugucccuggucgccagcguggaguugcccaacucccuggaggaacugggcgacgggcucgcgauggggauaaugaugcucaaacugcucaccgaauuccagccgcaccagcuguggaccacccuguuaagccugacuuucaucaagacaacccugucucucgacuacgccuggaagacaaccgcaauggcacugagcauagucucccuguucccccucugccugagcaccaccucccagaagaccaccuggcugccggugcuccuggguuccuuuggguguaagccccugaccauguuuuugaucaccgagaacaagaucuggggcagaaaguccuggccccugaacgaggggaucauggcgaucggcauagugucaauucugcucuccagccuacugaagaaugacgucccccucgccgggccgcugaucgccggcggcaugcugauagcuugcuacguuauaagcggauccagcgccgaccuaagccuggagaaggcggccgagguguccugggagcaagaggccgaacacuccggcaccagccacaacauucuggucgaggugcaagacgaugguaccaugaagaucaaggaugaagaacgcgacgacacguuaaccauccugcugaaggcaacccuccuagccguguccggcguauaccccaugaguauucccgcgacacuguuugugugguacuucuggcagaaaaaaaagcagcgguccgggguguuaugggacacgcccaguccucccgaggucgagcgcgccgugcuugacgauggcauauaccggauacuccaacgcggccugcucgggcggagucaggugggcgucgggguguuccaggauggaguauuccacacuauguggcacgugacacgaggggcaguacugauguaccagggcaagcggcuggaaccaagcugggcauccgugaagaaagaucugaucucauacggagggggauggcgcuuccagggguccuggaacacgggugaagagguccaagugauugccgucgagcccgggaagaacccgaagaauguccagacaacaccgggcacuuucaagacccccgagggcgaagugggcgcgauagcccuggauuucaagcccgggacgagcgggucaccgauaguaaaccgggagggcaagaucgucggcuuauacgguaacggcguggugaccacuuccgggacauacgucagugcgaucgcacaggccaaggcgagccaagagggcccccuccccgagaucgaggacgagguguucaaaaagcguaaccugacgauuauggaccugcacccgggcucuggcaagacccggcgcuaucugcccgcaaucguucgagaggcuauuaagcgcaagcuccggacccugauccucgccccaacccgagucguggcgucugagauggccgaggccuugaaggggaugcccauacgcuaccagacgaccgccgucaagagcgagcacaccggacgggagauagucgacuugaugugccacgccacuuucacgaugcgccuccugaguccagugcggguacccaauuacaacaugauaaucauggacgaggcgcauuuuaccgaccccgccucaaucgccgcacgcggcuauaucagcacccgugucgggaugggagaggccgcggccaucuuuaugaccgcgacgcccccggggagcguugaggccuuuccccagagcaacgcgguuauccaagaugaggagcgcgacauccccgagcgguccuggaacuccggcuacgacuggaucaccgacuuccccgggaagaccguuugguucgucccgucgaucaaguccggcaacgacaucgcgaacugccugcgcaagaacggcaagcgggucauucaacucagccguaagaccuucgacacggaguaccagaagaccaagaacaacgauugggacuauguagugaccaccgacaucuccgaaaugggcgcuaacuucagggcagaccgcgugaucgauccccggcgcugucugaagcccguaauacugaaggacggucccgaacgggugauucucgcaggcccaaugccagugacgguagcuagcgccgcccaacgccgcggccgcaucggucggaaccagaacaaggagggggaccaguacguguacaugggccagccccugaacaacgaugaggaccacgcccauuggacagaggcaaagaugcugcucgauaauaucaacaccccugaggggaucaucccggcccuauucgaacccgagcgcgagaaguccgccgcgauagauggcgaguaccgccugcgcggggaagccaggaagacguucguagagcucaugcggaggggcgaccugcccguuuggcuguccuacaaggucgcauccgagggcuuccaguacagcgaccggcgauggugcuucgacggggaacguaauaaccagguccucgaggagaacauggacguggagaucuggacgaaggagggcgagcgaaagaaacuacggcccagguggcuggacgcgcggacauacagcgacccgcucgcucugcgggaauucaaggaauucgcugccgggcggcgcucagucagcggcgacuugauccuugagaucggaaagcugccccaacaccugacccuccgggcgcagaacgcgcuagacaaucugguuauguuacacaacucggagcaaggggggaaggccuaccgccacgccauggaggagcugcccgacacuauagaaacucuuaugcuccuagcccugaucgcagugcucaccggcgggguaacccuguuuuucuuaagcgggaagggucucggcaagacuuccaucggucuacuaugcguaacggccagcucugcccuccuuuggauggccagcguggagccccauuggaucgccgcuagcaucauacuggaguucuuccuaaugguccucuugaucccggagcccgaccgacagcgcacgccccaggacaaccagcuggcauaugucgugaucggccugcuguucaugauucucacaguggccgccaaugagauggggcugcuggagacuaccaagaaggaccucgggaucgggcacgucgcggccgaaaaccaccaacacgcaacgaugcuggacguggaccugcggccggcgagcgcguggacccucuacgccguggcgaccacaguuaucacgcccaugaugcgccacaccauugagaacacaaccgcaaauauuagccugacggccaucgcgaaccaggccgcgauccugaugggucucgacaaggguuggcccauuagcaagauggacaucggggucccgcugcuggcgcucggcugcuauucccagguuaacccgcugacccugaccgcugccguccucaugcucguggcgcacuacgccaucaucgggccuggcuugcaggccaaggccacccgugaagcccagaagcgaaccgcugcugguaucaugaagaacccgaccguggacgggauagucgccauagaccucgaccccgugguguaugacgcuaaauucgagaagcagcuggggcaaauuaugcuccucauccugugcaccagccaaauccugcucaugcgcaccacgugggcccugugcgaguccaucacccuggcuacaggcccgcucacaacgcugugggaggguucucccgggaaauucuggaacaccacgaucgccguuucgauggccaacaucuuucggggcagcuaccucgccggagccggguuggcguucucccugaugaagucgcugggcggaggcagacgggggaccggcgcgcaaggagagacgcucggggaaaaguggaagcgccagcuaaaccaacugucgaagagcgaguucaacaccuacaagcggagcggcauaauggagguggaccgcucggaggccaaggagggacucaagaggggagaaacaacuaagcacgcagugagccgggggaccgcgaaacugcgaugguucgucgaacgcaaccucguuaagcccgaaggcaaggugaucgaccugggaugcgggcgcgguggguggagcuacuacugugccggcuuaaagaaggucacggaggugaagggguauaccaaaggcggccccgggcacggggagccgaucccccuggccaccuacggguggaaucuggugaaguugcacagcggcaaagacguauucuucaugccgcccgagaaaugcgacacccugcugugcgacaucggggaguccucaccgaauccgaccaucgaggaaggccgcaccuugagggugcugaagaugguagaacccuggcugcgaggcaaccaauucugcauaaagauacucaaucccuauaugcccucagucguggaagcucuggagcagaugcagcguaagcacgggggcaugcucgugagaaacccccugagccgaaacuccacccacgagauguacuggguuagcugugggaccggcaacaucgugucugccgugaacaugacgagccgcaugcugcuuaaccgguucaccauggcacacaggaagcccaccuacgagcgugaugucgaccucggcgcggggacccgucacguggccguggagccugaggucgccaaccuggacaucaucggacaacgcaucgagaacaucaagaacgagcacaagagcacguggcauuacgacgaagacaacccguacaagaccugggccuaccaugggagcuacgaggugaagcccuccggaagcgcguccucuauggugaacggggucguucggcugcucaccaagccgugggacgucauccccauggugacucagaucgccaugacggacaccacgccguucggacagcagagaguguucaaggagaaaguagauacccgaaccccccgcgccaagcggggcacgacccagaucauggaggugacugccaaguggcuguggggcuuccugucucgcaauaagaagccccggaucugcacgcgggaggaauucacccggaagguccgcagcaacgccgcgaucggcgccgucuucguggacgaaaaccaguggaacagcgccaaagaggcaguagaagaugaacguuucugggacuuaguacaucgugagcgggaacuccacaagcaggggaaaugcgcgaccugcguguacaacaugaugggcaaacgagagaagaaguugggugaauucgguaaggccaaagguucccgggccauuugguacauguggcucggggcccgcuuccuggaguucgaggcccugggcuucaugaaugaggaucacugguucagccgggaaaauucucuaagcgggguggagggcgaaggacugcacaaacuuggcuauaucuugagggacaucuccaaaaucccgggcgggaacauguacgcggacgacaccgccgguugggacacacggaucaccgaggacgaccugcagaacgaggccaagaucaccgagaucauggagcccgagcacgcccuccuugccaccagcaucuuuaagcugacguaccagaauaaggucgugcgcgugcaaagacccgcgaagaaugguaccgucauggacgugaucuccaggcgggaucaacggggaagcggucagguggggaccuacggccugaacaccuucacgaacauggaagugcagcucauccgccagauggagagcgaagggaucuuccugcccagcgagcucgaaacaccgaacuuagccgagcgggugcuggauugguuagagaaacauggcgcugaacgccucaagagaauggccaucucgggggacgauugcguggucaagcccaucgacgaccgauuugccaccgcacuaaccgcccugaaugacaugggcaaggugcggaaggacauaccccagugggagcccuccaagggcuggaaugacuggcaacaggucccguucugcucccaucauuuccaccaacucaucaugaaggacgggcgcgagauaguagugcccugccggaaccaggaugagcucguuggccgcgcccgggugagccagggagccggcuggagccugcgcgaaaccgcaugccucggcaagagcuaugcgcagauguggcaacuaauguacuuucacaggcgcgaccugcggcucgccgccaacgccaucugcuccgcugugccaguggacuggguccccacgucgcguaccaccuggagcauccacgcccaccaucaguggaugaccacggaagacaugcucuccguguggaaucgcguguggauagaagaaaacccguggauggaggacaagacgcacgucucguccugggaggaggugcccuaccugggcaaacgagaggaccagugguguggcucacuuaucgggcuuaccgcccgcgccaccugggccacgaacauacaagucgccaucaaccagguccggcgccugaucggcaacgagaacuaccucgacuauaugaccuccaugaagcgguucaaaaacgagagcgacccggagggggcgcugugguga

SEQ ID NO: 23875 - RNA, 9879 nt, Artificial Sequence
  derived and/or modified CDS sequence (opt11) from DENV-1__GU131968__SS-prME
agcguaaccaugcugcucaugcuacugcccaccgcccucgccuuucaccuuacaacccguggcggggagccccacaugaucgugagcaaacaggaaagagguaagagccuucuguucaagaccagcgccggaguaaacaugugcacgcugaucgccauggacuugggcgagcucugcgaggacacaaugaccuacaagugcccccaaaucacugaggcugaaccggacgacguggauugcuggugcaacgccaccgacacuugggucaccuaugggaccugcagccagacuggcgagcaucgucgggauaagcgaucaguggcacuagcgccccacgucggccugggccucgagacacggaccgagaccuggaugucauccgagggugccuggaagcaaauucagcgggucgagaccugggcccugcgucaccccggguucacugugaucgcucuguuccucgcgcaugccauaggaaccucaauuacgcaaaaggggaucaucuucauacugcugaugcucgucacccccuccauggccaugcgcugcgucggcaucgggaaccgggacuucguagagggccugagcggcgccacguggguggacgucgugcuggaacacggguccugcgugaccaccauggccaagaacaaacccacccuggauauagaguugcugaaaacggaggugaccaacccugcgauccuccguaagcuguguaucgaagccaaaaucagcaacaccaccacggacuccagaugcccaacccagggcgaagccacacugguggaggagcaggacgcgaacuucgucugccgccggaccuucgucgaccgcggcuggggaaacggcugcggcuuauuugguaagggaucucugcugacgugugccaaguuuaagugcgugacuaagcucgagggcaagaucguccaguacgagaaccugaaguacuccgucaucgucaccguacacaccggcgaucagcaucaaguggggaacgagacaacagaacacggcaccauugcgacuauaacuccccaggcacccacuagcgagauacaguugaccgacuauggggcccucacccuggacugcaguccgaggacaggucuugacuucaacgagaugguucuccugacgaugaaggaaaaguccuggcuuguccacaaacagugguuccuagaccugccccugcccuggaccuccggggccagcaccucucaggagaccuggaaucgccaggaccuguugguuaccuucaagacugcgcaugcgaagaagcaggagguggucgugcugggcucccaggaaggagccaugcauaccgcccucaccggggccacugagauucagaccuccggcaccaccacgaucuuugcagggcaccucaagugccggcugaagauggacaagcuaacccugaagggcacaucguacgugauguguacggggagcuucaagcuagagaaggagguagcggaaacgcagcauggcacuguccuggugcaggucaaguaugagggcaccgacgcccccugcaagauacccuucaguacccagaaugagaagggggugacgcagaacggucgccucaucacagccaacccgaucgucaccgacaaggagaagcccguaaacauugagaccgagccgccguucggggagagcuacauaguugugggggccggcgagaaggcgcugaaacuguccugguucaagaaggggagcuccaucggcaagauguucgaggcaacggcacgcggggccagacggauggccauccucggggauaccgcgugggacuuuggaagcaucggcggaguguuuaccuccguggggaaacuggugcaccaggucuucggcacugccuacggggugcuguucagcggcguguccuggacuaugaagaucgggauugggauccugcugaccuggcugggccucaacagccgguccacuagccuguccaugaccugcaucgccgucgggauggucacguuauaccuuggcguuauggugcaagcagacagcgggugcgugaucaacuggaagggcagggagcugaagugcggguccggcaucuucgugaccaacgagguucacaccuggaccgaacaguacaaguuucaggccgacuccccgaagcggcuuagcgcagccaucggcaaggccugggaggagggggugugcggaaucagaucugccacccggcuugaaaacaucauguggaagcagaucucgaacgagcugaaccauaucuuacucgagaacgacaugaaguuuacggugguggugggcgacgccaacggcauccuggcgcaggguaagaagaugaucaggccgcagcccauggagcacaaguacucuuggaagagcugggggaaggccaagaucauaggcgccgacauccagaacacuaccuucaucaucgaugggcccgacaccccugagugccccgacaaccagcgggccuggaauauaugggaaguggaggacuacggguucgggauauucacgaccaacaucuggcuaaagcuccgggauuccuacacccagaugugcgaucaccguuugaugagcgcggccaucaaggacucgaaagccguucacgccgauaugggcuacuggaucgagagugagaagaaugaaaccuggaagcuggagcgcgccuccuucauagaggugaagacguguaccuggccuaagagccacacccucugguccaacggcgugcuggagagcgagaugauaauaccuaagaucuacgguggccccaucucccagcauaauuaccggcccggguacuucacccagaccgcggggcccuggcaccuugggaaacucgaacuggacuucgaucuuugcgagggcaccaccgucgugguggaugaacacugugguaaccgcgggccuagccuacgaacuaccacugucaccggcaagaucauccacgagugguguugucgcuccugcacccugccgcccuugagguuccgcggggaggacggcugcugguacggaauggagauucggcccgugaaggagaaggaagagaaccuuguccguucgauggucuccgcugguaguggugagguagacucguucucucuggggauccuaugcgccucuauuaugaucgaagaggugaugagaagccgcuggagccggaaaauguugaugacgggcacccuggccguauuucuguuacugaucauggggcagcugaccuggaaugaccucauacgccugugcaucauggugggugccaacgccucagauaggauggggaugggcaccacguaccuggcccuaauggccaccuucaagaugcggccgauguucgccgucggucugcuguucaggcggcugaccucucgugaggucuuauuacugaccaucgggcugucccugguggccagcgucgagcucccuaacuccuuagaggaauugggcgaugggcuggcgaugggcauuaugaugcugaaacugcucacggaguuucagccccaccagcuguggacuacccugcucagccugaccuucaucaagacaacccuuucccucgacuacgcauggaagaccacggccauggcccugagcaucgucucccuguuuccacucugucucucaacgaccagucagaagaccaccuggcugccggugcuccugggcagcuucggguguaagccccugaccauguuccucaucaccgagaacaaaaucuggggcaggaaguccuggccccugaacgaaggcaucauggcaauuggcauagucagcauccugcucaguagccugcugaagaacgacgugccguuagccgggccgcuaaucgccggcgguaugcugaucgccugcuacgucaucagcggguccagcgcggaucucucccuggagaaagcggcugaggucagcugggaacaggaggcugaacacucaggcaccucccacaacaucuugguggaggugcaagacgauggcacuaugaaaaucaaggacgaggaacgcgacgacacccucacgauacugcuaaaggccacccuccuagcagucuccggcguguaccccaugaguauccccgcuacacuguucguuugguacuucuggcaaaaacggaagcagcgcuccgggguucucugggacacccccucgccuccagaaguggagcgugccguccuggacgacgggaucuaccguauccuacagagaggccucuuggggcgaucacagguaggcguggggguguuccaggacgggguuuuccacacgauguggcacgucacgcgcggggccguccugauguaccagggcaagcgccuggagcccaguugggccagugucaagaaggaccucaucagcuacggcgggggcuggcgauuucagggcagcuggaauaccggagaggagguccaggugaucgcggucgagcccgggaagaauccgaagaauguucaaaccacgcccggcaccuucaagacgcccgagggcgaggugggagcgaucgcccuggacuuuaagcccggcaccagcgguucuccuauaguuaacagggagggcaagauugugggccuguacgggaacggcguggucacgaccucuggaaccuacgugagugccaucgcucaggccaaggcuucgcaggagggcccccugcccgagaucgaggacgagguguuuaagaagcggaaccuuaccaucauggaccugcacccggggaguggcaagacucgcagguaccuccccgcuaucguucgcgaggccaucaagagaaagcugcgcacgcugauccuagcucccacccggguaguggcguccgagauggccgaggcacugaaaggcaugccgauacgguaucaaaccacggccgucaagagcgagcacaccgggcgcgaaauaguggaccucaugugccacgccaccuucaccaugcggcuccugagcccggugagaguaccaaacuacaacaugaucaucauggacgaggcgcacuucacggaccccgccagcauugccgccagaggcuauaucuccacacgugugggaaugggugaggccgcggccaucuucaugaccgcgacgccgcccggcagcguggaggccuucccccaguccaacgcggucauacaggacgaggagcgggacauaccagagcggagcuggaacagcggcuacgacuggauuacggacuuuccuggcaaaaccgugugguuugugcccaguaucaaaagcgggaacgacaucgccaacugcuugcgcaagaauggcaaacgcguaauucagcucagccgcaagacguucgacacggaguaucaaaaaacgaagaacaacgauugggacuacgucgugacgaccgacauaucagagaugggggcaaacuuccgcgccgaucguguuauugacccacgccggugccugaagcccgugauauugaaggacggccccgagagggugauccuugccgggccaaugcccgucaccguggcaagcgcggcccagcggcgcggccggaucggccgcaaccaaaacaaggagggugaccaauacguguacaugggccagccuuugaacaacgaugaagaucacgcccacuggacggaggccaagaugcugcuggacaacauaaacaccccugaggggaucaucccggccuuauucgagcccgagcgugagaaguccgcggccauagacggagaguaucggcugcgcggggaggcgcggaagaccuuuguugagcuaaugcgcaggggcgaccugcccguauggcugagcuacaaggucgccuccgaaggcuuccaguacucugaccgcagguggugcuuugacggggagcgcaacaaccaagugcucgaggagaauauggacguagagaucuggaccaaggagggcgagcggaaaaagcugcgcccccgguggcuggaugcgcgcaccuauuccgacccccucgcgcugcgggaguucaaagaauucgccgccgggcgccgguccgucagcggcgaccugauccucgaaaucggcaagcugccucagcaccuuacguuacgcgcgcagaacgcacuggacaaccuggugaugcuccacaacuccgagcagggcgggaaggccuaccggcacgcgauggaggagcuccccgacacuaucgagacccugaugcuccuggcccugaucgcgguucucaccgggggcgucacgcuguucuuccuguccgggaagggccucggcaaaaccucuauagggcugcugugcguaaccgccaguucagcccuccuguggauggcaagcguggagccccauuggaucgcggcaaguaucauccuggaauucuuucucaugguccugcucaucccggagccggaucgccaacggacgccccaggauaaccagcucgccuacguggugaucggccuccuguucaugauccucacggucgcggcuaacgaaaugggccuccuggagaccaccaagaaggaucucggcaucgggcacgucgcugcggagaaucaccagcacgcgaccaugcuggacguggaccugcgcccagccagcgccuggacacucuacgcaguagcgaccacagugaucacgcccaugaugcggcacacgaucgagaauacgaccgccaacaucucccucacggcuaucgcgaaucaggcugcgauccugaugggccucgacaagggcuggcccaucagcaaaauggacauagguguuccccugcuggcgcuugggugcuacucccaggucaacccgcugacgcugaccgccgccgugcucaugcugguggcgcacuacgcaaucauugggccuggccugcaggccaaggcuaccagagaggcccagaagcgcaccgcggccggaaucaugaagaaccccacggucgacggcauaguggccaucgaccuagaccccgugguauacgacgccaaguucgagaagcaacuuggccagaucaugcuccucauccugugcaccagccagauccuucugaugcggaccacuugggcgcugugugaguccauaacgcuggcgaccggaccgcucacaacgcucugggagggaagccccggaaaguucuggaauacuaccaucgccguaaguauggccaacaucuuccgcggcagcuaccuggccggugccggacucgcguucucccugaugaagucucugggcgggggccggcgcgggaccggcgcccagggugagacccucggcgaaaaguggaaacgucagcuuaaccagcuuuccaagagcgaguucaacacguacaagcgcuccgggaucauggaggucgaccgguccgaagcgaaggaggggcugaagcgcggggagaccaccaagcacgccgucagccgugggaccgcgaagcuacgcugguucguagagcggaaccuggucaagcccgagggcaaggucaucgaccugggcugcgggcggggcgggugguccuacuauugcgccggccuaaagaaggugacugaggugaagggguacacgaaaggcggccccgggcacgaagagcccaucccgauggccaccuauggcuggaaucuggucaagcuccacagcgggaaagacguguucuuuaugccgcccgagaagugcgauacccuguugugcgauaucggcgaguccuccccuaaccccaccaucgaggaggggcggacgcugcgcgugcuaaagauggucgagcccuggcuacgugguaaccaguuuugcaucaagauccugaaccccuacaugccguccgugguggagacgcucgagcagaugcagcgcaagcacggcggcaugcuagugcguaaccccuugagccgaaacuccacgcacgagauguacugggugagcugugguaccgggaacaucgugucggcugucaacaugacaucccggauguuacugaaccgcuucacaauggcccaccgcaagcccacuuucgagagagacguggacuuaggcgcgggaacccgccacguggccguggaacccgagguggccaaccucgacaucaucgggcagcggauugagaacauuaagaacgagcauaaguccacguggcauuacgacgaagacaacccauacaagaccugggccuaccacggcagcuaugagguaaaacccagcggaagcgccucuagcauggucaacggcguggugcgccugcugacaaagcccugggacgugauucccauggugacccagaucgcgaugacugacacgaccccguucggccagcaacgagucuucaaggagaagguggacacccguacgccccgggccaagcgcggaaccacccaaaucauggaggugaccgccaaguggcucuggggauuccugucccguaacaagaagccccgaaucugcaccagggaggaguucacccguaagguccggagcaacgcagccaucggugcggucuucguggacgagaaccaguggaacagcgcaaaggaggcaguugaggacgagcgcuucugggaccugguacauagagagcgcgaacuacacaagcaaggcaagugcgcgaccuguguguacaacaugauggggaagcgggagaagaagcugggcgaguucgguaaggcgaaaggcucccgcgccaucugguacauguggcugggcgcucgguuccucgaguucgaggcucuuggguucaugaacgaggaucacugguuuucgcgggagaacuccuuaucaggcguggaaggggagggucuccacaagcugggguacaucuugcgggacaucuccaagaucccggguggcaacauguacgccgacgacaccgcggggugggacacgcgcaucaccgaagacgaccuccagaacgaagccaagaucaccgacaucauggagccggagcacgcccuauuagccaccucgaucuucaaacucacguaccagaacaagguggugcguguccagcggccagccaagaacggcacagugauggacgugauaucccgacgcgaccagcggggaagcggccaggucggcaccuacggucuuaacaccuucacgaacauggaggugcagcucaucagacaaauggagagcgagggaaucuuucuccccagcgagcuggaaacaccgaaccucgccgagagagugcucgacuggcuggagaaacacggggccgagcggcugaagcgcauggccauuuccggcgaugacugcgucgugaaacccauagacgaccgguucgcgaccgccuuaaccgcguuaaacgacaugggcaaggugcgcaaagacaucccacagugggagcccucgaagggcuggaacgacuggcagcaaguaccuuucugcucccaccauuuccaccaguugaucaugaaggacggccgggaaauaguggugcccugcagaaaccaagacgagcucgucgggagggcccgcguaagccagggcgccggguggucgcugcgggaaacagccugucuuggcaagagcuaugcccagauguggcaguugauguacuuccacaggcgggacuugcgccuagcggccaacgccaucugcuccgccgugcccgucgacuggguacccacgagccggaccacuuggagcauccacgcgcaccaucaguggaugaccacggaggauaugcucuccguguggaaccgcguauggauugaagaaaauccguggauggaggauaaaacccauguaucgaguugggaagaagugcccuaucuggggaaacgcgaggaccaauggugugggagccugaucggauugaccgcccgggccacgugggccacgaacauacaggucgccauuaaucaagugagacggcugaucgggaacgagaacuaucucgacuacaugaccuccaugaagcgcuuuaaaaacgagagcgaccccgagggcgcccucugguga

SEQ ID NO: 23876 - RNA, 9879 nt, Artificial Sequence
  derived and/or modified CDS sequence (opt11) from DENV-1__GQ868506__SS-prME
agugucacaauguuacucauguuacugccgaccgcccucgccuuccaccugaccacccgggggggggaaccgcacaugaucgugagcaaacaggagcggggcaagagccuccuguucaagacgagcgcuggggugaacauguguacacugaucgccauggaccuuggagaauuaugcgaggacaccaugaccuacaaguguccccagauuaccgaggccgagcccgaugacguagacuguugguguaaugcgacggacaccugggucaccuacgggacaugcucccagacuggcgagcaucgccgggacaaacgcucgguggcccuugccccccaugugggccuugggcucgagacgcggaccgaaaccuggaugagcuccgagggcgccuggaagcagauccagcgggucgagacuugggcuuugcggcacccaggguucacggugauagcguucuuccuggcgcacgccauaggcaccaguaucacgcagaagggcaucaucuucauucuucugaugcuggugacccccuccauggccaugcguugcgucggcaucgggaaccgggacuucguggaggguuuaagcggggcgacguggguagacgucguguuggagcacgggagcugcgugaccaccauggccaagaacaagccaacccuggacaucgagcuccugaagacugaggucaccaaucccgcgauccuucgcaagcucugcauugaggccaagaucagcaacaccacaacggauagucggugccccacccagggcgaggccacccugguggaggagcaggacgccaauuucgugugccgucggaccuucgucgaccgcggcuggggaaacggcugcgggcuguucgggaaggggucucuccugacuugcgccaaguucaagugcgugaccaagcuugagggcaagaucgugcaguaugagaaccucaaguacagugugaucguaacuguccacaccggcgaccagcaccagguggggaacgagacgacugagcauggcaccaucgcgacgauuacgccccaggcacccacgucagagauccagcugacggauuacggggcccugacccuggacuguaguccccggacagggcucgacuucaacgagaugguacuguugacgaugaaggagaaguccuggcugguccacaagcagugguuccuugaucuaccgcugcccuggaccuccggggccagcaccagccaggagacuuggaaccgccaggaccugcucgugacguucaagacugcccacgcuaaaaagcaggaggucgucguacugggcucccaggagggcgccaugcacacggcgcugaccggagccacugaaauccagacgucuggcaccaccacgaucuucgccggacaucuaaagugccggcuaaaaauggacaagcugacacuuaaaggcaccucuuacgugaugugcacggggagcuucaagcuggagaaggagguagcggagacgcagcacggcacugugcuggugcagguaaaguacgagggcaccgacgcccccuguaaaauccccuuuucaacccaggacgagaaagggguuacgcaaaacgggcgcuugaucacugccaacccuaucgugaccgacaaagaaaagcccgugaacauugagacggagccgcccuucggggaguccuacaucgucgugggggccggcgagaaggcgcucaagcuguccugguucaagaaggggagcuccaucggcaaaauguucgaggcaacggcccgcggggcgcgucgaauggccauacugggcgauaccgccugggauuucgggagcaucggcgguguguucaccuccgugggcaagcucgugcaccaggucuucggcaccgccuacggggugcuguucaguggcgucucuuggaccaugaaaaucgggaucggcauccuucucacguggcucggccugaacagccgcuccaccagucucuccaugaccuguauugccguugggauggugacacuguaccugggcgugauggugcaggcagacagcgggugcgugaucaacuggaaggggcgcgagcucaaguguggcuccgggaucuucgugacgaacgaaguccacaccuggaccgagcaguacaaguuucaggcugacagcccgaagcggcucucggcugccauaggcaaagcuugggaggaagggguguguggcauccgauccgcaacccgccuagagaacauaauguggaagcagaucagcaacgagcucaaccacauacuguuggagaacgacaugaaguuuacggugguagugggggaugccaacggcauccucgcgcaggggaagaagaugauucgcccccaaccuauggagcacaaguacaguuggaagucuuggggcaaggccaagaucaucggcgccgacauccagaauaccaccuucauaaucgacggccccgacaccccggaaugcccagacaaccaacgggccuggaacaucugggagguggaggacuacggcuuugggaucuucacgaccaacaucuggcugaagcugcgcgacuccuacacccagaugugcgaccacagacucauguccgcggccaucaaggauucuaaggcagugcacgccgauaugggguacuggaucgagagcgagaagaaugagaccuggaaacuggcucgcgcguccuucauugagguaaagacaugcaccuggccuaagagccauacccuguggucgaacggcgugcuagagagugagaugaucauccccaaaaucuacgggggcccuauaucccagcacaacuaucggccaggguacuucacgcaaacggccggccccuggcaccuggggaaacuagagcucgacuuugauuugugcgaggguacgaccgucgugguagacgagcacuguggcaacagagggccgagucugcggacaacgaccgucaccggcaagaucauccacgaguggugcugccgcucgugcacccuuccgccccugcgguuccguggggaggacggcugcugguacgggauggagauccgaccugugaaggagaaggaggagaaccuugugcguagcaugguuuccgccggcucgggcgaggucgacagcuucucucucgggauccuuugcguguccauaaugaucgaagagguuaugcggucccgguggagccggaagaugcugaugacgggcacccucgccguauuccuguuacuugugauggggcagcugacauggaacgaccuaauccgucucugcaucauggucggcgcgaaugcguccgaucgcaugggaaugggcacaacguaccuugcuuugauggcaacauucaagaugcguccgauguucgcugugggccugcuguuucgcagacugaccagccgcgagguacucuugcugaccaucgggcucaguuugguagccuccguggaacugccuaacucacuagaggagcugggcgaugggcuggcuaugggcaucaugaugcucaaacugcuaacggaguuccagccgcaccagcucuggacgacucuccugagccucaccuucaucaagacgaccuuaucccuggacuacgccuggaaaaccacugccauggcccugucaaucgucucccuauuuccacugugccucagcacgaccucccagaagaccaccuggcugccaguguugcugggcagcuucgggugcaagccccucaccauguuccugaucacggagaacaagaucuggggccggaagucauggccccucaacgagggcaucauggcaaucggcaucgugucaauccuccugucuagccuucugaagaacgacguaccgcuggccgggccgcugaucgccggcgggaugcuaaucgccugcuacgugaucagcggguccagcgccgaucugucuuuagaaaaagcggcagagguuagcugggagcaagaggcugagcacucaggcacuagccacaacauacugguagaagugcaggacgacgggaccaugaagaucaaggacgaggagcgcgacgacacccugaccauacuccugaaggccacccugcuagccguaaguggugucuaccccaugucgaucccagcgacccuguuuguaugguacuucuggcagaagaagaagcagcggucagggguguugugggauacgcccagcccgccugagguugagagagccguacucgaugacggcaucuaccguauacugcagcgaggccuacuagggcggucucaggugggcgucggggucuuccaggacggcguguuccauacgauguggcacguuacccgcggcgccgugcucauguaccagggcaagagauuggagcccagcugggccuccgugaagaaggaccugaucagcuacgggggagguuggcgcuuccagggguccuggaacacgggggaggagguccaaguuaucgccguggaacccgggaagaauccgaagaacgugcagaccacgcccggcaccuucaagacccccgaaggugaggugggcgcgaucgcccucgacuucaagccgggaaccagcggauccccgaucgucaaccgggagggcaagaucgucggacucuaugggaacggcgugguuacaacgagcgggaccuacguuuccgccaucgcucaggccaaggcgagccaagagggcccccugccggagaucgaggacgagguauucaaaaaacgcaaccucaccaucauggaccuccacccagggagcggcaagacgcgacgcuaccugcccgcuauaguacgggaagccauuaagcgaaaacuaaggacccuuaucuuagcccccacccgagucguggccucagaaauggcggaggcccucaagggaaugcccauacgauaccagaccacagccgucaaaucagagcacaccgggagagagauugucgaccugaugugccacgccacauucaccaugcgucugcuuucuccgggccggguacccaauuacaacaugaucaucauggacgaggcgcauuucacagaccccgccucuaucgccgcucgcggauacaucuccacacgcgugggcaugggggaagccgcggccaucuucaugaccgccaccccucccggcucugucgaggccuucccccaguccaacgccgugauccaggaugaggagcgcgacauccccgagcggagcuggaacuccgguuaugacuggaucacggacuuucccgggaaaaccgugugguucgucccgagcaucaaauccggaaaugacaucgcgaacugccugcgaaagaacgggaagcgagugauacagcugagccgcaagacuuuugacaccgaguaccagaaaacaaagaauaaugacugggacuacguggucaccacagacauuucggagaugggcgccaacuuccgggccgaccgcgugaucgacccccggcgcugccucaagcccgugauccugaaggacggccccgagcgggucauccuggccggcccgaugcccgugacaguggcgagcgccgcccagcgccggggccgcaucgggcggaaccagaacaaggaaggcgaccaguacgucuacaugggucagccccugaacaaugaugaggaccacgcccacuggaccgaggcgaagaugcugcuagacaauaucaacacccccgaggggauaaucccugcccuuuucgagccagagcgcgaaaaguccgccgccaucgacggcgaguaucgucugcggggggaagccagaaagaccuuuguggagcugaugcggcgcggcgaccuacccgugugguuaagcuacaagguggccuccgagggguuucaguacagcgaucggcgguggugcuucgauggcgagcggaauaaccaagugcucgaagagaacauggacguugagaucuggaccaaggagggggaacgcaagaagcuacggccuagauggcuggacgcgcggaccuacuccgacccgcuggcccugcgcgaguucaaagaguucgccgccggccgucggagcgugagcggcgaccucauacuugagaucgggaagcugccccagcaccuuacccugcgggcacagaacgcccuugacaaccuagugaugcugcacaacucugaacaaggcgggaaggccuaccgacacgcgauggaggaacuccccgauaccauagagacgcugaugcuguuggcccuuauugcgguccugaccgggggggugaccuuauucuuccugagcggcaagggccucgggaagaccaguaucggccuccugugcgugaccgccuccuccgcccuguuauggauggccucagucgagccccacuggaucgccgcguccaucauucuggaguucuuccugauggugcuccucaucccggagcccgaccggcaacgcacgccucaggacaaccaguuggccuacguggucaucggguuacuguucaugauacugacgguggccgccaacgagaugggccuccuugagaccaccaagaaggaccuggggaucggccacguggcagcggaaaaccaccagcacgccaccauguuagacgucgaccugcggccggcuucggccuggacccuguacgccguugcgacgaccgucaucacgcccaugaugcggcacacuaucgagaauacgacggcgaacauuucccucaccgcaauagcgaaccaggccgcgauucugaugggccucgacaagggguggcccaucagcaagauggacauaggcguuccccucuuggcccugggcugcuacucccagguuaacccgcucacgcuuacggccgccguucugaugcucgucgcgcacuacgccaucauuggcccagggcuucaggccaaggccacgcgggaggcacagaaacggaccgcugccgguaucaugaagaacccaacggucgacggcaucguggccaucgaccuggacccagucguguacgacgccaaguucgagaaacaacucgggcaaaucaugcuucugaucuugugcacuagccagauccugcucaugcguacgacgugggcccugugcgaguccaucacgcuggcgaccggaccuuugaccacgcucugggaggggagcccuggcaaguuuuggaacacgacaaucgccguauccauggccaacaucuuccggggcagcuaccuggccggugccggccuggcguucucccucaugaagucccucgggggcggacgccgggguaccggcgcccagggggagacucucggcgagaaguggaagcgccagcuaaaccagcugucgaaaagcgaguucaauacguacaagcggagcggaaucauggaggucgaccgcuccgaagcgaaggaaggccugaagcgcggggagaccacgaagcacgccgugagucgcggaaccgcgaagcuccggugguucguggaaagaaaccuggucaagcccgagggcaaggugaucgacuuagggugcggcagagguggcugguccuauuacugcgcggggcugaagaaagugacugagguuaaaggguacacaaagggcggcccgggccacgaggaaccgauccccauggccacauauggguggaacuuggucaagcugcacucagguaaggacguuuucuucaugccgcccgagaaaugcgauacccuccucugcgacaucggggaguccagcccgaaccccaccaucgaagaggggcgcacgcugcggguucugaagaugguggagccguggcuccgcggcaaccaguuuugcauuaagauccugaaucccuacaugccgagcguggucgaagcccuggagcagaugcagcggaaacacgguggcaugcucguacgcaacccccugucgcggaacuccacacacgagauguacugggugagcugugggaccggcaauauuguuucugccgucaacaugaccagccgcaugcuacucaaccgcuucacgauggcgcaccgcaaacccaccuacgagcgcgacguugauuuaggcgccgggaccagacacgucgccguggaacccgagguggccaaccuugacauaaucggccagcggaucgaaaacaucaagaacgagcacaaguccaccuggcacuaugacgaggacaauccguauaagacgugggcguaccacggcagcuacgaaguaaagcccuccggcuccgcgagcagcauggugaacggggugguccgccuccugaccaaacccugggaugugauaccuauggucacacaaauagcaaugaccgacacgaccccauucggacagcagaggguauucaaggagaagguggacacucgcacgcccagggccaagcggggcacgacgcagaucauggagguaaccgccaaguggcuguggggauuccucuccagaaauaagaagccccggauuugcacgcgcgaggaguucacgcggaaggugcgcucuaacgcugcgaucggcgccguuuucgucgacgaaaaccaguggaauagcgccaaggaggccguggaggacgagcgguucugggacuuggugcaccgagagcgggagcugcauaagcaagggaagugcgcgaccugcgucuauaacaugaugggcaagcgcgagaagaaacucggggaguucggcaaggccaagggcuccagggccauaugguacauguggcugggcgcgagauuccuggaguucgaggcacucgguuuuaugaacgaggaccacugguucucgcgggagaacucccugagugggguggaaggggaggggcugcacaagcugggcuacauucugcgcgacauauccaagaucccggggggcaacauguacgcggacgacaccgcaggaugggacacccgcaucacggaggacgaccuucaaaacgaggccaagauuaccgagaucauggagcccgagcacgcccuacucgccaccagcaucuucaaacucacauaccaaaacaaggucguccgcguccagcgccccgcuaaaaaugggacggugauggaugugauaucccggcgagaccaacgggguuccggacagguugggaccuauggucucaacaccuucaccaacauggaaguucagcugauccgccagauggaguccgaagggauauuccugcccagcgagcucgagacgccgaaccuggccgagcgcguucuggauuggcuagagaagcacggcgccgaacgcuuaaagcggauggccaucucgggggacgacugcgugguaaagccaaucgacgaccgcuucgccacagcucugaccgcccucaaugacaugggcaagguacggaaggacaucccccagugggaacccagcaagggcuggaacgacuggcagcagguccccuucuguucccaccacuuccaucaguugaucaugaaggacgggagagagaucguugucccuugccggaaucaggacgagcugguuggccgcgcucgugugagccagggggccggcuggucccuccgggagacagccugccugggcaaauccuaugcgcagauguggcagcugauguacuuccacagaagagaccuccggcuggcagccaacgccauuugcuccgcggucccaguagacugggugcccaccagccgcacgaccuggagcauccaugcccaccaccaguggaugaccacggaggacaugcuguccgucuggaaucgcguguggauagaggagaaccccuggauggaggacaagacgcacguuucuuccugggaggaaguucccuaccucggcaagcgcgaggaccagugguguggcagccugauugggcugacggcgcgcgcgaccugggccacuaacauccaagucgcgaucaaucaggugcggcgccucaucggcaacgagaacuaucuggacuacaugacguccaugaagcgguucaagaacgagagcgaccccgagggggcccugugguaa

SEQ ID NO: 23877 - RNA, 9879 nt, Artificial Sequence
  derived and/or modified CDS sequence (opt11) from DENV-1__GQ868507__SS-prME
agcgugaccaugcuacugaugcuacuacccacagcccuggcauuucaccuaacaacucgaggcggggaaccccacaugauaguuaguaaacaggaacgcgggaaaagucugcuauucaagaccagugcuggggucaacaugugcacauuaaucgcuauggaccucggcgaacucugcgaagacacgaugaccuacaaguguccccaaauaaccgaagcagaacccgacgacguggauuguuggugcaacgcuacggacacguggguuacuuauggaaccugcucccaaacaggggaacauaggcgggacaagcgaucgguugcccuggcaccacacguaggacucggacuagaaacgcgcaccgaaacauggauguccagcgaaggcgcuuggaagcaaauccaaaggguagaaaccugggcacuccgacaccccggguucacaguuaucgcgcuauucuuagcacacgcuaucgguacgucgauaacccagaagggaaucauauucauacuucugaugcugguaacuccaaguauggcaaugcggugugucgguauaggaaaucgagacuucguggaaggccucuccggcgcgaccugggucgacguagugcuagaacacggcuccugugucaccacgauggcaaagaacaagccgacgcucgauauagaacuauugaagaccgaagugacgaaucccgcgauccugaggaaacugugcaucgaagcgaaaauaagcaacacgacgacggacagccgcugccccacccagggggaggcaacacuugucgaagaacaagaugccaacuuuguaugucgucggacauucguagauagaggaugggggaauggcugcggacuauucggaaaaggcagccuccuaacgugcgccaaguucaagugcguaaccaagcuagaagguaaaaucgugcaauacgaaaaucugaaguacagcgugauaguaacaguacacacgggagaucagcaccaagugggaaaugaaacaacugaacacgggacgaucgcgacaauaacuccacaagcccccaccagcgagauacaacucacggacuacggggcccugacccuugacuguucacccagaacaggacuagacuuuaaugaaaugguguugcuaaccaugaaggagaaauccuggcugguucacaaacaaugguuccucgacuugccccuaccauggacaucaggggccuccacaagccaagagacauggaacagacaagacuuacuggugacauucaaaaccgcacaugccaagaaacaagagguuguaguccucggaagccaggaaggcgcaaugcauacggcucucaccggcgccaccgagauacaaacuucaggcacgaccacaaucuucgcuggccacuugaagugccgauuaaaaauggacaagcucacguuaaaaggcaccuccuacgucaugugcacugggagcuuuaaacucgaaaaagagguugcagaaacacagcacggaacagugcuuguccaggugaaguaugaggguaccgacgccccaugcaaaauaccauucaguacccaggaugaaaaaggagucacgcaaaacggcaggcuaaucacggcaaacccaauagugacugauaaagagaaacccguuaacaucgaaacagaaccacccuucggugaauccuacauuguugugggcgcgggugaaaaggcucuaaaacugucgugguucaagaagggaagcagcauuggcaaaauguuugaggcaacagcccgaggggcgcgucgaauggcaauccugggggacacggcgugggauuucggcagcaucggcgguguauucaccuccgucgguaagcucguccaccaaguauucggaacagccuaugggguccuguucucggguguuagcuggacgaugaaaauuggaauuggcauccugcucacguggcuggggcugaacucccgcucaacgagccucuccaugacaugcaucgcggucggcauggugacguuauaucuaggcgugaugguacaagcagacucuggaugcguaaucaacuggaaaggccgggagcucaaaugcggcagcggaauuuuugucacaaacgaagugcauacuuggacagagcaauauaaauuccaagcugauucaccaaaacggcuauccgcugccauugguaaggcgugggaagagggcgugugcggaauacgcagugccacgaggcucgaaaacauaauguggaagcaaauaaguaacgaguuaaaccacauacugcuggagaacgacaugaaauucaccguggugguuggagacgccaacggaauacuagcacagggcaagaaaaugauucgaccacagccgauggaacacaaauacuccuggaaauccuggggcaaagccaaaauaauaggugcagacauacaaaacacaaccuucauaaucgacgggccggacacaccggagugcccugacaaccaacgcgccuggaacaucugggaaguggaggauuacgguuucggcaucuuuacaacaaacauuugguugaaacuucgcgacaguuacacccaaaugugugaccaccgguuaaugucggccgccauaaaagacucgaaggcggugcaugcagacaugggauacuggaucgaauccgagaagaacgaaacauggaaguuagcgcgggcauccuuuaucgaagucaagacaugcacauggcccaaaucucacacgcucuggagcaacgguguauuagaguccgaaaugauaaucccgaaaaucuauggagggcccaucagccaacacaacuaucgcccaggguacuucacccaaacggccggccccuggcaccucggcaaacucgaacuagauuucgaucugugcgagggcacgacagucgucguagacgaacacugcgggaauagaggacccagcuuacggacgacaacagucacgggcaagauuauccacgaauggugcuguagaucaugcacauugccuccacuuagauucagaggggaagacggcugcugguacgguauggaaaucagaccaguaaaggaaaaagaagaaaaucuggugcgcuccaugguaagcgcaggcucgggcgaaguagacaguuucucccucggaauccucugugccagcauaaugauagaagaaguaaugaggagccgauggagcaggaaaauguugaugaccggaacccucgccguauucuugcuccuaguaauggggcagcuaacauggaaugaucucauacggcugugcauaauggugggugcaaacgcgucggacagaaugggaauggggacgacguaccuagcacugauggcgacguucaagaugcgaccaauguucgcagucggccuacucuuccgacgccuaacaagccgggaagugcuccuccucaccauaggauuaagccucgucgccucgguugagcugccgaacagccucgaggagcuaggagaugggcuagccauggggauaaugaugcugaagcuacucaccgaguuccagccccaccaacucuggauuacccuacuuagccuaacauucaucaaaacgacacugagccucgacuaugcguggaagaccacagcgauggcguuaagcauagugucacuguucccgcugugccuaucaaccacuucgcagaaaacaaccuggcuuccaguacugcucggcagcuuugguuguaagcccuugacaauguuucuuaucacggagaacaaaaucugggggagaaagucuuggccucucaacgaaggcaucauggccauagggaucguaagcauacuacucucaucccuacuaaagaaugauguucccuuagcgggcccucucaucgcgggagguauguugauagccuguuacgugauauccgggucaagcgccgaucucucccuggagaaggcggcagaaguguccugggaacaagaagccgagcauuccgguaccagucauaacauucucguggagguccaagaugacggaaccaugaagaucaaggacgaagaacgggaugauacacucacaauacuacuaaaggccacucuccucgccgucagcggcguguaccccaugagcauuccggcaacccucuuugucugguacuuuuggcaaaagaagaaacaacgcagcggaguguuaugggacacgccguccccgcccgaaguagagagagcagugcucgacgacggcaucuaccgcauccuccaacgaggacugcugggaagaucucaggugggcgucgggguguuccaagacggcguguuccauacaauguggcacgucaccaggggagcaguucugauguaccaaggcaaacgccuagagccuagcugggcgucaguaaagaaagaccuaauaucauauggagguggauggagauuccaggguucauggaacacgggagaagaaguacagguaaucgcuguagaacccggaaagaaucccaagaacguucagacaaugccagggacguucaagacuccggaaggugaggucggggcaaucgcccuagacuucaagccgggaacaagugguucucccaucguaaaccgggaggggaaaauaguuggccuauacggcaacggagucgugacgacaaguggaacauacguaagcgcaaucgcgcaagcgaaagcgucacaagaaggcccccugccagagaucgaagacgaaguauuuaagaaacgcaaccucacaauuauggaccuccauccgggcaguggaaaaaccagaagauaccucccggcaauggugcgcgaagccauaaaaagaaaguugagaacccuaauacuggcgccuacccguguaguagccucugagauggcagaagcacugaaaggaaugccgauccgguaccagacgacggccgucaagucggaacacacgggacgggaaauagucgaucugaugugccacgcuacguuuaccaugcggcugcuuucccccgugcgaguccccaacuauaacaugauaauaauggacgaagcacacuuuacggaccccgccagcauugcagcccguggguacauaagcacaaggguaggcaugggcgaggcagcugcaaucuucaugacagccaccccgccaggcaguguagaagcauucccccaaagcaaugccguaauacaagacgaagaaagagacaucccggagaggagcuggaacucaggauacgacuggaucacugauuucccggggaaaacaguaugguuuguacccuccauaaagucaggcaacgauaucgccaauugccugcgcaaaaacgggaagcgcguaauccaacugucaaggaaaacuuucgacaccgaauaccagaaaaccaaaaacaacgauugggacuaugucgucacaaccgacauaucggaaaugggcgccaacuuccgggcagaucgagucauugauccgcgaaggugcuuaaaaccagugauacuuaaagacggccccgaacggguaauccuggcggguccgaugccaguaacggucgccagcgcagcccaacgacggggccgaauagggcgaaaccaaaacaaggagggggaucaauacguauacaugggacaaccgcuaaauaacgacgaagaucacgcucacuggaccgaggccaaaaugcuguuagacaacauaaacacccccgaggggauaaucccggcgcuguucgagccagaacgggagaaaagcgcagcgauugacggagaguaccggcuacggggcgaagcacguaaaaccuucgucgaacuaaugagacgaggggaccuacccguuugguugucauauaaaguagccucggaaggcuuccaauacagcgaccgucgcuggugcuucgacggagagaggaauaaccaaguccuggaagagaauauggacguggaaauauggaccaaggagggagaaagaaagaaacuccgcccccgcuggcuagaugcgcgcacauacagugacccauuggcgcugcgagaauuuaaagaauuugccgcagggagacgaaguguuagcggcgaucuaauacucgaaaucggaaaacuaccccagcaccucacacucagagcacagaacgcacuagauaacuuagucaugcuccacaacagugagcagggcggaaaagcguaccgacacgccauggaagaacugcccgauacgauagaaacacugauguuacuggcccucaucgccguccuaacgggaggaguuacccuauuuuuccuaagugggaaaggacuaggcaagacaaguauaggccugcucugcgugaccgcuucgucagccuuacuguggauggccagcgucgaaccacacuggauagcagccagcaucauccucgaguucuuucucauggugcucuugaucccagaaccagaccgucagcggacaccgcaagauaaccaacuagccuacguaguuaucgggcugcucuuuaugauccuuacugucgcagcuaacgagaugggccuacucgaaaccaccaaaaaggaucuagggaucggccacguugccgcagaaaaccaccagcaugcaacgaugcuugauguggaccuaagaccggcgagcgcauggacccuauaugccguggcgaccacgguuauaacaccgaugaugaggcacaccaucgaaaacacaacggcaaacauuucacuuacugccauagccaaccaggcggcuauacucaugggguuagauaaaggauggccgaucaguaaaauggauauugggguaccucuucucgcacucgggugcuacagccaaguaaauccacucacauuaacugccgcaguacugauguuaguggcgcacuacgccauuauagggcccggguugcaggcgaaggcaacacgugaggcgcaaaaacgaacagcagcgggcaucaugaaaaacccaaccgucgacggaauuguagcaauagaccuagauccaguaguauaugaugcaaaguucgagaaacaacuuggucaaaucaugcuccuaauccuuugcacaucacaaauccuccuuaugaggacgaccugggcacuaugcgagucaauaacacuagccaccgggccguuaacgacucuaugggaaggcuccccgggaaaauucuggaacacuacuauagcagugagcauggcgaacauauuccgggguaguuauuuagccggagcagggcucgcauucucuuuaaugaaaagccuaggcgguggucgacgagguacgggugcacagggggaaacgcuuggggaaaaauggaaaagacagcuaaaucaacucucaaaaucagaauuuaacacauauaagcgcucaggcauaauggaaguggaccgguccgaggcaaaagagggacuaaaaagaggagaaacgaccaaacacgccgucucccgaggaacagcgaagcuccgcugguucgucgagagaaaccuggugaaacccgaggguaaaguuauagaccucggcugcgggagaggaggauggaguuauuacugcgcaggccuuaagaaagugacagaagucaaaggauauaccaaagggggaccgggacacgaggaaccgauuccgauggcuaccuacggauggaaccucguaaagcugccaagcgggaaggacguauucuucaugccaccggaaaagugugacacauuauuaugcgauaucggcgaaagcucacccaauccaacaaucgaagaggggcgcaccuugagaguccucaaaauggucgagccguggcuucgagggaaccaauucugcauaaaaauccuaaauccauacaugccauccguuguagagacccuagaacaaaugcaacgaaagcacggagggaugcucgugcgcaacccccugagccgaaauucaacacacgaaauguacuggguaucauguggcacugguaacauaguuagugcggugaacaugacgucaaggauguuguuaaaccgauucaccauggcacaccgaaagcccacauacgaacgcgacguagauuugggcgccggcacgagacacguugcgguggagccggagguagccaaucucgacauaauuggccagcgaaucgaaaauaucaaaaacgagcacaagucgacauggcauuacgaugaggacaacccguauaaaacuugggcguaucacggguccuacgaaguaaaacccucuggaagcgccucgagcauggugaacgggguagucagacugcugacaaaaccaugggauguaauaccaauggugacacaaauagcaaugacagauaccacccccuucggccagcagcgagucuucaaagagaaaguagauacgcgaacaccgcgagcaaaacgggggacaacgcaaauuauggaggugacagccaaguggcucuggggguuucuuagccggaacaagaaaccgcgaauaugcacccgggaagaguucacgcggaaggugcggagcaacgcggcgauuggugccguauucguagaugagaaccaguggaacagcgcgaaggaagccguggaggacgagcgcuucugggaucucguucaccgcgaaagagaauuacauaaacaaggcaagugcgccacgugugucuauaacaugauggggaaacgugagaagaaacucggagaguucggaaaagccaaagguagucgcgcgauaugguacaugugguuaggagcaagguuucucgaauuugaagcgcugggcuucaugaaugaggaccacugguucagccgugaaaauagccucucagggguagaaggggagggucuacacaaacucggcuacauccuuagagacauaucaaaaauuccaggcgguaacauguacgcugacgacacggcgggcugggauacaaggauuaccgaggaugaucugcaaaaugaagcgaagauaacugaaauaauggagcccgaacacgcacuccuagcgacgagcauauuuaaauuaaccuaccaaaacaaaguuguacgcguacagagaccagccaaaaacggaacagucauggacguaaucagccggcgugaucaaagaggcagcggccaaguaggcacuuacggacuaaacacauuuacaaauauggagguacagcucauacggcaaauggaaagugaaggaauauuccugccaagugaacuggaaacaccaaaccucgcagagagaguccuagacuggcucgaaaaacauggagcagaacgacuuaaaaggauggcgaucucgggagacgacugugucguaaagccgauagacgacagauucgcaacagcauugacugcgcucaaugacaugggaaagguccgcaaagauaucccacagugggagccaucuaaaggguggaaugacuggcaacagguuccguuuuguucccaucauuuucaccaacuuaucaugaaagacgguagggaaaucgucgugcccugccguaaccaggacgagcuugugggccgagcccggguaagucagggggccggauggagccuaagagaaaccgcuugcuuggggaaguccuacgcccaaauguggcaacucauguacuuccaccgucgcgaccuaagacuugcagcuaaugcgauuugcucagcaguccccguagacugggucccaacuucaagaaccacguggagcauccaugcgcaucaccaauggaugacaacugaggacaugcucagcgucuggaaccgcgucuggaucgaagagaacccauggauggaagauaaaacccacguauccagcugggaagagguuccuuaccucgggaaacgugaagaccaguggugcggcagccuuauaggacuaacggcccgcgcaacaugggccacaaacauccaaguggcuaucaaccaaguuagacgccuaaucgggaacgaaaacuaccuggacuacaugacauccaugaagcgauuuaaaaacgaaagcgacccggaaggggcccuaugguaa

SEQ ID NO: 23878 - RNA, 9879 nt, Artificial Sequence
  derived and/or modified CDS sequence (opt11) from DENV-1__GQ868508__SS-prME
uccgucaccaugcuucuaaugcuucugcccaccgcgcuugccuuccacuuaaccacacggggcggcgagccccacaugaucgugagcaagcaggagcgagggaagucguuauuauuuaagacaagcgcaggggugaacauguguacccuuaucgccauggauuuaggcgagcucugcgaagacaccaugaccuacaaguguccccagaucacggaggccgagcccgaugacguggacugcuggugcaacgccaccgacacaugggugacauaugggaccugcagucagaccggcgaacaccggcgggacaagcguuccguggcccuggcgccccacgucggcuuaggcuuagaaacccggaccgaaacuuggaugagcagugagggugcauggaagcagauccagcgcgucgagaccugggccuugcgccaccccggguucacagucauugcccuauuccucgcccacgcaaucggcacgaguauuacacagaaggggauuaucuuuauccugcuaaugcucguuacccccaguauggccaugcgcugcguagggauuggcaauagagauuuuguagaggggcugagcggggcaacuuggguggacgucgugcuggaacacggcuccugcgugaccaccauggccaagaacaagcccacuuuggacaucgagcugcugaaaacggaggucacaaauccagcuauccugaggaagcugugcauagaggcuaagaucaguaacacuaccacggacuccagaugcccaacccagggcgaggcgacucuagucgaggagcaggacgcuaacuuugugugccgucguaccuucgucgaccgugggugggggaacggcugcggucuguuuggcaaggggucccugcucacgugugccaaguuuaagugcguaaccaagcucgagggcaagauuguucaguacgagaaccuaaaguauagcgugaucgugaccgugcacaccggagaucagcaccaggucgggaacgagacgacggagcacggcaccaucgcaaccaucacgccgcaggcccccacgagcgagauccagcugaccgacuauggagcgcucacccuggauugcagcccccggaccggccucgacuucaacgagaugguucucuugacuaugaaggaaaagaguuggcuaguacacaagcagugguuccucgaucucccgcuacccuggaccucgggagccucuaccucccaggagaccuggaauagacaggacuuguuagugacguucaagaccgcccaugcgaaaaaacaggaaguggucguucugggcucccaagagggugccaugcacaccgcacucaccggggccacggagauccagaccaguggcacgacuacgauuuucgcugggcaucucaagugccggcuaaaaauggacaaguuaaccuugaagggcaccucguaugugaugugcacuggguccuucaagcuugagaaagagguugcggagacgcaacacgggacugugcuggugcaggucaaauacgaagguaccgacgccccgugcaagauccccuucucuacccaggacgaaaaaggggugacgcagaaugggcgacucauaaccgccaacccuaucgugaccgacaaggagaaacccguuaacaucgagaccgagccccccuucggagaguccuacaucguggugggugcaggcgagaaagcucucaaacuaucuugguucaaaaaggggagcuccaucggcaagauguucgaggccacugcccgcggggcccggcggauggcaaucuugggagacaccgccugggacuuuggaucaauuggcggcgucuucaccuccguagggaaguugguccaucagguguucggcacggccuacggggugcuguucaguggcgugucauggacgaugaaaaucgggaucggcauccuccugacuugguugggccucaacucacgguccaccucucuguccaugaccugcauagccgucgggauggugacacucuaucucggcgugaugguccaggcagacagcgggugcgugaucaauuggaaaggccgugaguuaaagugcggguccgggaucuucgugaccaaugagguccauacuuggaccgagcaguacaaguuccaagccgacucaccgaagcgacugagcgcggccaucgguaaggcuugggaggagggagugugcggaauccgcuccgccacgcggcuagagaacaucauguggaagcagaucagcaacgaacugaaccacauacuacucgagaacgauaugaaauucacgguugucgugggcgacgccaacggcauccuggcacagggaaagaagaugauccgcccacagccaauggagcacaaauacaguuggaaguccugggggaaggcgaagauuaucggagcagauauccagaauacaacuuucaucauugaugggccagacaccccggagugccccgacaaucagcgggccuggaacaucugggagguggaggacuacggcuucgguaucuuuacaaccaacauauggcugaaguuacgagauucuuauacccagaugugcgaucaccgccugaugagcgcggccaucaaggacaguaaagccguccaugcugacaugggcuacuggaucgagagcgagaagaacgagaccuggaagcuggccagagcgaguuucaucgaggugaagacgugcaccuggcccaagagccacacccucuggucuaacggagugcuggagagcgaaaugaucauacccaagauuuacgggggcccgaucucccagcacaacuacagacccgguuauuucacacagacggccggcccauggcacuugggaaaacucgagcuggacuucgaucuaugcgaagggaccaccguggugguugacgagcauuguggcaaucgagggccgucgcuacggaccacgacagucacgggcaagaucauccacgaaugguguugccgcuccugcacccugccaccccuacgguuccggggggaggacggcugcugguacgggauggagauccgacccgugaaggagaaggaggaaaaccucgugcgauccaugguauccgccggcagcggcgagguggauagcuucucccugggcauccugugcgccagcauuaugauagaggaggugaugcggucgcgguggucgcggaagaugcucaugaccgggacccuagccgucuuccuucuccuaguuauggggcagcugaccuggaacgaccucauccgccuaugcauaauggugggcgcgaacgccuccgaccgcauggggauggguaccaccuacuuagccuugauggccacuuucaagaugcggccaauguuugcagucgggcugcucuucaggcgguugaccagccgcgagguacugcugcucacaaucggucuaagucuggucgcaagcgucgagcuccccaauagccuggaggagcugggcgacgggcucgccauggggauuaugaugcugaaguugcuaacggaguuccagccgcaccagcuguggaucacccuacucucgcugaccuucaucaaaaccacgcuaucccuagacuacgcuuggaagacuacugcaauggcgcugagcaucguuucccuguucccccucugcuuaagcacaacgucccaaaaaacaacuuggcuuccgguccuccucgguucguucggaugcaagccucugaccauguuccucaucacagagaauaaaaucugggggaggaaauccuggccucugaaugagggaauuauggcgaucgguaucgugucuauccuacuguccagccuguugaagaacgaugugccccucgccgggccauuaauagccggcggcaugcugauugcguguuacgucauaagcgguuccagcgcggaccucucccuggagaaggccgccgaggugucuugggaacaggaggccgagcacuccggcacaagccacaacauccuaguggagguacaggacgacggcacuaugaagauaaaagacgaggagcgcgacgacacacucaccauccugcugaaggcgacguugcuggcggugaguggcguguaccccaugaguauacccgccacccuguucgucugguacuucuggcagaagaaaaagcagcgguccggggugcugugggauacccccagcccgccagaaguggaaagagccguccuugaugacggaaucuaccggauccugcagcgcggucuguugggccggucccaggugggcgugggcgucuuccaagacggcguguuccauacuauguggcacguuacaaggggggccguccugauguaccagggcaaacgccuagaacccuccugggccucugugaagaaggaccucaucuccuauggcgggggcuggagguuucaggggucguggaauacgggcgaagagguucaggucauugcgguggagcccgggaaaaacccgaagaacguccagacaaugccagguacauucaagaccccugaaggugagguuggggccauugcacuggacuucaagccaggcacaagcgggucccccauuguuaaccgggaggggaagaucgugggacucuacggaaauggcguggugaccaccagcggaaccuacgugagugccaucgcccaggcgaaggcuucucaggaaggcccucuccccgagauugaggacgaagucuucaaaaagcgcaaccugacgauuauggacuuacacccggggucuggaaagacccggcgcuaccugcccgccaugguacgugaggccaucaagcgcaaguugcggaccuuaauucuggcgcccacgcggguggucgccuccgagauggccgaagcucugaaggggaugccaauccgcuaccagaccaccgccgucaagagcgaacauacugggagggagauuguagaccucaugugucacgcgacuuuuaccaugcgccucuuaucaccagucagggugcccaacuauaauaugaucaucauggacgaggcgcacuucacugacccugccucgaucgccgcuaggggcuauaucucaacccgggucgguaugggcgaggcggccgcgauuuucaugacggccacgccgcccggcagcguagaggccuuuccgcaauccaaugcggugauccaggacgaggagcgcgacauuccagagcggagcuggaauuccggauacgacuggaucacggacuuucccggcaagacugucugguucguccccuccaucaaguccgggaacgacaucgcaaacugccuacgcaagaacggcaagcgagugauacaacucucgcgcaagacguucgacaccgaauaccagaagaccaaaaacaacgacugggauuacgugguaaccacagacauauccgagaugggagcaaacuuccgggccgaccgcgugaucgauccacggcguugccuaaaacccguuauccugaaagacggcccagagcgggucauucuugcggggccgaugccggugaccguggccagugcugcccagcgacgggggagaaucggacggaaccagaacaaagagggcgaccaauacgucuacauggggcagccccugaauaacgacgaggaccacgcccacuggacugaggcgaagaugcuccucgauaacauaaacacgcccgaagggaucaucccggcccuuuucgagccagagcgcgagaagucagccgccaucgacggggaguaccgccuaagaggggaggcccgaaagacguucguggaguugaugaggcgcggggacuuacccgucuggcugaguuacaagguugcguccgaaggcuuccaauacagcgacaggcgcuggugcuucgacggggagcgcaacaaucagguuuuagaagagaacauggacgucgagauauggacuaaggagggugagcguaagaagcugcggccccgcuggcuggacgcaaggaccuauucggaucccuuggcccugcgcgaguucaaagaguucgcggccgggcggcgaucagugagcggcgaccugauccuggaaauaggcaagcuuccacaacaucugacacuccgggcccagaacgcccuggacaaccuuguuaugcuccacaacagugaacaggguggaaaggccuaccgccacgccauggaggaguuacccgacaccaucgagacgcugaugcuccuagcgcugaucgccguccucaccgggggggugacccuauucuuccugagcgguaagggauuaggcaaaacuucgauaggucugcuaugcguuacggccagcagugccuugcucuggauggccagcgucgagccgcauuggauugcggccuccauaaucuuagaauucuuccucaugguacugcugauaccagagcccgaccgucaacgcacgccccaagacaaccagcucgccuaugugguuaucggcuugcuguuuaugaucuugaccgucgcugcaaacgaaauggggcugcuagagaccacgaagaaggaccuuggcaucgggcacguggcagccgagaaucaucagcacgccacaaugcuugacguugaccugcgaccggccucugccuggaccuuguaugcgguggcuacgacagugaucacacccaugaugcgccacacgauagaaaacaccacggccaauauaucauugaccgccaucgccaaccaggccgccauccugaugggucucgauaaggguuggccgaucaguaaaauggauaucggggucccccugcuugcgcucggcugcuacucccaaguaaacccucuuacuuugaccgccgcgguguuaaugcuggucgcccacuacgccauuaucgggcccggcuuacaggcuaaggccacacgggaggcgcagaagcgcacggccgccgguaucaugaagaaccccaccguggacggcauaguggccaucgaccucgaccccgucguguacgaugccaaguucgaaaagcagcugggucagauuauguuacucauccugugcacuagccagauccugcucaugcguacgaccugggcccugugcgagaguauaacgcuggcuaccggcccgcucacuacccuuugggaaggaucucccgggaaguucuggaacacaaccaucgcgguguccauggcuaacaucuuccggggaagcuaccuggccggcgcggggcucgcuuucagccugaugaagucgcuuggcgggggccgccgagggacgggugcgcaaggggagacacuaggggagaaguggaagcgccaguugaaccagcuaaguaagagugaguucaacacauacaagcggucgggcauaauggaagucgaccgcuccgaggccaaggaggggcucaagcggggcgagacaacgaagcacgcggugagccgcgggacggcgaagcugcgcugguucguugaacgcaaccuggucaagcccgagggcaaagugaucgaccugggcuguggacguggcgguuggucguacuacugcgccggucucaagaaggugaccgaggucaaagguuacacuaaaggcgguccaggccacgaggagccgauucccauggcuacauacggcuggaaccugguuaagcuccacagcgggaaggacguuuucuucaugccgcccgaaaagugcgacacccuccugugcgacauaggagagucgucuccaaaccccaccauagaagaagggcgcacacugcgcguccucaagaugguagagcccuggcugcgcggcaaucaguucugcauaaaaaucuuaaaccccuacaugccguccguggucgaaacgcucgagcaaaugcagcgcaagcacggagggaugcuggucagaaacccccugucucggaacuccacgcacgagauguacuggguaagcugcggcacggggaauaucguauccgccguuaacaugaccucgcguaugcuccugaaccgauuuacgauggcgcaccgcaagccgacauacgagcgcgacgucgaccugggcgccgguacccgucacgucgcagucgaacccgaaguggccaacuuggacaucaucggacaacgcauugagaauauaaagaacgagcacaaauccaccuggcacuaugacgaggacaaccccuacaagaccugggccuaccacggcaguuacgaggucaagccuuccgggagcgccuccagcauggugaaugguguggugcggcugcugaccaagcccugggacgugaucccuauggucacccagaucgcaaugaccgacaccacccccuucgggcaacagcgcguguuuaaggagaagguggacaccaggacgccgagggcuaagaggggcaccacucagaucauggaggucaccgccaaguggcucuggggcuuucuaucccgcaauaaaaagccccgaauuugcacucgcgaggaguucacacguaaaguacgcaguaaugccgcgauuggcgccgucuucgucgacgaaaaccaguggaauucggcaaaggaggcaguugaggaugagcgguucugggaucugguucacagagaacgggagcuccacaagcagggcaagugugcgacguguguauauaacaugaugggaaagcgggagaagaagcugggcgaguucgggaaagccaaaggcucgcgggccaucugguacauguggcuaggcgcgcgguucuuagaguucgaagcccuggguuuuaugaacgaggaccacugguucagccgugaaaacagccugagcggcguggaaggggagggacuccauaaacugggguacauccugcgcgauauaucgaagaucccggguggcaauauguacgcggacgacacggcagggugggacaccagaaucaccgaagacgaccuccagaacgaggcgaagauuacagaaaucauggagccugagcacgcccuacuggcaaccucaauauucaagcuaaccuaucagaauaaagugguacgcgugcagcgccccgcgaaaaacggcacgguaauggacgucauuucccggcgugaucagcggggcagcggacaagugggcacguacgggcucaacaccuucacuaacauggaggugcaacugauccggcagauggaguccgagggcaucuuccuccccagcgaacuggaaacgccaaaccuggccgagagaguccucgacuggcuggagaagcacggggccgagcgucugaagaggauggccaucucaggcgacgauugcguaguuaagcccaucgacgaccgcuucgccaccgcgcucaccgcacugaacgauauggggaagguccgcaaagacaucccacaaugggagcccaguaaggguuggaacgacuggcagcaggugccuuucugcucccaccacuuccaccagcugaucaugaaggacggccgcgaaauuguggucccaugcagaaaccaggaugagcuuguggggagggccagagugucgcagggggccgggugguccuuacgcgagacugccugccugggcaagagcuaugcgcagauguggcagcucauguacuuccaccggcgcgaccuccggcucgccgcgaaugcgaucuguagcgccguucccguggauuggguacccaccagucgcacgacguggagcauccacgcccaccaccaauggaugacgaccgaagacaugcucuccguuuggaaucggguuuggaucgaggaaaauccguggauggaggacaagacacacgugaguucaugggaggagguccccuaccuagggaagcgcgaggaccaguggugcggcucucuaauaggucugaccgcccgcgccaccugggccaccaauauccaaguggccauaaaccaggugcggcgccuuaucgggaaugaaaacuacuuggacuacaugaccuccaugaagcguuuuaaaaacgaaagcgaccccgagggugcacucugguga

SEQ ID NO: 23879 - RNA, 9879 nt, Artificial Sequence
  derived and/or modified CDS sequence (opt11) from DENV-1__GQ868509__SS-prME
agcgugaccaugcugcucaugcugcugccgaccgcccucgccuuucaucuuaccacacguggcggggagccccacaugaucgucuccaagcaggagcggggcaagagccucuuguucaagaccucggcaggugugaacaugugcacucugaucgccauggaccugggggagcucugcgaagauaccaugaccuauaagugcccccagaucaccgaagccgagcccgacgacguggacugcuggugcaacgccacggacacaugggucaccuacggcaccugcucgcagaccggcgagcaccgcagggauaagcgcucuguggcccuggcuccccacguuggcuugggacucgaaacccggaccgagaccuggaugagcucugagggcgccuggaagcagauccagcgcguugagaccugggcacuucgacacccuggguucacggugaucgccuuguuccucgcgcaugccauagguacgagcaucacccagaaggggauuaucuucauccuacuuaugcucgugacucccuccauggccaugcgcugcgucgggaucggcaaccgcgauuucguggaggguuugagcggggcgacauggguggacgucgugcuggagcacggguccugcgugaccaccauggcgaaaaacaagcccaccuuggacaucgagcugcugaagacggaagucacuaaucccgcaauccuccgcaagcugugcaucgaggccaagaucagcaacaccaccacggauucccgguguccgacgcagggcgaggccacacugguggaggagcaggacgcuaauuucgugugccgucggaccuucgucgaucgcggcuggggaaacggcugcggccuauucgggaaagggagccugcuuacgugcgccaaguucaagugcgugaccaagcucgagggcaaaaucgugcaauacgagaacuuaaaguacuccguuaucgugaccgugcacaccggugaccagcaccaggucgggaacgagacaaccgagcacggcaccaucgcuaccaucacgccccaggcucccacgagcgagauccagcugacugacuacggcgcccuuacgcucgacugcagcccccggacgggccuggacuucaaugagaugguucuccuaacgaugaaggagaaauccugguuaguacacaaacagugguuccucgaccuuccgcugccguggaccuccggugcaaguaccagccaggagaccuggaaccgccaggaucuccuggugacuuucaagaccgcccacgcgaagaagcaggaagugguagugcugggcucccaagagggggccaugcacacugcacucaccggggccacggagauacagaugagcggcaccacaacuaucuuugcaggucaccugaagugcagacuaaagauggacaaacucacgcugaagggaaccuccuaugugaugugcaccgggagcuuuaaguuggagaaggagguggcggaaacacagcauggcacgguacuggugcagguuaaguaugagggcaccgacgcacccugcaagaucccauuuagcacccaggacgagaagggggugacgcagaacggccgccucaucacggcgaaucccaucgugaccgauaaggagaagcccgucaauaucgagaccgaacccccauucggggagucuuauaucguggugggagccggcgaaaaggcgcugaagcuguccugguuuaagaaggguagcuccaucggcaagauguuugaggccaccgcccgcggggccagacggauggccauccucggcgacacggcuugggacuucgggagcauuggcggcgucuucacguccguggggaagcuggugcaucaggucuucggaacugccuacgggguacuguuuucuggcguguccuggacgaugaaaauagggaucggcauccuuuuaacgugguugggccuuaacagccgcuccaccucucugucuaugaccugcaucgccgucgggauggugaccuuauaccucggugugaugguccaggccgauagcgggugcgugaucaauuggaaaggccgggaacugaagugcggguccggcaucuucgugacgaaugagguucacacuuggaccgagcaauacaaguuccaggccgacagcccgaagcgccuuuccgcagcuaucggcaaggccugggaggaaggggugugcgggauacgauccguaacccggcucgagaacaucauguggaaacaaaucagcaacgaacugaaccauauccucuuggagaacgacaugaaauucaccguaguggugggggacgcgaacggcauacuggcccaagggaagaagaugauuaggccacagcccauggaacauaaauacuccuggaagucauggggcaaggcgaagauaaucggagccgacauacagaacaccaccuucauuaucgacgggcccgacacaccggagugcccagacaaccagcgggccuggaacaucugggaagucgaggauuacggcuucgggaucuucaccacgaacaucuggcugaagcucagagacuccuauacccagaugugcgaccaccggcuuaugucugccgcaauuaaagacaguaaagccgugcacgccgauaugggcuacuggaucgagagcgagaagaacgagaccuggaagcuggcccgcgccucuuucaucgaggugaagacgugcacguggccuaagagccacacucuaugguccaauggggugcuggagagcgagaugaucauccccaagaucuacgggggcccuauaucccagcacaacuaccgucccggauacuucacgcaaacagccggcccuuggcaccuugggaagcucgagcuggacuucgacuuaugcgagggcacgaccguggugguugacgagcacugcggcaaucgcgguccgucucuccgcaccaccacgguuaccggcaagaucauccaugaguggugcugccgcuccugcacccucccgccccuccgauuccgcggagaggacggcugcugguacgggauggagauucgacccgugaaggagaaggaggagaacuuagugcggagcaugguguccgccggcucuggcgagguggacuccuucuccuuggggauucugugcgccagcaucaugaucgaggagguaaugagaucuagauggagccguaagaugcuaaugaccggcacgcuggccguguuccuacuccugaucauggggcagcugaccuggaacgaccucauccgccuguguaucauggugggggccaacgcguccgaccgcauggggaugggcaccaccuaucuggcccucauggccacguucaagaugcggcccauguucgccgucggucugcuguuccggcggcucacgucucgugagguccuucugcucaccaucgggcugucccugguggcaucuguggagcuccccaauucgcuugaggagcugggggacgggcucgcgaugggcaucaugaugcugaagcuccucaccgaguuccaaccccaccagcuguggacgacccugcucagccugaccuucauaaaaaccacgcugucccuagacuaugccuggaagacaaccgccauggcacugagcaucgugucccuguuuccgcucugccugagcaccacgucccagaagacaaccuggcugccaguccuccuaggcuccuucgguugcaagccccugaccauguuccucauaaccgagaacaagaucuggggcagaaaguccuggccccugaaugaaggaauuauggcuaucggaauugugagcauccugcucuccagucugcugaaaaacgacgugccgcucgccgggccgcugaucgccggcggaaugcugauugccugcuacgucaucucuggguccucugccgaccuuuccuuggagaaggcagccgaagugagcugggagcaggaggccgaacacuccgguacgagccacaauaucuugguggagguccaagacgacggcaccaugaagaucaaggacgaggagcgcgacgacacccucaccauccugcugaaggccacgcucuuagccguguccggcguguaccccaugagcauccccgcaacccuguucuuaugguacuucuggcagaaaaagaagcagcgcuccgggguacugugggacaccccuagcccucccgagguggagcgcgccgugcuugacgacggaaucuaccgcaucuuacaacgcggccuacuggggcggucccaaguuggcguggggguguuccaagauggcguauuccacaccauguggcacgugacgcgcggcgccguacuaauguaccagggcaagagguuagagcccagcugggccagugucaagaaggaccugaucagcuacggcggggguuggcgcuuucaggggucuuggaacacaggcgaggagguccaggugaucgccguagagccuggcaagaacccgaagaacgugcagaccacccccggcacguucaaaacccccgagggcgaggugggggcgauagcccuggacuuuaagccuggcaccucugggucuccgaucgucaaccgcgagggcaagaucgugggccucuacgggaacggaguggucacaacgagcgggacauacguguccgccaucgcccaggccaaggcgagccaagagggcccgcuacccgagaucgaggacgaaguguucaaaaagcgcaaccuaaccaucauggaccuccacccggggagcggcaagacccgccgauacuuacccgccaucguaagggaggcuauaaagcgcaagcuacggacucucauacuggcucccacgcgcgugguggcguccgaaauggcagaggcccuaaaggguaugcccauccgauaccagacgaccgcgguaaaaagcgagcacacgggaagagagaucguggaucucaugugccacgccaccuucaccaugcgucugcugucccccgugagaguccccaacuacaacaugaucaucauggacgaggcccacuucacggauccggccagcaucgcggcacgaggcuacaucaguacgagaguggggaugggcgaagccgcggccaucuuuaugaccgcuacgccgcccgggagcguugaagcguucccgcagagcaacgccgucauacaagaugaggagcgcgacauccccgagcggucguggaacuccggcuacgacuggaucaccgacuucccuggcaaaacagugugguucgugccauccauuaagagugggaacgacaucgcgaacugccuccgcaagaauggcaagcggguuauccagcucagccggaagaccuucgacacggaguaccaaaagacuaagaauaacgacugggacuacguuguaaccaccgauaucucugagaugggagccaacuuucgcgccgaccgcgucaucgacccccggcgcuguuugaagccagugauucucaaggacggcccggagcggguaauccuugccgggccgaugcccgucaccguggcguccgcggcccagcgcagaggccgcauaggccggaaucagaauaaggagggugaccaguacguauacaugggccaaccccugaacaacgaugaggaucacgcacauuggacagaggcgaaaaugcuccuggacaacaucaauacgccagaggggaucaucccggcccuguucgagcccgagcgcgagaagucugccgccauagacggcgaguaccgucuccgcggggaggcccgcaagaccuuugucgagcugaugcggcgcggugaccuccccguuuggcucuccuacaaagucgcgucugagggcuuccaguacagugaccggcgcuggugcuucgacggggagcggaacaaccagguccuagaagagaacauggacguggaaaucuggacaaaggagggugagcgcaagaagcugcggccccgguggcucgacgcucggaccuauuccgacccacuggccuuaagagaguucaaggaguucgccgccgggcggcggagcgucagcggagaucucauucuggaaaucgguaaacucccccaacaccuaacccuccgggcccaaaacgcccuggacaaccucguuaugcugcacaauagugagcaggguggaaaggccuaucgccacgccauggaggagcugcccgacacgauugagacccucaugcugcuggcccucauugcagugcugacggggggggucacccuguucuuccucagcgggaaaggccuuggcaagacguccaucgggcuacucugugugaccgccucguccgcucugcuauggauggcguccguugagccccacuggauagccgccuccaucauccuggaguucuuccugaugguccuacucaucccggagccggaccggcagcgcacgccccaggauaaccagcuggcuuacguggugauaggccuccuauuuaugaucuugaccguugcugccaacgagauggggcuacuagagacgacgaagaaggaccuggggaucgggcacguggccgcggagaaccaucagcacgccaccaugcuggacguagaccuccgacccgccagcgccuggacgcuguacgccgucgcgacgaccgugaucaccccaaugaugcgucacacaaucgagaauacgaccgccaacaucucccugaccgccaucgcgaaccaggcugcgauacucaugggccuggacaagggcuggcccauuucaaaaauggacaucggggugccgcugcucgcccuaggcugcuacucgcaggugaacccccugacccuaacggccgcaguguuaauguugguggcgcacuacgccauuaucgggccaggucuccaagcaaaggccacgcgggaggcccagaaacgcaccgcggcagggauuaugaaaaaccccacagucgacggaaucguugccaucgaccuggauccaguggucuacgacgccaaguuugaaaagcagcuggggcagauuaugcuccugaucuuauguacgagccagauccuccugaugcgcaccaccugggcccugugugaguccaucacccucgcgacgggcccccugaccacucugugggaggguagcccagggaaguucuggaacaccacgauugccguauccauggccaacauuuucagaggcagcuaucucgcgggugccgggcuggcuuuuucccugaugaaaucccucggcggaggccgccgagggacgggcgcccagggugaaaccuuaggggagaaguggaagaggcagcugaaucaauugagcaagagcgaauucaacaccuacaaacggagcgggauuauggagguggaccgaucggaggccaaagagggccuuaagcggggugaaacgaccaagcacgccgucagccgcgggacagcgaagcugcggugguucguggagcgcaaccucgugaagcccgaggguaaagucauugaccuuggcugcggacggggcgggugguccuacuacugugccggccugaagaaggugaccgagguaaagggcuauaccaagggcggcccgggccacgaggaacccauccccauggcgacguacggauggaaucuggucaagcuccacagcgggaaggacgucuucuucaugccgcccgagaagugcgauacccuguugugcgacaucggagaauccagcccgaaccccaccaucgaggaggggcgcacacuccgcgugcugaagaugguggaacccuggcugcgcggcaaucaauucugcaucaagaucuugaaccccuacaugcccuccgugguggaaacccuugagcagaugcaacggaagcacggcgggauguuaguucgcaauccucucucgagaaacucuacgcacgagauguacugggucaguugcggaaccgggaacaucguguccgccgucaacaugacgagccgcaugcuccugaaccgguucaccauggcccacaggaagcccaccuucgagcgcgauguggaccucggcgcgggcacuagacacguugccgucgagcccgagguggccaaccuggacauuaucgggcagcggaucgagaauaucaagaacgagcacaaguccaccuggcacuacgacgaggacaacccguacaagacgugggcuuaucacggcagcuacgaggugaagcccuccggcuccgccagcagcaugguuaacggcguagugaggcuauugaccaagccuugggacgucauccccauggugacccagauugcgaugacugauacgaccccauuugggcagcagcgugucuuuaaggagaagguggacacccggacgccgcgggccaagcgaggcacgacccagauuauggaggugaccgccaaguggcuguggggcuuccugucccgcaacaagaagccccggaucugcacuagggaggaauucacgaggaagguccgcagcaacgccgcaaucggggcgguguucguggacgagaaccaauggaauagcgccaaagaggccgucgaggacgagcgguuuugggaccucguccaccgcgagcgggagcugcacaagcagggcaagugcgcgaccugcguguacaacaugauggggaagcgcgaaaagaagcugggcgaguucgggaaagcaaagggcucccgcgccaucugguauauguggcugggcgcgagguuccuggaguucgaggcccugggguucaugaacgaagaucauugguucagccgggagaacucccucagcggggucgagggggagggccugcacaagcugggguauauccuccgcgacauaucuaagaucccgggcggcaacauguacgccgacgacacagccgggugggauacgcggaucacggaagaugaccuacaaaacgaggccaagaucacagacaucauggagccugagcaugcgcugcucgccaccagcaucuucaagcugaccuaucagaacaaaguugugcgcguccaacggcccgcaaagaacgggacggugauggacguuaucucccgccgcgaccagcgggggagcggccagguggggaccuacgggcuuaacaccuucacgaacauggaggugcagcucauucgccagauggaaucagaaggcaucuucuugccuagcgaauuagagacaccgaaucucgcggagcgggugcuggacuggcuggagaagcacggggccgagcgccucaagaggauggccaucuccggagacgauugcgucgugaagccuaucgacgaccguuucgccacggcccuuaccgcgcuaaacgacaugggcaaggugcggaaggacaucccucagugggaacccagcaagggcuggaacgauuggcaacaggucccauucugcagccaucacuuucaccagcuuaucaugaaggauggccgcgagaucguggugccuugucggaaccaggacgagcuggucgggcgugcccgagugucccagggcgcaggauggucccugcgugagaccgcuugccucgguaagagcuacgcacagauguggcaacuaauguacuuucaccggcgcgaccugagacuagcggcgaacgcaaucuguuccgccgucccggucgacugggugcccacuagucguacgacuuggucaauucacgcacaccaucaguggaugacgaccgaagacaugcugucuguguggaaccgggucuggauugaagagaacccguggauggaggacaagacgcauguaagcuccugggaggaggugcccuaccuggggaagcgcgaggaucaauggugcggcagccucaucggccugaccgcccgcgccacaugggcaaccaacauccaagucgcgauuaaucaagugcgccgccuuauugggaaugagaacuaccucgacuauaugacuagcaugaagcgguucaagaacgagagcgacccugagggcgcgcugugguga

SEQ ID NO: 23880 - RNA, 9879 nt, Artificial Sequence
  derived and/or modified CDS sequence (opt11) from DENV-1__GQ868510__SS-prME
agcgugaccaugcugcuaaugcugcugcccaccgcccucgccuuucacuugaccacccgggguggggaaccccacaugaucgugucuaaacaggagcggggcaagagccuccucuucaagaccagcgcgggugugaacaugugcacccuaauagccauggaccugggcgagcucugugaggacaccaugaccuacaaguguccccagaucacagaggccgaacccgacgacguagacugcuggugcaacgcaacggacacgugggucaccuaugggacguguagccagaccggcggccaccgccgggaaaagcgcuccguggcacuggcgccccacguagggcugggacucgagacgaggacugagacguggaugagcuccgagggagccuggaagcagauccagcggguagagacaugggcccugcggcaccccggcuuuacgguaaucgcccuguuccucgcgcacgcgaucgggaccagcaucacccagaagggcaucauauucauccugcugaugcuggugacacccuccauggcaaugcguugcgucgggaucggcaaccgggacuucguagaaggccugagcggagccacguggguagacgugguucuggaacacggaucgugcgugaccacgauggccaagaacaagcccacccucgacaucgagcuccugaagacggaggucaccaaccccgcgauccuccgcaaguugugcaucgaggccaagaucagcaacacaacgacggacucccggugcccgacucagggcgaggccacccugguugaggagcaggaugccaacuucgugugcaggcgcaccuucgucgaccguggauggggcaaugggugcggccucuucgggaaaggcucccugcugacgugcgccaaguucaagugcgugaccaaacucgagggcaagaucgugcaguacgagaaccugaaguauuccgucaucgugacagugcacaccggggaccagcaucaggugggcaacgagacgacagagcaugggaccauugcgaccauaacgccccaggcccccacuucagagauccagcugaccgacuacggcgcccucacccucgacugcagcccccggaccgggcuggacuuuaaugaaauggugcuccugacgaugaaagagaaauccuggcugguccacaagcagugguuucuagacuugccccugcccuggaccuccggcgcuaguaccucgcaggagaccuggaaucgccaggaccuccuaguaaccuucaagaccgcccacgcgaagaaacaggaggucgucguccugggcucccaggagggggccaugcacaccgcccucaccggugccacggagauccagaccagcgggaccaccacuauauucgccggccaccugaagugcagauugaagauggauaagcucacccugaagggaaccuccuaugugaugugcaccggcagcuucaagcuggagaaggaggucgcggaaacgcagcacggcaccguccuggugcaggucaaauacgaggguaccgacgcaccaugcaagauccccuucuccacccaggacgaaaagggcgugacgcagaacggacgccucaucaccgcuaacccuaucgucaccgacaaagagaagcccgugaacaucgagaccgagccacccuucggcgagucuuacaucguggugggcgccggggagaaggcgcuuaagcuguccugguucaagaagggcuccucaaucgggaagauguuugaagccacggcccggggagcccgacggauggccauccuaggggacaccgcgugggacuuuggcagcauaggcggggucuucaccuccgugggaaagcuggugcaccagguguucgggaccgccuacggcguucuguucagcgggguguccuggacgaugaagaucggcaucggcauccuccucaccuggcuggggcucaauagccgcucgaccagccuguccaugaccugcaucgccgucggcaugguaacgcuauaccucggggugaugguccaggccgacuccggcugugucaucaacuggaaggggcgcgagcugaagugcggguccggcaucuucgugaccaacgaaguccacaccuggacugagcaguacaaguuucaggccgacagcccgaagcgucuuagcgcggccaucggaaaggcgugggaggagggugugugugggauacgcucagccacccggcucgagaacauaauguggaagcagaucucaaacgagcugaaccacauccugcucgagaacgacaugaaguucaccgugguagugggcgacgccaacgggauccuggcgcaggguaagaaaaugauccgcccccagccgauggagcacaaguacuccuggaaguccuggggaaaggcuaagaucaucggggccgacauccaaaacaccaccuucauaaucgauggccccgacaccccggaaugccccgacauccagcgugccuggaacaucugggagguggaggacuacggguucgggauauucacaaccaacauauggcugaagcuccgcgacuccuacacccagaugugcgaccaccgacucaugagcgccgccaucaaggacucaaaagcgguccacgccgacaugggcuacuggaucgagagcgaaaaaaacgagaccuggaagcuggcccgcgccuccuucaucgaggugaagacgugcaccuggcccaagagccacacccucugguccaacggggugcuugagagugaaaugaucauccccaagauuuacggcgggcccaucucccagcauaacuaccggcccggcuacuucacccaaacggcggggcccuggcaccugggaaagcucgagcuggacuucgaccugugcgagggaacgaccgucgugguugaugagcacugcgggaaccgcggcccgagccuccggaccacuaccgucaccgggaagaucauccacgaguggugcugccgcuccugcacguuaccgccccugcgcuuccgcggagaggacggaugcugguacggcauggagauccggccagugaaagagaaggaggagaaccucgugaggucaauggucuccgccggcucuggagagguggauagcuucucccugggcaucuuaugcgccagcaucaugauagaggaggugaugcggucccgguggagccguaagaugcuaaugacggggacgcuggcgguguuccugcuccugaucaugggucagcugaccuggaaggaccucaucagacugugcaucauggugggcgccaacgccucggaccguaugggcaugggcaccacauacuuagcccucauggccaccuucaagaugagaccgauguucgccguggggcugcuguucagacggcugaccagccgcgagguccugcuauuaaccaucggccugucccugguggcgagcguggagcuccccaacucccuggaggagcugggggacggccucgccaugggcaucaugaugcuuaagcuucucacggaguuccagccccaccagcuauggaccacccuacucucguuaaccuucaucaagaccaccuuaucccucgacuacgccuggaagaccaccgccauggcgcugagcauugucucacuguucccacucugucuguccacgaccucccaaaagacaacauggcucccgguacuccuggggagccugggcugcaagccccucaccauguuucuuaucacggagaacaagaucugggggcguaagucuuggccccugaacgagggcaucauggcuaucgggaucgucagcauccuccuguccagccugcucaagaacgacgugccccuggccggcccgcugauugccggaggaaugcucauagccugcuaugugaucagcggcuccagcgcugaccuuucgcuggagaaggccgccgaggucagcugggaacaagaggccgaacacucggguaccagccacaauauacucguggaggugcaggacgacgguacaaugaagaucaaggacgaggagcgcgacgacacgcugacgauacugcucaaggccacacugcuggcagucuccggggucuaccccaugagcauccccgccaccuuauucgugugguauuuuuggcagaagaagaagcagcgguccggcguccugugggacacccccagcccgcccgagguggagcgagccguccuggacgacggcaucuaccgcauccugcagcgcgggcuccugggccggucccaagucggcguggggguuuuccaggacggggucuuucacacgauguggcacguuacccgcggcgccgugcugauguaccagggcaagagacucgagcccucaugggccucuguuaagaaggaucugaucagcuacgggggcgguuggcgcuuccaaggcucuuggaauaccggggaggagguccaggugaucgccgucgagcccggcaagaaccccaagaacgugcagaccacgcccggcaccuucaagacucccgagggggaagugggcgccaucgcccuggacuuuaagccagggaccagcggcucuccgaucgucaaccgggagggcaagaucguggggcucuaugguaacggggugguuacgacaagcggcacuuacguguccgcuaucgcccaggcgaaagccagccaagaagguccccugcccgagaucgaggaugagguuuucaagaagcgcaaucugaccaucauggaccuccacccgggcagcggcaagacccggcgguaccuccccgccauuguccgggaggccaucaagagaaagcuccggacucucauccuggcccccacccgcgugguggccuccgagauggccgaggccuuaaagggaaugcccauccgcuaccagaccacugcuguuaagagcgagcacacaggccgggagaucguggaccucaugugccacgcaaccuucaccaugcgccugcugucgccagugcggguccccaacuacaacaugaucaucauggacgaggcccacuuuacggacccggccagcaucgcggcccgcggguauaucuccacgcgggugggcaugggggaggcggcagccaucuucaugaccgccacgccgcccggcagcguggaagcguucccccagucuaacgcugucauccaggacgaggaacgcgacauccccgagcgguccuggaacuccggauacgacuggaucacugacuuccccgggaaaaccgucugguucguccccagcaucaaauccggcaaugacaucgccaacugccuccgcaagaacggaaaacgggucauccagcugagccgcaagaccuucgacaccgaguaccagaagacgaagaacaacgacugggacuacguggucaccaccgacaucuccgagaugggcgccaacuuccgugcagauaggguaauagacccccggcgcugccucaagcccgugauucucaaggacggaccggagcgggugauccuggcgggcccgaugcccgucaccguggccagcgccgcucagcgcagaggccggaucggucggaaccagaacaaggagggcgaccaguacguguacauggggcagccccugaauaaugacgaggaccacgcccacuggaccgaagcgaagaugcuacuugacaacauuaacacccccgagggcaucaucccggcccuguucgagcccgagcgcgagaaauccgcugcgaucgauggcgaguaccgccuccggggcgaggccagaaagacguucguggaguuaaugaggcgcggcgaccugcccguguggcuuagcuacaaggucgcguccgagggguuccaguacagcgaucggcgcuggugcuucgacggcgagcggaacaaccaagugcuggaggagaacauggacguugagaucuggacgaaggagggggagcgcaagaagcugcguccccgcuggcucgacgcccggaccuacuccgacccacuggcccugcgcgaguucaaggaguucgcagccggccggagaagcgucagcggcgaucucauccuggagaucgggaaacugccccaacaccucacgcugcgggcgcagaacgcccuggauaaccucgugaugcugcacaacuccgagcaaggggggaaggccuaucgccacgccauggaagaauugcccgacaccaucgagacccuaauguugcuggcgcucauagccgugcuuaccggcggggucacgcuuuucuuccucagcggcaagggccucgggaagaccucuaucggucuguuaugcgugaccgccagcuccgcccuccuguggauggccagcguggagccccacuggaucgcggccuccauuauccucgaguucuuucucaugguccugcuaauaccggagccggaccggcagcgcacgccucaggacaaccaacuggcauaugucgugaucggucuccuguucaugauccucaccgucgcggccaacgaaaugggccugcucgagacuacaaagaaggaccuggggauaggccacguggccgccgagaaucaucagcaugccacuaugcuggacguggaccuucggccggccagcgccuggacguuguacgcggucgccaccaccgugaucacccccaugaugcgacacacgaucgagaacaccaccgccaacauuucccugaccgccaucgccaaccaagcugccauccucaugggccucgacaagggguggccgaucagcaagauggauaucggcgugccccuccucgcccucgggugcuacucccaggucaacccacugacgcuuacugccgcgguucugaugcugguggcgcacuaugccaucauaggccccggacuccaagccaaggccacacgggaggcgcaaaagcggaccgccgccggcauaaugaagaaccccacgguagacggcaucguugccaucgaccuggaccccgugguguacgacgccaaguuugagaagcagcuagggcaaauuaugcuccugauccugugcacaagccagauacuccugaugcgcaccaccugggcuuugugcgagaguauaacgcucgcaaccgggccgcugaccacccugugggaggggagccccggcaaguucuggaacacgaccauagccguguccauggccaacaucuuccggggcagcuaccucgccggggcgggccuggccuucucccugaugaagucccuagguggcgggcgccggggcaccggcgcccagggggagacccuaggcgagaaguggaagcgccagcuaaaccagcucuccaaguccgaauucaauacuuacaagcggagcgggaucauggagguggaucgcuccgaagccaaagaaggccucaagaggggggaaacaaccaagcacgcugucagccggggcacagccaaauuacggugguuuguggagaggaaccuugugaagcccgagggcaaggucauagaccucggguguggccgcgggggcugguccuacuacugcgccgggcugaaaaagguuaccgaggugaagggauacacgaagggcgggcccggccacgaggagccgauucccauggcuaccuacggguggaaccugguuaagcuccacucaggcaaggacguauucuuuaugccucccgagaagugcgauacccugcugugcgacauuggggaguccagcccgaaccccaccaucgaggagggccgcacgcuccgggugcugaagaugguugagcccugguugcgaggcaaucaguucugcaucaagaucuuaaaccccuauaugccguccgugguggaaacccuggagcaaaugcagcggaagcacggggguaugcuaguccgcaauccccucagccggaacuccacccaugagauguauugggugucaugcggaacgggcaacaucguguccgccgucaacaugacgaguaggaugcugcugaaccgguucaccauggcgcaccgcaaaccaaccuacgagcgcgacguggaucucggugccgggacccggcacguggccgucgagcccgagguggcuaaccuggacaucaucggacagcgcaucgagaacaucaagaacgagcauaagaguacguggcacuacgaugaggacaacccguacaaaaccugggcuuaccacgggagcuacgaggugaagcccuccgguucagcguccuccauggucaaugggguugugcgccugcucaccaagcccugggacgucaucccaauggugacgcagaucgcaaugaccgacaccaccccguucggccagcagcgagucuucaaggaaaagguggacacccggacgccccgugccaagcguggcaccacccagauaauggaaguaacugccaaguggcuguggggauuucugucccggaacaagaagcccaggaucugcacgcgcgaggaguucacccggaagguccgcagcaacgccgcaaucggcgccguguucguggacgagaaccaauggaacucagccaaggaggccgucgaggacgagcgcuucugggaccucguacaccgugagcgcgaguugcauaagcagggcaagugugcgaccugcguguacaacaugaugggcaagcgagagaagaagcugggggaauucggcaaagccaaaggcucccgggccaucugguacauguggcucggggcccgguuccuggaguucgaggcucuggguuucaugaacgaagaccauugguucagccgagagaacucccucucugggguggagggcgaggggcugcacaaauuaggcuacauucuucgcgauaucuccaagauaccgggcgggaacauguacgcggacgacaccgccggcugggacacgcggaucaccgaggacgaccugcagaacgaggcuaaaauaaccgacaucauggagcccgagcacgcccugcucgccaccagcauauuuaaguugacguaccagaacaagguggugcgcguccagcgcccggcgaagaacgggaccgugauggacgugaucucccggcgcgaccagcggggaagcggccagguagggaccuacggccuuaauacauucacgaacauggaggugcagcucauucgccagauggaguccgaagggaucuucuuacccuccgagcuggagacaccgaaccucgcagaacgggugcuggacuggcugggcaagcauggggccgagcgccucaagcgaauggcgaucaguggcgacgacugcgucgugaagcccaucgacgaccgcuuugcaaccgcgcugaccgcccugaacgacaugggcaaagugcggaaggacaucccccagugggagcccagcaagggguggaacgacuggcagcaggucccguuuuguucccaucacuuccaccagcucaucaugaaggacggcagagaaauagugguccccugucggaaucaggacgagcuggucgggcgcgcccgggugagccaaggugccgguuggucccugcgcgagaccgccugcuuaggcaagaguuacgcgcagauguggcagcugauguacuuccaucggcgcgaccugcggcucgcugccaaugccaucuguuccgcggugcccgucgacugggugcccacgagccgcaccacguggagcauccacgcgcaccaccaguggaugaccacggaggauaugcuguccguauggaaccgugucuggaucgaggagaacccguggauggaggacaagacccacgugagcuccugggaggaggugccuuaucuggggaagagggaggaucaguggugcgggagccucauuggacugaccgccagagccaccugggccacgaacauccaggucgcgaucaaucaagugcggagacugauaggcaacgagaacuaccucgacuacaugacauccaugaagcgguucaagaacgagagcgaucccgaaggcgccuugugguaa

SEQ ID NO: 23881 - RNA, 9879 nt, Artificial Sequence
  derived and/or modified CDS sequence (opt11) from DENV-1__GQ868511__SS-prME
agcguaacaauguuacucauguugcuaccgaccgcgcucgcuuuccaccugacgacucguggaggggaaccgcacaugauagucaguaaacaggaacgggggaaauccuuacucuuuaagacgagcgcgggggucaacaugugcacccuaauagcgauggaccucggagaacuuugcgaagacaccaugacguacaagugcccgcagaucacggaagcggaaccagacgacguggacugcuggugcaaugcgacggacacaugggugacauacgggaccugcagccagacgggggaacacaggcgagacaaacggaguguggcucuugcgccacacgucggguuaggguuagaaacacgcacagaaacuuggaugucaagugaaggcgcguggaagcaaauacagagaguugaaacaugggcacuucgacacccuggcuuuacugucauagcacucuuccucgcacacgcaaucggcacaucaauuacgcaaaaaggcauaauuuucauacuguugaugcuuguuacgccaucgauggcgaugcggugcgucggaauugggaacagagauuucguagaaggacuuagcggcgccaccuggguugacguaguacucgaacacggcucaugcguaacuaccauggcaaagaacaaaccaacguuagacauugaacuccucaaaaccgaaguaacaaacccagccauacuccggaaacugugcauagaagcuaaaauaucuaacacaaccacagacucccgcugucccacccagggagaagcaacccuagucgaagaacaagacgcuaauuucguuuguagacgcacauucgucgaccgggguuggggcaacgguugcgguuuguucggaaaggggucacugcucacgugcgcgaaguucaaaugcgucacuaagcucgaagguaagaucguccaguacgagaaccuaaaauacagugugauaguaacaguucacacgggugaccagcaccagguaggaaacgagaccaccgaacacgguaccaucgcgacaauaacaccgcaggcaccgacguccgaaauacaguugaccgauuacggugcccugacucuggauugcucaccaaggacaggccuggauuucaacgaaaugguacuucuuaccaugaaagaaaagaguuggcuaguccacaaacaaugguucuuagaccuaccgcuuccuuggaccagcggcgcgucuaccagccaggaaacuuggaaucgacaagaccuccugguuacauuuaaaacagcacacgcaaagaaacaggagguagugguccuaggcagccaagagggagcgaugcacaccgcgcucacuggagcaacugaaauccaaacaagcgggacaaccacaauauuugcagggcaccuaacgugcaggcucaagauggacaaauuaaccuuaaaggggacaagcuacgugauguguaccgguucauucaaacuagaaaaggaagucgccgaaacgcaacacggaacgguccuggugcagguaaaauaugaagggacggacgcaccaugcaaaauaccauuuaguacccaggacgagaagggaguaacacagaauggccgacugauaacggcaaaccccauugucacagacaaggaaaaaccgguaaacauagaaaccgagccgcccuucggagaaucauacaucgugguaggagcgggggaaaaagcgcuaaaacucagcugguucaagaaaggaucuagcauagggaagauguucgaagcuacggcgcgcggugcaaggaggauggcaauacuaggugacacugcgugggauuucggguccaucggggguguuuucaccucagucggcaaacugguccaccaggucuuugguacugcuuacggcguacuguucucaggcguaagcuggacaaugaaaaucggcaucggaauacuccucacguggcuaggccuaaacucgcgaagcacgagccucucaaugaccuguaucgcaguaggaauggugacacuauaccucggcguaauggugcaggccgacuccgggugugucaucaacuggaaaggucgggaacuuaagugcggaucgggcauauucgugaccaacgagguccacacguggacugagcaauauaaauuccaagcagacagccccaaacgcuugagcgcagcaauagggaaagccugggaggaaggggugugcggcauacggagugcgacucgucucgagaacauaauguggaaacaaauaagcaacgaacuaaaucacauccucuuggaaaacgacaugaaauuuacggugguagugggcgacgccaauggcauucucgcacaagggaagaaaaugauuagaccgcaacccauggagcauaaauacagcuggaaaaguuggggaaaagccaaaaucaucggugccgauauccaaaacacgaccuucauaaucgacggcccugacacgccagaaugcccggacaaccaaagggcauggaacauaugggagguugaggacuauggguuuggaauuuucaccaccaauauaugguuaaaacuucgggacagcuacacccaaaugugugaccaccguuugauguccgcagcgaucaaggacuccaaggcgguacacgcagauaugggcuacuggauugagucagagaaaaaugagaccuggaagcuagcccgggccucguucauugaagugaagacgugcaccuggccaaaaagccauacacuguggucgaacgggguccuggaaucugaaaugauaaucccaaagauauacggcggcccgauuucacaacacaacuacaggccuggguacuucacucaaacagcuggaccguggcaccugggcaaacuagagcuugauuucgaccuuugcgaaggaaccacggucgucguagaugagcacugcggcaaccgcggccccagccuacggaccacaacuguuacgggaaaaauaauacacgaguggugcugucgguccugcacacugccgccccuacgguuccgaggcgaagauggaugcugguacgggauggaaaucagaccagugaaggagaaagaagagaacuuaguccggagcauggugucagccggaagcggcgaagucgacuccuucagucuaggaauccugugcgcguccaucaugauagaggaagugaugaggucccgauggagcaggaaaaugcuaaugaccgggacacuugcagucuuccugcuauugguuaugggacagcucacguggaaugaccuuauaagacucuguaucaugguaggggcaaacgcuucagaccgaaugggaaugggaacaacauaucuagccuugauggccacauuuaagaugagaccaauguucgcagucggacucuuauucagacgguuaacaagccgcgaaguacuucuacuuacuaucgggcugucauugguggcuagcguggagcugccgaacagccucgaagaauuaggggacggacuugcuaugggcaucaugauguugaaacugcucacagaguuccagccccaccagcuauggacaacccuacuaucccuaacguucauuaagacaacguugagcuuggacuacgccuggaaaaccacagccauggccuuaagcauaguaaguuuauuuccacuaugucuaagcaccacaagccaaaagaccacuugguugccgguauuguuagggagcuucgguuguaagccguugacgauguucuuaauuacagagaauaaaaucuggggacgcaaaucguggccgcuaaacgagggaauuauggcaauaggaaucgucucgauacuccuuuccagcuuacuaaagaacgacguaccacuggccgggccacuaaucgcuggcggcaugcuaauagccugcuacguuaucucgggaagcagugcagaucuaucacuagagaaagcagccgaggucucgugggagcaggaagcagaacacuccgggaccagccauaacauuuuggucgaaguccaagaugacggcaccaugaagaucaaagacgaagaacgcgacgacacacugacaauauuacuaaaagccacgcuccuagcagugaguggcguauaccccaugaguauuccggccacacucuucguaugguacuucuggcaaaagaaaaagcagcguaguggaguacucugggacacacccagcccaccagaagucgaacgagcaguacucgaugacgguaucuacaggauucuccaaagaggccuacuaggaaggagccaaguaggcguaggaguguuccaggaugggguguuccacacaauguggcauguaacgcgcggugcagugcuaauguaccaaggaaagaggcuagagccuagcugggcaucgguuaagaaagacuuaauaucuuaugggggaggcuggcgcuuccaagguagcuggaacacuggggaagaaguccaggucaucgcaguggaaccagggaaaaaccccaaaaacguucaaacaaccccaggaacauucaaaacaccagaaggggaaguaggcgcaauugcccuagacuucaagcccgggaccagcggcagcccaauaguaaauagagagggaaaaauuguggggcucuacggcaacggcguugugaccacuucgggaaccuacguauccgccaucgcacaagcgaaagcgucccaggaaggcccgcuuccggaaauagaagacgagguguucaaaaagcgcaaccuaacuaucauggaccuacacccaggaaguggcaaaacgcgccgauauuuaccagcaaucguaagagaagcaauaaagaagaaacuucggacccuaauacuggcaccaacgagaguagucgcuuccgaaauggcagaagccuuaaaaggaaugcccaucagauaccagacuacagcugucaaauccgaacacacuggacgcgagauaguagacuuaaugugucacgcuacauucacaaugaggcuucucucaccggugcgggucccaaauuacaacaugaucauuauggacgaggcccacuucaccgauccugcgucgaucgcugccaggggauauaucagcacgagggucggcaugggcgaagccgccgcaaucuucaugaccgcgaccccgccaggcagcguggaagcauucccacaauccaacgccguaauucaagacgaagaaagagauauucccgagcguucauggaacaguggcuacgacuggaucaccgauuucccuggcaagacagugugguucgugcccagcaucaagaguggaaacgauauagcgaacugccuacggaagaaugggaagagaguaauucagcucuccaggaaaacguucgacacagaguaucagaaaaccaagaacaacgauugggacuacguugugacaacggacauuucagagaugggagccaauuuccgagccgaccgugugauagacccaagacgaugccuaaaaccagucauacuaaaggacggaccggaaagaguaauuuuagcgggaccaaugccaguuacaguagccucagcagcgcaacggcggggcagaauaggcaggaaucagaauaaagagggagaucaguacgucuacaugggccaaccacuaaacaacgacgaggaccaugcgcacuggacggaagcgaaaaugcuccuagacaauauuaacaccccagaggggauaauaccugcccuauucgagcccgaaagagagaaaagcgcagcaaucgacggagaauaccgccucaggggcgaagcuaggaaaacauucguggagcuaaugcgcagaggcgaucuccccguauggcugagcuacaaaguggcuucugagggcuuucaauacucggacaggagauggugcuucgacggggaacgaaacaaccaggucuuagaagaaaauauggacgucgagauuuggacgaaagaaggagagcgaaagaaacugcggccccgauggcucgacgccaggacauacagcgacccacuagcccucagggaguucaaagaguucgcggcagggcgcaggaguguaagcggggaucucauccucgagauaggaaaacuaccacaacaucuaacgcugcgggcccaaaaugccuuagauaaccugguaaugcuccacaacuccgagcaaggggguaaagcguacagacacgcaauggaggaacuaccggacacgauugaaacacuuaugcuauuagcacucauugcagucuuaaccggcggugucacccuauuuuucuugucagggaaaggacucggaaagacaucgaucggacuguuguguguaaccgcaucgagcgcucugcuauggauggccagcgucgagccacacuggaucgccgcaaguauaauccuagaguucuuccuaauggugcuccuuauucccgaacccgaucgucaacgcaccccacaggauaaccaacucgcuuacguagucauaggccuccucuucaugauucucacuguggcagcaaacgaaaugggacuccuagaaacaaccaagaaggacuuagggauuggacauguggccgcggagaaucaucaacacgcaaccaugcucgacgucgaccucaggccggcgagcgcguggacccucuacgcgguugcgacuacggucaucacccccaugaugcggcacacuaucgaaaauacaaccgccaacaucagucuaacagcgauagcgaaccaagcagcgauccuuaugggccuggacaaaggauggcccauuaguaaaauggauaucggggugccgcuacuggcgcuaggcugcuacucccaggucaacccauuaacccugaccgccgcgguucucauguuagucgcccacuacgcuauuauaggaccgggccuacaagcgaaggccacacgggaggcacaaaagcguacagcugcaggcauaaugaaaaacccuaccgucgauggaauuguagcaauugaccucgacccaguaguauacgaugccaaauuugagaagcaacucggacaaauaaugcuccugauucucugcacuagccagauauuacucaugcguacaaccugggcacugugcgagagcauaacacuagcaacgggcccucucaccacacucugggaaggcagcccagggaaauuuuggaauacgacaauugcgguaaguauggcuaauauauucagaggcucguaccucgcaggcgcagggcuagccuucucauuaaugaaaucacucgguggagggagacguggaaccggagcacaaggcgagacgcucggcgaaaaauggaaaagacaauugaaccaauugaguaaaucggaguucaacgccuacaagcgaucuggcauaauggaaguggaccguucggaagcgaaagagggccuaaagagaggugaaaccacaaagcacgcggucagucggggcacagcuaagcugcgaugguucguggaacgaaacuugguuaaacccgagggcaagguuauagaccucggaugcgguagaggagggugguccuacuacugugcgggccuaaagaaagucacugaaguaaaaggauacaccaaaggagggcccggccacgaggagcccaucccaauggccacguacggguggaaccuuguaaaacuccacaguggaaaagauguuuucuuuaugccacccgaaaagugcgacacccuacuuugcgacauuggagaauccucacccaacccaacgauugaagagggaagaacguuaagaguacuaaagaugguagaaccaugguugcggggaaaucaauucuguauaaagauccugaacccauacaugccaucggucgucgaaacacucgaacagaugcaaaggaagcauggaggcaugcucgucagaaacccccucucacgcaauagcacccacgaaauguacugggucucgugugggacggggaacaucgucagcgcgguaaauaugaccaguagaaugcugcucaaucgauucacgauggcucaucgaaagccuaccuacgagagagacguagaccucggagccggaacacgucacguggcaguagagccagaaguggcaaaccuagacauaauaggccagcggaucgaaaacaucaaaaacgaacauaaaagcaccuggcauuacgacgaggacaacccguacaagacuugggccuaccacgguagcuacgaagugaaacccagcgguucagccuccuccauggucaacgguguggugcgacugcucacaaaaccaugggauguaauaccaaugguaacccaaauagcaaugaccgacacuacgccuuucggacaacagagaguauuuaaagaaaaaguggacaccagaacuccgagggcuaaacgaggaacaacccagaucauggagguaacagcaaaguggcuauggggauuucuaucaagaaacaagaaaccuagaauaugcacaagggaagaauuuacuaggaagguccgaucaaacgcagcuaucggcgccgucuuuguagacgaaaaucaauggaacucagccaaagaagcugucgaagaugagagcuucugggaccucguacauaaagaaagagagcuccacaaacagggcaaaugcgccaccugugucuauaauaugauggggaagcgggaaaagaaacuuggagaauuugggaaagcgaagggaagccgggcaaucugguacauguggcucggagcgagauucuuggaguucgaagcucugggauucaugaacgaggaccacugguuuagccgcgaaaacucauuaucuggcgucgaaggggagggacugcacaaacuuggguauauacuuagagauaucagcaaaauuccugggggaaacauguaugccgacgacaccgcaggaugggacacucgaauaacagaagacgaccuacaaaaugaggccaaaaucacagagauuauggaacccgagcacgcccuacuggccacaaguaucuucaaacugacguaucagaacaaagugguucgaguacagcguccagccaaaaacggcacgguaauggacgucaucucgcgccgcgaccagcguggcaguggccaggugggcacauacgggcucaacacauucacgaacauggggguccaacucauccgccaaauggagucggaagggauauuccuacccucugagcucgaaaccccaaaucuggcggaacgagugcuugacuggcuagaaaaacacggcgcggaaaggcugaagagaauggcaauuagcggcgacgauugcguagucaaaccgaucgacgacagauucgcaacagcgcucacggcucugaaugacauggggaagguaaggaaagacauaccgcagugggaaccaucgaagggguggaacgacuggcaacaagugccuuucugcagccaccacuuccaccagcuaauaaugaaagacgggagggaaaucguagucccguguagaaaccaggacgaauuagugggucgcgccagggucagccaaggugccggauggagccugcgagaaacagcgugccugggaaaaagcuacgcacaaauguggcaacucauguacuuccauaggcgggacuuaaggcuugcggccaacgccaucugcuccgccguccccguagacuggguaccaacaucgcgcacaacguggucgauccaugcucaccaccaguggaugaccacggaggacaugcucagcguguggaaucgcguauggaucgaggagaacccguggauggaagacaaaacccacguuuccaguugggaagaggucccauaccuggggaaacgugaggaccaaugguguggaagccucaucggccucacagcccgcgcaacgugggcaacgaauauucaggucgcaauaaaccagguccgccgacuaauaggcaacgaaaacuaucucgacuacaugacgagcaugaaaagguucaaaaaugaaagcgaucccgagggggcgcucugguaa

SEQ ID NO: 23882 - RNA, 9879 nt, Artificial Sequence
  derived and/or modified CDS sequence (opt11) from DENV-1__GQ868512__SS-prME
agcgugaccaugcuacucaugcugcugcccaccgcccuggccuuccaccugaccacccggggcggggaaccccacaugaucgugagcaagcaggagagagguaaaagcuuacuguuuaaaaccagcgcugguguuaauaugugcacccugaucgccauggacuuaggcgagcucugugaggacaccaugaccuacaagugcccccaaaucaccgaggcggagcccgacgacgucgacugcuggugcaaugccacggauaccugggugaccuacgggaccugcucucagaccggcgagcaccgccgggacaagcgcuccguggccuuggcuccucacgugggcuuagggcucgagacccguaccgaaacguggaugagcuccgagggcgccuggaagcaaauccagcgcgucgagaccugggccuuaaggcaccccggguucacggugaucgcucuguuccuggcgcacgccauugguaccagcaucacccagaaggggaucauauucauccugcugaugcucgugacccccuccauggccaugcgcugcgucggcaucggcaaccgggacuucguugaagggcugagcggcgccacguggguggacgucguccuggagcacgggucaugcgucaccaccauggccaagaacaagcccacccucgacaucgaacugcugaagacggaggucaccaacccugcaauccuccgaaagcugugcaucgaagccaagaucucuaacaccaccaccgauucccgcugcccuacccagggagaggccaccuugguggaggagcaagacgccaacuucguaugccgccgcacguucguggaccgcggcuggggaaacggcugcggccucuucggaaaggggucccugcucacgugcgccaaguucaaguguguuaccaagcucgaagguaaaaucgugcaguacgaaaaccugaaguauagcgucaucguaaccguccacaccggcgaccagcaccaagucgggaaugagacgaccgagcauggcaccaucgcgaccauaacgccgcaagcuccuacgucagagauccagcugaccgacuacggggcccucacccuggacugcagcccccggaccggccuagacuucaaugagaugguacuucugaccaugaaggagaaauccuggcuggugcacaagcagugguuccucgaccucccgcugcccuggaccuccggggccagcacuucucaggagaccuggaaccgccaagaccuccuggugacuuucaagacagcccacgccaaaaagcaagaaguggucgugcugggcucccaagagggcgccaugcacaccgcccugacgggggccacggagauccagacuuccggcaccaccacgaucuuugcagggcacuuaaagugccggcugaagauggacaaacucacgcuuaagggcaccuccuacgugaugugcacggggagcuuuaagcuggagaaggaggucgcugaaacgcaacauggcaccgugcuggugcaggugaaguacgagggcacggacgccccaugcaagauccccuucuccacccaggacgagaaagggguaacgcagaauggccgucucaucaccgccaacccgaucgugaccgacaaagagaaaccugucaacaucgagacugagccgcccuucggggagagcuacaucguggugggggccggagagaaggcgcugaagcuguccugguucaagaaggggagcaguauugggaagauguuugaggccacggcccgcggugcccgccggauggcuauccucggcgacaccgcgugggacuucgggagcauuggaggcgucuucaccucuguggggaagcucgugcaccaggucuucgguaccgccuacggggugcucuuuagcggugugucguggacgaugaagauagggaucggcauccuucugacauggcuaggccucaauagccgcucgaccucacuguccaugaccugcaucgccgucgggauggugacgcuguaucucggcgugaugguccaggcugacagcgggugugugaucaacuggaaaggccgcgagcugaagugcggcuccggcaucuucgugaccaacgagguccauaccuggaccgagcaguacaaguuccaggcagacucuccuaagcggcugucugcagcaaucggcaaggccugggaggaggggguuugcggcauucgcuccgccacccggcuagaaaacaucauguggaagcaaaucagcaacgagcugaaucacauccugcucgagaacgacaugaaguucacgguggucguuggagacgccaacggcauccuggcucaggggaaaaagaugauccggccccagcccauggaacacaaguacuccuggaaguccuggggcaaagccaagaucaucggcgcugauauccagaacaccaccuucaucaucgacgggccagauaccccggagugucccgacaaccagcgggccuggaacauaugggagguggaggacuacggcuuugggaucuuuacuacgaacauauggcugaagcuccgcgauagcuacacucagaugugcgaccauagauuaaugagugcggccauaaaggacuccaaggccguccacgccgacaugggcuacuggaucgagagcgaaaagaacgaaacauggaagcuggcgcgcgcguccuucauugaaguuaagacuugcaccuggcccaaaucacacacccucugguccaacgggguccuggagagcgaaaugauaauccccaagaucuauggaggaccgaucucccagcacaacuaccggcccggguauuucacacaaacggccggccccuggcaccuggggaagcucgagcuggacuucgaccugugcgaagguacgacagucgugguggacgagcacugcggaaaccgagggccgucgcucaggacaaccaccguaaccggcaagaucauccacgaauggugcugccgcuccugcacccugccgccccugagguuccguggggaggacggcugcugguacggaauggaaaucaggcccgugaaggagaaagaagagaaccuugugaggagcauggucucugccggcagcggggagguggacucauucucucuagggauccugugcgugaguaucaugauugaggaggucaugcggucacgcuggagccggaagaugcucaugacgggcacccuggcuguguuccugcuccuggugaugggucagcugaccuggaacgacuugaucaggcuguguaucauggucggcgccaacgcauccgaccgcauggggaugggcaccacguaccuggcccucauggccaccuucaagaugcggccgauguucgccguggggcugcuguuucgccgguuaaccagccgcgagguguuacugcucaccaucgggcugucguuaguugccagcguggagcuccccaacucccuggaggaguugggcgauggacucgcgaugggcaucaugaugcuuaagcuauugacagaguuccagccccaccaacuguggacgacccuccucagccugaccuucaucaagacgacccuaucucucgacuaugccuggaagaccacggccauggcccugagcauagugucccuauucccccucugccugagcacgaccucccaaaagaccaccuggcucccugugcuccugggcagcuucgggugcaagccccugaccauguuccucaucacggagaauaaaauauggggacgcaagucuuggccccugaacgaggggaucauggcgaucggcaucguaagcaucuugcucucuucacugcugaaaaaugaugucccgcuugccgggccacugaucgcggguggcaugcugaucgccugcuacgucauaagcggguccagugcggaccuuucccuggagaaggcggccgagguaagcugggagcaggaggccgagcacuccggcaccagccacaacauccucgucgagguacaggacgacgggaccaugaagaucaaggacgaggagcgcgacgauacccucaccauacuucuaaaggccacucuuuuagcugugucaggcgucuaccccaugucaauacccgcgacacucuucgugugguauuucuggcagaagaagaagcagcgguccggcgugcucugggacacccccagcccccccgaagucgagcgcgccgugcuggacgacgggaucuaccggaucuuacaacgcggacugcucgggagaagccaggucggcgucgggguguuucaggacggcguguuccacacgauguggcacgucacgcgcggagccgugcugauguaccagggcaagagacuggagcccagcugggcguccgugaagaaggaccucaucuccuacggagggggcuggcgcuuccaagggucuuggaacaccggcgaagagguccaggugaucgcugucgagcccgggaagaacccgaagaacguucaaaccacccccggcacuuucaaaacacccgagggcgaagugggggcgauugcccuggacuuuaagcccggcaccagcggcucaccgaucgucaaccgggagggcaaaauugucggccuguacgggaacggcguggugacgaccagcgggaccuacgucuccgcaauugcgcaggcuaaggcgagccaggaggguccccugcccgagaucgaagacgagguuuuuaagaaacggaaccugaccauaauggaccugcacccagggagcggcaagacgcggcgcuaccuccccgcgaucgugcgggaggccaucaagaggaagcugcggaccuugauccucgcccccaccagggugguggccucggagauggccgaggcccuaaaggguaugcccauucgcuaccagaccacggccgugaagagcgagcacaccgggcgagagaucgucgaucuuaugugccacgccaccuucaccaugcgccuacuguccccugugcgcguuccaaacuacaacaugaucaucauggacgaggcccacuuuacggaccccgccagcaucgcagcccgcggcuacauaucgacgcgagucggaaugggagaggcggcggccaucuuuaugaccgcuacgccaccaggcagcguggaagccuucccgcaguccaaugccgucauccaggacgaagagcgcgacauccccgagcggucauggaacuccggguacgauuggaucacggacuucccagguaaaaccgucugguucgugcccucgaucaagagcggcaacgacaucgcgaacugccugagaaaaaauggaaaacgggucauacagcucucucgcaagacauucgacaccgaguaccaaaagacgaagaacaacgacugggacuaugucgugaccacugacaucuccgaaaugggggccaauuuccgggccgaccgcgugaucgacccgcggcgaugcuugaagcccguaauacuaaaggacggccccgagcgggugauccucgccggcccgaugcccgugaccguggcgagcgccgcccaaagaaggggccggauuggccguaaccagaacaaggagggagaccaguacguguacaugggacagccccucaacaacgacgaggaccacgcccacuggacggaggccaaaaugcugcucgacaacaucaacaccccugagggaaucaucccggcacuguucgaaccggagcgugagaagagcgccgccaucgacggcgaguaucgccuccgcggggaggcccgcaagaccuucgucgaguugaugagacgaggcgaccugcccguguggcucagcuacaaggucgcuucugagggcuuccaguacucggaucgucgcuggugcuucgauggggagcguaacaaucagguccucgaggagaauauggacguggagauauggaccaaggaaggggagcgcaagaaacugcggccgcgcuggcuugacgcgcggaccuacagugacccgcucgcccugcgcgaguucaaagaguucgccgccggucggcgcagcgugagcggcgaccugauccucgagaucggcaagcugccccagcaccugacacugcgugcccagaacgcucuggacaaucuggucaugcugcacaacuccgagcagggcgggaaggccuaccgucacgccauggaggagcuccccgacaccaucgagacccugaugcuccuagcccuuaucgcgguguuaacagggggcgugacgcuguucuuccucagcgggaagggccucgggaagaccuccaucggucugcuuugcgucaccgccagcuccgccuugcucuggauggccagcguggaaccccacuggaucgccgcauccaucauccuggaguuuuuccuaaugguguuacuaaucccggagcccgaccggcagcgcaccccccaagacaaccaacucgccuacguugugaucggccugcuguucaugauccucacuguggccgccaacgagaugggucugcucgagaccacuaaaaaggaucucggcauugggcacgucgccgcggaaaaccaccagcacgccaccaugcuggacguggaccugagaccggcuagcgccuggacgcucuacgccguugcgacgaccgugaucaccccuaugaugcgccauacaauugagaacaccaccgccaauaucucccugaccgccaucgcuaaccaggcagcgauccugaugggccucgacaagggcuggcccauaaguaagauggacauaggugugccccugcuggcccuuggcuguuacagccaggugaacccacugacgcuaacggcagcuguccucaugcugguggcgcacuacgccauuaucggccccggucugcaggccaaggccacccgggaggcacaaaaacggaccgcggcuggcaucaugaagaaccccacgguggacggaaucgucgccaucgaucuugaccccgugguguacgacgcuaaguucgagaagcagcugggccagaucaugcugcucauacucuguaccucgcaaauucugcucaugcgcacgaccugggcccugugcgaauccauaacgcuagcgacgggcccgcugaccacccuuugggaggggagccccgggaaguuuuggaacacgacaaucgccgucuccauggcgaacauauuccggggcagcuacuuggcaggcgccggucucgccuucagucugaugaagucacucggcgggggccgccgcgggaccggcgcccagggcgagacgcuaggcgagaaguggaagcgccagcugaaccagcuguccaaguccgaguucaacaccuauaagcgguccggcaucauggaaguggaccguucagaggccaaggaggggcugaagcggggugagacuacaaagcaugccgugagucgcggaaccgcgaagcugcggugguucguugagcgcaaucucguuaagcccgagggcaaggugaucgaccugggcugugggcggggggggugguccuacuacugcgccggccucaaaaaggucaccgaggugaaggguuacaccaagggcggccccgggcacgaggagccgauccccauggccacuuacggcuggaacuuagugaaacugcacucugggaaggaugucuucuucaugccccccgagaaaugugauacccuccugugugauauuggagaguccagccccaaccccacuauugaggaggggcgcacguugcgcgugcuaaagaugguagagcccuggcugcgcggcaaccaauucugcaucaagauucugaaucccuacaugccgucugucguggaggcgcucgaacagaugcagcguaagcacggcggcaugcuggugcggaaccccuugagccggaacuccacccacgagauguacugggucucauguggcaccgggaacauagugucagccgugaacaugaccagcagaaugcuccucaaccgguuuacuauggcgcaucggaagcccaccuacgagcgcgacgucgaucugggcgcuggcacgcggcauguggcgguggaaccugagguugccaaccucgacaucauuggccagcguaucgagaacaucaaaaacgagcauaaguccaccuggcauuaugacgaggacaacccguacaagacuugggcuuaucacgguagcuacgaggugaaacccuccgggagcgcuuccaguauggugaacggcgucgugcggcuacugaccaagcccugggacgucauacccauggugacccagaucgccaugacugacacgaccccuuucgggcaacagcgcguauucaaggagaaggucgacacucggaccccccgugcuaagcggggaaccacccagaucauggaagugaccgccaaguggcucuggggcuuccugucccgcaacaagaagccucggaucugcacccgagaggaguucacccggaaggugcggagcaacgccgcgaucggggccguuuucguagacgagaaccaauggaacagcgccaaggaggccgucgaagacgagcgguuuugggaccugguccaucgcgagcgggagcugcacaagcaaggcaagugcgcgaccugcguguauaacaugauggggaagcgggagaagaagcugggcgaguucgggaaggccaagggcucccgggccaucugguacaugugguuaggagcacgcuuccucgaguucgaggcccugggguuuaugaacgaggaccacugguucucccgggagaacagccugucagggguggaaggggagggucuccacaagcugggguauauccuacgcgauaucuccaagaucccaggcggcaacauguaugcugacgacaccgcagggugggacacccggaucacggaggacgaccuccagaacgaggcgaagauaaccgagauaauggaacccgagcacgcucugcuggccacuagcaucuucaaacucaccuaccagaacaagguugugcgaguccagcgccccgcgaagaauggcacggucauggaugugaucucccgucgugaccagcgugggagcggucaggugggcaccuacgggcucaacacuuucacuaacauggagguucagcugauccggcagauggaaucugagggcaucuucuuaccuagcgagcucgagacaccgaaccuggccgagcggguuuuggacuggcuugagaagcacggugccgagaggcugaaacguauggcgaucuccggcgacgacuguguggucaaacccaucgacgaucgcuucgcuaccgcgcucaccgccuuaaacgacauggggaaggugcggaaggacaucccucagugggagcccucgaagggcuggaacgacuggcagcaggucccuuucuguucccaccacuuccaccaacuuaucaugaaagacggccgcgagaucguugugcccugccggaaccaggacgagcuuguugggcgcgccagggucagccagggcgcuggcuggagccuucgcgagacugccugccucggcaagagcuacgcccagauguggcaacucauguauuuccauagacgcgaccugcgacuggccgcgaaugccaucugcuccgcggugcccguggacugggugcccaccagucgcacgaccuggagcauccacgcccaccaccaguggaugaccaccgaggacauguuauccguguggaaccggguguggaucgaagagaauccauggauggaggacaagacccacgucagcuccugggaggaggugccuuaccugggcaagcgcgaagaccagugguguggcagccugaucggucucaccgcccgcgcaaccugggccaccaacauccagguugcgaucaaccaaguccggcggcugaucgggaacgaaaacuaccuggacuacaugacauccaugaagcgguuuaagaacgagucagacccugagggagcccuaugguga

SEQ ID NO: 23883 - RNA, 9879 nt, Artificial Sequence
  derived and/or modified CDS sequence (opt11) from DENV-1__GU131970__SS-prME
agcguaaccaugcuuuugaugcugcugccuaccgcacucgccuuccacuugacgacgcggggaggggagccccacaugaucgugagcaagcaagagaggggaaaaagccuccuguuuaagaccucagccggggucaacaugugcacccugaucgcaauggaccugggcgagcugugcgaggauacgaugaccuacaaauguccgcagauuaccgaagccgagcccgacgacguggauugcuggugcaaugccaccgacacgugggugacauacggcacguguagccagaccggcgagcaccgacgggagaagcgcuccguggcccucgcgccccacgugggucuuggguuagagacgcggacagagaccuggaugucauccgagggcgccuggaagcagauccagcgcgucgagaccugggcacuuagacauccuggauucacggugaucgcccuguuccucgcgcacgccaucggcaccucuaucacccaaaaagggaucaucuucauacuauuaaugcucgugacccccuccauggccaugagaugcgucggcaucggcaaucgggacuuuguugaggggcugagcggcgccacguggguggacgucgugcuggagcacggcucaugcgucaccaccauggccaagaacaaaccuacgcucgacaucgagcugcugaagacggaagucacuaacccagcgauccuccggaagcugugcauugaggccaaaaucagcaacaccaccacggacucccggugucccacccagggggaggccacgcucguggaggaacaggacgcuaacuuugugugccgccggacauucguagaccgcggcugggggaauggcugcggccucuucggcaaggggagccugcugacgugcgccaaguuuaagugcgugacgaagcucgaagguaagaucgugcaguacgaaaaccugaaguauuccguuaucgucacggugcacaccggcgaccagcaccaggucgggaacgagacgaccgagcacggaaccaucgcgaccaucaccccccaagcccccacgagcgagauccagcugaccgacuacggcgcucuaacccuggacugcuccccccggaccggacuggacuucaacgagaugguguuguuaacgaugaaggagaaguccuggcugguccacaagcaaugguuccucgaccugccgcuucccuggaccuccggggccaguaccagccaagagaccuggaaucgccaggaccuccuggugacuuuuaagacagcccacgcgaaaaagcaagaaguggucgugcuaggcucccaggagggagcuaugcacaccgcucucaccggggccaccgagauccagaccuccggcaccaccacuaucuucgcggggcaccuaaagugccggcugaagauggacaaacucacccugaagggcaccuccuacguuauguguaccgggagcuucaaacuggagaaagaggucgcggaaacgcagcacggcacgguucuggugcaggucaaguacgaaggcaccgaugcucccugcaagauccccuuuuccacccaggacgagaagggggugacacagaacggccgucucauuaccgccaacccgaucguuaccgacaaggagaaacccgucaacaucgagacugaaccgcccuucggugagagcuauaucguggugggcgccggcgagaaggcacugaaguuaagcugguucaagaagggaagcucaaucgguaagauguucgaagcgacugcccgcggugccagacguauggccauccuaggcgacaccgcaugggauuucgggucuaucggcggcgucuucacgucggucgggaaguuggugcaccagguauucggcaccgccuacggggugcuguucagcggcguguccuggacuaugaagaucgggauaggcauacucuugaccuggcugggccucaacucgcguucaacuucucuguccaugaccugcauugcugucgggauggugacacuguaccucggcgucaugguacaggccgacagcgggugcgugaucaacuggaaaggccgcgagcucaagugcgggaguggcaucuucguuacaaacgaaguccacacauggaccgagcaguacaaguuccaagccgacuccccgaaaagacugucugcggcuauaggcaaggccugggaggagggggugugcggcauccgauccgccaccagacuggaaaacaucauguggaagcagaucagcaacgagcugaaccacauacugcucgaaaaugacaugaaauucacgguggucguuggugacgcgaacggcauccuugcccaggggaagaagaccaucaggccucaacccauggaacauaaguacuccuggaaguccugggguaaagcgaagaucaucggcgcugacauccaaaacacgaccuucauuaucgacgggccugacacgccggagugucccgacaaccagcgggccuggaacauaugggagguggaggauuacggguuugguaucuucaccaccaauaucuggcugaagcuccgcgacuccuacacccagaugugcgaucaccggcugauguccgcagcuaucaaggacuccaaggccguccacgccgauaugggguacuggaucgaaagcgagaagaacgagacuuggaagcuggcccgcgcguccuucauugaggugaagaccugcaccuggccgaaaagccacacccucugguccaauggcgugcuggagucagagaugaucaucccaaagauuuaugggggcccgaucucucagcauaacuaccggcccggguacuucacccaaaccgccggccccuggcaccuggggaagcucgaguuagacuucgaccugugcgagggcaccacggucgugguggaugagcacugcgggaaccgcgguccgagucuccggacaacuaccguuaccggcaagauaauccacgaguggugcugccgcuccugcacgcugccuccucugcguuuucggggggaggacggcugcugguacgguauggagaucaggcccgucaaagagaaggaggagaaucucguacgcagcauggugagcgcaggcagcggcgagguggacagcuucucccucgggauccugugcguaagcaucaugaucgaggaggucaugagaucccgcuggagccgaaaaaugcucaugaccggcacccuggccguguuccugcugcugaucaugggucagcuaaccuggaaggacuuaauucgcuuauguaucauggugggcgccaacgcuuccgaccgcaugggaaugggcacgaccuaccuggcccucauggccaccuucaagaugagaccgauguucgcggugggcuuguuauuccgccggcuaaccucucgggaagugcugcugcucacgauagggcugucccugguugcuagcgucgaauugcccaacucccuagaggagcucggcgacgggcucgcgaugggcaucaugaugcuaaaacuguugaccgaguuucauccccaccagcuuuggaccacgcugcucagccugacuuucaucaagacgacccugucccuggacuacgcguggaagacgacggcaauggcacugagcauaguaucuuuauuuccccucugccugagcacgaccucccagaagaccaccuggcugccgguucuacuaggcagcuucgggugcaagccccugacgauguuucuuaucaccgagaacaagaucuggggcaggaaauccuggccccugaacgaggggauuauggcgaucggcauugugaguauccugcucuccagccugcugaagaacgacgugcccuuagcggggccucucaucgccggcggcaugcugaucgccugcuaugucaucucagggucaagcgcagaccucucccucgagaaggcggcagagguguccugggagcaggaagccgagcauagcggcacuagccauaacauucucgucgagguucaggacgacgggaccaugaagaucaaggaugaggaacgcgaugacacgcuuaccauccugcugaaggcaacccuccuggccguaaguggaguguaucccaugagcauccccgcgacccucuucgugugguacuuuuggcaaaagaagaagcagcggucggggguucuuugggacacgcccaguccgcccgaaguggagcgcgccguacuggacgacggcauauacagaauccugcagcgcgggcugcucgggcggucccaggucggcgugggggucuuucaggaugggguguuccacacgauguggcacgugacgcgcggggccguccugauguaucagggcaagcggcuggaacccagcugggccucuguuaagaaggaccucaucagcuaugggggcggauggcgcuuccagggguccuggaacaccggggaggaggugcaagucauagccguggagcccgggaagaacccgaagaauguccagacaacucccggcaccuucaagacuccugaaggugagguaggggcgaucgcccuggacuuuaagccagggacgagcgggagcccgaucgugaacagggaggguaagauagugggccuauacgggaauggcguggugacuacuagcgggaccuacgugucugccaucgcccaggcuaaggcgagccaggagggcccccuccccgagauugaagacgaaguauucaaaaagcgcaaucuaacgaucauggacuuacacccggggagcggcaagacccgcagguaucucccggcuauuguucgggaggccaucaagcgcaaguugcggacccugauccucgccccgacccgcgugguugcgagugagauggccgaggcccugaaggggaugcccauccgauaccaaacaaccgccgugaagagcgagcacaccggucgagagauuguggaucugaugugccacgccaccuucacgaugcgacugcuguccccgguucgcgugcccaacuacaacaugaucaucauggacgaggcgcacuucaccgacccagccagcaucgccgcccgcggcuacauuuccacccgugugggcaugggcgaagcugcggcaaucuucaugaccgccacgcccccgggcucugucgaagcguucccccaguccaacgccguuauccaggaugaagagcgcgacauccccgaacggagcuggaacucgggcuaugauuggaucaccgacuucccagggaaaacugugugguucguuccgagcauaaaauccggaaacgacaucgcgaacugccugcgcaagaacggcaagcgggugauccaacucagucguaaaacuuucgacacggaauaccagaagacaaaaaauaacgacugggacuauguggucaccaccgacauauccgagaugggggccaauuuccgcgccgaccgcgugauugaccccagacgcugccugaagccugugauccugaaggacgggcccgagcggguuauccuagcagggccgaugcccgugacgguggcgucagccgcgcagaggcggggcaggaucgggaggaaccagaacaaggagggggaucaauacgucuacaugggacagccccugaacaacgaugaggaccacgcccauuggaccgaggccaagaugcucuuagacaacauaaacacccccgaggggaucauaccggcacucuucgagcccgaacgcgagaagagcgccgccaucgacggcgaguaucgccugcgcggggaggcccgcaagacuuucguggagcucaugcgucgcggcgacuuacccguuugguugucguacaagguggccuccgagggcuuccaguauagcgaccggcgauggugcuucgacggggagcggaauaaccagguacucgaggagaacauggacgucgagaucuggaccaaggaaggcgagcgcaagaaacugcggccccgcugguuagacgcgcggaccuacagugacccgcuggcccugcgcgaguucaaggaguucgccgccgggcguaggagcgugagcggcgauuugauucucgagaucggcaagcugccccagcaccugacccuaagggcccagaacgcgcuggacaaccuggugaugcuccauaauucagagcagggcgggaaggccuaccgccacgccauggaggaacugcccgacaccaucgagacucugaugcuucuggccuuaaucgcgguccuaacaggcggcgucacucuguucuucuugagcgggaaaggucuugggaagaccuccaucggacugcugugcgugaccgccagcuccgcccuccuguggauggccagcguggagccccacuggaucgcggcguccaucauccuggaguucuucuugaugguguuacuuauuccugagccugaucgucagcgcacgccccaggacaaccagcucgccuacguggucaucgggcuccuguucaugauucucaccguggcagccaacgagaugggguugcuggagaccacgaaaaaggaccucgggaucggucacguggccgcagagaaucaccagcacgccacuaugcuggauguugacuuacggccggccuccgccuggacccucuacgccgucgcgacuaccgugaucacucccaugaugcgccacaccaucgagaacacuaccgccaacaucucccugacggccaucgcgaaccaggccgccauccugaugggccucgacaagggcuggcccauaagcaagauggacaucgggguaccccugcuggcacucggcuguuacucacaggugaacccgcugacacuaaccgccgcagugcucaugcuagucgcgcacuacgccaucauugggccaggcuuacaggccaaggccaccagggaggcccaaaagagaacggcggccgggaucaugaagaaccccaccguggacggcaucguggccaucgaccucgaccccgucguguacgacgccaaauucgagaagcagcucggccagaucaugcugcucaucuugugcaccagccagauacuguugaugaggacuacgugggcccugugcgaguccaucacccuggcgaccgggccgcucaccacgcugugggaaggcagccccgggaaguucuggaauacaaccaucgcagucuccauggccaacaucuuccggggcucauaucuugcgggcgccgggcucgccuucucccugaugaagagccugggagggggccgccgggggaccggcgcccaaggagagacgcucggggagaaguggaagcgucagcugaaucaguuauccaaguccgaguucaacacauacaagcggaguggcaucauggaagucgaccgaagugaggccaaggaggggcugaaacggggggagaccaccaagcacgccgugagcagagggaccgcgaagcugcggugguucguugagcgcaaccuugucaagccugagggcaaagugaucgaccuggguugcgggcggggcgggugguccuacuauugcgccggccucaaaaaggugacggaagucaagggguacaccaagggcggccccgggcacgaggagccgaucccaauggccaccuacgguuggaaccugguaaagcuucacagcgggaaggacguguucuucaugccgcccgagaagugcgacacccuccuaugcgacaucggcgaguccagcccgaaccccacgauugaggaggggcgcacccuacgaguacucaagaugguggagcccugguuacgcggcaaccaguuuuguaucaagauccugaaccccuacaugccguccguggucgagacucucgagcagaugcagcggaaacacggcggcaugcuggugcgcaacccacuuagccggaacuccacccacgagauguacugggucucaugcgguacagggaacaucguuagugccgucaacaugaccagcagaaugcuuuugaaccgguucaccauggcucaccgaaagcccaccuacgagcgcgacguggaccugggcgcgggcacgcggcacgucgccguggagccugagguggccaaccucgacaucaucgggcagcgcaucgagaauaucaagaacgagcacaagaguaccuggcacuaugacgaggacaacccguacaagacgugggcuuaccacggcagcuacgaggucaaaccguccgggagugcguccagcauggugaacggcgugguccggcugcugaccaagcccugggacguuauccccauggucacgcagaucgcgaugaccgacaccacuccguucggacagcagcgcguauucaaagagaagguggacacccggacuccccgggccaagcggggcacgacccagauaauggaagucaccgccaaguggcucuggggguuccugucccgcaacaagaagccccggaucuguacgcgcgaggaguucacccggaaggugcgcagcaacgccgccauuggggcgguguucgucgaugagaaccaauggaacucggcgaaggaggccguggaggacgagcgguucugggaccuggugcaucgcgaacgagagcuccauaaacagggcaagugugcgaccugcguuuacaacaugauggggaagagagagaagaagcugggggaguucgggaaggcgaagggcagcagggccaucugguauauguggcugggggcgcgcuuccucgaguucgaggcgcuuggguucaugaaugaggaucacugguuuagccgggagaacagcuugaguggcguggagggggagggccuccacaaacucggguacaucuuacgugacaucucgaagaucccgggcggcaauauguacgcagacgacacggcggggugggacacccgcaucacggaagacgaccuacagaacgaggccaagaucaccgacaucauggagcccgaacacgcgcugcuggccacgagcaucuucaagcucaccuaccaaaacaaggugguccgcguucagcgccccgcgaagaacgggaccgugauggacgucaucucgcggcgcgaccagcgggggagcggccaggucggcacuuacggguuaaacacguucaccaacauggaggugcagcugauccggcaaauggaguccgagggaaucuuccuccccucggaacuggagaccccgaaccuugcggagcguguccucgacugguuagagaagcacggagcugaacgccugaaaagaauggccauuuccggcgacgauugcguuguaaagcccaucgacgaccgcuuugccaccgcccucaccgcgcugaacgacauggggaagguccggaaggacaucccccagugggagcccagcaagggcuggaacgacuggcagcaggucccguucuguucccaucacuuccaccaacugaucaugaaggacggccgagagaucgucgugccgugucggaaccaggacgagcugguagggagagcacggguuucgcagggcgccgguuggucccugaaggaaacggcuugcuuaggcaagagcuacgcucagauguggcagcuuauguacuuccaccgccgggaccuacgucuugcggccaacgccaucugcucugccguccccguggacugggucccuaccagccggaccacuuggagcauccacgcacaucaccaguggaugacuaccgaggacaugcucuccguuuggaaccgcguguggaucgaggagaacccguggauggaggacaagacccacguguccuccugggaggagguccccuaucuggggaagcgggaggaccagugguguggcucgcugauuggccucaccgcccgcgcaacgugggcuaccaauauccagguggccaucaaccaggugcgccggcugaucgguaacgagaacuaccuagacuacaugaccuccaugaaacgcuucaagaacgagagcgaccccgaaggcgcccucugguaa

SEQ ID NO: 23884 - RNA, 9879 nt, Artificial Sequence
  derived and/or modified CDS sequence (opt11) from DENV-1__KF955427__SS-prME
agcgucaccaugcugcuaaugcuguugccgacagcucucgcauuccaccugaccaccagagggggcgagccgcauaugaucguguccaagcaggagcggggcaagagcuugcuauucaagaccagugcugggguuaacauguguacccugauugccauggaucugggugaacuaugcgaggacaccaugacuuacaagugcccccagaucaccgaagccgagcccgacgacguggauugcugguguaaugccaccgauaccugggucaccuacgggaccugcagccagaccggcgagcaccgucgggauaagaggagcguggcccuggcgccccacgugggccuggggcuagagacgcggaccgagaccuggauguccagcgagggugccuggaagcagauccaacggguggagacuugggcccugcgucaucccggguuuacgguuaucgcuuuguuccucgcccacgccauagguacauccaucacgcagaaggggaucaucuucauccugcugaugcucgugacucccuccauggccaugcgcugcguaggcaucggcaacagagacuuuguggaggggcugagcggcgcgacgugggucgacgucgugcuggagcacggguccuguguaaccaccauggccaagaacaagccuacccucgacaucgagcuucuuaagaccgaagucaccaaucccgcgaucuugcgcaagcucugcaucgaggcaaagaucagcaacaccacaacggauagucggugucccacacaaggcgaggccaccuugguggaggaacaagacgcuaacuuugugugccgccggaccuucgucgaucgagggugggguaaugguugcggccucuucggcaaggguagccuccugacgugcgcgaaguucaagugugugacuaaacuugagggcaagaucguacaguacgagaaccugaaguacucugugaucgugaccgugcacaccggcgaucagcaccaggucgggaacgaaacgacugagcacggcacuaucgccaccaucacgccccaggcucccaccagugagauccagcuaaccgacuacggggcccucacccuagacugcagccccaggaccggccuugacuucaacgagauggugcuacugaccaugaaggagaaguccugguuaguccacaagcagugguuccucgaccugcccuugcccuggacguccggggccagcaccucacaggaaacguggaaccgccaggaccuacuggucacguucaagaccgcccacgcgaagaagcaggaaguggucgugcuggguucucaggagggggccaugcacaccgccuggaccggggcgacggagauccagaccagcggcacgaccacuaucuucgccggccaccucaaguggcggcucaagauggacaaacuuacccucaaaggcaccuccuacgugaugugcacggggaguuucaaacuugagaaagaaguggcagagacgcaacacgggacaggccuaguccaaguaaaguacgaggggacagacgcccccugcaagaucccguucuccgcccaggacgagaaaggagucacccagaacggccgacugaucacggcuaaccccaucgugaccgacaaggaaaagcccguuaauaucgaaaccgagccgccauucggcgagagcuacaucgucguuggcgcgggggagaaggcccuuaagcucuccugguucaagaagggcagcuccaucgggaagauguucgaagccaccgccaggggcgcccgcaggauggcgauccucggggacacggccugggacuucgguucaaucggcggcguguucaccuccgucggcaaacuugugcaccagguguucgguaccgccuauggcguccuguucucuggggugagcuggacaaugaagaucgguaucggcauccugcucacguggcuggggcugaauagccgcuccaccagccuguccaugacuugcaucgccguggguauggucacccuguaccuggggguaauggugcaggcugauagcggcugcguuaucaacuggaaaggucgcgaauuaaagugcggcucgggcaucuucgugacuaacgaagugcacaccuggaccgagcaguacaaguuucaggcggauagccccaagcggcugagcgccgccaucggcaaggccugggaggaaggagucugugggauccgauccgcgacccggcuggagaauaucauguggaagcagauaagcaacgagcucaaucacauucugcuggaaaacgacaugaaguucacagugguggucggugacgcgaacgguaucuuggcccaggguaagaagaugauccggccccagcccauggagcacaaguacuccuggaaguccuggggaaaggccaagauuaucggggccgauauucaaaacacgaccuucauuaucgauggucccgauaccccggagugcccggauaaucagcgggcguggaacaucugggagguggaggacuacggguucggcaucuucaccacgaacaucuggcugaaacugcgagauuccuacacucagaugugcgaccacagauugaugagcgccgccaucaaggacuccaaggccguucacgccgacaugggcuacuggaucgaaagcgagaagaacgaaaccuggaagcuggcgcgugcuuccuucaucgaggucaaaaccugcacguggcccaaaagccauacccuaugguccaacggggugcucgagucggagaugauuauccccaagauuuauggcgggccgaucagccaacacaacuaucggcccggcuacuucacccagaccgcaggacccuggcaccucgggaagcuggaauuggacuucgaccugugcgagggcacgacuguagucguugacgagcauugcgggaaccgcgguccuucgcugcguaccacaacggugaccggaaagaucauccacgaauggugcugccgaucuugcacccugccgccccugcguuuccguggcgaagacggcugcugguacggcauggagauccggccugucaaggagaaggaggaaaaucuggugcgcuccauggucuccgccggcagcggagagguugauagcuucuccuuagguauccugugcgccucuauaaugaucgaggaagugaugcggucacgcuggagccggaagaugcugaugaccgggacgcucgcgguguuccugcuccucguaaugggccagcugaccuggaacgaucugauccgccuaugcaucauggugggggccaacgcuuccgaccgcaugggaaugggcacuaccuaccuggcgcugauggcuacguucaagaugcgcccgauguucgcggucgggcuccuuuuccgccggcugacaucccgcgaggucuugcugcugaccaucggccucucccuaguggccagcgucgagcugccgaacucacuugaggagcugggugacggucuggcgauggggaucaugaugcugaagcugcuaaccgaguuccagccccaccaacuuuggacgacacugcuaucucucacuuucauuaagaccacguugagucuggacuacgccuggaagaccacggccauggccuuaagcaucgucucccuguucccccugugccucucuaccacuucccagaaaaccacuugguugccggugcuguuggggagcuucggcuguaagccccugaccauguuccugauuaccgaaaauaaaaucugggggcggaaguccuggccccucaacgagggcaucauggccaucgggaucgucagcauacugcuguccucacucuuaaagaacgacgugccccugccagacccccucaucgccggcggcauccugaucgccugcuacgugaucagcgggucuucagcggaucugucccuggagaaggccgccgagaugagcugggagcaggaggccgaacacuccggcacgagccacaacauccugguagaggugcaggacgacggacccaugaagaucaaagaugaggaacgggacgacacucuaacaaucuuacugaaagcuacccugcucgcgguguccggcgucuacccuaugagcauaccaggaacgcuuuucguaugguacuucuggcaaaagaagaaacagcguuccggcguccugugggacacccccagucccccuaaagucgagagggcgguguuggacgacgguaucuaccggauccuacagagggggcugcugggucggagccagguaggggucggaguguuccaggacgggguguuccacaccauguggcacgucacccgaggcgccgugcucauguaccagggcaagcggcuggagccgagcugggccagcguuaagaaggaccugauauccuacgggggagguuggcguuuucaagguagcuggaauacgggcgaagaagugcaagugaucgccguggagcccggcaagaaccccaagaacguccagaccacuccuggcaccuucaagacuccggaaggagaggucggcgcgaucgcccuugacuuuaagccggggaccucaggcucccccaucgucaacagagaggggaagaucgucggguuauauggcaauggggucgucaccaccagcggcacguaugucuccgccauugcccaggcuaaggccagccaagaagggccguuacccgaaaucgaggaugagguuuucaagaagcgcaaccucaccauaauggaccuccaucccggcaguggcaagacccggcgcuaccuucccgccauuguucgggaggcuaucaagcgcaagcuccggacccugauccuggccccaacccgaguuguggcguccgaaauggccgaggcccucaaagggaugccaauccgcuaccagacgaccgcggucaagagcgagcacaccggccgggagauagucgaccugaugugccacgccacguucacaaugcgccuucucucccccgugcgggugcccaauuacaacaugauuaucauggacgaggcgcacuucaccgacccggcuagcaucgccgcgaggggguacauauccaccagagucggcaugggggaagcagcggccauuuucaugacggcaacgccgcccggcagcguggaggcuuucccacaguccaaugccguaauucaggacgaggagcgcgacaucccggagcgaagcuggaacaguggcuaugacuggauaaccgacuuccccgggaagaccgucugguucguccccucgaucaagucaggcaaugauaucgcgaauugccugcgcaagaacggcaagcgggugauccaauugagccgcaagacguucgacaccgaguaccagaagaccaagaacaacgacugggacuacgucgugacaacggacauuuccgagaugggcgccaacuuucgggccgaccgcgugaucgacccacggcgcugccucaaaccgguuauccugaaggacgggcccgagagagugauccuggccgggcccaugcccguaacaguugcgagcgccgcccagcgccggggccgcauaggucguaaucagaacaaggagggcgaccaguacguguauauggggcagccgcuaaacaaugacgaggaccacgcucacuggacagaagcaaagaugcuauuagauaacaucaacacacccgaggguauuauacccgcacucuuugagccugagcgcgagaaguccgccgccaucgacggggaauaucgccugcggggcgaggcgcgcaagacguucguggaguuaaugcggcgcggcgaccuuccggucuggcuaagcuacaagguggccuccgaagguuuccaguacuccgacaggcgcuggugcuucgacggcgagcggaacaaccagguccuggaggaaaacauggacguggaaaucuggaccaaagaaggggagcggaagaagcuccggccacgcuggcuugacgcgcggacguacuccgacccccucgcccuccgcgaguucaaggaguuugcugcuggccggcgcagcauuagcggagaccugauucuggagauugggaagcucccccaacaccugacccugcgggcccagaacgcgcucgacaaccuggugaugcugcacaacuccgagcagggcgggaaggccuaucgccacgccauggaggaacucccggacaccaucgagacgcugaugcuccucgcccugauagcgguccugaccggcggggugacccucuucuuccugagcggaaagggccuggggaagacuuccauaggccuccugugugugacggccagcuccgcccugcucuggauggccagugucgagccccauuggauugccgcguccaucauccuggaguucuuucugauggugcuccugauacccgagccggaccggcagcgcacgccccaggacaaccagcuagcguacguggucauugggcugcuguucaugauccugaccguggccgccaaugagaugggccuacuggagaccacgaagaaggaccuggggauaggacacguagccgcggagaaccaccaacacgcaaccaugcuggacgucgaccugcggcccgcuagcgccuggaccuuauacgcuguggcgacuacagugaucacgccgaugaugcgccacaccaucgagaauaccacggccaauaucucccucaccgccaucgccaaccaggcggcgauccugaugggacuggacaagggguggccgaucucuaagauggacaucggcgucccccuccuggcacuggggugcuacucccagguuaacccgcuaacgcugaccgccgcagugcugaugcucguggcgcacuacgccaucaucggccccgggcugcaggcgaaggccacgcgggaggcacagaagaggaccgcggccggcaucaugaaaaauccgaccguggacggcaucgucgccauugaccuggacccagucguguaugacgccaaguuugagaagcaacuggggcaaaucaugcuacugauccucugcaccagccagauccugcugaugcgcacgaccugggcccucugcgaguccauuacacuggcgaccggcccccuaacgacccugugggaagggagcccggggaaguucuggaauaccacgaucgccguauccauggccaacaucuuccggggcagcuaccuugccggugcaggccuggcauucagccucaugaagucccucgguggcgggcgccgugggacgggcgcccagggcgaaacccugggcgagaaguggaagcgccagcucaaccagcugaguaagagcgaauuuaacacuuacaagcggagcgggaucauggaggucgaccgaagugaggcgaaggagggccugaagcgcggggagaccacgaagcacgccgugagccggggcacagcgaagcuccggugguuuguugaacgcaaccuggucaagccggagggcaaggucaucgaccugggguguggacgcggcgguuggucauacuacugcgccgggcugaaaaaggugaccgaggucaagggcuacaccaagggagggcccggccacgaggagcccauccccauggccaccuauggguggaaccucgugaagcugcacagcgguaaggacguguucuucaugccucccgaaaagugugacacgcugcucugcgacaucggggaguccucgcccaaccccacuaucgaggagggucgcacacugcgggucuuaaagaugguggagcccuggcuccgcggcaaccaguucugcaucaagauccugaaccccuacaugccuuccguggucgagacgcuggagcagaugcaacggaagcacggaggcaugcucgugcggaacccacugagccgcaacuccacgcacgagauguacuggguuagcugcggcacugggaacaucgucuccgccgugaacaugacuucgcgcauguugcucaaucgguucaccauggcccaccgcaagccuacguacgagcgcgauguggaccugggcgcggggacccgccacguagccguagagcccgaaguggccaaccuagauaucaucggccagcggaucgagaauaucaagaacgagcauaagucaaccuggcacuacgacgaggacaacccuuauaagaccugggccuaccacgggagcuacgaggucaagcccuccggcagcgcuucuagcauggugaacggggugguacggcuacugacgaaaccgugggaugugauccccauggucacccagaucgccaugacugacaccacuccuuucggucagcagcgcguuuuuaaggagaaaguggacacccggaccccaagggccaagcgaggcaccacucaaaucauggaggucaccgcaaaauggcucuggggguuucucuccagaaacaagaaaccccggaucugcacccgugaggaguucacccggaaaguacggagcaacgccgccauaggcgcgguguucgucgacgagaaccaauggaacucagcgaaggaggcuguggaggacgagagguucugggaucuggugcaccgcgagagagaacugcacaagcaagggaaaugcgcgacgugcguuuacaauaugaugggaaagcgcgagaagaagcucggggaguucggcaaagcgaaaggcucccgagcaaucugguacauguggcugggggcucgcuuccuggaguuugaggcgcucggcuucaugaaugaggaccacugguuuagccgagagaacucucugucagggguggagggcgagggacugcacaaacuuggcuacauucugcgcgauaucuccaagauccccggcgggaacauguacgccgaugacacagcgggcugggacacccggaucaccgaggacgaucugcagaacgaggcuaaaaucacagagauuauggagcccgagcacgcccuacuugcgaccagcaucuucaaacugacuuaucagaacaaggugguccgagugcagcgcccggccaagaacggaaccgugauggacgucaucucccgcagggaucagagagggucgggccaagugggaaccuacggccucaacacguucaccaacauggagguucagcugauccgccaaauggagucagagggaaucuucuuacccagugagcucgagaccccaaaucuggcggaaagaguccuggacuggcuagagaagcacggcgccgagcggcugaagcggauggccaucuccggggacgacugcguggugaaacccauugacgaccgcuucgccacagcacugacagcgcucaaugacaugggcaaggugcggaaggacaucccgcaaugggagccuagcaaaggcuggaaugacuggcagcagguccccuucugcagccaccacuuccaccagcugaucaugaaggacggacgcgaaaucguggucccaugccggaaucaggacgagcucguuggccgcgcccgggugagccaaggagccggcuggucccuccgcgagaccgccugccugggcaaaucguacgcccagauguggcagcugauguacuuccacagaagggaccucagacuggcagccaacgcgauuugcuccgccgucccaguggacuggguucccaccagccgcaccacguggagcauccacgcgcaucaccaguggaugacuaccgaggacauguuauccgucuggaaccggguguggauugaggagaaccccuggauggaggacaagacacaugugucguccugggaagaggugccguaccucggcaagcgugaggaccaguggugcgguucuuugaucgggcugacggcccgcgcaacgugggccaccaacauacagguggccauuaaccaaguucgucgccucaucggcaaugaaaacuaucuggacuacaugaccuccaugaagcgauucaagaacgagagcgauccugaaggggcgcugugguaa

SEQ ID NO: 23885 - RNA, 9879 nt, Artificial Sequence
  derived and/or modified CDS sequence (opt11) from DENV-1__GQ868513__SS-prME
agugugaccaugcuauuaaugcugcuucccacagcccucgcauuccaccugaccacccgaggcggggagccccacaugaucgucagcaagcaagagcguggcaagagccucuuauucaagacgagcgcgggggugaauauguguacccugaucgccauggaucuaggcgagcucugcgaagacaccaugaccuacaaaugcccccagauaaccgaagccgagcccgacgacguagacugcuggugcaaugcgaccgacacgugggugaccuacgggacaugcagccagaccggcgagcaccgacgggacaaacgcuccguugcccuggcuccgcacgucggacugggucucgagacucgaaccgagaccuggaugagcagugagggcgcuuggaaacagauccagcgcgucgagaccugggcucucagacaccccggguucacagugaucgcccuguuccucgcacacgcuauuggaaccucgauaacccagaaggggaucaucuucaucuugcugaugcucgugacccccucgauggccaugcgcugcgugggcaucgggaaccgcgacuucguggaggggcugagcggcgccacguggguggacguuguguuagagcacggguccugcgugaccacuauggcgaagaauaagcccaccuuagacaucgagcuucugaagacagaggucaccaaccccgcaauccuccgcaaacugugcaucgaagcaaaaaucagcaauacaaccacggacucccggugcccgacccagggagaggccacccuaguggaagagcaggacgccaacuuuguaugccggcggaccuuugucgaccggggcugggguaacggcuguggccuguucggcaaggggucucugcucacgugcgcuaaguucaagugcgugacuaaauuagagggcaagaucgugcaguaugagaaucugaaguacuccgucaucguaaccgugcacaccggugaccagcaccaaguugggaacgagacuaccgaacacggcaccaucgcgaccaucacgccccaggcgcccacguccgagauucagcuaaccgacuacggggcccuaacccuggacuguucuccccggacgggccuagacuucaacgagaugguccugcucacgaugaaggagaaguccuggcuggugcacaagcagugguuccucgaucugccgcugcccuggaccaguggcgcgagcacaagucaggagaccuggaaucgccaggaucuacuuguaacguuuaagacagcccaugcgaagaagcaggaggugguuguucugggcucccaggagggagccaugcccaccgcccucacaggggccacggagauacaaaccagcggaaccaccacgaucuucgcgggucaucugaagugcagacugaagauggacaaacucacucuaaaagggaccuccuacgugaugugcacugggagcuucaagcuugagaaagaggucgcggagacgcaacacggcaccgugcugguacaagucaaguacgaggguaccgacgcuccuugcaagaucccguuuuccacccaagacgaaaagggggugacacagaacggccgacuuauaaccgccaacccaauagugaccgacaaggagaagcccgugaacaucgaaaccgagcccccuuucggggagagcuacaucguggugggcgcuggggagaaggcgcuuaaauuguccugguucaagaagggcuccuccaucggcaagauguucgaggcuacggcccgcggggccagacggauggcaaucuuaggugacacggcgugggacuucgggagcauuggcggcgucuuuaccucugugggcaagcuagugcaccaagucuuugggacugccuacggcguccuguucagcggcguauccuggacuaugaagaucggaaucggcauccuccugacgugguuaggacucaacagccgcuccaccagccuguccaugacguguauugccgucgguauggugacgcucuaucucggcgugaugguccaggcugacagcggcugcgugaucaacuggaagggccgcgagcuuaagugcggguccggcaucuucgugaccaaugagguccauaccuggaccgagcaguauaaguuccaggcugacagccccaagagacugucggcugccauaggaaaggccugggaggaaggggugugcgggauccgcagcgcaacgcgguuagagaauauaauguggaagcaaauaagcaacgaacucaaccacaucuuacucgagaacgacaugaaguuuacgguggucgugggggacgccaacggcauacuggcgcagggcaagaagaugauacgcccacaacccauggagcacaaguacuccuggaaguccuggggcaaggccaagauaaucggugccgacauccagaacaccacuuucaucaucgaugggcccgacacccccgaguguccugacaaucagcgggccuggaacauuugggagguggaagacuacggcuucgggaucuuuacgaccaacaucuggcugaagcucagagacaguuauacacagaugugcgaccaccggcugaugagcgccgccaucaaggacuccaaggccguccacgccgacaugggcuauuggaucgagucugaaaaaaacgaaaccuggaagcuggcacgcgccaguuucaucgaagugaagaccugcaccuggcccaaaagccacacacucuggaguaacggcgugcuggaguccgaaaugauuaucccgaagaucuaugggggccccaucucucaacacaacuaccgucccggauacuucacccaaacugcaggcccguggcaccuggggaagcuggagcuggacuucgacuuaugugaaggcacuaccgucgugguggacgaacacugcggcaaccgcgggccaucccucagaacaacuaccguuaccgggaagaucauccaugagugguguugccgcuccugcacccugccgccccugcgguuucgcggggaagacggcuguugguacgggauggaaauucggccggucaaggagaaggaagagaaccucgugcgcagcauggucucagcuggcagcggcgagguggacagcuuuagccuggggauccugugugccagcaucaugaucgaggagguaaugagaucacgcuggagccggaagaugcucaugacaggaacccuggcagucuuccugcuccuggugauggggcagcugaccuggaacgacuuaauccguuuaugcaucaugguaggagccaacgccuccgaccgcaugggaaugggcacuacauaucuugcgcuaauggccacguucaagaugcggcccauguucgccguagggcugcuguuucgcagauugaccagccgcgaggugcugcuguuaacaaucggucugucccuggucgcgucaguugagcuaccgaacucccuggaggaacugggcgacgggcucgcuaugggcaucaugaugcugaagcugcucacggaguuccagccccaucaguuguggauaacccuucucagccuuaccuucaucaagaccacgcugucucucgauuaugccuggaagaccaccgccauggcucugaguaucgugucccuguucccccugugccugagcaccacuucgcagaagaccaccuggcuucccguccuccuaggcucuuucggcuguaagccguuaaccauguuuuuaauuaccgagaauaaaauauggggccggaaguccuggccccuuaacgaggggauuauggccauuggcauugucuccauccugcucuccuccuuacugaagaacgacgugccgcuggcagggccccugaucgccggaggaaugcuuaucgcgugcuacgucauaucggggucgagcgccgaccucucccuggagaaggccgccgaggugagcugggagcaggaggccgagcacuccggcacaagucacaacauacuuguggagguucaagacgacgggaccaugaagaucaaggacgaggagagggacgacacccucaccauccuucugaaggcaacgcuccuggcugucucgggcguguaucccauguccaucccggccacccuguucgucugguacuucuggcagaagaagaagcagcgguccggcguuuugugggacaccccgucuccgcccgagguggagagagcuguccuggacgacgggaucuaucggauccugcagcgaggccuccucgguaggucccaggugggcguaggggucuuccaggacgguguguuccauaccauguggcacgugacccgcggggcaguccugauguaccagggaaagcggcuggagccgaguugggcguccguaaagaaggaccucaucagcuacggagggggcuggcgcuuccagggguccuggaacaccggcgaagaagugcaggucaucgcgguggagccugggaagaaccccaaaaacgugcaaacgaugcccggcacguucaagacgcccgaaggggaggucggggcaaucgcccuggauuucaaaccaggcaccagcggguccccgauagugaaccgggaaggcaaaauugugggccuguacggaaacggggucgugaccaccagugggacuuacguauccgccaucgcacaggcaaaagcgagccaggagggcccauuaccggagaucgaggacgaggucuucaaaaagaggaaucuaaccaucauggaccuucaccccgggagcggcaagacccgccgcuaccucccggcaauggugcgggaggccaucaagcgcaagcuucgaacccugauccucgcucccacgcgaguagucgccuccgagauggccgaggcccugaagggcaugccgauccgcuaccagaccaccgccgucaaaagcgaacacaccgggcgggagaucguggaccuaaugugucaugcgacguucaccaugagacuccucuccccgguccggguccccaauuacaacaugaucauuauggacgaggcccacuucacugacccggccagcauugccgcccgaggcuacaucagcacccgaguggggaugggcgaggcagccgcuauauuuaugaccgccaccccgcccgggucggucgaggccuucccccagucaaacgcggugauccaggacgaggaacgcgacaucccugagcggagcuggaacuccggcuaugacuggauaaccgauuuccccgggaagaccgugugguucguccccucaauuaaguccgggaacgacaucgccaacugucugcgcaagaacgguaaacgggugauccagcucagccgcaagacauucgacacggaguaccagaagaccaagaacaaugacugggacuauguagucaccacugacaucuccgagaugggggccaacuuccgggccgaccgcgugaucgacccccggcgcugccuuaagccugugaucuugaaggacggcccggagcgggugauccucgcggggcccaugccaguaacugucgccagcgccgcgcagcgccgggguagaaucgggcggaaccagaacaaggagggagaccaguacgucuacaugggccagccacuaaauaaugacgaggaucacgcacacuggaccgaggcgaaaaugcuucucgacaacaucaacaccccggaagggauaauccccgccuuguucgagcccgagcgcgagaagucugcugcuaucgacggcgaguaccgccugagaggggaggcgcgcaagacauucguagagcucaugcggcgaggggaccugcccguguggcugagcuacaagguugcgucagagggauuucaguacagcgacagacgcuggugcuucgacggggagaggaacaaccaaguccucgaggagaacauggacgucgagauauggacaaaggaaggcgagagaaagaaguugcguccacgcuggcuggacgcucggacguacuccgacccacucgcccugcgagaguucaaggaguucgccgccgggcggcgcucuguuucgggcgaucuuauuuuggagauuggcaagcucccacaacaccugacccucagagcgcaaaacgccuuagacaacuuagugaugcugcauaacuccgaacaaggcgggaaggccuaccgccaugcuauggaggagcugcccgacaccaucgagacguuaaugcuccuggcgcugaucgccguccugacgggaggagugacccuguucuuucugagcgguaagggccucggcaagacgagcaucggacugcugugcgugacggcgaguuccgcccuccuguggauggcaagcgucgagccacacuggaucgcggccuccaucauccuggaguucuuccucauggugcugcuuaucccugagccugacaggcagcgcacuccucaggauaaucaguuggccuacgugguaaucggucuccuguucaugauucucaccguggcugccaacgagauggggcuguuggaaaccacgaagaaggacuugggcaucgggcauguugcggccgagaaucaccagcacgcuaccaugcuggacguugacuuacggccggccagcgcauggacgcucuaugcgguggccaccacggugaucacccccaugaugcggcacacuaucgagaauaccacggccaacaucagucugacggcuauagcuaaccaggcggccauccugaugggccuagacaagggcuggccaaucucaaagauggacaucggggucccguugcuggcacucggcugcuacucccaagugaacccccugaccuuaaccgcugcgguacucaugcuggucgcgcacuacgcaauaaucgggccgggccuucaggcgaaggccacgcgcgaagcgcagaagcgaaccgccgcuggaaucaugaagaaccccaccguggacgggaucguggccaucgaccuggacccggucguguaugacgcgaaguuugagaaacaacugggucaaaucaugcuacucauccuuugcaccagccagauccugcucaugcgaacaaccugggcgcugugcgaguccauaacacuggcuacgggcccccucacuacccugugggaggguagccccggcaaguucuggaacacaaccaucgccgugucgauggcaaacaucuuccggggcagcuaccuggccggugccggcuuagcguuuuccuuaaugaaaucccugggcgggggcagacgggggacgggcgcgcagggggagacccuaggggagaaguggaaacgccaacugaaccaauuauccaagucggaguucaacacuuacaagcggagcgggaucauggaggucgaccgauccgaggccaaggagggacucaagcggggugagaccacaaagcacgcggugucucgcgggaccgcuaagcugcggugguuugucgaacgaaaucuggucaaacccgagggcaagguaauugaccucggcugcgggcggggcgguugguccuacuacugugcuggccucaagaaggucaccgaggucaagggguacaccaagggcggcccggggcacgaggaacccauccccauggcuacguacggcuggaaccuggugaagcugcacagcggcaaggaugucuucuucaugcccccggaaaagugugauacgcuuuugugcgacaucggcgaaucuagccccaacccgacuaucgaagaggggcgcacgcugcgggucuugaaaaugguggagccgugguuacguggcaaucaguucuguaucaagauccugaacccauauaugccaagcguggucgagacccucgagcaaaugcagcggaagcacggcgggaugcucguccgcaacccgcugucucggaacuccacgcaugagauguacugggugagcugcggcaccggcaacaucgucuccgcggugaacaugacgagcaggaugcucuugaaccgguucaccauggcgcaccgcaagccaaccuacgagagggacgucgaccugggcgccggaacccgccacgucgcaguagaaccggagguugccaaccuugacaucaucggacaacgcauagagaauaucaagaacgagcacaaauccaccuggcacuacgaugaggacaauccguacaagaccugggccuaccacggcagcuacgaaguaaagcccucagggagcgcaucuaguauggugaacggagucguacggcuucugacgaagcccugggacguuaucccuauggucacccagaucgcuaugaccgacacuacgcccuucggccagcagcgcguguuuaaggagaagguagacacccggacaccccgcgccaagcggggcacuacccaaaucauggaggucacggccaaguggcucuggggauucuugucacggaacaagaaaccacggaucugcaccagagaggaauucacccggaagguucgcagcaaugccgcgauaggugccguguucgucgacgagaaucaauggaacagcgcuaaggaagcugucgaggacgagcgcuucugggaucugguccacagggagcgggaacuacacaagcaggguaaaugcgcgacgugcguguacaacaugauggggaagcgcgagaagaagcugggcgaguucgguaaagccaaggggucacgggcuauuugguacauguggcucggugcucgguuccucgaauucgaagcccugggguucaugaacgaagaucacugguucagccgagagaacucccugucaggcguggagggggaaggacuccacaaacucggauacauccuacgagauaucucaaagaucccggggggcaacauguacgcggacgacaccgccgggugggacacccggauaaccgaggacgaccuccagaacgaggccaagaucacugagauaauggagcccgagcacgcauuacuagccacgagcauuuucaagcucaccuaccagaacaagguaguccgcgugcagagacccgccaagaacggcaccguuauggacgugauaucccgccgugaccaacgggggagcggccaagugggcacauacgggcugaacaccuucacgaauauggaggugcagcugauccgccagauggagagugagggcaucuuuuugccaagcgagcucgaaacccccaacuuggccgaacggguccucgacuggcuggagaaacacggggccgagagacuaaaacggauggccaucagcggcgaugacugcguagugaagcccaucgacgaucgcuucgccacggcgcucacggcgcugaacgacauggggaaagucaggaaggauauuccccagugggagccaaguaaaggcuggaacgauuggcagcagguucccuucugcucccaccacuuccaucaguuaauaaugaaagacggccgcgagaucgugguccccugucggaaccaggaugagcuaguugggcgcgcccgagugagccagggcgcgggguggucccugcgcgagacagcaugucuagguaaguccuaugcucagauguggcagcuuauguacuuccaccggcgggacuugcggcuggccgccaacgccauuugcuccgcaguccccguugacugggugccgaccucgcgcaccaccuggagcauccacgcgcaccaccaguggaugaccacugaagacaugcucucuguauggaaucggguauggaucgaggagaaccccuggauggaggacaagacccacguaaguucuugggaggaaguccccuaccugggcaagcgugaggaccaguggugcggcucucugauuggcuugacggcccgcgccacaugggccaccaacauccagguggcuaucaaccagguucggcgccugaucgguaacgagaauuaccuggacuacaugacguccaugaagcgguucaagaacgagagcgaccccgagggcgccuuaugguga

SEQ ID NO: 23886 - RNA, 9879 nt, Artificial Sequence
  derived and/or modified CDS sequence (opt11) from DENV-1__GU131973__SS-prME
ucuguuacaaugcuucuaaugcuacuuccuacagcccuggccuuccaccugacuacaaggggcggugaaccacacaugauaguaaguaaacaagaacgaggcaaaucgcuacuuuucaaaacauccgccggugucaauauguguacgcuaaucgcaauggaccuaggggaauugugugaagacacaaugaccuauaaauguccgcaaauaacggaagcagaaccggaugacguggacugcugguguaacgcgaccgacaccugggugacguaugggacguguagucagacaggagagcaucgacgagauaaacgcagcguagcccuagcgccacauguuggcuugggccuagaaaccaggacagagacguggaugucuuccgagggggcauggaaacaaauacagaggguagagaccugggcccuccgccauccaggauucacggugauagcuuuauuucucgcacacgcgauagguacgagcauaacgcagaaggguauaaucuucauauuacucaugcucguaacgcccucgauggcuaugaggugcgucggaauagggaaucgggacuucguagagggauugaguggggcgaccugggucgacgucguucuagaacaugggagcuguguaacaacaauggccaagaacaaaccaacccuugacauagaguuacugaaaacggagguuaccaaucccgcuauacucagaaaacugugcaucgaggcuaaaaucuccaacaccaccaccgacucgcguuguccaacacaaggcgaggccacgcuuguagaggagcaggacgcaaacuucgucugcagacgaacauucgucgaccggggcuggggaaacggcugcggacuguuuggcaaaggaagccuacucacaugugccaaauuuaaaugugucacgaaacuagaagggaagauugugcaguacgagaaccucaaguacucagucaucgucacgguccacaccggggaccaacaucaggucggaaaugaaaccacggaacacggcaccaucgcuacaauaacaccccaggcuccgacaucggaaauccaacucaccgauuacggagcacugaccuuggacugcucccccagaaccggucuagauuucaaugaaaugguccuacugaccaugaaagagaaguccuggcucgugcacaaacaaugguuccuagaccuuccacucccauggaccaguggagcaucaacgagccaagaaacauggaacaggcaagaccuccuaguuacauucaaaacagcgcacgcuaaaaagcaagagguaguaguacucgggucccaagaaggggcuaugcauacugcacucacaggagcgacagagauacagacuuccggcacuaccacgauauucgcgggacaccugaaaugcagacugaaaauggacaaacugacgcucaagggcaccagcuacgucauguguacaggauccuucaaauuagaaaaagaaguggcggaaacacagcacggcaccguccuaguacaaguaaaguacgaggggacggacgcgccguguaagauaccuuucagcacacaagaugaaaaaggcguaacgcaaaauggacgccuaaucaccgcgaacccgauaguaacggauaaagagaaacccgugaacauagagacugaaccgcccuuuggagaauccuacauagucgucggcgccggcgaaaaagcacuaaagcuaagcugguuuaagaaaggauccucuauaggcaagauguuugaagcaacagccaggggugcgcgccgaauggcaauucuuggcgacacagcaugggacuucgggagcauugguggaguauuuacgagcgucggaaagcuaguacaccaagucuucggaacggcguacggcguccucuucaguggagucuccuggacaaugaaaauaggaauaggcauucuacugaccuggcuuggacuuaacucacgguccacuagccuaagcaugaccuguauagcaguaggaauggucacccuguaccugggaguuaugguccaagcggauucagggugcguuaucaacuggaaggggagggaguuaaaaugcgggucagggaucuucgucaccaacgaaguacacacuuggacggaacaauacaaguuucaggcagacucgccgaagcgauuaagugcagcuauagggaaagccugggaagaagguguaugcgggauaaggucagcgacgcgccuggagaauauuauguggaaacagaucagcaacgagcuuaaucacauucuacuggaaaacgauaugaaguucaccguuguaguaggggaugcaaacgggauccuggcgcaaggcaagaaaaugauuaggccgcaacccauggagcacaaguacagcuggaagucaugggggaaagcuaagauaauaggcgccgacauccaaaacacaacuuucaucauagaugggccggacacuccagaaugcccugauaaucagcgggcguggaacaucugggaagucgaagauuacggcuuuggaaucuucaccaccaacauaugguugaagcugcgagacuccuacacacaaaugugcgaccacagauuaauguccgccgcgauaaaagauaguaaggcuguucaugcggauaugggauauuggauagaaucugagaaaaaugaaacauggaaacuggcucgagcaucuuucaucgagguaaaaacuuguacauggccgaaaucucacacgcuauggucuaacggcguauuggagagugagaugauaauacccaaaaucuacgggggcccuauuagccaacauaacuaccgaccaggguacuuuacgcaaaccgcaggcccauggcaucuugggaaacuugagcuggacuucgacuuaugugaaggcaccacaguaguaguagaugaacacugcggaaauagagggcccucccuccggacuacuacggucacaggcaagauaauucaugaguggugcuguagaaguugcacgcugcccccgcugcgguuucggggcgaggacgggugcugguauggcauggagauccgcccaguaaaggaaaaagaagagaaucucgugcgcucuaugguuucagcagguucgggagaaguggacagcuucagcuuaggcauucugugcgugagcauaaugaucgaagaaguaaugcggagccguuggucacgcaagaugcuaaugacagggacacuggcgguguuccuacuccucguaaugggccaacugacauggaacgaccugauucggcuguguaucauggucggcgcgaacgccagugacagaaugggaauggggacuaccuaccucgcgcucauggcaaccuucaagaugcgaccuauguucgccguaggacuacucuucagacggcucacgucucgcgagguacuacugcugaccauugggcucucccuggucgcgagcguagaacugccaaacagccuagaagaacucggagauggacuagcgauggggauaaugaugcugaaacuacugaccgaguuucaaccacaccagcuauggacgacgcucuugagccuaacguucauuaagacaacauuaagucuggacuaugcguggaaaacuacggcuauggcccuuucaaucguaucgcuauucccucuaugucuaucaacgaccucgcaaaagaccacaugguuaccaguccucuuaggcaguuucggcugcaaaccucugacgauguuccuuaucacggagaacaaaaucugggggagaaaaagcuggccacucaacgaagguaucauggcaauaggcauagugucaaucuuguuaaguagccuucucaaaaacgacgucccacuagcaggcccacuaauagcaggcgggaugcugauugcaugcuacguaauuuccggaaguuccgcagauuuaagccuggaaaaagccgcggaagucagcugggaacaggaggccgaacacaguggaacgucccacaauauccuagucgaagugcaagacgacggaacgaugaagaucaaggacgaagaacgggacgauacgcucacgauacuacucaaagcaacgcuuuuggcaguaucaggggucuacccaaugucaauuccggcaacgcuauucguuugguacuuuuggcagaaaaagaaacaaagaucagggguccuaugggacaccccaucgcccccugagguagaaagggccguacucgaugacggcaucuacaggauccuucaacggggccuacuaggcaggucacaagugggcguaggaguauuccaagacggcgucuuccacacaauguggcacguaaccagaggcgcgguccucauguaccaagggaaacgccuagagccgaguugggcaaguguaaagaaagaccuuauaagcuacggcgggggauggagguuccaggguagcuggaacacgggagaagagguccaagugauagcgguugaaccgggcaaaaauccgaaaaaugugcaaaccacgcccggaacuuuuaaaacaccggagggagaagucggagccauagccuuagacuucaaaccagggaccucaggguccccaauaguaaacagggaaggcaagauaguaggacuauacgguaacgggguggucacaaccagugggacguacgucagugcgaucgcgcaggcgaaagccucccaggaaggcccacuacccgaaaucgaagacgaaguauucaagaaacgaaaucuaacuauuauggaccuucaucccgggucaggaaagacccgccguuaucucccagcuaucguacgagaagccauaaaacggaagaugcgcacgcugauacuggccccuacacgugucguagcauccgagauggccgaagcauuaaaaggaaugcccaucagauaccaaacaaccgccgugaaaucggaacacacgggccgcgagauaguggaucugaugugccacgcaacuuuuacaaugcgccugcucucgcccgucagaguaccuaacuauaauaugaucaucauggacgaagcucacuucaccgacccagccagcaucgccgcacggggcuacaucagcacccgagucgggaugggagaagcagccgccaucuucaugacggccacgccaccggggagcgucgaagcauucccgcaaagcaaugcgguaauccaagaugaggaacgagauauccccgagcgcucauggaacucaggguaugacuggaucacggacuucccuggcaaaacagucugguucgugccaucgaucaagaguggcaaugacauagcuaacugccugcgcaaaaacggaaagaggguuauccaacuuucucggaagacuuucgacacugaguaccagaaaaccaaaaacaacgacugggauuacgucguaacgacggauaucuccgagaugggugcuaacuuucgcgccgaccgaguuauagauccacgccgcugcuugaaacccguaauacucaaggacggccccgaaagagucaucuuggcggggccgaugcccguuaccgucgcgucggcugcgcaaagacguggccguaucggccgaaaccaaaacaaggaaggagaucaguauguauacaugggucaacccuuaaauaacgacgaagaccacgcacacuggaccgaagccaagaugcuccucgacaacauaaacaccccggaaggaauaauacccgcauuguucgagcccgaaagggagaagucggcggccauagacggagaauacagacuaagaggggaagcacggaaaacguuugucgaauugaugagaagaggggaucugcccgucuggcuaucauacaaggucgccagugaaggcuuccaguacucagaccgcagauggugcuucgacggcgaaaggaacaaccaggugcuagaagagaacauggacguugaaauauggaccaaggaaggcgaaaggaagaaacucagaccccgaugguuagacgcaagaaccuauagcgauccacuggcgcugagagaguucaaggaguucgcugcagguaggcgcagcguaagcggagacuugauacuagaaauaggcaaauugccacagcaccuaacgcuacgggcgcagaacgcccuggacaaccuaguaaugcugcauaacucugagcaaggagggaaagccuacaggcacgccauggaagaacugccggacacaauagaaacucucaugcugcuggcccugauagcgguccucacgggaggggucacguuauucuuucucuccgggaaaggccuugggaaaacuucaauaggucuccuaugcgucaccgcguccucggcacuguuauggauggcaagcgucgagccccacuggauagccgcaagcaucauccuagaguucuuccucaugguccucuuaauacccgaaccagaucgccaaagaacaccccaagauaaccagcucgcauauguaguaaucgggcuccucuucaugauacucaccguagcugcuaaugagauggggcugcucgaaaccacaaagaaggaccuaggcaucggacacguggcggcagagaaccaucaacacgccacuaugcucgauguggaccuacgucccgcgucugcuuggacccuguacgcaguggcaacaacgguaaucacacccaugaugagacauacgauagagaacacaacggcaaacaucagccucaccgccauagcaaaucaagccgcgauacuaaugggccuagacaaaggauggcccaucuccaagauggacauaggagucccgcuucuggcacuagggugcuacucccaagugaacccacuuacgcuuaccgcggccguucuaaugcuagucgcccacuacgccaucauaggaccaggccugcaagcaaaggccacaagggaggcccaaaagcgcaccgccgccgguauaaugaagaacccaacgguagauggcaucguagcgaucgaccuagacccgguagucuacgacgcgaaauuugaaaagcagcuagggcaaauaauguugcuaaucuuguguaccagccagauccugcucaugcgaacaaccugggccuuaugcgaaucgauuacccuugcgaccgggccacuaacuacacuaugggaagggagcccaggcaaauucuggaacacaacaauagcgguuucgauggcaaacaucuuccgaggcagcuaccucgcuggggcgggucucgcguuuagccucaugaaaucacucggcggaggacguagaggaacaggcgcccaaggcgagacccugggagaaaaauggaaaaggcaacuuaaccaacuauccaagagugaguucaauaccuacaaaaggucaggaaucauggaggucgacaggucugaggcaaaagaagguuuaaaacgcggcgaaacaacaaaacaugcgguaagcagaggcacagcaaagcucagaugguuuguagaacgaaaccucgucaaacccgaaggaaaaguuaucgaccuaggcugcggcagaggaggcuggagcuauuacugcgcaggccucaagaaaguaaccgaagucaaagguuauaccaaagggggcccggggcacgaagaacccaucccuauggccaccuacggguggaaccugguaaaacugcacaguggaaaagacguauuuuucaugccacccgagaagugcgacacccucuuaugcgacauaggggaaucgucccccaacccaaccaucgaggaaggccgcacgcuucgcguacuuaagaugguagaacccuggcugcgcggcaaccaguucugcaucaagauccugaacccauacaugcccagcguuguggaagcguuagaacagaugcagcggaaacacgguggaaugcucguccgcaauccacucucgcggaacuccacucacgagauguacuggguauccugcgggacggggaacaucgucucagccgugaacaugacaagcagaaugcuguuaaaccgauucaccauggcacacaggaagccaacuuacgaacgggaugucgaccuuggagcgggaacgagacauguagccgucgaaccagagguagcuaacuuggacaucauaggacaacguaucgaaaacaucaagaaugaacauaaauccacguggcacuacgacgaagacaacccauauaagaccugggcauaccacggcagcuacgaagucaaaccaaguggcucagcaaguagcaugguaaauggcguaguccgccuccugaccaaaccgugggauguaauaccaaugguuacacaaaucgcaaugacagacaccacacccuucggccaacaacggguguucaaagagaagguugauacacguacgccacgugcgaaaagggggacaacacaaaucauggaggucacagcaaaguggcucuggggguuccucagccggaacaaaaagccgcggaucugcacacgagaggaauuuacgcgaaaaguucgaucaaaugcggcaaucggagcuguauucguggacgaaaaccaauggaacagugcgaaggaggccgucgaagacgaacgguucugggaucucguucaucgggaacgggaacuucacaagcaggggaagugcgcuacaugcguauacaacaugauggguaaacgcgaaaagaaguugggcgaguucggcaaggccaaggggagcagagccauaugguacauguggcucggcgcgcguuuccucgaguucgaggcccuaggguucaugaacgaggaucacugguucagcagggagaacucacugagcgguguagaaggagagggacugcauaagcuaggauacauucuccgggauauaagcaagaucccaggagggaacauguacgcggacgauacagcuggaugggauacccguauaacggaggacgauuuacagaacgaagcaaagauaaccgaaaucauggagccugaacacgcacuacucgcgacaagcaucuucaaacucacauaccagaacaaaguaguucgcguucaaagaccggccaagaacgggaccguaauggacgugaucucacgcagagaccaacgaggguccggccaggucggaacauacggucugaacacguuuacgaacauggaagugcagcuaaucagacaaauggagagcgaaggaauauucuugcccucagaguuagaaaccccaaaccucgcugagaggguccuagacuggcucgaaaaacacggagccgaacgccugaaaaggauggcaauaagcggagacgauugugugguaaaaccuauagacgacagauucgcaacggcacuuacggcccucaacgauaugggcaagguaagaaaagauauaccccagugggaaccgagcaagggcuggaacgacuggcaacaaguaccauucugcucucaucauuuucaccagcuuauaaugaaagacggaagagagauuguggucccuugucggaaccaagacgaguugguuggcagagcaagaguaagccagggcgccggcuggaguuuacgcgaaacagcaugccuaggaaagucauacgcccaaauguggcaauuaauguacuuccacagaagggacuugagacuggccgcgaacgcaauaugcuccgccgucccuguagacuggguaccgacaucgcgcaccaccuggucaauacacgcacaccaccaguggaugacgaccgaggauaugcucuccgucuggaacaggguauggaucgaagaaaacccauggauggaagacaagacacacgucucaucgugggaagagguaccauaccuggggaaacgugaggaucaauggugcggcucacugaucggucuaaccgcucgagcaaccugggcaacaaauauacaaguagcaauaaaccagguacggcgauugauuggcaacgaaaauuacuuagacuacaugacgucgaugaagcgcuucaaaaaugaaucggacccugaaggagcacuuugguag

SEQ ID NO: 23887 - RNA, 9879 nt, Artificial Sequence
  derived and/or modified CDS sequence (opt11) from DENV-1__GQ868517__SS-prME
agcgugacaaugcugcucaugcugcuacccaccgcucucgccuuccaccugaccaccagaggcggggagccgcacaugaucgugagcaagcaggagagaggcaagagccuccuguucaaaacuuccgccggugugaacaugugcacgcugaucgccauggaucugggcgagcucugcgaggacacuaugaccuacaagugcccacagauuaccgaggccgagccggacgauguggacugcuggugcaacgcaaccgacacuugggugacauaugggaccugcucacagaccggugagcaccggcgggacaaacgcuccgucgcccuggcgccccacgugggccugggucucgagacucggaccgagacauggaugagcagugagggcgccuggaagcagauacagagagucgagaccugggccuugcggcacccgggguuuacggugaucgccuuauuccucgcgcacgccaucggcaccagcaucacccagaagggcaucaucuuuauccugcugaugcucguaacccccuccauggccaugaggugcgucggcaucgggaacagagacuucguggagggacugagcggcgccacguggguggacgucguccuggagcauggguccugcgugaccaccauggccaagaacaaacccacccucgacaucgagcugcugaagaccgaggucacaaacccggcgaucuugcgaaagcuuugcaucgaggcgaagaucagcaacacaaccacggauucgcgguguccgacccagggagaggcgacccucguggaggagcaggacgcaaacuucgucugcagacggaccuucguugacaggggcugggggaauggcuguggccucuucgggaaggggagccuacugacgugcgcaaaguucaagugcgugacaaagcucgagggcaaaauugugcaauacgaaaaccugaaguacuccgugaucgugaccguacacacaggcgaccagcaccagguagggaacgagacgacugaacacggcaccaucgcaaccaucacuccacaggcccccacguccgagauccagcuaaccgacuauggggcccugacccuggacugcagcccccggaccggcuuagacuuuaaugagaugguacuccuuacgaugaaggaaaagucauggcugguacacaagcaaugguuccucgaccugccgcugcccuggaccuccggcgccaguacaagccaggagaccuggaaucgccaggaucuccuggugacguucaaaaccgcacacgcuaaaaagcaggagguggucguguuaggcucccaagaaggggccaugcacaccgcccucaccggugcaacggagauccagaccucgggcaccaccacgaucuucgccgggcaccugaagugucgacuaaagauggauaagcucacacugaagggcaccuccuacgucauguguaccgggagcuucaagcuggaaaaggaggucgcugagacgcagcauggcaccguccuggugcaggucaaguaugagggcaccgacgcccccugcaagauccccuuccucacccaagaugagaagggaguaacgcaaaacggccgccugaucaccgcaaacccgauagugaccgacaaggagaagccugugaacauugagaccgagccgcccuucggggagucauacaucguggugggcgccggcgaaaaggcguuaaagcuuagcugguuuaagaagggguccucgauugggaaaauguuugaggcuaccgcccgcggggcccgccgaauggccauccugggcgacaccgcgugggacuucgggucuaucggcggcgucuucaccagcguggggaagcuagugcaccaggucuuuggcaccgccuacgggguccucuucagcggcgugagcuggacgaugaaaaucgggauuggcauccugcugacauggcucggccugaacagccgcagcacauccuugagcaugacuugcaucgccguagggauggugacgcucuaccugggggugaugguccaggccgacuccgggugcgugaucaauuggaaagggagagagcugaagugcggaagcggcauuuucgucaccaacgaaguccacaccuggaccgagcaguacaaauuccaggccgacuccccgaagcgccucagcgcggccaucggcaaggcuugggaggaggguguaugcggcaucagaagcgcuacgcggcuggagaacauaauguggaagcagaucaguaacgagcugaaucacauccuccucgagaaugacaugaaauucacgguggucgugggggacgccaacggaauccuggcgcaggguaagaagaugauuaggccccagcccauggaacacaaguacagcuggaaguccugggguaaagccaaaaucaucggugcggacauccagaacaccaccuucauaaucgacgggcccgacaccccggaauguccagacaaucagcgggcauggaacaucugggagguggaggacuacggauucggaaucuuuacaaccaacauauggcucaaacugagggacagcuacacccagaugugcgaucaccgauugauguccgcagccauuaaggacagcaaagccguccacgccgacaugggcuauuggaucgagucugagaagaacgagaccuggaaacucgcccgcgcaucauucaucgaggugaagacguguaccuggcccaagucccauacacuauggagcaacggcgugcuggaguccgagaugaucauucccaagaucuacgggggcccuauaagccagcacaacuaccguccgggguauuucacccagacagcagggccuuggcaccucgggaagcuggagcuggacuuugaccucugcgagggaacaaccgucgugguggacgagcauugugggaaccgggguccaucccugcggacaacaacagucacaggcaagaucauccacgaguggugcugccgcagcugcaccuuaccgccccuccgguuccgcggcgaagacgguuguugguacggcauggagauccggcccgucaaggaaaaagaagagaauuuagugcgcuccauggucagcgccggcagcggcgagguugauucauucagccugggaauucucugugccuccaucaugaucgaagaggugaugcggagccgcuggucccggaagauguuaaugacgggcacucuggccgucuuccuccuguuaauaauggggcagcucaccuggaaugaccugauccgauuguguaucauggugggcgcgaacgccagcgaccgcaugggcaugggcacuaccuaccucgcccuuauggccaccuucaagaugcggccgauguucgccguggggcuccucuucagacggcugaccucgcgugaaguccuccuccugacuauaggucugagccucguggcgaguguggaacugcccaauagccuggaggagcucggagacgggcuggccaugggaaucaugaugcugaagcuccucacggaguuucagccccaccagcuauggaccacacugcugucucugacuuucauuaagacgacccucucucuggauuacgccuggaagaccacagccaugguccugucgaucgugagccucuucccccuguguuuguccacgaccagccagaaaacuacuuggcugccgguccugcugggcuccuucgggugcaagccccuuaccauguuucugaucacggagaacaagaucuggggucggaagagcuggccccugaacgaagggauuauggcgaucggcaucguguccauccuccuaagcagucugcucaagaacgacgugcccuuggccggaccgcugaucgcugggggcaugcucaucgccuguuacgucaucagcggauccuccgccgacuugagccuggagaaggcggcagaaguuuccugggagcaggaggcugagcacucgggcacaucccacaacauccucguggagguccaggaugacgggaccaugaaaaucaaggacgaggaacgcgacgacacccugacaauccucuugaaggcuacuuugcuugccgucucaggaguuuacccgauguccauacccgcgaccuuauucgugugguacuucuggcagaaaaagaagcaacggucgggggugcugugggacaccccguccccgccagaaguggagagagccguuuuggaugacggaauauaccggauucuucagcgcggccuccugggcaggucccaggugggcgugggggucuuucaggacggcguuuuccacacgauguggcacgucacccgcggggcgguccugauguaucagggcaagcggcucgagcccucuugggccagcgugaaaaaggaccugaucuccuacggagguggauggcgauuccaggguagcuggaacaccggcgaggaggugcaggugaucgccguggagccugggaagaacccgaagaacgugcagaccacgcccggcaccuuuaagaccccugagggugaggucggugcuauugcacuggauuucaaaccgggcacauccgggagcccgaucgugaaccgggagggcaagaucgugggccucuacgggaacggcgucgugacaaccuccgggacguacgugagcgccauagcccaagccaaggcgucccaggagggcccccugccagagauugaagacgagguauuuaaaaaacgcaaccugacaaucauggaccuccacccugggagcggcaagacgagacgcuaccugccagccaucgugagggaggcuauuaagcgcaagcugcgcacccucauucuugcccccacccgcguggucgcgagcgagauggccgaggcccuaaagggcaugcccauccguuaccagacuacugccguuaaguccgagcacacugggcgugagaucguggaccucaugugccacgccaccuuuacuaugcgucugcugagcccuguacggguucccaacuacaacaugauuaucauggacgaggcgcauuucacggaccccgcauccaucgccgcccgcggcuacaucagcacccguguggggaugggcgaagccgcggcgauuuucaugacugccacgccgccgggguccgucgaggccuucccccagagcaacgcugugauccaggaugaggaacgcgacaucccggagcgauccuggaacucuggcuacgacuggaucacggacuucccuggaaaaaccgucugguucguccccucuaucaagagcgggaacgacaucgcgaacugucuccgcaagaacggcaagcgggugauccagcugucacgcaagacuuucgauaccgaguaccagaagacaaagaacaacgacugggacuacguggugaccaccgacauaagcgagaugggggccaacuuccgggcagaccguguaaucgacccccggcgcugucugaaaccugugauccucaaggacggccccgagcgagucaucuuagccgggccgaugcccgugaccguggcguccgccgcgcagcgccggggccgcaucggccggaaucagaacaaggaaggggaccaguacgucuacaugggccaaccccugaacaacgacgaggaccacgcccacuggaccgaggccaagaugcuccuggacaacaucaacacccccgaggguaucaucccggcgcucuucgaacccgagcgcgagaaguccgcagcgaucgacggcgaguaccgccuccgcggcgaagcccgcaagacauucguugaacugaugcgccgaggcgaccugcccguuuggcuaucguacaagguggccagcgagggcuuucaguauuccgaccggcgcuggugcuucgacggggagcguaacaaccagguucuggaggaaaacauggaugucgaaaucuggaccaaggagggcgagcgcaagaaacugaggccccgcuggcucgacgcgcggaccuacagugacccgcucgcccugcgcgaguuuaaagaguuugccgccgggcgaagauccguaagcggcgaccucauccuggagauuggcaaguugccucagcacuuaacgcugagagcucagaacgcgcuggauaaccucguaaugcugcacaacagcgaacaaggagggaaagccuaccgccacgccauggaggaacugcccgacaccaucgagacauugaugcugcuggcucucaucgccguccugaccgggggcgugacgcuguuuuuucucuccgggaaggggcuagggaagaccucuaucgggcugcuaugcgucaccgccagcagcgccuuguuguggauggccuccgucgagccccauuggaucgccgcgagcaucauccucgaguucuucuugauggugcugcugaucccugagccagaccgucagcgcacaccccaggacaaccagcuggccuacgugguuaucgggcuccucuucaugauccucacgguggccgccaacgagauggggcugcucgaaaccacuaagaaagaccugggcaucgggcacguggccgcggagaaucaccagcacgccacgaugcuggacguugacuugagaccggccuccgccuggacgcuguacgcuguugcgacuacugugaucaccccuaugaugcggcacacgaucgagaacaccacugcgaacaucucauugacggccauagccaaccaagcggcgauacucaugggcuuggacaagggcuggcccaucuccaagauggacaucgggguaccccugcucgcccugggcugcuacagccaggugaacccgcucacucucaccgcugccguucugaugcuggucgcgcacuacgccaucaucgggcccggcuuacaggcaaaggcuacucgggaggcccaaaagcgcacggcggcagggaucaugaagaacccgacggucgacggcauuguggccaucgaucuggaccccgugguguacgacgccaaguucgagaagcaacuaggccagaucaugcuccugauauuauguaccucacagauccucuugaugcgcaccaccugggcgcugugcgaaagcauuacguuagcgaccgggccguugaccacccugugggagggcuccccagggaaguucuggaacacgaccauugccgugagcauggccaacauauuccggggcuccuauuuagcuggugccggccuagcguucucuuuaaugaagucccucggcgggggccgccggggaaccggugcccagggcgagacccucggugagaaguggaagaggcagcugaaccagcucagcaaguccgaauucaacacguacaagcggagcggcaucauggaggucgacaggucagaggccaaggagggccugaagcgcggcgagacaaccaaacacgcaguaucgagaggcaccgcuaagcugcguugguuugucgagcgcaacuuagucaagccagagggcaaggugaucgaucuaggcugcggucgggggggguggagcuacuacugugccggccugaagaaagucaccgaggucaaaggauacacaaagggugggcccgggcacgaggaaccgauccccauggccacuuacggguggaacuuagugaagcuccacucaggcaaagacguguucuuuaugccgcccgagaagugcgacacccugcuuugugacaucggggagagcuccccgaaucccacuauagaggaggggcgcacucuacggguacugaagaugguggagcccuggcugcgcggcaaccaguucugcaucaagauacucaauccauacaugccgucuguagucgagacccucgagcagaugcagcguaagcacggcgggaugcugguucgcaacccccuuucccggaauagcacccacgagauguacuggguuucguguggcaccgguaacaucgucucugccgugaacaugacguccagaaugcuucuuaaccgguucaccauggcccacagaaagcccacauucgagcgcgacguggaccucggcgcggggacgcggcacguggccguggagccggagguggccaacuuagacaucaucgggcagcgcaucgagaacauuaagaacgaacacaagagcacguggcacuacgaugaggacaacccguacaagaccugggccuaucacggcucauacgaggucaagcccucuggaucugcuagcaguaugguaaacggggugguucggcugcucacaaaaccgugggacgugauacccauggucacacaaaucgccaugacggauacgaccccauucggccagcagcgaguguucaaggagaaaguggauacgcggacgcccagagcuaagcggggcaccacccagaucauggagguuaccgcaaaguggcuguggggcuuccucagccgaaauaaaaagccccggaucugcaccagagaggaguucacccggaaggugagauccaacgcagccaucggggcgguguuuguagacgagaaccaguggaacagcgccaaggaggcaguggaggacgaacgguucugggaccucgugcaucgcgaacgggagcugcauaaacagggcaagugcgcgacuugcgucuacaacaugauggguaagcgggagaagaaacugggggaguucgggaaggcgaagggcagccgggcuaucugguacauguggcucggcgcccgguuccuagaguucgaggcccucggcuucaugaacgaggaccacugguucucgcgugaaaacagccucuccggggucgagggcgaaggcuuacacaagcugggguacauccuccgcgacaucagcaagauccccggggggaauauguacgccgaugacaccgcagggugggacacgaggaucacagaggacgauuuacagaaugaggcuaaaaucaccgacaucauggaacccgagcacgcccuccucgcuaccuccauauucaagcugaccuaccaaaauaagguggucaggguucagcgccccgcuaagaacggcaccgugauggacgucauaagccggagggaccagagaggguccggccaaguggggaccuacggccugaacaccuucacgaacauggaaguucaacugauccgccaaauggagagcgagggcaucuuccugcccuccgagcuggaaaccccgaaccucgcagagcgagugcuggacuggcucgagaagcacggugcagagcgccucaaacggauggcuaucagcggcgacgacugcgucgugaagcccaucgacgaccgcuuugccacagcucugaccgcgcugaacgacauggggaaaguccggaaggacaucccccagugggaaccuuccaagggcuggaaugacuggcaacaagucccuuucugcagccaccacuuccaccagcuuauuaugaaggacggcagggaaauagugguucccugccggaaccaagacgagcuaguagguagagcccgagugucccagggggccgguuggagucugcgcgaaaccgccugccucggcaaaucguaugcccagauguggcagcuaauguacuuucaucggcgcgaccugcggcucgcggccaacgccaucugcagcgccgucccuguggacugggugccuacuucucgcaccacguggagcauccacgcgcaucaccaguggaugaccacggaagauaugcugagcgucuggaaccggguguggaucgaggagaacccguggauggaggauaagacccacguguccagcugggaggaggucccuuaccuggguaagagagaggaccaauggugcggcucccucaucggucugaccgcccgcgccaccugggcuacaaacauacagguggcuauaaaccagguccggcgccugaucgggaaugagaacuaccucgacuacaugaccucuaugaagcgguuuaagaaugaguccgacccugaaggagcgcugugguga

SEQ ID NO: 23888 - RNA, 9879 nt, Artificial Sequence
  derived and/or modified CDS sequence (opt11) from DENV-1__GU131976__SS-prME
ucagugaccaugcugcucaugcugcugcccaccgcccucgccuuccaccucaccacccggggcggggagccgcacaugaucguaagcaagcaggagagaggcaagagccuccuguucaagaccucugcuggggugaacauguguacacucaucgccauggaucugggcgaguugugcgaggacaccaugaccuacaaaugcccccagaucacagaggcagagcccgacgacguggacugcuggugcaacgccaccgacaccugggucacuuacgguacaugcagccagacgggcgagcaccggcgggacaaacgcuccguggcccuggcgccccacgucggacuggggcucgaaacgcggacugagaccuggaugagcuccgagggcgccuggaaacagauccaacgcgucgagacaugggcgcuacggcaccccggguucacggugaucgcccuguuccuagcgcacgcuauaggcaccagcaucacucagaagggaauuauauucauccugcugaugcuagugacccccuccauggccaugcgcugcgucggcauuggcaaucgggauuucguagaggggcugagcggcgcgaccuggguggacgucgugcuggagcacgguuccugcguuacgaccauggccaagaacaagccuacucucgacaucgaacugcugaagacggaagugaccaaccccgcaauccuccgcaagcugugcauagaggcuaagaucagcaacacgaccacugacucccgaugcccgacccaaggcgaggccaccuugguggaggagcaggacgccaacuucgugugccgccggacguucgucgaccggggcugggggaacggcugcggccuguucggcaaggggagccugcugacgugcgccaaguucaagugcgugaccaagcuggagggcaagaucguucaguacgagaaccucaaguacuccgucaucguuacuguacacaccggcgaccagcaucaggucgggaacgagacgaccgagcacggcaccauagcuaccauaacgccccaggccccuaccagcgagauccagcugaccgacuacggggcccucacccuggacugcagcccccguaccggucuggacuucaacgagauggugcuccugacgaugaaggagaagucauggcuggugcacaagcagugguuccuugaccugccgcuucccuggaccagcggggccagcaccagccaggagaccuggaacaggcaggaccuccuggugaccuuuaaaaccgcccacgcgaagaagcaggagguagucguccugggcucccaggagggcgccaugcauaccgccuuaacuggggccacggaaauacagacaagcgguaccaccacaaucuucgccgggcaccugaagugccggcugaagauggacaagcucacacugaaaggcaccuccuacgugauguguacagguagcuucaagcuggagaaggagguugcagagacgcagcacggcaccguacugguacaggucaaguacgagggcaccgacgcccccugcaagauccccuuuuccacccaggacgagaagggggugacgcagaacggccgccucaucaccgccaacccgaucguaaccgauaaagaaaagcccgucaacauugagaccgaaccgccauucggggagagcuacaucguggugggggccggagagaaggcgcugaagcuguccugguucaagaaggggagcuccaucggcaagauguucgaggccacagcccgcggggcccgccggauggccaucuugggcgacaccgcgugggacuucgggagcauuggcggcguauucaccuccguggggaagcuggugcaccaaguauuuggcaccgccuacgggguucuguucuccggcgugagcuggacgaugaagaucgggaucgguauccuccugaccuggcuggggcuaaacagccgcuccacaagccuguccaugaccuguauagccguggggauggugacgcucuaccucggcgugaugguucaggccgacagcgggugugugaucaacuggaagggccgcgagcugaagugcggguccggcaucuucgugaccaaugagguccacaccuggaccgagcaguacaaguuccaagccgauucgccgaagcggcuguccgcugccaucggcaaggccugggaggagggagugugcggcauccgcucugccacccggcucgagaacauuauguggaaacaaaucucuaacgagcugaaccacauccugcucgagaacgacaugaaguucacaguggucgucggggacgccaacggaauccuggcacaggggaagaaaaugauccgcccccagcccauggagcacaaguauuccuggaagaguugggggaaggccaaaaucaucggcgccgacauccagaacacaacguucaucaucgacgggccagauaccccggagugccccgacaaccagcgggccuggaauaucugggagguggaggacuacggguucgggaucuucacgaccaacaucuggcugaagcuccgcgacuccuacacccagaugugcgaccaccgacugaugagcgcggccaucaaagacuccaaggcgguccacgccgacaugggcuacuggaucgagagcgagaagaacgagaccuggaagcucgcccgcgcgucguucauugaggugaagacgugcaccuggcccaagagccacacccucuggaguaacggcgugcuagagagcgagaugaucaucccaaagaucuacgggggaccgaucucccagcacaacuaccggcccggguacuucacccaaacggccggccccuggcaccuggggaagcucgaacuagauuucgaucucugcgagggcaccaccgucgugguggacgagcacugcggcaaucgggguccaucgcuccguaccacgacugucaccggcaagaucauccacgaguggugcugccgcuccugcaccuugccaccccugagguucaggggggaggacggcugcugguacgggauggagauccgucccguuaaggagaaagaggagaaccucgugcgcucaaugguuucugccggcucgggcgagguggauagcuucucccuggggauccugugcgcaagcuugaugaucgaggagguuaugcggucacgcuggagccggaagaugcuaaugacgggaacacuggcugucuuucuccugcugauaauggggcagcucaccuggaacgaccugauccgccugugcaucaugguaggcgcgaacgccuccgacaggauggguaugggaaccacguaccucgcauuaauggccaccuucaagaugagaccgauguuugccgugggguuauuguucagacggcugaccagccgcgaggucuuacuccugacgaucggucugucccucguugcaaguguugagcugcccaacucccuggaggagcucggcgacgggcuugccaugggcaucaugauguuaaaacuccugacggaguuccagccccaccaguuauggaccacccuccugagccugacuuucaucaagacgacccucucccuggacuacgccuggaagacaaccgcgauggcccuuagcaucgucucccucuucccccugugccugagcacgaccucccagaagaccaccuggcucccggugcugcuaggcagcuuugggugcaagcccuugaccauguuccuuaucacggagaacaagaucugggggcguaaguccuggccgcugaaugaggguauaauggcaaucggaaucgucagcauccuccuguccagccugcucaagaacgacgugccucuggcggggccgcuuauagccggcggcaugcucauugccugcuacgugaucagcgguuccagugcggaucucuccuuggagaaggccgccgaggucagcugggaacaggaggccgaacacuccggcacgagccacaacauauuaguggagguacaagacgacggcaccaugaagaucaaggaugaggagcgcgacgacacccugacgauucugcucaaggccacgcugcuggcggucuccgguguguaccccaugagcaucccggccacccuauucguaugguacuucuggcagaagaagaaacagcgauccgggguucugugggacacccccagcccgccggagguggagcgcgccguacuggacgacggcaucuaucggauccugcagaggggccuccuggggcguagucaggucggcguagggguguuccaggacgguguauuccauacgauguggcacgugacccgaggcgcggugcugauguaucagggcaagcgguuagaaccgucaugggcaucugucaagaaggaccucaucucguacggcgggggcuggcgcuuucaggggagcuggaacaccggcgaggagguccaggugauugcggucgagcccgggaagaacccgaaaaacguacagaccacgccuggcaccuuuaaaacccccgagggugaggugggggccaucgcccuggacuucaagcccggcaccagcggcuccccgaucgucaaccgggaaggcaaaaucguuggccucuaugggaacggcgugguaacgaccuccggaaccuacgugucugccauagcccaggccaaggccagucaggaaggcccccugcccgagaucgaggacgagguguucaagaagaggaaccuaacuauuauggaccuccacccggggagcggcaagacucggcgcuaccugcccgccaucguucgggaggcgauaaaaaggaagcugaggacgcucauccuggcgcccaccagggugguggccuccgaaauggccgaggcccugaagggaaugcccauccgcuaccagaccacggcgguuaagucagagcacaccgggcgggagaucguagacuuaaugugccacgcaaccuucaccaugcgccugcuuuccccagugcggguccccaacuacaauaugaucaucauggacgaggcccacuucacggaccccgccagcaucgcggcccgcggcuacaucuccacucggguggggaugggcgaggcggcagcgaucuucaugaccgccacgccgcccgggucgguggaagccuucccccagucuaacgcgguuauccaagacgaagagcgcgacauccccgaaagauccuggaacucuggcuacgacuggaucacggacuuccccggcaaaacugugugguucguuccguccaucaaguccgggaacgauaucgcaaacugucuccggaaaaacggcaagcgggucauacagcugagccgcaagaccuucgacaccgaguaccagaaaacgaaaaacaacgacugggacuauguggugaccaccgauauauccgagaugggggccaacuuccgcgcggaccgcgucaucgacccccggcgcugccugaagcccgucauccucaaggacggccccgaacgcgugauccuggcagggccgaugcccguaacuguugccucagccgcccagcgccgaggccgcaucggccggaaccagaacaaggagggggaucaguacguguauaugggccagccccuuaacaaugaugaagaccacgcacauuggacggaggcgaagaugcuccuggacaacaucaauacccccgagggcaucauuccggcucucuucgagcccgagcgcgagaaauccgccgcuaucgauggcgaguaccgucuacgcggggaagcgcgcaagaccuuugucgaguuaaugcgacgcggcgacuuacccguguggcucaguuacaaggucgcguccgaaggcuuccaguacucugaccgucgcuggugcuucgacggagagcggaacaaccagguccucgaggaaaacauggacguggagaucuggaccaaggagggcgagcgcaaaaagcugcggccuagauggcucgaugcccggacguauuccgacccccuggcccuccgcgaguucaaggaauucgccgccgggcggcgcagugucucuggcgaccuuauccucgaaauagguaaauugccccagcaccugacgcugaaggcgcaaaacgcgcuggacaaccucgugaugcuacacaacuccgagcaaggggggaaggcguaccggcacgccauggaagagcugcccgacaccauagagacccucaugcugcuggcgcucaucgccgugcugaccgggggcgucacgcuguuuuuccucagcgggaagggccugggcaagacauccaucgggcugcucugcgugaccgccaguucagcccugcuguggauggccucgguggagccccacuggauugccgcuuccaucauccucgaguuuuuccugaugguccugcucaucccggagcccgauaggcagcgcacuccccaggauaaccagcuggccuacguggugauaggccuccucuuuaugauccugacggucgccgccaacgagaugggguugcucgagacaacaaagaaagaucugggcaucgggcacguggcggccgagaaccaccaacaugccaccaugcuggacguggaccuccgcccggccagcgccuggacgcuguacgcggucgcuaccaccgugaucacccccaugaugcggcacacgaucgagaacaccaccgccaacaucucccugaccgccaucgccaaccaggcggcgauccucaugggcuuggacaaaggcuggccaaucucuaagauggauaucggcgugccccugcucgcccugggcugcuauagucaaguaaacccacugacgcucaccgcugcugugcugaugcugguggcccacuacgccaucaucggccccggccuccaggccaaggccacccgcgaggcgcagaagcguaccgccgccgggaucaugaagaaccccacggucgacggcaucguugcuaucgaccuggaucccguugucuacgacgcuaaauucgagaagcagcugggccagaucaugcuccugauccuuugcaccagccagauacuacugaugcggaccaccugggcgcugugcgaguccauaacgcucgccacagggccuuugacaacccuaugggagggcucacccggcaaguucuggaacacgaccaucgccguguccauggccaacaucuucaggggcagcuacuuggccggggcagggcuggccuuuuccuuaaugaagucccucggcgggggccggcgcgggaccggcgcccagggcgagacccugggggagaaguggaagcggcagcugaaccaacucucgaaaagugaguucaacacguacaagcgaagcggcaucauggaaguggacagaucugaggcaaaagaggggcugaagcgcggcgaaaccacaaagcacgcggucagccgggggaccgccaagcugcgcugguucguggagcggaaccuggugaagcccgagggcaaggucaucgaucucggcugcgggcgcggcgggugguccuacuacugcgccgggcugaaaaaggugaccgaggugaagggguacacgaagggcggcccugggcacgaggaaccgaucccuauggcaaccuacgguuggaaccuggugaagcuccacucggguaaggacguguucuucaugccgcccgagaagugcgacacucuucugugcgacauaggcgaguccagcccaaaucccaccaucgaagaggggcgaacgcuccgcgugcugaagauggucgagccguggcugcgggguaaccaguuuugcaucaagauacucaacccauauaugccguccgugguggagacccuggagcagaugcagcgcaagcauggcgggaugcugguccgaaauccccucagccgcaacuccacccacgaaauguacugggucagcugcggcaccgggaauaucgucuccgccguaaacaugacgagccggaugcugcugaaccguuucaccauggcgcaccguaagcccacguuugagcgagauguggaccucggagcggggacccgccacguggcggucgagcccgaaguagccaaccuugacaucauagggcaacggaucgagaauauaaagaacgagcacaaguccacguggcauuacgaugaagacaacccguacaagaccugggccuaccacggcucauacgaggucaagcccucggggagcgcguccucgauggucaacggcgucguacgccugcucaccaaaccaugggacgucaucccuauggugacgcagaucgccaugacagauaccaccccguucggccagcagcggguauucaaggagaagguggacacucgcacgccccgggccaagcgcggcaccacccagauuauggaggugaccgccaaguggcuguggggcuuccugucccguaacaagaagccccgcaucugcacgcgggaggaguucacccgaaagguccggagcaaugcagcuaucggggccguguucguggacgagaaucaguggaauucugccaaggaggccgucgaggacgagcgcuucugggaccucgugcaccgugagcgcgagcugcacaagcaaggcaagugcgcgacgugcguguauaacaugaugggcaagcgggagaagaaacuuggcgaguucgggaaggccaagggcucccgcgccaucugguacaugugguuaggggccagauuccuggaguucgaggccuugggguuuaugaacgaagaccacugguucagccgcgagaacucccuuagcggcguagagggggagggccugcacaagcugggguacauccuccgggacaucuccaagaucccgggcggaaacauguacgcagacgacaccgccgggugggacacgcgcaucacugaggacgaucugcagaacgaggccaagaucaccgauaucauggaacccgagcacgcccugcucgccaccuccaucuuuaaacugacguaccagaacaaggucgugcggguacagcgcccggcgaagaacggcaccgugauggaugugaucucccgacgggaccagcgcgggagcggccaggucggcaccuaugggcugaacaccuucacgaauauggagguucaguuaauccggcagauggagucugagggcaucuuuuuaccuagcgaguuggagaccccgaaccucgcagagcgcgugcuggacuggcuugagaagcacgggaccgagagguugaagcgcauggccaucuccggagacgauugcgucgucaagcccaucgacgaccgguuugccaccgcccugaccgcguugaacgacauggggaaggugcgcaaggacauuccccagugggagccgagcaagggcuggaacgacuggcagcagguaccauucugcucccaccacuuucaccagcucaucaugaaagacggccgcgagauuguggugcccugccgcaaccaggacgagcuaguugggcgggcccgcgucagccaaggcgccggauggucccugcgggagacggccugucucggaaaguccuacgcccagauguggcaacugauguacuuucaucgccgggaccugcgccucgcggccaacgccaucugcucggccguacccgucgacugggugcccacgagccggacuaccuggagcauccacgcgcaccaccaguggaugacgacggaggacaugcuguccguguggaaucgagucuggaucgaggagaauccguggauggaggauaagacccacgugagcuccugggaggaagugcccuaccucgggaagcgggaggaccaguggugcggcucacucaucggcuuaaccgcccgugccacgugggcuaccaauauucagguugccaucaaccaagugcgcaggcugaucgggaacgagaacuaccucgacuauaugaccuccaugaagcgcuucaagaacgagagcgaucccgagggcgcgcuaugguga

SEQ ID NO: 23889 - RNA, 9879 nt, Artificial Sequence
  derived and/or modified CDS sequence (opt11) from DENV-1__GQ868518__SS-prME
ucggugacaaugcugcucaugcugcugcccaccgcccuggcguuucaccucacgaccagaggcggggagccccacaugaucgugagcaagcaggagcggggcaagagccuccucuucaaaaccagcgcggggguuaacaugugcacacuuaucgccauggaccugggggaacuaugcgaggacacaaugaccuauaagugcccucagaucacagaagccgagcccgaugacguggacugcuggugcaacgcuaccgauacgugggugaccuacgguaccuguagccaaacgggcgaacaccgccgggauaagcgcuccguggcccuggccccccacgugggacuggggcuagagacgcggaccgaaaccuggaugagcuccgagggagccuggaagcagauccagcgcgucgagaccugggcccugcggcaccccggguucacgguaaucgcccuauuccucgcgcaugcuaucggcaccucgauuacacaaaaagggaucaucuucauccugcugaugcucgugacucccuccauggccaugcgcugcguuggcauuggaaaccgggacuucguggaaggccuguccggcgcaacuuggguggaugucgugcuggagcacgggagcugcgugaccaccauggcuaagaacaagcccacccucgauaucgagcugcuaaagacggaggugaccaauccagcgauacucagaaaguuauguaucgaggccaagaucagcaauaccaccacugacuccagaugccccacccagggcgaggccacccucguggaagagcaggacgccaacuuuguaugcaggaggaccuuugucgaccgcgguuggggcaacgggugcggcuuguucggcaaggggucacuacugacgugugcgaaguucaagugcgugacgaagcucgaggggaaaauuguacaguacgagaaccugaaauacagcgucauuguuaccgugcacacuggggaccagcaccagguaggcaacgagacgaccgagcacggcacuauagcgaccaucacgccgcaggcccccacgagcgaaauacaacugaccgacuauggggcccucacccucgacugcagcccacggaccggccuggacuucaacgagauggugcuccugaccaugaaggagaagucuuggcugguucauaagcaaugguucuuagaucugccgcugcccuggaccuccggggccagcacaagccaggagaccuggaaucgacaagaccuccucgugacguucaagaccgcacacgcgaagaagcaggagguggucguucugggcagucaagaaggcgcgaugcacaccgcuuuaacuggcgccacggagauccagaccagcgguacgacaacgauauucgccgggcacuuaaagugccggcugaagauggacaagcucacguuaaaggguaccuccuacguaaugugcaccgggagcuucaagcuggagaaggaagucgcggaaacgcagcaugguaccgugcuggugcaggucaaauacgagggcacugacgcccccugcaagauacccuucucgacccaggaugaaaaggguguaacgcagaacggccgccuuauaaccgccaaccccaucguaaccgacaaggagaagccugucaacaucgagacugagccucccuuuggcgagagcuauaucguggugggggcuggcgagaaggcguuaaagcucuccugguucaagaaggggagcagcaucggcaagauguucgaggcgaccgcccgcggcgcccggcggauggccauccucggcgacacggcgugggacuucgggucuaucggcgggguauucaccuccguggguaagcuggugcaccagguguucggcaccgccuauggugugcuuuucucgggcgugagcuggacgaugaagaucgggaucgggauccuccugacuuggcugggcuugaauagucguuccaccucgcuguccaugacguguauugcuguagggauggugacgcuauaucugggcguuaugguccaagccgacagcgggugcguuauaaacuggaagggccgcgaauuaaaaugcggauccgggaucuucguuaccaacgaaguacacacguggaccgagcaauacaaguuccaggccgacagcccgaagcggcugucugcggcaaucggcaaggcgugggaggagggggugugcggcauccgguccgccacucggcucgagaacaucauguggaagcaaaucagcaaugagcugaaccacauucuucucgaaaacgauaugaaguucaccgugguugucggggacgccaacgguauccuggcucaggggaaaaagaugauucguccacagcccauggagcacaaauacucuuggaaaucauggggaaaggccaagaucaucggugcggacauccagaauacgacguuuaucaucgacgggcccgacaccccggagugccccgacaaccagcgcgccuggaacaucugggaaguggaggacuacggguucgggauauucacgaccaauauauggcugaagcuucgagacuccuacacccagaugugugaccaccggcugaugucggcggccaucaaggacuccaaggccguccacgccgacaugggcuacuggauugagagcgagaagaacgagacguggaagcuggcccgcgcgagcuuuaucgaggucaagacgugcaccuggcccaaaucucauacacugugguccaaugggguacuggagucggaaaugaucauuccaaagaucuacggggguccgaucucccagcacaacuaccgaccaggguacuuuacucagacagccggccccuggcacuuaggcaagcucgagcuggacuucgaccugugcgagggcaccaccgucgugguggacgagcauuguggcaacagagggccgagccuccgaaccacgaccgugaccggcaagaucauacacgaguggugcugccgcagcugcacucugcccccccugagguuccgaggggaggauggcugcugguacgggauggagauacggcccguuaaggagaaggaggaaaaccucgugcgcagcaugguguccgccgguagcggcgagguggacagcuucuccuuagggauccugugcgccagcaucaugauagaggagguaaugcggagccgauggagccggaagaugcucaugacuggcaccuuagcugucuuccugcugcuggugaugggacagcugacuuggaacgaccucauccgccuguguaucauggugggcgcgaacgccucugaccgcaugggaauggguacuacuuaucuugcccucauggccaccuuuaaaaugcgaccaauguucgccgucggccugcuguucagaagacucaccagccgggagguacugcuguuaaccaucgggcuauccuugguggcuagcguggagcuccccaauuccuuggaggagcugggcgacggguuggcaaugggaauuaugaugcuuaagcuacucacugaguuccagccccaccaacuguggaccacccugcuaagccugaccuucauuaagacgacccugucccuugacuacgccuggaagacgaccgccauggcgcugagcauagugagucuguucccacuaugccugucgacgaccucgcagaaaaccacuuggcugccgguccuccuggggagcuucgggugcaagccucuaacaauguuccucaucacugaaaacaagauuuggggccggaaguccuggccccugaacgaggggauaauggccaucggcauugucucuauccuucucucgagccuguugaagaaugaugugccccucgccggaccgcugaucgccggcggcaugcucauagccugcuacgucauuagcggauccucagcggaccucucgcuggagaaggcggccgaggugagcugggagcaggaggccgaacacagcggucccagccacaacauccugguggaaguccaggaugacgggaccaugaagauaaaggacgaagagcgcgacgacacccucacuauucugcuuaaggcgacguugcuugcaguguccggcguguaccccaugagcaucccagcuacccuguucgucugguauuucuggcagaagaaaaagcagcguuccggggugcucugggacacaccguccccucccgaaguggagcgugccguccuagacgacgguaucuacagaauacugcaacgcggacugcuggggaggucgcaggugggagugggggucuuucaggacgguguguuccacaccauguggcacgugacgcgcggggcugugcucauguaucaggguaagcggcuggagcccagcugggcauccgugaagaaagaucuaaucagcuacggcgggggcuggcgcuuucguggguccuggaauacaggcgaagaggugcaggucaucgcgguggaaccgggcaagaacccaaagaacgugcagaccacacccggcacguucaagacccccgaaggcgaggucggugccaucgcccuggacuuuaagccgggcaccagcgggucccccauagugaaccgcgaggguaagaucguaggucuguacgguaauggcguggugaccaccagcgggaccuacguauccgccaucgcgcaggcgaaggccagccaggagggcccccucccggagauugaagacgaggucuucaaaaaacgcaaccugaccauaauggaccuucaccccggcagcgggaagacccgccgguaccuccccgccaucgugagagaggccaucaagcggaagcugcgcacgcugauucuugcgcccacccgcguaguggccuccgagauggccgaggcccugaaaggcaugccgauccgguaccagaccaccgccgucaagucggaacacacugggagggagaucguggaccugaugugccacgcgacauuuaccaugcggcuacugucacccguccgcgugccaaacuacaacaugaucaucauggacgaggcccacuucacagaccccgccaguaucgccgccaggggcuacaucaguacgaggguggggaugggcgaggcggccgcaaucuucaugaccgccacaccgcccggguccguugaggccuuuccccaguccaacgcaguuauccaggacgaggaacgggacauacccgagcgcagcuggaacuccggcuacgacuggaucaccgacuucccgggcaagacagugugguuugucccgagcaucaaauccggaaacgacaucgccaacuguuugcggaaaaacggcaagcgugugauccagcugucccggaaaaccuucgacacggaguaucagaaaaccaagaacaacgacugggacuacgugguaacgacggacaucuccgaaaugggggccaacuuuagagccgaccggguuaucgacccacgccgaugccucaagcccgugauccuaaaggacggccccgagcgcgucauacucgcggggccuaugcccgugaccguggccagugcggcucaacggcgcggccguaucggcagaaaucagaacaaggagggcgaccaguauguguacaugggccagccuuuaaacaaugacgaggaccacgcccauuggaccgaggcgaaaaugcuguuagacaacauaaacacgccugaggggaucauaccggcucuguucgagccggaacgcgagaagucagccgccauagacggcgaguaucgccuucgcggggaggcacggaagaccuucguagagcucaugcgacggggcgaccugccagucuggcuuagcuauaagguggcuucagaggguuuccaguacucugacaggagaugguguuucgacggggagcggaacaaccaggugcucgaagagaacauggacgucgagaucuggaccaaggagggugagcgcaagaagcuucguccgagauggcuggacgcccgcacuuacagugacccacuggcccugcgggaguuuaaggaguucgccgccgggcgucggagugucagcggcgaccugauccuugagaucgguaaacugccgcaacacuuaaccucccgcgcacaaaacgcccucgacaaccuggugaugcugcacaacuccgagcagggcgggaaggcuuaccggcacgccauggaagagcuucccgacacaaucgaaacccugaugcugcucgccuuaaucgccguacuuacagguggcgucacccucuucuucuuaucugggaagggccugggaaagacgagcaucggccuccugugcgugaccgccuccagugcacugcucuggauggccagugucgagccgcacuggaucgcagcgucuauuaucuuggaguucuuccugaugguccuccugaucccugagccugaucgccagagaaccccgcaggauaaccagcucgcguacguggucaucggccuacucuuuaugauccugacaguggccgcuaacgagauggggcuccuggagaccacgaagaaagaccucggcaucggacauguggcggccgagaaccaccagcacgccaccauguuagacgucgaccugagacccgccucagccuggacccuguaugcgguagcgacgaccguuaucacccccaugaugcgucacacgaucgagaauacgaccgccaacaucucucucaccgcgauugcaaaccaggcggccauucuaaugggccuggacaagggcuggcccaucaguaagauggacauuggaguaccucuccuggcccugggaugcuacagccaagugaacccgcucacccugacggccgcggugcugaugcucgucgcccacuacgcaaucauagggcccggccugcaggccaaggccacccgcgaggcgcagaagcggaccgcagccgguaucaugaagaaccccaccguggacggcauuguggccauugaccucgaccccguuguguacgacgccaaguucgaaaagcagcucggccaaaucaugcugcugauucucugcacgucccagauccuccugaugcggaccaccugggcguuaugugagagcaucacccuggccacgggaccacugacuacccucugggagggguccccugggaaguuuuggaauacgaccauagccgugucaauggcuaacauauuucgcggcuccuaucuggccggcgcgggguuagccuucucguugaugaagucccugggcgggggacggcgugggaccggcgcccagggcgagacccugggcgaaaaguggaaacggcagcucaaccagcugaguaaaucagaguucaacaccuacaagcgcuccggaaucauggaggucgacagaagcgaggcuaaggaggggcuaaagcgcggcgagacgacuaagcaugcggugucacggggcacggcgaagcuucgcugguucguggagcggaaccuugucaagcccgaaggaaagguuaucgaccuuggcugcgggcgaggugggugguccuacuacugcgccgggcugaagaagguuaccgaggucaaaggguacaccaaggguggcccgggccacgaagagcccauccccauggccacguacggcuggaacuuggugaagcuucacuccgggaaagauguguucuucaugcccccggagaagugcgacacgcugcucugcgacaucggcgagagcucccccaaccccaccaucgaagaggggcggacacugcggguccucaagaugguggagcccuggcuucgggguaaucaguuuugcaucaagauccugaacccguauaugccaagcguggucgagacgcuggagcaaaugcagcgcaaacacggcgggauguuagugcggaaucccuuaucccgcaacagcacccacgagauguacuggguauccugugguaccggaaacaucguaucugcagugaacaugaccucccgcaugcugcucaaccguuucacgauggcgcaccggaagccaaccuaugagcgggacguggaccugggcgccggcacgcgccacgucgccguggaaccagagguggcuaaccuagacauaauugggcaacggaucgagaacauaaagaacgagcacaagaguaccuggcacuacgacgaggauaaccccuacaagacgugggccuaccacggcagcuacgaggucaagcccagcggcuccgcgagcuccauggugaauggugugguccgcuuauuaaccaagccaugggaugucauaccgauggucacgcagauugccaugacugacacgacccccuucggacagcagcggguguucaaggagaagguggacacgcgcacgccccgagcuaagcgcggcacgacgcagauaauggaggucaccgccaaguggcuguggggauuccucagccggaacaagaagccgcgcauauguacgcgggaagaguucacgcguaaagugcgcaguaacgccgcgaucggggcgguguucguggacgagaaucaguggaacagcgccaaggaggccguggaggacgagcgcuucugggaccuggugcaccgggagcgcgagcugcacaaacagggcaaaugcgcgaccugcguauacaacaugauggggaagcgggagaagaagcucggggaauucggcaaggccaaaggcagccgcgccaucugguacauguggcugggggcacgguuccuggaguucgaggcacuugguuucaugaacgaagaucauugguucagucgagagaacagccuguccggaguugagggggagggucuucacaaguugggcuacaucuugcgagacaucucuaagauccccgguggcaauauguacgcggacgacacagcagggugggacacccgaaucacagaggacgaucugcagaacgaagccaagauaaccgagaucauggagccggagcaugccuuguuagccaccucaaucuucaagcugacuuaccagaacaaagugguucgcgugcagcgcccggcgaagaacggcaccguuauggacgugaucucccgccgggaucaaagaggcucugggcagguggggaccuacggccucaacaccuuuaccaacauggaggugcagcugauccggcaaauggagucugaagguaucuucuugcccuccgagcucgaaacccccaaccucgcggaacgcguccuggacuggcucgagaagcauggggccgagcgucugaagcgcauggccaucuccggcgacgacugcguugugaaacccauugacgaucgcuuugccaccgcccugacggcccucaacgacauggggaaagugcgcaaagacaucccccaaugggaaccgucgaagggcuggaacgacuggcagcagguucccuucugcagccaccacuuccaccagcuaauaaugaaggacggacgggagaucgugguccccugccggaaccaggaugagcuggugggacgugcccgcgucucccagggcgcaggguggagccuccgggagacggccugccugggcaaguccuacgcacagauguggcagcugauguacuuucaucgcagagaccuccgccuggcggccaacgccaucuguagcgcuguucccguggacugggugccgacuucccggacgaccugguccauccacgcccaccaccaguggaugaccacugaggauaugcugagcgucuggaaccgcguauggauagaggagaacccguggauggaggacaagacgcacguguccagcugggaggaaguccccuauuuggggaagcgcgaggaucagugguguggcucccugaucggacucaccgcccgagcuacgugggccaccaacauucagguggcgauuaaucaagugcgccggcucaucgggaacgaaaacuacuuggacuacaugacgagcaugaagcgcuucaagaacgagucugacccugagggcgcccugugguga

SEQ ID NO: 23890 - RNA, 9879 nt, Artificial Sequence
  derived and/or modified CDS sequence (opt11) from DENV-1__GQ868519__SS-prME
agcgugaccaugcugcucaugcuacugcccaccgcccucgcuuuccaccugaccacgcgggggggcgagccccacaugauagugagcaagcaggagcggggcaagagccuccuguuuaagacauccgcgggcgugaacauguguacucugaucgccauggacuuaggugagcucugcgaggacaccaugaccuacaagugcccucagauaaccgaggccgaacccgacgacgucgacugcuggugcaacgcaacggacaccuggguuacguaugguacuugcucccagacuggcgaacaccgacgggacaagcgcuccguggcccuagcgccccacgugggccuggggcucgagacacggaccgagaccuggaugagcuccgagggggcguggaagcagauccagcgcgucgagaccugggcccugcggcaucccgguuucacggugauagcuuuauucuuagcgcaugcaaucggcaccagcaucacccaaaaggggauuauuuucauccuacugaugcucgugaccccguccauggcgaugcgcuguguuggaauaggcaauagagacuucguggaggggcugagcggcgcgacauggguggacgucgugcucgagcacggguccugcguaaccaccauggcaaaaaacaagccaacccucgacaucgagcugcugaagaccgaagucaccaaccccgcgauccucagaaagcuguguaucgaagcgaagaucagcaacacaaccacggacucccggugcccgacccagggcgaggccacccugguggaggagcaagaugccaacuucgugugcaggcggaccuuuguggaucgcgguugggggaacggcugcggccuguucggcaaggggagccugcugacgugcgccaaguucaagugcgugaccaagcucgagggcaaaaucgugcaauacgaaaaccugaaguacuccgucaucgugaccgugcacaccggagaucaacaccagguggggaacgagacgacugagcacggcaccaucgcgacaaucacgccccaggcaccgacgagugagauacagcugacagacuacggagcccucacccuggacugcucacccaggacggggcuggacuucaacgagauggugcuccucaccaugaaggagaaguccuggcuaguacauaagcagugguuccucgaccugccguugcccuggaccuccggggccagcaccagccaggaaacauggaaucgacaagaccuacuggugaccuucaagacggcccacgccaagaagcaggagguggucguguugggaagccaagagggcgcgaugcacacugcccucaccggagccacagagauccagaccagcgguacgacaacgaucuuugccgggcaccugaagugccggcugaagauggacaagcucacccugaagggaaccaguuacgugaugugcacggguaguuuuaaacuggagaaagaggucgcggagacgcagcacggcaccgugcuggugcaggucaaguacgagggcaccgacgcgcccuguaaaauccccuuccugacccaagacgagaagggcgugacucagaaugggcgccugaucaccgccaacccuaucgugaccgacaaggagaagcccgucaacaucgagaccgaaccgcccuucggggaguccuacaucguugugggcgccggcgaaaaggcguugaagcucagcugguuuaagaagggguccagcaucggcaagauguucgaggccacggcccgcggggcucgccggauggccauacugggggacaccgcgugggacuuuggguccauaggcggcgucuucaccagcgucgguaagcugguccaccagguuuucggcaccgccuaugggguccuguucagcggcguuagcuggacgaugaaaaucgggaucgggauauuguugaccuggcucggcuuaaacuccagaagcacgucccuguccaugacguguaucgccgucgggauggugacacucuaccugggcgugaugguccaggcagacuccggcugcgugaucaauuggaagggccgggagcuaaagugcgggaguggcauauucgugaccaaugaaguacacaccuggacagaacaguacaaguuccaagcggacuccccaaagcggcucuccgcggccaucggcaaggccugggaagagggcgugugcggaauccgcucggccacacgguuagagaacaucauguggaagcagaucagcaacgagcucaaccacauucuccuggagaacgacaugaaauucacggucgucgugggggacgccaacgggaucuuagcucaggggaaaaagaugauccgcccccaacccauggagcauaaguacaguuggaaguccugggggaaggccaagaucaucggggcggacauucagaauaccaccuucaucauagacggccccgauacuccggagugccccgacaaucagcgggccuggaauaucugggagguggaggacuacggcuuugggaucuucacaaccaauaucuggcucaagcugagagacagcuacacucagaugugcgaccaccgguuaaugagugcggcgauaaaggauagcaaggcgguacacgcugacaugggauacuggaucgaguccgagaagaaugagaccuggaagcucgcucgcgcgagcuucaucgaggugaagacgugcaccuggcccaagucccacacccuguggagcaacggcguacuggaauccgagaugaucauccccaaaaucuacgggggcccgaucagccagcauaauuaucgacccggguacuucacccagacggcuggcccauggcaccucgggaagcuagagcuggacuuugaccucugcgagggaaccacagucgugguugacgaacacugcggaaaccgcgggccgucuuugcggaccacgaccgucaccggcaaaauuauccacgagugguguugccgcagcugcacccugccgccgcuccgguuccguggggaggacggcugcugguacgggauggagauccggcccgugaaagaaaaggaggaaaaccugguacgcuccauggucagcgccgguuccggcgagguggacaguuucagccuggggauucucugcgccuccaucaugauagaggaagugaugaggagccgcuggucccgaaagaugcucaugacaggcaccuuggcggucuuucuacugcuggugaugggucagcucacauggaaugaucugauccgccugugcaucauggugggggcgaacgccagcgaucgcauggggaugggcaccacauacuuagcccucauggcaaccuucaagaugcgaccgauguucgccguaggucuccucuuccgccggcucaccagccgcgagguucugcuucugaccauagggcugagccucguggccucugucgaauuacccaacagccuggaggagcucggcgaugguuuggccaugggcaucaugauguugaagcuccugacggaguuccagccccaccagcuuuggaucacccuccuuucguugacguucaucaagaccacgcucagucuggacuacgccuggaagacaacagcaauggcgcuguccaucguaagccucuuccccuuaugccucuccaccacgagucagaagaccaccuggcugccgguccugcuggguuccuuuggguguaagccucucacuauguuccucauaaccgaaaauaagauauggggucgcaagagcuggccccugaacgagggaauuauggccauagggaucgugagcaucuugcugagcucccuucucaagaacgacgugccacuggccggaccguugaucgccggcggcaugcucaucgcauguuacgucauaagcgggagcuccgcugaccugucccuggaaaaggccgcugagguguccugggagcaggaggccgagcacuccggcacaucacacaacauccugguggagguccaggacgacggaacgaugaaaauaaaggacgaggagcgcgacgacacccugacgauccugcucaaggccacacugcuagcugugagcggcguguacccaauguccauuccagcuacccuguucgucugguacuuuuggcagaaaaagaagcagcgguccggggugcugugggacacucccaguccgccggagguggagcgagccguccuggacgauggaaucuaccggauccuacagcgcggccucuuggggcgaucucaggugggcgucggggucuuccaagauggcguguuccacacaauguggcacgugacgcggggagccguucugauguaccagggcaaacggcuugagcccucaugggcgagcgugaagaaggaucugauauccuacggcgggggcuggcgcuuccaggguucauggaacaccggugaagaggugcaggucaucgcggucgaacccgggaagaauccgaagaacgugcagaccaugcccggcacuuucaaaacgcccgaaggcgaaguuggagccaucgcccuggacuucaagcccggcacguccgggagcccgaucgugaaccgugagggcaaaaucgugggccucuacggcaacggcgucgugacaacuuccgggacguacgugucggccaucgcucaggcgaaggccucccaagagggcccccugcccgagaucgaggaugaggucuucaagaagcgcaaccugaccaucauggaucuccaccccgggagcgguaagacccggcgcuaccugcccgccauggugcgggaagcaauuaagcgcaagcugagaacucucauacucgcgcccacgcgcgugguugccagcgagauggccgaagcccugaagggcaugccgauacgauaccagaccaccgccgugaagucugagcacacggggcgagagauuguggaccucaugugccacgcgacguuuacuaugcgucugcuaucgccggucagggugcccaacuacaacaugaucauuauggacgaggcccacuucaccgacccggccucuaucgccgcccguggcuacaucagcacgcggguagggaugggcgaggcggcggcuaucuuuaugacugccaccccuccugggucggucgaggccuucccccaaagcaacgcggucauccaggacgaggagcgcgacauacccgagcggucauggaacagugguuacgacuggaucaccgauuuucccgggaagaccgugugguuuguccccaguaucaagagcgggaacgacauagccaacugccuucgcaagaacgguaagcgaguuauacagcugucccgcaaaacauuugacacggaguaccagaaaaccaagaacaacgacugggacuacguggucaccacggauaucagcgagaugggggccaacuuccgggccgaccgcgugaucgacccacggcgcugccuuaagcccguuaucuuaaaagacggccccgagcggguuauccuggcugggccgaugccggugaccgucgcguccgccgcccagcgaagaggccgcauaggucggaaccagaauaaggagggggaccaauacguauauaugggccagccccugaacaacgacgaggaccacgcccacuggaccgaggcgaagaugcuccucgauaacaucaacaccccagaggggaucauaccggcccuguuugagcccgaacgcgagaaaucagccgccaucgacggugaguaccgccuccgcggggaggcgcggaagacguucguggagcugaugcggaggggcgaccugcccgucuggcucuccuacaagguggcuagcgaaggcuuccaguacuccgaccggcgcuggugcuucgacggagagcgaaacaaccagguuuuggaggagaacauggacgucgagaucuggaccaaggaaggugagcgcaagaaguuacggccccgcuggcucgacgcccggacguauagcgacccucuggcccugcgcgaguuuaaggaguucgcagccgggcggcgcucaguuagcggcgaccucauccuggagauaggcaaacuuccucagcaccucaccuuacgggcgcaaaacgcccuagauaaccuagugaugcugcacaauagcgagcagggggggaaggccuaccgccaugccauggaagagcugccagauacuaucgagacguugaugcuacuggcgcuuaucgccguccugacagguggcgugacccuguucuuccucagugggaagggccugggcaagaccagcauaggccugcuaugcguuacggccuccagcgcccuacuguggauggccuccguggagccccacuggaucgcagcgagcaucauccucgaguucuuccugaugguacugcuuaucccggagcccgacagacagcgcacgccacaggacaaccagcucgccuacguugucaucggccuccucuucaugauccugaccguagccgccaaugagaugggccugcucgagaccaccaagaaagaccugggcauagggcacgucgcagccgaaaaccaccagcaugccacaaugcuggacgucgaccuccggccggccucggccuggacguuauacgcgguggcaaccacgguuaucacccccaugaugcgccauacaauagagaacaccacggccaacaucagccugaccgccaucgcaaaccaggcggccauacucaugggccuggacaagggguggcccaucuccaagauggacauaggggucccccuacucgccuugggcugcuacucacaggucaacccgcugacccuuacagccgcugugcuuaugcuggucgcccauuacgcgaucauugggcccggccuccaggccaaggccacacgugaggcccagaagaggaccgccgccgggaucaugaagaacccuaccguggacggcaucguggccaucgaccuggaccccgucguguacgacgccaaguucgagaagcagcugggucagauuaugcuccugauccugugcacgagccaaauccuccugaugagaacgacuugggcucugugcgagucaauuacccucgccaccgggccgcugaccacccuuugggagggcucacccgguaaguucuggaacaccaccaucgccgugaguauggcgaauauauuucggggcaguuacuuagccggcgcaggacuggccuuuagucugaugaagucccuugggggcggccgacggggaacgggcgcccagggcgagacacugggggagaaguggaagcgccagcugaaccaacuuucaaaguccgaguuuaacacuuauaagagaagcggcaucauggaggucgacagaagcgaagcaaaggagggccugaagcggggcgagaccacgaagcacgcggugucccgcgggacagccaaguuacggugguuuguggagcgcaaccuggucaaacccgagggcaaggugauagaccucggcugcgggcggggcggguggucguacuacugcgccggccuaaagaaggugaccgaggucaaaggguacacgaagggcggucccgggcaugaggaaccgauaccuauggcgacguacggcuggaaucuugugaaguugcauuccgggaaggacguguucuucaugccccccgagaagugcgauacccuccugugcgacauaggcgagucuuccccgaacccaacaauugaggaggggcguacccuacggguacugaagaugguggagcccugguugagaggcaaccaguucugcaucaagauucugaaucccuacaugccgagcguuguagagacccuagaacagaugcagcgcaagcauggagggaugcuggugcgcaacccucucucccggaacagcacgcaugagauguauuggguauccugcgggaccgguaacauagucagcgcugugaacaugaccucccggaugcugcugaaccgguucaccauggcgcaccgcaagcccacguacgagcgcgauguagaucucggcgccggcacccggcacgucgccguggagcccgagguggccaaucuggacauuaucgggcagcgcaucgagaacaucaagaacgagcacaagucgaccuggcacuacgaugaggacaacccguacaagacaugggccuaucacggguccuacgagguuaagcccaguggguccgccagcuccauggugaacggcgugguccggcuguugacgaagcccugggacgugauccccaugguaacacaaaucgccaugaccgauaccacgccuuuugggcagcagcgcguuuucaaggagaaaguggacacccggacgccccgugccaagcggggcacgacgcagaucauggaggucaccgcaaaguggcuguggggcuuccugagccgaaacaaaaagccccggaucuguacccgggaggaguucacccgcaaagugagguccaacgcggcgauaggggccguguucgucgaugagaaccaguggaacucggccaaagaggccguggaggacgagagauuuugggauuuggugcaccgcgaacgggagcugcauaaacaaggcaagugcgcgacgugcgucuacaacaugauggggaagcgcgagaagaagcucggcgaguucgggaaggccaaaggcagccgggccauuugguacauguggcucggggccagauuccuggaguucgaggcccugggcuucaugaacgaggaccacugguucucccgggagaacuccuuaagcggcguggagggugaagggcugcacaagcugggguacaucuugcgcgacaucaguaagauccccggcggcaauauguacgcggaugauaccgccgggugggauacgcggauuacugaggacgaccuccaaaaugaggccaagaucaccgagauuauggagcccgagcacgcccuucucgcuacguccaucuucaagcugaccuaccaaaacaagguggucaggguccaacgcccagcgaaaaacggcaccgugauggacguaaucagccgucgcgaucaacguggcuccggccaggugggcacguacgggcugaacaccuuuaccaacauggaggugcagcucauccgccagauggagagcgagggaaucuucuuaccuuccgagcuggagaccccgaaccucgcggagcggguacuggacuggcuggagaagcauggggcggaacgccuaaagcggauggccaucagcggcgacgacugcguggugaagcccaucgacgaccgcuucgcaacugcucugaccgcguugaacgauauggggaagguccgcaaggacaucccgcagugggagcccucaaagggcuggaacgacuggcagcaggucccguucugcagccaccacuuccaucaguuaauuaugaaggacgggagagagaucgugguccccugccggaaucaagacgagcuugugggucgcgcccgggugucccagggcgccgguuggagccuccgcgagacggccugccugggcaaauccuacgcccagauguggcagcuuauguauuuccaccggcgcgaccuacgguuggcggccaacgcuaucugcucugcggugccaguggacugggugccgaccucccgcaccacauggagcauccacgcccaccaccaguggaugaccaccgaggacaugcugagcguguggaaccggguguggaucgaggaaaacccauggauggaagacaaaacccacguguccagcugggaggaagugcccuaucuggggaagcgugaagaucaauggugcgggucgcucaucggccugaccgcccgcgccaccugggccaccaacauccagguugcgaucaaccaggugcggcgcuuaaucgggaacgagaacuaccucgauuacaugaccagcaugaagcgguuuaagaacgaguccgauccagagggugcccugugguaa

SEQ ID NO: 23891 - RNA, 9879 nt, Artificial Sequence
  derived and/or modified CDS sequence (opt11) from DENV-1__KF955443__SS-prME
ucugucaccaugcuacucaugcuacugcccaccgcccucgccuuucaccugaccacccggggcggggagccacacaugaucguaagcaagcaggaacgcggcaagagccuccuguucaaaaccucagccggugugaacaugugcacccucauagcaauggaccugggcgaguugugcgaagacacgaugaccuacaagugcccccagaucaccgaagccgagcccgacgacguagacugcuggugcaacgccaccgacaccugggucaccuacgggacgugcagccagaccggcgagcaccggcgggauaagcgcuccguggcccuggcaccccacgugggccuggggcucgagacgcggaccgagaccuggauguccucagagggcgccuggaagcaaauccaacgcgucgagaccugggcccuuagacaccccggguucacggugaucgcguuauuucucgcgcacgcaauuggcaccucuaucacucagaaggggaucaucuucauccugcugaugcucguaacucccuccauggcgaugcgcugcgucgggaucggcaaccgggacuucguggaggggcugucgggggccacauggguggacgucgugcuggagcacggguccugcgugaccacaauggcgaagaacaagcccacccucgacauagagcuguugaagaccgaggucaccaaccccgcgauccuccgcaagcugugcauugaagcaaagauaagcaacaccacuacggauucccggugcccgacccagggcgaggccacccuggucgaggagcaggaugccaacuucgugugccgccggaccuucgucgaccgcggcugggggaacgguugcggccuguucggcaaggggagccuguuaacgugcgccaaguuuaagugcgucacuaagcucgaggggaagaucguccaguacgagaaucugaaguacuccgucauagugaccgugcauaccggcgaccagcaccaggucgggaacgagacgaccgagcaugguaccaucgcgaccaucacuccccaggccccgacgagcgagauccaacugaccgacuacggggcccucacacuggacugcagccccagaaccggccuggacuucaacgagauggugcuccucacgaugaaggagaaguccuggcuaguccacaagcagugguuccucgaccugccccugccguggacauccggggccucgaccagccaggaaaccuggaaccgccaggaccucuuagugacguucaagacagcccacgcgaaaaagcaggagguggucguacuggggucacaggagggcgcgaugcauaccgccuugaccggggcaacggagauccagaugagcggcaccaccaccaucuucgcagggcaccugaagugccggcugaagauggacaagcucacguugaagggcaccagcuacgugaugugcacggggucguucaagcuggagaaagaagucgcggagacccagcacggcacgguccuggugcaggugaaguacgagggcaccgacgcccccugcaagauccccuucuccacccaggacgagaaggguguuacccagaacggucgccucauaacggccaauccgaucgugaccgacaaggagaagcccgucaacaucgaaaccgagccgcccuucggggagagcuacauaguggugggugccggcgagaaggcccugaaacucuccugguucaagaagggaagcagcauaggcaagauguucgaagccacagcccgcggggcgaggcguauggcaauccucggggauacggcuugggacuucgggagcaucgguggaguguucaccucgguugggaagcuugugcaccaggucuucggaaccgccuacggggugcuguucagcggcgucuccuggaccaugaagauugggaucggcauccuccugacguggcugggccucaacagccgcuccacaagccuuuccaugaccuguauagccguagggauggugacccucuaucucggcgugaugguccaggcagacagcgggugcgugaucaauuggaagggccgagagcugaagugcgggagcgguaucuucgugacgaaugagguacacaccuggacagagcaguauaaguuccaggccgauagcccgaagcggcugagcgcggcuaucggcaaggccugggaagagggcgugugcggcauccgcuccgugacucggcucgaaaacauuauguggaagcagauuaguaacgagcugaaccacauccuacucgaaaaugacaugaaguucacggucguggugggggacgccaacggcauccuggcccaggguaagaagaugauacgcccccaacccauggagcacaaguauuccuggaaguccugggggaaggcgaagauaaucggcgccgacauccaaaacacgaccuuuaucauugacgggccagacacuccugagugcccagacaaccagcgggcauggaacaucugggagguggaggacuacggcuucgggaucuucaccacgaacaucuggcugaagcuucgcgacuccuacacacagaugugcgaccaccgucugaugagcgccgcgauuaaggacuccaaggccguccacgcggauaugggcuacuggaucgagagcgagaaaaacgagaccuggaagcuggccagagccuccuucaucgaagucaagacguguacguggcccaagucacacacccucugguccaacgguguccuggagagcgagaugaucauccccaagaucuacgggggcccuaucucccagcauaacuaccggccuggguacuucacccaaaccgcgggcccguggcaccugggcaagcucgagcuggauuuugaccuuugcgagggcacgaccguggucgucgacgagcacuguggcaacagggggccgagccuacggacgaccacggugaccggcaaaauaauccacgaguggugcugccgcucaugcacccuucccccccugagguuccgcggggaggacggcugcugguacggaauggaaauccggcccgugaaggagaaggaggagaaucucguccgcagcaugguguccgccggcagcggcgagguggacagcuucucccuggggauccucugugccagcaucaugaucgaagaggucaugcggagccgcuggagccggaagaugcucaugaccggcacgcuagccguguuccugcuccugaucauggggcagcugaccuggaaugaccucauccgccugugcaucauggugggcgcaaaugcguccgaccgcaugggcaugggcaccaccuaccuggcccucauggccacguucaagaugcggccaauguucgcaguagggcugcuuuuccgucggcucacaucacgcgagguguuacuacucacgaucggacugucccugguggccucggucgagcuccccaacucccuggaggagcugggcgacggucuggcgaugggcaucaugauguugaagcugcucaccgaguuccagccgcaccaguuauggacgacccugcucagcuuaacauucaucaagaccacgcugucccucgacuacgccuggaagaccacugccauggcccugagcaucgugucccuguucccgcucugccugagcacuacgucccagaaaaccaccuggcugccggugcuccugggcuccuucgggugcaaaccccuaaccauguuccucauuaccgagaacaagauauggggccggaaauccuggccccuaaacgagggaaucauggcgaucggcaucgugagcauccugcucucuucgcugcugaagaaugacgugccccucgccggaccgcuaaucgcgggcggcaugcugaucgccugcuacguaaucagcggcuccagcgcagaccucucccuggagaaggcggccgaggugagcugggagcaggaggccgagcacuccgguacgagucacaacauccugguggagguucaagacgacgggaccaugaaaauaaaagacgaggagcgcgacgacacccucaccaucuugcugaaggccacacuccuggcaguguccgguguguacccgaugagcauccccgcgacccuguuccucugguacuucuggcagaagaagaagcagcggucggggguccugugggacacccccucgccgcccgaaguagagcgcgccguccuggacgacggcaucuaccggauccugcagcgcggccugcuggggcgaucccaggucggagucgggguguuccaggacggcgucuuucacaccauguggcacguuacgagaggggccgugcugauguaccagggcaagcgccucgagcccagcugggccuccgucaagaaagaccugaucagcuacggugggggcuggagauuccaaggguccuggaacacgggcgaggagguccaggugaucgccguagagcccgggaaaaacccgaagaacgugcagaccacccccggcacguucaagacucccgagggcgaagugggcgcgaucgccuuggacuucaaaccaggcaccucuggcuccccgaucgucaaccgggagggcaaaaucgucgggcuauacgggaacgguguugucaccacgucagggaccuacgugucagccaucgcccaggccaaagcgucucaggaggguccccugcccgagaucgaggacgagguguucaagaaacgcaaccuuacuaucauggaccuccacccggggagcggcaagacccgucgcuaccugccggccauuguccgggaggccauaaagcgcaagcugcgcacgcucauucuagccccaacccgcgugguugcguccgagauggccgaagcccugaaaggcaugccuauccguuaccagaccaccgccgucaagagcgaacacaccgggcgggagauagucgaucuaaugugccacgccaccuucaccaugcgccugcuguccccggugagagugccuaauuacaacaugaucaucauggacgaagcgcacuucaccgaccccgccagcauugccgcccgcggcuacaucuccacgcggguggggaugggcgaggccgcggcuaucuuuaugaccgcuacgccgcccgggagcguagaggccuucccccagagcaaugcggucauucaggacgaggagcgugacaucccagaacggagcuggaacucaggcuaugacuggaucaccgacuuccccgguaagacggugugguucgugcccagcaucaaguccggaaacgacaucgcgaauugucuccgcaagaacggcaagcgggucauccagcucagccgcaagacuuucgacaccgaguaccagaagacgaagaauaacgacugggacuacguggugacgaccgacaucuccgagaugggggcaaacuuccgggcugacagagucauugacccccggcgcugccugaagcccguaauucucaaagacggcccggagcgggugaucuuggcugggccgaugccugucacugucgcgagcgccgcccagcgccggggccgcauugggcggaaccagaauaaagagggggaucaguacguguauaugggccaaccgcugaauaaugacgaggaccacgcccacuggaccgaggccaagaugcuccuggauaacaucaacacgcccgaagguauuauuccggcgcucuucgagcccgagcgggaaaagucagcggccaucgauggcgaguaccgccuccgcggugaagcccgcaagaccuucguagaguuaaugcggcggggcgaccuccccguguggcucucauauaaggucgcuuccgagggauuccaguacagcgaccggcgcuggugcuucgacggggaacggaacaaccaggugcuggaggagaacauggacguggaaaucuggaccaaggagggcgaacgcaagaagcugcggccacgcuggcucgacgcacggaccuacagugacccgcuggcccugcgcgaguuuaaggaguucgccgccgggcggcggagugucagcggcgaccuaauccuggagaucggcaagcugccccagcaccucacacugcgggcccagaacgcgcucgacaaccucgugaugcugcacaacuccgagcagggcgggaaagccuaccgccaugccauggaggagcugcccgacacgauagaaacgcucaugcugcuagcgcucaucgcggugcugaccgggggcgucacccucuucuuccucagcgggaagggcuugggcaagacguccaucgggcugcucugcguuacugccuccuccgcccugcuguggauggccuccguggaaccacacuggaucgccgcgucuaucauccucgaguuuuuccucauggugcuguuaaucccggagcccgaccggcagcgcaccccccaagacaaccaacucgccuauguggugaucggccuguuguucaugauccugacagucgccgccaacgagaugggccugcucgagacgaccaaaaaggaccugggaaucggucacguagccgcggagaaccaccagcacgccaccaugcuggacguugaccuccggccagccagcgccuggaccuuauacgccgucgccacgaccgugauaacccccaugaugcgacauaccaucgagaacacgaccgccaacauaucccugaccgccaucgccaaucaggccgcaaucuuaaugggccuggacaagggcuggcccauuagcaagauggacaucggggugcccuugcucgcccuuggcugcuacucccaggucaacccgcugacccucacggccgcaguccucaugcuuguugcccacuacgccaucaucggccccggccuccaggccaaagccacccgggaggcucagaagcgcacagcggccgggaucaugaagaacccgaccgucgauggcauuguugccaucgaccuggaccccguggucuacgacgccaaauucgagaagcagcuggggcagaucaugcucuugauccugugcacgagccagauccucuugaugcgcaccaccugggcccuuugcgagagcauuacccucgcgacgggcccgcugacaacccugugggagggcagccccgggaaauucuggaacacuacgaucgccgugucaauggcuaacaucuuuagaggcagcuacuuagccggcgccgggcucgcguucucccugaugaagucccucggggguggccgccgagggaccggcgcccagggcgaaacucugggggagaaguggaagcgucagcugaaccagcucuccaaguccgaguucaacaccuacaagcggagcggcaucauggagguggaccgcuccgaggccaaagaggggcugaaacggggcgagacgacaaagcacgccguaagcagagggacagcgaagcugcggugguucguggagcgcaaucuggugaagcccgaaggcaaggucauagaccucggaugugggcggggcgguugguccuacuauugugccggccugaagaagguaaccgaggugaagggguacaccaaggggggccccgggcacgaggagccgauccccauggccacuuacggauggacccuggucaagcuccacagcgggaaagacguguucuucaugccgcccgagaagugcgacaccuugcugugugauaucggcgaauccagcccgaaccccaccaucgaagaggggcgcacacuccgggugcugaagauggucgagcccuggcugcgcggcaaccaguuuugcaucaaaauccucaacccguacaugccuucagugguggagacccuggagcagaugcagcggaagcacggcgggauguugguccgcaacccgcugagccggaacuccacccacgagauguacugggugucgugcggcacagggaacauuguguccgcggucaacaugacgagccgcaugcugcugaaccgguucaccauggcccaccgcaagcccacauucgagagggacguggaccucggcgcgggcacucggcauguggccgucgagccugagguugccaaccuggacaucauugggcagcgcaucgagaacaucaagaacgagcacaaaucgacguggcauuacgacgaggacaacccguacaagaccugggccuaccacggcucuuacgaggucaagcccuccgguagcgcguccagcauggucaacggcguggugcggcuacuaaccaagccgugggacgucauccccauggugacccagaucgcgaugacggacaccaccccguucgggcagcagcgagucuucaaggaaaagguggacacccggacuccccgcgccaagcggggcaccacacagaucauggaggucaccgcgaaauggcuguggggcuuccugucccgcaacaagaagcccaggaucugcacgagagaggaguucacccggaagguccgcagcaaugccgccauaggagcggucuucguggacgagaaccaguggaacagcgccaaggaggcagucgaggacgagcgguucugggacuugguacaucgcgaacgagaacugcacaagcagggcaagugcgcgaccugcguguacaacaugauggggaagcgcgagaagaagcuaggcgaguucgggaaggcgaagggcucaagagccaucugguacauguggcucggggcccgcuuucuggaguucgaggcccugggguucaugaacgaggaccacugguucagccgggagaacucgcucucgggcgucgagggggaaggccugcacaagcugggguauauccuccgugacaucagcaagaucccgggcgggaacauguacgccgacgacaccgcggggugggacacgagaaucacggaggaugaucugcaaaacgaggccaagauuaccgauaucauggaacccgagcacgcccuguuagccaccagcaucuucaaguugaccuaccagaacaaggugguccgcguccagaggccggcgaagaauggcaccgugauggacgugaucucccggcgcgaccagcggggaucuggccaggugggcaccuaugggcugaacaccuuuacuaacauggaggugcagcugauuagacagauggaguccgagggcauuuuucugcccuccgaguuagagaccccaaaccucgccgagagggugcuggacuggcuggagaagcacggggccgagcgccucaagaggauggccaucucgggcgacgacugcgucgugaagcccaucgaugacagguucgcaaccgcccugaccgcguuaaacgacauggggaaggugcggaaggacaucccccagugggagcccagcaagggcuggaacgacuggcaacagguuccguucugcucccaccacuuccaccagcucaucaugaaggacggccgcgagaucguggugccgugccggaaccaggacgaguuagucggccgagcccgugucagccagggggccggguggucccugagggaaaccgccugucucggcaagagcuacgcccagauguggcagcugauguacuuccaucggcgcgaccugcggcucgcagccaacgcgaucugcuccgccgugcccgucgacugggugcccacgagccgcaccacauggucaauccacgcgcaccaccaauggaugaccacggaggacaugcugucgguguggaaccggguauggaucgaggagaacccguggauggaggacaaaacccacgugagcuccugggaagaggugcccuaucucgggaaacgcgaggaccaguggugcggcagccugaucggccugaccgcccgcgccaccugggccacaaacauccaggucgccaucaaccaggugcggcgccugaucggcaacgagaacuaccucgacuacaugaccuccaugaagcgguucaagaacgagagcgaccccgaaggcgcacuuugguga

SEQ ID NO: 23892 - RNA, 9879 nt, Artificial Sequence
  derived and/or modified CDS sequence (opt11) from DENV-1__GQ868520__SS-prME
ucggugacgauguugcucaugcuuuugccgaccgcacuugccuuccaccugacuacccggggcggcgagccccacaugaucgugagcaagcaggagcggggcaagagccuccuauucaagaccagcgcgggggucaacaugugcacccugaucgccauggaucugggugaacucugcgaggacacgaugaccuacaagugcccccagaucaccgaggccgagcccgacgacguugacugcuggugcaaugccacagauacaugggugaccuacgggaccugcagccagaccggcgagcaucgccgggacaagcgcucuguagcgcuggcgccccacguuggcuuggggcucgaaacccggaccgagaccuggaugucguccgagggcgcauggaaacaaauucagcgcgucgagaccugggcccugcggcaccccggguuuaccgugaucgcucucuuccucgcgcaugccaucgggacuagcaucacucagaaggggaucaucuucauccugcugaugcucgugacccccaguauggccaugcguugcgugggcauuggcaaccgggauuuugucgaaggguugagcggugccacguggguugacgucgugcuggaacacggguccugcgucaccaccauggcuaagaacaagcccacccuugacaucgagcucuugaagacagaggucaccaacccugcgauccuccgcaagcuguguaucgaggccaaaauaagcaauaccaccacggacucccggugcccaacccaaggugaggccaccuugguggaggagcaggaugccaacuuuguuugucgccgaaccuucguggaucgcggcugggggaauggaugcggcuuauucggcaaggggagccuuuuaacuugcgccaaauucaaaugugugaccaagcuagagggcaagauaguucaauacgagaaccugaaauacuccgugaucguuaccgugcacaccggcgaccagcaccaggucgggaacgaaacgaccgagcacggcaccaucgccaccauaacaccucaggcccccacgagcgaaauccagcuuacggacuacggcgcgcucacccuugacuguagcccccggaccggccuggacuucaacgagaugguccucuugaccaugaaggagaaguccuggcuaguccacaagcagugguuccucgaccugccgcuccccuggaccuccggggccaguaccagccaggagaccuggaaccgccaggaccucuugguuacguucaagaccgcccacgcgaagaagcaggagguggucguuuuagguucccaagagggcgccaugcauaccgcccucacuggagccacggaaauccaaaccagcggcaccaccaccaucuuugccgggcaccugaagugucgguuaaagauggacaaacucaccuugaagggcaccuccuauguuaugugcacagggagcuucaagcuggagaaggaggucgcggagacgcagcacgguaccguccuggugcaggucaaauaugagggaaccgacgcccccugcaagauuccguucagcacccaggacgagaagggggugacgcagaacggccgccucaucaccgccaacccgaucgugaccgacaaggaaaagcccguaaacaucgagaccgaaccacccuucggggaaagcuacaucguggucggcgccggggaaaaggcgcugaagcuguccugguucaagaaaggguccuccauaggcaaaauguucgaggccacggcacgcggagcccgccguauggccauccucggcgacaccgcgugggacuucgguagcaucggcggcgucuucacuuccguggggaaacuugugcaccaggucuucggcaccgccuacggggugcuguucagcggaguauccuggacgaugaagaucgggaucggaauacuccugaccuggcuuggccucaacagucgcucgaccagcuuguccaugaccuguaucgccgucgggauggucacucuguaccuuggcgugaugguccaagccgauagcggaugcgugauaaacuggaagggaagggaguugaagugcgggagcggcaucuucguaacgaacgagguccacaccuggaccgagcaguacaaguuucaggccgacaguccgaagcggcugagcgcggccaucggcaaggccugggaggagggggugugcggcauccguuccgccacccggcucgagaacaucauguggaagcagauaagcaacgagcugaaucauauccuauuagaaaaugauaugaaguucaccguggucguuggggacgccaauggcauucuggcgcaggggaagaagaugauccgcccccagcccauggagcacaaguacuccuggaaguccuggggcaaggccaagaucaucggugccgacauccagaauacgaccuuuaucaucgacgggcccgacacaccggagugccccgacaaccagcgagccuggaacauaugggagguagaagacuauggguucgggaucuuuacgacgaacaucuggcugaagcuccgcgacuccuacacccagaugugcgaccaccggcugaugagcgcggccaucaaggacucgaaggccguccacgccgauaugggguacuggauagagucugagaaaaaugagaccuggaagcuggcccgcgcuuccuucaucgaggugaagacgugcaccuggcccaagagccacacccucugguccaacggcguguuggagagcgagaugaucauccccaaaaucuacggugguccgaucucucagcacaacuaccggcccggguacuucacccagacggccggcccguggcaccuggggaaauuggagcuggacuucgacuuaugcgagggcacgaccgucgugguugacgagcauugcggcaaccgcgggccgagccuccgcaccacgaccgucaccggcaagaucauccaugaauggugcugccgcuccugcacgcugccgccccugcgguuucgcggugaggacggcugcugguacgggauggagauucggcccgugaaggagaaggaggagaaucucgugaggagcauggucucagcuggaagcggcgagguggacagcuucaguuuggggaucuugugcgccaguauaaugaucgaggagguaaugcggucccgcuggagcagaaagaugcucaugaccggcacucuggccgucuuccugcuccugguuauggggcagcugaccuggaacgaccucauccgccuguguaucauggugggcgcgaacgcguccgaucgcaugggaaugggaaccacguaccuggcccuaauggccacauuuaagaugcggccgauguuugccgucggguuauuguuccgucggcugaccagucgcgaggugcugcuccucaccauuggguugucccucguagccagcgucgagcuccccaacucccuggaggagcugggggacgggcucgccaugggaauaaugaugcugaagcugcucacagaguuccagccccaccagcucuggaccacccugcucagccuuaccuucauuaagacgacucuaagccuagacuaugccuggaagaccaccgccauggcccugagcaucgugaguuuauucccucucugccugagcaccaccucccagaaaacgacguggcugcccguccuccugggcagcuucgggugcaagccccugaccauguuccuuaucaccgagaacaagauuuggggccggaaaaguuggccacugaacgaggggaucauggccaucgguaucgucucaauccugcucuccucacuguuaaagaacgaugugccacucgcuggcccgcugaucgccggcgguaugcugaucgccugcuaugucaucaguggguccagcgcggaccucucccuggagaaggccgccgaggugagcugggaacaggaggcugagcacuccggcaccagccauaacauccugguugaaguccaagacgacgguacgaugaagaucaaggacgaggaacgcgacgauaccuuaacaauccuccugaaggccaccuuacuggcaguguccggcguuuaccccaugagcauccccgccacccuguuuguaugguacuucuggcagaagaagaagcagcgguccggggugcuaugggacaccccuagcccaccagagguggagagagcuguccuggacgauggcaucuaucggauccugcagcgcggccuacucgggcggucccaggugggcgugggggucuuccaggacggaguguuccacacgauguggcacgugacucgcggggccguccugauguaccaggggaaacggcuagagccuucgugggcguccguuaagaaagaucucaucucuuacggaggaggcuggcgcuuccagggauccuggaacaccggcgaggaggugcaggucaucgcgguggagcccgggaaaaacccgaagaaugugcagacaaugcccggcaccuucaagacccccgagggcgaagucggggccaucgcgcuagacuucaagcccggcacaagcggauccccgaucgugaaccgggagggcaagaucguuggccuguacgggaacgggguuguuaccacgagcgggaccuacguaucagccaucgcucaggcaaaagcuagccaggaaggcccuuuacccgagaucgaggacgagguuuuuaagaagcguaaucugacaaucauggaccugcacccugggucaggcaagacgcggcguuacuugcccgccauggugagggaggccaucaagcgcaagcugcgaacgcugauccucgcgccuacccgcguggucgccuccgaaauggcagaggcccugaagggaaugccuauccgcuaccaaaccaccgccgucaagagcgagcacacgggacgggaaauuguggaccugaugugccacgcgacauucacuaugcgcuuacuguccccgguccgcgugccgaacuacaauaugaucaucauggacgaggcccauuuuaccgaccccgcgucgauagccgcccgcggcuacauaucuacgcguguggggaugggcgaggcggccgccaucuucaugaccgccacgccgcccgggagcgucgaggccuucccccaguccaacgcgguuauccaggacgaggagcgcgacauucccgaacggucguggaacuccggcuacgacuggaucaccgacuucccuggcaaaacggugugguucguacccagcaucaaguccggaaaugacauagcaaacugccugaggaagaacggcaaacggguaauacaacuaagccgcaagaccuuugacaccgaguaccaaaagacuaaaaacaacgacugggacuacguggucacgaccgacauauccgagaugggcgccaacuuccgggcugaucgcgugaucgaccccagacguugucugaagcccgugauccugaaggauggcccugagaggguaaucuuggcgggaccgaugcccguaacgguggccagcgccgcccagcgccgggggaggaucgggcggaaccagaacaaagagggagaccaguacguauacaugggccagccccucaacaacgacgaggaccacgcccauuggacggaagcgaaaaugcugcucgacaacauuaacacacccgaggggaucaucccggccuuauuugagcccgagcgcgagaaauccgccgccaucgauggcgaguaccgucucaggggggaggcgcgcaagaccuucguggaguugaugcggcggggagaccugcccgucuggcuuagcuacaaaguggcgucugagggauuccaguauagcgaccggcgcugguguuucgacggagagcguaacaaccaggugcuugaagagaacauggacguugagaucuggacgaaggagggagagcgcaagaagcugcgcccccgcuggcucgacgcgcggaccuauuccgacccgcuagcccugcgcgaauuuaaggaguucgccgccgggaggcguagcgugaguggcgaccucaucuuggagauuggcaagcugccucagcaucuaacccuccgggcgcagaacgcccuggacaaccuggugaugcuccacaacuccgaacaaggcgguaaggccuaccgccaugcgauggaggaacugcccgauacuauagagacccugaugcuccuggcccucaucgcggugcucaccgggggcgugacccuguucuucuugagcgggaagggccucggcaagacgucuaucgggcugcugugcguuaccgcgagcagcgcccuccuguggauggccagcgucgagccccacuggaucgcggccuccaucauccuggaguucuucuugauggugcugcugaucccggaaccggaccggcagcgcacgccucaggacaaccaguuagcguacguggugaucggccugcuguucaugauccucacgguugccgccaacgaaauggggcugcuggagacgaccaagaaggacuuaggcaucgggcacguggcggccgagaaccaccagcaugccaccaugcuagacguggaccuacggccggccagcgccuggacccuauacgcgguggccacaaccgugauaaccccuaugaugcgccacacaaucgagaacacgaccgcuaacaucucccugaccgcaauugccaaccaggcugccaucuuaaugggacucgacaaggguuggccgauaaguaagauggacaucgggguccccuugcuggcacucgguugcuacagccaggugaacccgcugacccugacggccgcggugcuuaugcuagucgcccacuaugccaucaucggacccggccugcaggccaaagccacccgggaggcgcaaaagcggaccgccgccggcauaaugaaaaaucccacuguggacggcaucguggccaucgaccucgaccccgucgucuacgacgccaaauucgagaagcagcugggccaaaucaugcugcugauacugugcacgagccagauccugcugaugcgaaccaccugggcucugugcgaguccauaacccuggcuacggggccgcuaaccacccugugggagggcucuccggguaaauucuggaauacaacgaucgccgugucuauggccaauaucuuccggggcaguuaucuggccggcgcggguuuagccuucucacugaugaagucacugggcgguggccggcgcgggaccggcgcccagggugagacccucggagagaaguggaagcgccagcugaaccaguuauccaagagcgaguuuaauaccuacaagcgcagcggaaucauggaggucgaccgcagcgaggcaaaggaagggcucaagcggggcgagacgaccaagcaugccgugagccgcgggaccgcuaaacuccgcugguucguggagaggaaccucgucaagcccgaaggcaaggugauugaccucggcugugggcggggagguugguccuacuacugcgcugggcucaagaaggugaccgaaguaaagggguacacgaagggcggccccgggcacgaggaaccgaucccaauggccacguacggauggaaccuggugaaguuacacagcgggaaagacguguucuucaugccgcccgagaagugcgacacacucuugugugacaucggcgagucaaguccgaaccccacgaucgaggaggggcgcacccuucggguccuaaaaaugguggagccguggcuucgcgggaaccaguucugcauaaagauccugaaccccuacaugccguccguugucgagacgcucgagcaaaugcagcggaagcacgguggcaugcuagugaggaauccccugucacgcaacuccacucacgagauguacugggucuccugcgguaccgguaauaucgucuccgcugugaacaugaccucucgcauguuguugaaccgguucacgauggcgcaccgcaagcccacuuacgaacgagacguggaucucggcgccggcaccagacacguugccgucgagccggagguagcgaaccucgacaucaucggacagagaaucgagaacaucaagaacgagcacaaguccacuuggcauuacgaugaggacaauccguacaagacgugggccuaccacggcagcuacgaagucaagcccuccgggagcgcgagcagcauggugaacggcguaguccgucugcugaccaagccaugggacgugauccccauggucacccagauagccaugaccgacacuaccccauucgggcagcagcgcguguuuaaggagaagguugacacccgcaccccccgggcuaaacgggggacgacccagaucauggaggucacagcaaagugguuguggggcuuccugucccguaauaagaaaccccggaucugcacccgcgaggaguucacgagaaaggugcgcucgaacgcugcgaucggggccguguucgucgacgagaaccaguggaacagcgccaaagaagcuguggaggaugagcgguucugggacuuagugcaccgggagcgggagcuccacaaacagggcaagugcgcgacgugugucuauaacaugauggggaagcgcgagaagaagcugggcgaauucgggaaggccaaaggcucccgggccaucugguacauguggcugggcgcccgcuuccucgaguuugaggcccugggguucaugaaugaggaccacugguucagccgggagaauucucugagcggcguggagggggaaggcuugcacaagcuaggguacauccucagagacauuuccaagauaccggguggcaacauguacgcggaugauaccgccgggugggacacucggaucacugaagacgacuuacagaacgaagccaaaaucaccgagaucauggaaccggagcacgcccugcuggcaaccagcaucuucaagcucaccuaccagaacaagguggugcgaguccagagacccgcgaagaacggcacggugauggacgucaucagucguagagaccaaagggggucgggccaggugggcaccuacgggcugaacaccuucacgaacauggaggugcagcugauccgccagauggagucugaaggcaucuuucuucccagugagcuggaaacgcccaaucuagccgagcgcguccuugacuggcuggagaagcacggggcugaacggcugaaaagaauggccaucuccggcgacgacuguguggugaagcccauugaugaccgcuucgccacugcccugacugcccugaacgauauggggaagguccguaaggacaucccccagugggaaccgagcaagggcuggaacgacuggcagcaggucccguucugcucccaccacuuccaccaauugaucaugaaggauggccgcgagaucguugucccgugucggaaccaggaugagcucguggggcgcgcacgcgugagccagggcgcuggguggucccugcgcgagaccgccugcuuaggcaagagcuacgcccagauguggcaguugauguacuuccaccgccgcgaccugcggcuggccgcaaacgccaucugcucugccguccccguggauugggugccuaccagccgcacgaccuggagcauccacgcccaccaucaauggaugacuaccgaagacaugcucaguguguggaacagaguguggaucgaggaaaacccguggauggaggauaagacgcacgugagcuccugggaggagguccccuaccugggaaagcgcgaggaccaguggugcggcagucuaauuggccuaaccgcccgagccacuugggccaccaacauccagguugcuaucaaccaagugcggcgacugaucgggaacgagaacuaccuggacuacaugacguccaugaagcgguucaagaacgaaagcgaccccgagggcgcgcucugguga

SEQ ID NO: 23893 - RNA, 9879 nt, Artificial Sequence
  derived and/or modified CDS sequence (opt11) from DENV-1__GQ868522__SS-prME
agcgugaccaugcugcuuaugcugcugcccaccgcccucgccuuccaccugaccacccggggcggagaaccccacaugauagugagcaagcaggagcggggcaagagccuccuguuuaagaccagugcuggggugaacaugugcaccuuaauugccauggaccugggugagcucugcgaggacacaaugaccuacaagugcccccagaucaccgaggcugagcccgaugacgucgauugcuggugcaaugccaccgacaccugggucaccuacgggaccugcagccagacuggcgagcaccggcgggacaagcgcuccguggcgcuggcgccccacgugggccugggucucgagacccggacugagacguggaugagcuccgagggcgccuggaagcagauccagcgcgucgagaccugggcccugcgucaccccggguucacagugaucgccuuauuccuagcgcacgcgaucggcaccagcaucacccagaaagggaucauuuucauccugcugaugcucgugacucccucaauggccaugcgcugcgucggcauuggcaaccgggacuucguggaagggcugagcggcgccacguggguggacgucgugcuggaacacggcagcugcguuaccacuauggccaaaaacaaaccaacccucgacaucgaacugcugaagacggaggucaccaaccccgcgauccuccgcaagcugugcaucgaggccaagaucagcaacaccaccacggacucccggugcccgacccagggcgaagccacucugguggaagaacaggacgccaacuucgugugccgccgaaccuucgucgaccgcggcugggggaacggcugcggccucuucggcaaggggagccuguuaacgugcgccaaguucaaaugugugaccaaacucgagggcaagaucguucaguacgagaaccugaaguacucugugaucgugaccgugcacaccggcgaccagcaccaggucgggaaugaaacuaccgaacacggcaccaucgcgaccaucacgccccaggcacccacgagcgagauccagcuaaccgacuacggggcccucacccuggacugcagcccccggacgggccucgacuucaacgagaugguauugcugacuaugaaggagaagucauggcuggugcauaagcagugguuccucgaccugccucugccguggaccuccggggccagcaccagucaggagaccuggaaccgccaggaccuucuggugacguucaagaccgcacacgcgaagaagcaagaaguggucguucuggguucccaggagggcgccaugcauaccgcguugaccggggcaacggagauccagaccagcggcaccaccacgaucuucgcagggcaccuaaagugccggcugaagauggacaaacuuacccugaagggcaccuccuacgugauguguaccgggagcuucaaguuggaaaaggaagucgcggagacacaacacggcacaguguuggugcaggucaaguacgagggcaccgacgccccuugcaagauucccuucagcacccaggaugagaaaggagugacgcagaacggccgucuaaucaccgccaacccgaucguaaccgacaaagagaagccugucaacaucgagacagagccgcccuucggggagagcuacaucguggugggcgccggcgagaaggcgcugaagcugucuugguucaagaaggggagcuccaucggcaagauguucgaggcaaccgcccgcggggcccgccggauggcgauccucggugauacugccugggacuucgguagcaucggcggcgucuucaccuccguggggaagcuggugcaccaggucuucggcaccgcguacggaguacuuuucagcggcgugucauggacgaugaagaucgggaucggaauccucuuaacauggcugggccugaacagccguuccaccagccuguccaugaccugcaucgccgucgggauggucacucuguaccucggagugaugguccaagccgacagcgguugcgugauaaacuggaaaggccgggaguuaaagugcggguccggcaucuucgugacgaacgagguccacaccuggaccgagcaguacaaguuccaggcugacagcccuaaacggcugagcgcggcaaucgguaaagccugggaggagggggucugcggcauccgcuccgcuacccggcucgagaacauuauguggaagcagaucagcaacgagcuaaaccauauacugcucgagaacgacaugaaguucacgguggugguaggggacgccaacggcauccuggcccaggggaagaagaugauucgcccccagcccauggagcauaaguacuccuggaaguccuggggcaaggccaaaaucauaggugccgauauccagaacacuaccuuuaucaucgaugggcccgacaccccggagugccccgacaaccagcgggccuggaacaucugggagguggaggacuacggcuucgggauuuucacgaccaacaucuggcugaagcuccgcgacuccuacacccagaugugcgaccaccggcugauguccgcggcgaucaaggacuccaaggccguccacgcugacaugggcuacuggaucgagagcgagaagaaugagaccuggaagcuggcucgcgcguccuucauagaggugaagacgugcaccuggcccaagucacacacccucuggucuaacggcgugcuggagucugaaaugaucauacccaagaucuaugggggcccgaucucccagcacaacuaccgccccggguacuucacccagacggccggccccuggcaccuggggaaacuagagcuggacuucgaccugugcgaaggcaccaccgucguuguggacgaacacugcggcaacagagggccgagccuccggaccacuaccgucaccggcaagaucauccacgaguggugcuguagauccugcacccugccgccccugcgguuccgcggggaggacggaugcugguaugggauggagaucagacccgugaaggagaaggaggagaaccucgugcgcuccauggucucugcgggcaguggcgagguggauagcuucucccuggggauccugugcgccagcaucaugaucgaggaggugaugcggucccgcuggagccggaagaugcucaugacgggcacccuggccguuuuccuccuccuggugauggggcagcugacuuggaacgaccucauccgccugugcaucaugguaggcgcgaaugcuuccgaccgcauggggaugggcaccacguaccuggcccucauggccaccuucaaaaugcggccuauguucgccgucgggcugcuguuccgccgacugaccucacgcgaggugcugcugcucaccaucggccuuucccugguggcgagcgucgaacucccuaacucccuggaggagcugggggacgggcucgccaugggcaucaugaugcugaagcuacucacggaguuccagccccaccagcuguggaucacccucuuaagccugaccuuuaucaagaccacguuaucccucgacuacgccuggaagaccaccgccauggcgcugagcaucgugucccuguucccccucugccucagcacaacgucccagaagacgaccuggcugccgguccuccugggcagcuucgggugcaagccccugaccauguuccucauuaccgagaacaagaucuggggccggaaauccuggcccuugaacgaagguaucauggcuaucggcaucgugagcauccugcuauccagccuucugaagaaugacgugccccucgccgggccgcugaucgccggcggcaugcugaucgccugcuacgucaucagcggguccagcgcggaucucucccuggagaaggccgccgaggugagcugggagcaggaggccgagcacuccggcacgucacacaacauccugguggagguccaggacgacgggacuaugaagaucaaagacgaggagcgcgacgacacccuuaccauccuguuaaaggcgacgcuccuggcgguguccggcguguaccccaugagcauccccgccacucuguuugucugguauuucuggcagaagaaaaagcagcgcuccgggguccucugggacacccccagcccgcccgaaguggagcgcgccgugcuggaugacggcaucuaccgaauccugcagcgcggccugcucgggcggucccaggugggcgugggggucuuccaggacgguguguuccacaccauguggcacgugacgcgcggagcagugcugauguaccagggcaagcggcuggagcccagcugggccucagugaagaaggaccugaucagcuacggcgggggcuggcgcuuccagggguccuggaacacuggcgaggaagugcaggucaucgccguggagcccgggaagaacccgaagaacgugcagaccaugccaggcaccuucaagacgccggagggcgaggucggggccauugcucuggacuucaagcccggcacaagcggguccccgaucgugaaucgggagggcaagaucgugggccuauacgggaacggcgucgugaccaccaguggcacguauguguccgcuaucgcccaggcgaaggcaagucaggaaggcccccuccccgagaucgaggacgaggucuucaagaaacguaaccuuacaauuauggaucugcacccggguagcggcaagacccggcgauaccuccccgcuauggugcgggaggccaucaaacgcaagcuacggacccugauccuugcgcccacgaggguggucgcguccgagauggccgaggcccugaagggcaugcccauccgcuaucagaccaccgccguaaagagcgagcacaccgggcgggagauuguggaccugaugugccacgcuacauucaccaugcgccuccugucccccguccgggugcccaauuacaauaugauaaucauggaugaggcccacuucaccgaccccgccagcauugccgcgcgcggcuacaucucaacacggguggggaugggagaagcggcugccaucuucaugacggccacuccgcccgggagcgucgaggccuucccccaguccaacgcgguaauccaggacgaggagcgcgacauccccgagcggagcuggaacuccggcuacgacuggaucaccgacuuccccggaaagaccguuugguucguccccagcauuaagucaggcaacgacaucgccaacugccugcgcaagaacggcaagcggguuauccaguugagcagaaagacauucgacaccgaauaccagaagaccaagaauaacgacugggacuacguggucacgaccgacauuuccgaaaugggggccaacuuccgggccgaccgcgugauugacccccggcgcugucugaagccggugauccugaaggauggccccgagcggguuaucuuggcggggccgaugccugucaccguggcgagcgccgcccagcgccggggacggaucggccggaaccagaacaaggagggggaccaguacgucuacaugggccaaccccugaacaacgacgaggaccacgcccacuggaccgaggcgaagaugcugcucgacaacaucaacacccccgaggggauaaucccugcccuguucgagcccgagcgggagaaguccgccgcaaucgacggcgaguaccgccugcgcggggaagcccgcaagacguucguggagcucaugcgccgaggggaccugcccguauggcugagcuacaaaguggcguccgagggcuuucaguacagcgaccggcgcugguguuucgacggggagcggaacaaccaggugcucgaggagaacauggacgucgagaucuggacgaaggagggcgagcgcaagaaacugcggccccgauggcuggacgcccggaccuacuccgacccgcucgcucugcgugaguucaaggaguucgccgccgggcgacgcucggucagcggcgaccugauccucgagaucggcaagcuaccccagcaccugacccuccgggcgcagaacgcccuggacaaccuggucaugcuccacaacuccgagcagggcgggaaggccuaccgccaugccauggaggagcugcccgacaccaucgagacgcugaugcuccuggcguugaucgccguccucaccgggggcguaacccuguucuuccuaucugggaagggccucggcaaaaccuccaucgggcugcugugcgugacagccaguuccgcgcuccuguggauggccagcgucgaaccccacuggaucgcagccuccauaauccuggaguucuuccucauggugcugcugauuccggagcccgaccggcaacgcacaccccaggacaaccagcucgccuacguggucaucggccuacucuucaugaucuuaaccguggccgccaacgagaugggguugcuggaaaccacgaagaaggaccugggcaucggucacguggcggccgagaaccaccagcacgcaaccaugcuggacguggaucugcggccggccagcgccuggaccuuauacgcgguggccaccacggugaucaccccgaugaugaggcacacaaucgagaacaccacggccaacaucucccugacugcgaucgccaaccaggcggccauccugaugggucucgacaaaggcuggcccaucagcaagauggacaucggggucccccuucuggcccucggcugcuacucccaggucaacccucugacucugaccgcugcggugcucaugcuggucgcccacuacgccaucaucgggcccggccugcaggcgaaggcgacgcgugaggcgcaaaagcgcacggcggcuggaaucaugaagaaccccaccguggacggcaucgucgccauagaccucgaucccgucguguacgacgccaaguucgagaagcaacuggggcagaucaugcugcucauccugugcaccagccaaauccugcucaugcgcacgaccugggcguugugcgaguccaucacccuggcaaccgggccgcucacgacccugugggagggcucucccgggaaguuuuggaacacuaccaucgccguguccauggccaacaucuuccggggcagcuaccuggcuggcgcgggucucgccuucucccugaugaagucccugggcggagggcgccggggaacgggcgcccagggcgagacccucggggagaaguggaagcgucagcucaaccaacuguccaaaagcgaguucaacaccuacaagcgaagcggcauaauggaggucgaccgcagcgaggccaaggaggggcucaagcggggcgagaccacgaagcaugcggugagccgcggaacagccaagcugcggugguucguugagcgcaacuuaguuaagcccgaaggcaaggucaucgaccugggcugcgggagaggagggugguccuauuacugugcagggcuuaagaaaguaaccgaagucaagggguacaccaaagggggccccgggcacgaggagccgauccccauggcgaccuacggcuggaaucuggugaagcugcacagcgggaaggacguguucuucaugccgcccgagaagugcgacacgcuucugugcgacaucggcgaguccagcccgaaccccaccaucgaggaggggcgcacccugcgggucuugaagaugguggaacccuggcugcgcggcaaccaauucugcauaaagauccugaaccccuacaugccguccguggucgagacucucgagcagaugcaacggaagcauggugggaugcuggugcgcaauccccugucuaggaacuccacgcacgaaauguacugggugagcugcggcacaggaaacaucgucagcgccguaaacaugacuagccgcaugcuccugaaccgguucacuauggcgcaccggaagcccacguacgaacgcgacguggaccugggagcaggcacccggcacgucgcgguggaaccagagguggccaaccucgacaucaucgggcagcgcaucgaaaauaucaagaacgagcacaagucuaccuggcacuacgaugaggacaacccguacaagaccugggccuaccacgguagcuacgaggucaagcccuccgggucugccuccagcaugguuaacggcguuguccggcuguuaacgaagccuugggacgugauccccauggucacccagaucgccaugaccgacaccacgccguucggacagcagcgcguguucaaggagaagguggacacccggacgccucgggccaagcggggcaccacgcagaucauggaggucaccgccaaauggcucuggggcuuccugucccgcaacaagaagccccggaucugcacccgcgaggaguucacccggaaggugcgcuccaacgccgcgaucggggccguguuugucgacgagaaccaguggaacucggccaaggaggccguggaggacgagcgauucugggaccuggugcaccgcgagcgagagcuccauaagcagggcaagugcgcgacgugcgucuacaacaugauggggaagcgcgagaagaagcugggcgaguucgggaaggccaagggcucccgggccaucugguacauguggcuaggagcccgcuuccucgaguucgaggcccuaggguucaugaacgaggaucacugguucagcagagaaaacuccuugagcggcguugagggggagggccuccacaagcugggguacauccugcgagacaucuccaagaucccuggcggcaauauguacgcagaugacaccgccgguugggacacacggauuaccgaggacgaccuccagaacgaggccaagaucacggagaucauggagccggagcacgcccugcuggccaccagcauuuucaagcuaacauaccagaacaaggugguacgcgugcagcgccccgcgaagaacggcaccgugauggacgucauaucccgccgcgaccagcgggguagcggccaggugggcacauacggucugaacaccuucaccaacauggaggugcagcugauccgccaaauggaguccgagggcauauuccugcccagcgaacuggaaaccccaaauuuggccgagcgaguccucgacuggcuagagaagcacggggccgagcgccugaagcggauggccauuuccggcgacgacugcguggugaagcccaucgaugaccgcuucgccacggcguuaaccgccuuaaacgacauggguaagguccggaaggacauuccucagugggagcccagcaagggcuggaacgacuggcagcaggccccguuuugcucccaccacuuucaccagcugaucaugaaggacggccgcgagaucguggugcccugccggaaccaggaugagcucgucgggcgcgcucgggugagccagggagccggguggucgcugcgagagaccgcgugucugggcaagaguuacgcgcagauguggcagcucauguacuuccaccggcgcgaccugcggcuggcggccaacgcaaucugcuccgccgugccagucgacugggugcccaccagccgcaccacguggagcauccacgcgcaccaccaauggaugaccaccgaggacaugcuauccguguggaaucgggucuggaucgaggagaauccguggauggaggacaagacccacgugagcuccugggaggaggugcccuaccuggggaagcgggaggaucaguggugcggcagccugaucggucucacggcccgcgccacgugggcgaccaacauccaagucgccauuaaccaggugcggcgccuaaucgggaacgagaacuaccuagacuacaugaccuccaugaagcgguucaaaaacgagagcgaccccgaaggcgccuugugguag

SEQ ID NO: 23894 - RNA, 9879 nt, Artificial Sequence
  derived and/or modified CDS sequence (opt11) from DENV-1__HQ166036__SS-prME
agcgugacuaugcugcucaugcugcugcccaccgcccucgcuuuucaucuuacgaccagaggcggggagccccacaugaucgugucuaagcaggagagaggcaagagccuccuuuucaaaaccucagcgggggugaauaugugcacccugaucgcgauggaucugggcgagcucugcgaggauaccaugaccuacaagugcccgcagaucacagaggcggagcccgacgacguagacugcuggugcaacgccacggacacaugggugaccuacgggaccuguucgcaaaccggcgagcaccgccgggacaagcgcuccguggcgcuagcgccccacgugggccucggguuggagacucggaccgagacauggauguccucggaaggggccuggaaacagauccagcgcgucgagaccugggcccugcgacaucccgguuucacugugaucgccuuauuccucgcgcacgccauaggaacgucgauaacucagaaggguaucaucuucauacugcuaaugcucgucacgcccuccauggcaaugaggugcgucggaaucggcaaucgggauuucguggaggggcugagcggggccacguggguggacgucgugcuggaacacggcucaugugugaccaccauggccaaaaacaagcccacccucgacaucgaacuguugaagacagaagugaccaaucccgcgauauuaaggaagcugugcaucgaagcgaagaucuccaauacaaccacagacucccgguguccaacacagggggaagccacacugguagaagagcaagaugccaacuuugugugucgccggacuuucgucgaccgcgguugggggaacgggugcggccuauuuggcaagggaagccugcugacaugugccaaauucaagugcgucaccaagcucgaagggaagaucgugcaguacgagaacuuaaaguacuccgugaucgugaccgugcauaccggcgaccagcaccaggucgggaacgagacgaccgaacacggcacuaucgcgacgaucacgccccaggcccccacgagcgagauccagcugaccgauuacggcgcucuaacgcuggacugcagcccccggaccgggcuggacuucaaugagauggugcuccugacgaugaaagagaaauccuggcugguccacaagcagugguuccucgaucuuccgcugccauggacuuccggcgcgagcaccucccaggagacauggaaccgccaggaccugcuggucacuuucaagaccgcucacgccaagaaacaggaaguggucgugcucggaucccaggaaggcgccaugcacaccgcacucacaggggcuacggagauccagacgagcggcaccaccacgaucuucgccgggcaccugaagugucggcugaagauggauaaacucacccugaagggcacuuccuacgugauguguaccgggagcuucaagcuggagaaggaagucgcagaaacgcagcacggcaccguucuggugcaagucaaguacgagggcacagacgcccccugcaaaauccccuucuccacccaggaugagaagggggugacgcaaaacggccgccucauaaccgccaacccgauaguuaccgacaaggagaaacccgucaacauugaaaccgagccaccauucggggagagcuauaucgugguaggcgcgggcgagaaggcacuaaagcuguccugguucaaaaaggggucaagcauuggcaagauguucgaggccacggcacgcggggccaggcggauggccauccucggcgacaccgcgugggacuucgggagcaucgguggcgucuucaccuccguggggaagcuggugcaccaaguguucgguacagccuacgggguguuauucuccggaguguccuggacgaugaagaucgggaucgguauucuccugaccuggcuuggccucaacucccgcucaaccucgcuguccaugacuugcaucgccguggggaugguaacauuauaccucggggugaugguacaggcggacagcgggugcgugaucaacuggaaaggccgcgagcucaaauguggguccgguaucuuugugaccaacgagguccacacuuggaccgagcaguacaaguuccaagccgacagcccgaagcggcucagcgcggccauaggcaaagccugggaagagggggugugcggcauuaggagcgcuaccagauuagagaacauuauguggaagcagauuagcaaugagcucaaccacauacugcucgaaaacgacaugaaguucacuguuguggugggagacgcaaacgggauucuggcgcagggaaagaaaaugauacgaccccagccgauggagcacaaguacagcuggaaguccuggggcaaggccaagauaaucggcgccgacauccagaacacuaccuucaucaucgaugggcccgacacgccggagugccccgacaaccagcgugccuggaauaucugggagguggaagacuacggcuucgguaucuucacgacgaacaucuggcucaagcuccgcgacuccuacacccagaugugcgaccaccgccugaugagcgcggcaaucaaagacucgaaggccguccacgcggacaugggauacuggaucgagagugagaagaacgagaccuggaagcucgcacgcgcguccuucaucgaggugaagacuugcacuuggcccaaaagccacacccucugguccaacggcguguuggaaagugagaugauaauccccaagaucuacggaggcccgaucucucagcacaacuaccggccuggguacuucacgcagacggccggucccuggcauuuggggaaacuugagcuggacuucgaccugugugaggguaccaccgucguaguggacgagcacugcggcaaccgcgggccuagccuccggacuacgacagucaccggaaagauuauccacgaauggugcugccgaucuugcacccucccgccccugcguuuccgcggggaggacggcugcugguacgggauggaaaucagacccguaaaggagaaggaggagaaccucguucgcagcauggucuccgccggcagcggcgaaguugacaguuucucucugggcaucuuaugugccaguaucaugauagaggaagugaugcgcucccgauggagccggaagaugcugaugacaggcacccuugcagucuuucugcuccugguaaugggacaauuaaccuggaacgaccucauccgccucuguaucauggucggcgcgaaugcauccgaccgcauggggauggggacuacauaccuggcccucauggccaccuuuaagaugagaccgauguucgccguuggccugcuguuccgucggcucaccucacgcgaggugcuccugcucaccaucggacugagucucguagccucggucgaguugcccaacagcuuggaggaacugggggacgggcucgcuaugggcaucaugaugcugaagcugcucacugaguuccagccccaccagcucuggacgacccugcuaucacuaaccuuuauuaaaaccacccuaucgcuggauuacgccuggaagaccaccgccauggcgcugucuaucgugucgcuguuccccuugugccugagcacgaccucgcaaaagaccaccuggcuaccaguccuccuuggcagcuucgggugcaagccccugaccauguuccucaucaccgaaaacaagauuuggggacggaaguccuggccucuaaaugaagggaucauggccaucggcaucgugagcauccuguuaucuagccuacugaaaaacgacgugccccuggcagggccgcugauugccggcggcaugcugaucgccugcuauguaaucagcgguucgagcgcggacuuaucucuggagaaggccgccgaggugagcugggagcaggaagcagagcauuccggcaccagccacaacaucuuaguagaaguucaggacgacggaaccaugaaaaucaaggacgaggagcgggacgacacuuuaacgauccugcugaaggccacccuccuggcagugagcggcguguaccccaugagcauucccgcuaccuuauucgucugguacuucuggcagaaaaagaagcagcgguccgggguuuugugggacacccccagcccuccagagguggaacgcgccguccuggacgauggaaucuaccggauccugcagaggggcuuacuggggcgaucccaggugggcgugggagucuuccaggacggcguguuccacacgauguggcacgugacccgcggcgcgguucugauguaccaaggcaagcggcuggagcccuccugggcguccguaaaaaaggaccuuaucucuuacggcgggggguggagguuucgcgggucuuggaacacaggggaggaggugcagguuauagcgguagagcccgggaagaaccccaagaacguccagaccacgccgggcacuuucaagacccccgaaggcgaagucggggccaucgcccuggauuucaagcccggcaccaguggcucuccgauugugaaccgcgagggcaaaaucgugggccucuacgggaacggcguugugacaaccagcggaacguacguguccgcaaucgcccaagccaaggccucacaggagggcccccuccccgagaucgaagacgaggucuucaagaaacggaaucugaccaucauggaccugcacccgggaagcggcaagacgcgccguuaccucccugccaucgugcgcgaggcuaucaaacggaagcugcgcacccugauccuagcgcccacccgugucgucgcauccgagauggcggaggcccugaagggcaugcccaucagauaccagaccacggccgucaagagugagcacacggggcgagagaucguagaccugaugugccaugcgaccuucaccaugaggcuccuaucccccguacgcgugcccaauuacaacaugaucaucauggacgaggcccacuuuacugacccugcaagcaucgcggcccggggauacaucuccacccgagucggcaugggggaagcagcagccaucuuuaugaccgccacaccgcccgggagcgucgaggccuucccgcaguccaacgcugugauccaggaugaggagcgggacaucccagagcgaagcuggaacucgggguacgauuggauaaccgacuuccccggcaagacagugugguuugucccaagcaucaaguccgggaacgacaucgccaacugcuuacgcaagaacggcaaaagagucauucagcucagcagaaaaaccuucgacaccgaguaccagaagacgaagaacaaugacugggauuacguggucacgaccgacaucucggagaugggggccaacuucagggccgaucgggugaucgacccccgccggugccuuaaacccgugauacucaaggauggcccggagcgcguaauacucgcuggccccaugcccgugacuguagccagcgcagcccagagacgcgggcgaaucgguaggaaccagaacaaggagggggaccaguacgucuacaugggucagccccuaaacaacgacgaagaccacgcccacuggaccgaggcgaagaugcuuuuggacaacaucaacacacccgaagggaucauccccgcccuuuuugagccugaacgcgagaaguccgcugcuauugacggcgaauacaggcugcgcggggaagcgcggaaaaccuucgucgagcucaugagacggggcgacuuacccguuuggcugagcuauaagguggcguccgaaggcuuccaguacagcgaucgccgguggugcuucgacggugagagaaacaaucagguguuagaagagaacauggacgucgaaaucuggaccaaggagggcgagcggaagaagcugcgcccccgguggcuggaugcccgcacauacucggacccacucgcccugcgggaguucaaggaguuugccgccgggcgccggucugucagcggagaccugauucucgagaucgggaagcuaccucagcaccugacgucucgcgcacaaaacgcgcucgauaaccuggugaugcuccauaacucagagcagggcgggaaggcguaucgccaugccauggaggagcucccugacaccaucgaaacgcuuaugcugcucgcgcugaucgccguccugacgggaggggugacccucuuuuuccuuucggggaagggccuaggcaagacuuccaucgggcuccugugcgucacugccucauccgcucugcucuggauggcuuccgucgagccccacuggaucgcggcaagcaucauccuggaguucuuucuaaugguucuccugauuccggagcccgaccgacagcggacgccccaggacaaucagcuagccuaugugguuaucggccuccuguucaugauccugacgguagccgcgaacgaaauggggcuccuggaaaccaccaaaaaggaccugggcaucgggcacguagcggccgagaaccaccagcacgcuacgaugcuugacgucgaccugaggcccgccuccgccuggaccuuguaugcggucgcgacuaccguaaucaccccuaugaugagacacacgaucgaaaacacuacugccaacauaucccugacggccaucgccaaccaggcggccauacucaugggccuggauaagggcuggcccaucuccaagauggacaucggggucccccugcuggcccugggcugcuacagccaggugaacccucucacucuaaccgccgccgugcugauguugguagcgcauuacgcuauaaucgggccgggccugcaggcgaaggcaaccagggaggcgcaaaagagaacugcggccgggaucaugaagaaucccacaguggacggaaucguggccaucgaccuggacccagucguguaugaugccaaguucgagaagcaacucgggcagauaauguugcugauccucugcacgagucaaauccugcugaugcggaccaccugggcucucugugaaagcaucacucucgcaacgggcccccugacaacccugugggaaggauccccaggaaaauucuggaauacgaccauagccgugagcauggccaacauauuucgggggucguaucuggccggggccgggcuugccuuuagcuuaaugaagucccugggcggggggcggcgugguacgggcgcacagggcgagacucuuggcgagaaguggaagcgacagcucaaccagcugucaaaaagcgaguucaacacguacaagcgcucgggaaucauggagguagacaggucggaggcaaaggaggggcugaagcgcggggagaccaccaaacaugcggugucccgggggacggcgaaacuccgcugguucguggagcggaaucuugucaagcccgagggaaaggugaucgaccuggguugcgggagagggggguggagcuacuacugcgcaggccuaaaaaaggugaccgaggucaaggguuauacgaagggaggcccugggcacgaggagccgauucccauggccaccuacggcuggaaccuggucaagcugcacuccggcaaggacguguuuuucaugcccccagaaaagugcgauacccuucucugcgacaucggcgagucaucaccgaacccgaccauagaggaaggucggacccuucgcgucuuaaagaugguggagcccuggcuccgggguaaccaguucugcauaaagauccugaacccauacaugcccagcguggucgagacccuugagcagaugcaacgcaaacauggcgggaugcucguucggaacccucugucucgaaacagcacacacgagauguacuggguguccugcggcaccgggaacaucgucagcgcugugaacaugaccucccgcaugcugcucaaccgauuuaccauggcgcaccgcaagcccacuuacgaacgggauguggacuugggcgcggguacccggcauguugccguagaaccagagguagccaaccuagacauuaucggacagcggauugagaacaucaagaacgagcacaaauccacguggcacuacgaugaggacaaccccuacaagaccugggccuaccacggguccuacgaggucaaaccuagugguucagcgagcuccaugguuaacggcgugguccgccuccugaccaagccuugggacgugauaccgauggucacgcagauagccaugacggacacuaccccguucggucagcagaggguguucaaggagaaaguggacacuaggacuccccgggcuaagagaggcaccacgcagauuauggaggugaccgccaaguggcuauggggcuuccucagcaggaacaagaaaccccgcauuugcacgcgagaggaguucaccagaaaggugcggagcaaugccgccauuggggccguauucguggaugagaaccaguggaacagugccaaagaggccguggaggacgagcgcuucugggauuuagugcaccgggagcgcgagcuccacaagcagggcaagugcgcuaccugcguauauaacaugauggggaagcgggagaaaaaguuaggggaguucggcaaggccaagggcagccgugccauaugguacauguggcugggcgcacguuuccuggaguucgaggcccucggguucaugaacgaggaccacugguucuccagagagaauaguuugucgggcguggaaggggaaggacuacauaagcucggguacaucuuacgcgacauuagcaagaucccgggaggcaacauguacgcggaugacaccgccggaugggacacaaggaucaccgaggacgaccugcagaacgaggccaagaucacggagaucauggagcccgagcacgcccuucuugcgaccaguaucuucaagcugacguaucagaacaagguaguacgcgugcagcgccccgcgaagaauggaaccgugauggacgucaucucucggcgcgaccagcguggauccggccaggugggcacauacggacucaauaccuucacuaacauggaaguccaguugauucggcagauggagagcgaggggaucuuccugcccucagagcucgaaacuccgaaccuggccgagcgcguccuagacuggcucgagaaacacggggcggagcggcucaagcgcauggccaucagcggcgacgacuguguggugaagcccaucgaugaccgguucgcgaccgcguugaccgcacucaacgacauggggaagguacgcaaggacaucccccagugggagcccuccaaaggcuggaacgacuggcagcaggucccguuuugcagccaccauuuccaccagcugaucaugaaggacggccgggagaucgucgucccuugccgcaaucaggacgaacugguaggucgggcccgcgugagccaaggagccgguuggagccuccgggagaccgcuugcuuaggcaaguccuacgcgcaaauguggcagcugauguacuuccaucgccgggaccuccgucuggccgccaacgccauauguagcgcaguccccguagacugggugcccacuagcaggacuaccugguccauucacgcccaccaccaguggaugacgacggaggacaugcugagcgucuggaaccgcgucuggauagaggagaauccguggauggaggauaagacccacgugaguagcugggaggagguccccuaccucggaaagagagaggaccaguggugcggcucccugaucggccugacggcccgggccacaugggccacgaacauccagguggcuaucaaccaggugcggcggcugaucggaaaugagaauuaccuggacuacaugaccagcaugaaacgcuucaaaaacgaguccgaccccgaaggugcccuuugguga

SEQ ID NO: 23895 - RNA, 9879 nt, Artificial Sequence
  derived and/or modified CDS sequence (opt11) from DENV-1__GU131981__SS-prME
agcgugacuaugcuucuuaugcugcuaccaaccgcccucgccuuccaccugacgacccgggguggggagccccauaugaucguuucaaagcaggagcggggcaagagccuacuauucaagaccagcgcugggguuaacaugugcaccuuaauugccauggaucuuggggagcucugcgaggacaccaugaccuacaagugcccccagauuaccgaggccgagcccgacgacguggacugcugguguaacgccaccgauacgugggucaccuacgguaccugcucacaaaccggcgaacaccgccgggacaagcgcuccguggcccuggcgccccacgugggccuugggcucgagacccggaccgagaccuggaugagcuccgaaggcgccuggaagcagauccagcgcgucgagaccugggcccugcgucaccccggguucaccgucaucgcgcuguuuuuagcgcacgccaucggcaccagcaucacccagaaggguaucaucuuuauccugcucaugcucgugacccccuccauggccaugaggugcgucggcaucggcaaccgggacuucguggaggggcugucuggcgccacguggguggacguggugcuggagcacgggucgugcgugaccaccauggccaaaaacaaacccacccucgacaucgaacugcuaaagacggaggucaccaauccggccauccuccgcaagcuguguaucgaagcuaagaucagcaacaccaccacggacucccggugcccgacccaaggggaggcgaccuugguggaggagcaggacgccaacuucgucugucgcaggacauucgucgaccgcggcugggggaauggguguggccucuuuggcaaagggagucugcugacuugcgcuaaauucaaaugcgucaccaaguuggagggcaagaucgugcaauacgagaaucugaaguacuccgucauagugaccgugcacaccggcgaccagcaccaagucgggaacgagacaaccgagcacggcaccaucgcgacuaucacgccucaggccccuacgagcgaaauacagcuaacggacuacggggcccucacauuggacugcagcccccggaccgggcuggacuucaacgagauggugcugcuaacgaugaaggagaaguccugguuggugcacaagcagugguuccucgaccugccgcugcccuggaccuccggggccucuaccagccaggagaccuggaaccgccaggaccuccuggugacguucaagacagcucacgccaagaagcaagaggugguaguguugggcucgcaggagggagccaugcacaccgccuuaaccggggccacugagauccagaccucaggcaccacuacgauuuucgccgggcaccucaagugccgccugaagauggacaagcucaccuuaaaaggcaccuccuacgugauguguacggggagcuucaaacuggagaaggagguagcggagacgcagcacggaaccgugcuuguacagguuaaauacgagggcacagacgcucccugcaagauccccuucuccacgcaggacgagaagggggucacgcagaacggccgcuuaauuacggccaacccgauugugaccgauaaggagaagcccgucaacaucgagaccgagccgcccuucggggaaaguuacaucauggugggcgccggcgaaaaggcgcugaagcugagcugguucaagaaggggagcuccaucggaaagauguucgaggccacggcgcgcggggcucgucggauggcuauccucggcgacaccgcgugggauuucgggagcaucgguggcguguucaccuccgucgggaagcuagugcaccagguauucggcacagcguacgggguguuauucagcggcguaucguggacaaugaagaucgggaucggaauccuccugaccuggcugggucuuaacagccgcuccaccagccuguccaugacgugcaucgccguggggauggucacguuauauuuaggcgugauggugcaagccgacagcgggugcgugaucaacuggaaaggccgcgagcugaaaugcgggucaggaauauuuguuaccaacgaagugcacaccuggaccgagcaauacaaguuccaagccgacagccccaaacgguugagcgcggcgauuggcaaggccugggaagagggcguuugcggcauaagguccgccacucggcucgagaacaucauguggaagcagaucagcaacgagcugaaccacauacucuuagagaacgauaugaaguucacagugguagugggugacgccaacggcauccuggcccagggaaagaagaugauccgcccccagccgauggagcacaaguacuccuggaaguccuggggcaaggcaaagaucaucggcgccgacauucaaaacaccaccuucauuauagacgggcccgacaccccggagugucccgacaaccagcgugccuggaacaucugggaaguugaggacuacggcuuugggaucuucacgaccaacaucuggcugaaauugcgcgauuccuacacccagaugugcgaccaccggcugaugucagcggcuaucaaagacuccaaggcagugcacgccgacaugggauacuggaucgagagugagaagaacgagaccuggaagcucgcucgcgcguccuucaucgaggucaagacgugcaccuggccuaaaagccacacccucugguccaacggugugcuggaaagcgagaugauaauacccaagaucuacggcggaccgaucucccagcacaacuaccgccccggguauuucacccagacggccggccccuggcacuuggggaagcucgagcuggauuucgaucuuugcgagggcaccaccguggucguggacgagcacuguggcaaucgcgggccgagccuucggaccacgaccguuacaggcaaaaucauccacgaauggugcugccgcuccugcacgcugccgccgcugcgguuccgcggcgaggauggcugcugguaugggauggagauccggcccgucaaggagaaggaggagaaccucguacgcagcaugguguccgcuggcagcggagaggucgacagcuucagccuagggauccucugcgccagcaucaugauugaggaggugaugcgcagucgguggucaagaaagaugcucaugacgggcacgcuggccguguuccugcuccuagucauggggcagcugaccuggaacgaccucauccgccugugcaucauggugggcgcaaacgccuccgaccgaauggggaugggcaccacguaccuggcccuuauggccaccuuuaagaugcggccaauguuugccgugggacugcuguuccgccggcucacaagccgcgaaguccugcugcucacuauagggcugucccuggucgcgagcguggaguugcccaacucguuagaagaacuuggcgacggguuagccauggguaucaugaugcugaagcugcugacggaguuccagccccaccagcuuuggaucaccuuacucagccugacauucauaaaaacgacucugucccucgacuacgccuggaagaccaccgccauggcucugagcaucgugucucuauucccccucugccuguccacaacgagucagaagaccacguggcucccggucuugcugggcagcuucggcugcaagcccuugaccauguuccucaucaccgagaauaagaucuggggccggaagucuuggcccuuaaacgaggggauaauggccaucggcaucgucucgauccugcucucuagucugcuuaagaaugacgugccccucgccgguccgcugaucgccggcggcaugcugauugcgugcuacgugauaagcggcuccagcgcggacuuaagucuggagaaggcagccgagguaaguugggagcaggaggccgagcauuccggaacgagccacaacauacugguggagguacaagacgacgggaccaugaagauaaaggacgaggagcgcgaugacacccuaaccauccuguugaaggccacgcuccuggcggucuccggcguguaccccaugagcauaccggcaacucuauucgugugguacuucuggcagaagaaaaagcagcgguccgguguccucugggacaccccaagcccgcccgaggucgagagggccgugcuggaugacggcauauaccggauuuuacagcggggacugcucgggcguucccaggucggcguggggguuuuccaggauggcguauuccacaccauguggcacguuacgcgcggggcgguacuaauguaccagggcaagcggcuggagcccuccugggccucggucaagaaagaccucaucagcuacggcgggggcuggcgcuuccagggguccuggaauacuggcgaggaaguccaggugaucgcuguggagcccgggaagaacccgaagaacgugcagaccaugcccggcaccuucaagacgcccgagggggaggugggagcgauagcuuuggacuuuaagcccggaaccagcggguccccgaucgucaaccgggaaggcaagaucguaggccuguaugggaacggaguggugaccacuagcggcacauacguguccgccaucgcccaggcaaaggcaagccaagaggguccccuaccggaaauagaagacgagguguucaagaagaggaaccugaccauaauggaucugcacccgggcucuggcaagacccggcguuaucugccagccaugguccgagaggcaaucaagcgaaaacugcgcacccucauucuagcccccacacgcgugguggccagcgaaauggccgaagcccugaagggcaugcccauccgcuaccagaccacggcgguaaagagcgagcacacugggagagagauuguggaucugaugugccacgcgaccuucacaaugcgccuguuaagcccggugcggguccccaacuacaacaugauuaucauggaugaggcccacuucacagacccggccagcaucgccgcgcgcggguacaucucgacccgugucgggaugggcgaggcggccgccauuuucaugacagccacgccgcccgguucuguugaggcguucccacaguccaaugcggucauccaggacgaagaacgcgacauccccgagcggaguuggaacucuggcuaugauuggaucaccgacuuccccgguaagaccgugugguucgugcccucuaucaaguccgggaacgacauagccaacugucugcgcaaaaacggcaagcgagucauucagcucagucguaagacguucgacaccgaguaccagaagacuaagaacaaugauugggacuacguugugacaacggacaucuccgagaugggugccaacuucagagcagaucgcguuauugacccccgccgcugccugaagcccgucauccugaaagacggccccgagcgggugauccucgcgggcccaaugccggucacuguugccucugccgcucagcgccguggccgcaucggacguaaccaaaacaaggagggagaccaguauguguacaugggccagccgcugaacaacgacgaggaccacgcacacuggaccgaggcgaagaugcugcucgacaacaucaacacacccgaagggauaaucccggcccuguucgagccugagcgcgagaagagugccgccauugacggcgaguaccgcuuaagaggggaggcccggaagacguucguugaguugaugcggcgcggcgacuugcccguauggcucagcuacaagguagcgagugagggcuuccaguacucagaccggagauggugcuucgacggggagcggaacaaccaggugcucgaagagaauauggacguggagaucuggaccaaggagggcgaacgcaagaaacuucgcccccguuggcuggacgcccgaaccuacucggacccgcucgcacuucgggaguucaaggaguucgccgccggacggcgcagugucucuggagaucuuauccucgagauuggcaaacuuccccagcaccugacccuccgggcgcagaacgcgcuggacaaccuagucaugcugcacaacuccgagcagggcgggaaggccuaccggcacgccauggaggagcugcccgacacuaucgagacgcucaugcugcucgcgcugaucgccguacuuacuggaggggucacacuauucuuccugagcggcaaaggccugggcaagaccucaaucggacugcugugugugacggcaucgucggcacucuuguggauggcaucaguggagccccacuggauugcggccuccauuauacuggaguucuuucucaugguucugcugaucccggagcccgaccggcaacguacgccccaggauaaccaacuggccuauguggugauaggucuauuauucaugauccucacgguugccgccaacgaaauggggcugcuggagacuacgaagaaagaccucggcaucgggcauguggcggccgaaaaucaucagcaugccaccaugcuugacguggaccugcggccugccagcgccuggacauuauacgcgguagcgaccaccgugaucacccccaugaugcgccacacgauugagaacaccacggccaacaucucccugaccgccaucgccaaccaggccgccauccuuaugggguuggauaagggcuggcccaucuccaagauggacauuggggugcccuugcuggcccucggcugcuacucgcaggucaacccucugacccuuaccgccgcggugcucaugcugguggcccauuaugccaucaucgggccaggccugcaggccaaggccacgcgggaggcgcagaagcgcaccgccgcugggauaaugaagaaccccaccgucgacggcaucguggccaucgaccucgauccaguugucuacgaugccaaguuugaaaagcagcuuggucagauuaugcuacucauccugugcacgagccagaucuuacucaugcgcacgaccugggcgcugugcgagucaauuacccuggccaccggaccguugacgacccugugggagggaucaccagggaaguucuggaacaccaccaucgcgguauccauggcuaauaucuuucguggcagcuaccuagccggcgccggguuagcauucagucuuaugaagucccugggcgggggucgccggggaaccggggcccagggggagacccucggggagaaguggaaacgacaacugaaccaauuaaguaagagcgaguucaacaccuacaagcggagcggcaucauggagguggacagaucagaggcuaaggaggggcucaagcggggcgagaccacgaagcaugcggucagccgcgggaccgccaagcugcggugguucgucgaacgcaaccuggucaagccggagggcaaggucaucgaccucgggugcggucgaggcgguugguccuacuacugcgcgggccucaagaaggugaccgaggugaagggauacacgaagggcggcccagggcacgaggagccgauccccauggcgacguacggauggaaccuggucaagcugcacagcgggaaggacguguucuucaugccgcccgagaagugcgacacucuccugugcgacaucggcgagagcagcccgaaccccaccaucgaagaggggcgcaccuuacgggugcugaagaugguagagcccuggcugcgaggcaaucaauucugcaucaagauccugaaccccuacaugccgucuguuguagagacccucgaacagaugcagcggaagcacggcgggaugcugguccgcaacccccugagccguaacuccacucacgagauguacugggugagcugcggcaccgggaacaucguguccgcagucaauaugaccucucgcauguugcugaaucgcuucaccauggcgcaccgaaagcccacguacgagcgcgacguggaccucggcgcugggacuaggcacguugccgucgagcccgagguggccaaucucgacaucaucggucagcgcaucgagaauauuaagaacgagcacaaguccaccuggcacuacgacgaggacaacccguacaagaccugggccuaucacggcagcuacgaggugaagccguccgggucagcguccagcauggugaauggcguugugcgguugcugaccaagcccugggaugucauccccauggugacccagauagccaugaccgacaccacgccguucgggcagcaacgcgucuucaaagaaaagguggacacccggacaccccgggcaaagaggggcacaacgcagaucauggaggugacagcaaaauggcuguggggcuuccuguccaggaauaagaagccccggauuugcacgcgagaggaguuuacacggaaaguccgcagcaacgcggcgaucggggcuguguucguggacgagaaccaauggaacagcgcaaaggaagccguugaagaugagcgguucugggaucuggugcacagagagcgggaguuacacaagcagggcaagugcgccacuugcguguacaacaugauggggaagcgcgagaaaaagcugggagaguucggcaaggccaagggcucccgggccaucugguacaugugguuaggcgcccgcuucuuagaguucgaggcccugggauuuaugaacgaggaccacugguucagccgggagaacucccugucuggcgucgaaggggagggccuccacaagcugggauauauccugagagacaucuccaaaaucccgggcggcaacauguacgcggacgacacagccgggugggauacacggaucaccgaggacgaccugcagaacgaggccaagauuacggagaucauggaacccgagcaugcccuucuggcaaccagcaucuuuaagcucaccuaucagaacaaaguggugcgcguccagcgacccgcgaagaacggaaccguuauggacgugaucucacggcgagaccagcgagggagcggccaggucgguaccuacggucugaacaccuucacaaacauggaggugcagcugauccgccagauggaauccgaggguaucuuucuucccagcgagcuggagaccccgaacuuagcugagagagugcucgauuggcuugagaagcacggggccgagcgccugaaacguauggccaucagcggcgaugacugcgucgugaagcccaucgacgacagauucgccacggcgcucaccgcccugaacgacaugggcaaggugagaaaggacaucccccagugggagccuagcaaaggcuggaaugauuggcagcaggucccguucugcucccaucacuuccaccagcugaucaugaaagacggccgagagaucguggugcccugucggaaccaagacgagcugguagggagagcucgcgucagccagggggccggguggucccugagagagaccgcaugccugggcaaauccuacgcgcaaauguggcagcucauguacuuccaccggcgcgaccugaggcuggccgccaaugccaucugcuccgcugugcccgucgacugggugcccaccagccguaccacguggagcauucacgcccaccaccaguggaugacuacugaggauaugcucucaguguggaaccgggucuggaucgaggagaacccguggauggaggauaagacccacgugagcucuugggaagaagugccauaccuggggaagagagaggaccaguggugcggcagccucaucggauuaacggcccgggccaccugggccaccaacauacaggucgcgauuaaucaagugcggcgccugaucgggaacgagaacuaccuugacuacaugaccaguaugaagcgguucaagaacgagagcgacccagagggcgcccucugguag

SEQ ID NO: 23896 - RNA, 9879 nt, Artificial Sequence
  derived and/or modified CDS sequence (opt11) from DENV-1__GQ868529__SS-prME
ucugugacgaugcuucucaugcuacugcccaccgcccucgccuuccaccugacgacccggggcggagaaccccacaugaucgugagcaagcaggaacggggcaagagccucuuguucaagaccucagcgggcgugaacaugugcacccugauugcaauggaccugggcgaguugugcgaggacaccaugaccuacaagugcccccaaauaacggaagccgagccagacgacgucgacugcuggugcaaugcgacugacacuugggugaccuacgggacguguagccagacuggcgaacaccggagagacaaacgguccguggcccuggcgccacaugugggacuggggcucgagacgcgcacagagaccuggaugagcuccgaaggagccuggaagcagauccagcgcgucgagacuugggcccugaggcaccccggguuuacagugaucgccuucuuccuggcgcacgcgauuggcaccagcaucacccagaaggggaucauauucauccuccucaugcuggugacccccuccauggcuaugcgcugcgucggaaucggcaacagggauuuugucgaggggcucagcggcgcgacguggguagaugucgugcuagaacacggguccugugugaccaccauggcgaagaacaagcccacccuggacaucgagcugcugaaaacggaggucaccaaccccgccauccuacgcaagcuuugcaucgaggcaaaaaucagcaauaccaccacggacagccggugcccgacccagggcgaggccacccugguggaggagcaggacgccaauuucgugugucgcagaaccuuugucgacagaggcugggggaacggcugcgggcuguuugguaaggggagccuccugacgugcgccaaguucaagugcgugacaaagcuggagggcaagaccgugcaguacgaaaaccuuaaguacuccgucaucgugaccgugcacacgggcgaccagcaccaggucgggaacgagaccaccgagcacgguaccaucgcgaccaucaccccccaggccccuaccagcgagauccaguuaaccgacuacggggccuugacccucgacuguagcccgcggacuggccuggacuucaacgagaugguacugcucacuaugaaggagaaguccuggcugguccacaagcagugguuccuggaucucccucugcccuggaccucgggggccucgaccagccaggagacauggaaccgccaggauuugcucgugaccuucaagaccgcccacgcgaaaaagcaggagguggugguucugggcucgcaggagggagccaugcacaccgcccugacgggggccaccgaaauccaaaccagcggcacuacuacaaucuuugccgggcaccucaaaugccggcugaagauggacaagcugacccuuaagggcaccuccuacgugaugugcaccgggucauucaagcuggagaaagaggucgcggagacccagcacggcaccgugcugguucagguuaaguacgagggaacugacgccccauguaagauccccuucucaacgcaagacgagaagggggugacccagaacggccgccugauuaccgccaauccuauuguuaccgacaaggaaaagcccgugaacaucgagacggaaccgcccuucggggagagcuacaucguggucggcgccggcgagaaggcgcucaagcuguccugguucaagaagggcagcucaaucggcaagauguucgaggccaccgcucgcggggcacgucggauggcgauccugggcgacaccgcgugggacuucgggucuaucggcggcgucuucaccuccguggggaagcucgugcaccaggucuuuggcacugcguacggggugcuguucagcggcguauccuggaccaugaagaucgggaucggcauccugcucacguggcuaggccugaacucacgcuccacgagccucaguaugacgugcaucgcugucgggauggugacccucuaccugggcgugaugguacaagccgacagcgggugcgugauaaacuggaagggccgcgagcucaagugcggguccggcauauucgugaccaacgagguccacaccuggaccgagcaauacaaguuucaggccgacagcccgaagcggcugagcgcagccaucggcaaggccugggaggagggggugugcgggauccgcuccgccacgcggcuggagaacaucauguggaagcagaucagcaacgaacucaaccacauccuauuggagaacgacaugaaguucacgguggucgugggggaugccaacggcauccucgcgcaggggaagaagaugauccgcccacagcccauggagcacaaguacucauggaaaucauggggcaaggccaagaucaucggagccgacauccagaacacaaccuuuaucauugacgggcccgacacgccggaaugccccgacaaccagcgggcauggaacaucugggagguggaggacuacggcuuugggaucuucaccaccaacaucuggcugaagcugcgcgacucauacacccagaugugcgaccaccggcuuaugucggcagcuaucaaggacaguaaggcagugcacgccgacaugggcuauuggaucgagagcgagaagaacgagacguggaagcuggcaagggcuuccuucaucgaggugaagaccugcacguggccgaagagccauacgcugugguccaauggcgugcucgagagcgaaaugaucauccccaagauauacgggggcccgaucucacagcacaacuaccggcccggguacuucacgcagaucgccggccccuggcaccuagggaagcuggaacucgauuuugacuuaugugaggguaccaccgucgugguggacgagcauugcggcaaccgcgggccaagccugcggaccaccaccgucaccggcaagaucauccacgaguggugcugccgcuccugcacccucccgcccuugcgguuucgcggggaggauggcugcugguacgggauggagauccggcccgugaaggagaaggaggagaacuugguacgcagcauggucuccgccggcucgggagagguagacagcuuuucccuggggauccugugcgccagcaucaugauagaggaagucaugcgaucccgcuggagccggaaaaugcugaugacgggcacgcuggccgucuuccugcugcucgugauggggcagcugaccuggaacgaccugauucgccucugcaucauggugggggcgaaugccucggaccguauggggaugggcaccacguacuuagcccugauggccaccuucaagaugcggccgauguuugcgguaggccuuuuauuccggcggcugaccagccgcgaggugcuccuucugaccaucgggcucucccugguggcguccgucgagcuccccaacucccucgaggagcuuggcgacggccuggcgauggggauuaugaugcuaaagcugcugacggaguuccagccucaccaguuguggaccacccuucugagcuuaaccuuuaucaagacgacgcugucccuggacuaugccuggaagaccaccgccauggcacuuagcaucguuucccuguucccgcugugucucagcacgaccucccagaagaccaccuggcucccgguccuucucggcagcuucgggugcaaaccccuuaccauguuccuuaucacugagaacaagaucuggggcagaaagaguuggccccucaaugaagggaucauggccaucgggauuguuagcauccuccuguccagccuccugaagaacgacgugccacuggccgggccgcucaucgcgggcggcaugcugaucgcuuguuacgucauuagcggguccagcgcggaccugucccucgagaaggccgccgaggugucgugggagcaggaggcagagcauucaggcaccagccacaacauccugguggaagugcaagacgaugggacuaugaagauuaaggacgaagagagagacgacacccugacgauccuacugaaggccacccuguuggcgguguccggcguguacccgaugucuauccccgccacccuguucgucugguacuucuggcagaagaagaagcagcgguccggggugcugugggacacuccgagcccgccugaaguagagcgcgccguccucgacgacggaaucuaccggauccugcagcgcggccugcuggggcgcucacaggugggcgucggggucuuccaggacggcguguuccacacuauguggcacgugaccaggggggccguccucauguaccaggggaagcggcuggagcccagcugggccagcgugaagaaggaccugaucuccuacggagggggcuggcgcuuccaggggaguuggaacaccggcgaggaggugcaggucaucgcgguggagcccgguaaaaacccuaagaacgugcagaccacgcccggcaccuucaagacacccgaaggcgaggucggggccaucgcccucgacuuuaagcccgguaccagcggguccccgaucgugaaccgggagggcaagaucgucgggcuguaugggaacggcgucgugacgaccucgggcacguacguguccgcgaucgcccaggcgaaagccagccaggagggcccccuaccggagaucgaggaugaagucuucaaaaagcgcaaccugaccaucauggaccugcacccggggagcggcaagacgcggcgcuaucugccugccauggugcgggaggcaaucaagcgcaaguugcggacccugauccucgcgccaacccgcgucgucgccuccgagauggccgaggcacucaagggcaugcccauacgguaccagaccacggccgugaagagcgagcacaccggacgggaaaucguggacuugaugugccacgcgacguucacaaugcgccugcucuccccgguccgagugcccaacuacaauaugauuaucauggaugaggcccacuucacggaccccgccagcaucgccgcccgcggcuacaucuccacccgggugggaaugggcgaagcugccgccaucuucaugaccgccacuccgcccgggagcgucgaggccuucccccaguccaacgcggugauccaagacgaggagagggauaucccggagcggagcuggaacuccggcuacgacuggaucacggacuuuccgggcaagaccgugugguucguacccaguaucaagucugggaacgacaucgcgaacugccugaggaagaacggcaaacgggugauccaacugagccgcaagaccuucgacaccgaguaccagaaaacgaagaacaacgacugggacuacguugucaccacggacauuuccgagaugggggccaacuuccgggccgaccgcguuaucgacccccggcgcugccucaagcccguaauucugaaggacggccccgagcgggugauccuugcggggccgaugccagugaccguggcaagcgcggcccagcgccggggccgcaucggacggaaccagaacaaggagggagaccaguacgucuacaugggacagccucucaauaacgacgaggaccacgcccacuggacggaggccaagaugcugcuggacaacaucaauacaccugaggggauaaucccggcccuauucgagccugaacgcgagaaguccgccgccaucgacggcgaguacagacugcgcggagaagcucgcaagaccuuuguggagcugaugcggcgcggcgaccuccccguuuggcugagcuacaagguggcguccgagggcuuccaguacagcgaccggcgguggugcuucgacggggagcggaacaaucagguccuggaggaaaacauggacgucgaaaucuggacuaaggagggcgagcgcaagaagcuucggccccgcuggcuagacgcccguacauacuccgacccacuggcccuccgcgaguuuaaggaauucgccgccgggcggagaagcguguccggugaccugaugcuggagaucggcaagcucccccagcaucugacacugcgcgcgcagaacgcccucgacaaccuggugaugcuucacaacucggagcagggcgggaaggcuuaccgccacgcaauggaggagcuccccgacacuaucgagacccugaugcuacucgcgcugaucgccguccuaaccgggggugugaccuuguucuuccugagcggcaagggccugggcaaaaccuccaucggucuccuaugcgugacagccagcuccgcccuguuguggauggccucagucgagccccacuggaucgcggccucaaucauccuggaauucuuccugaugguguuacugaucccggagcccgaccggcagcgcacgccccaggacaaccagcuggccuauguggucaucggccuccuguucaugauccucacgguagccgccaacgagauggggcuccuggagaccaccaagaaggaccugggcaucgggcacguggcggccgagaaccaccagcacgcgaccaugcucgacgucgaccugcggccagccagcgcuuggacucucuacgcgguggcuaccacggugaucacccccaugaugcgccacacgaucgagaacaccaccgcuaacauaaguuuaacagcuaucgccaaccaggcggccauccugaugggccuggacaaaggcuggcccaucagcaaaauggacaucggggucccccucuuagcccugggcugcuacucccaggugaauccguugacccuuaccgccgcggugcugaugcucgucgcccacuacgccaucaucggacccggucugcaggcuaaggccacacgggaggcacaaaagcgcaccgccgccggcaucaugaagaaccccaccguggacggcaucguggccaucgaccuggacccaguuguguacgacgcaaaguuugagaagcaacucggccagaucauguugcugaucuuaugcaccagccagaucuuauuaaugcgcacuaccugggcguuaugcgagagcaucacgcuggccacuggcccucugacuacccucugggagggcucccccggaaaguucuggaauacgacaauugccguguccauggccaacaucuuucggggcagcuaccuggccggggcgggacuggccuucucccucaugaagucccugggcgggggccgccguggaaccggugcucagggcgagacccuuggggaaaaguggaagcgccaguuaaaccagcuguccaaaagcgaauucaacacguauaagcggagcggcaucauggaggucgaccgcuccgaggcuaaggaggggcugaagcggggcgagacuacgaagcacgcgguuagccgcgggaccgcaaagcuacgcugguucguagagcgcaacuuggucaagcccgagggcaaagugaucgaccuggguugcggucggggagggugguccuacuacugugcuggccugaagaagguaacugaggucaagggauauacuaagggcggccuaggucacgaggaccccaucccaauggccacguacggcuggaaccuagugaagcugcucgccgggaaggacguguuuuucaugccgcccgagaagugcgauacccuguugugugacaucggcgaaagcuccccgaaccccaccaucgaggaaggacgaacguuacgggugcugaagaugguggagcccuggcugcgcggcaaccaguucuguaucaagauccucaacccguacaugccuagcgugguggagacccuggagcagaugcagcggaagcacggcgggaugcuggugcgcaacccucucucccgaaauuccacccacgagauguacuggguguccugcggcacggggaauaucguaagcgcggugaauaugacgucccgcaugcugcugaaccgguucacgauggcccaccgcaagcccaccuacgaacgugacgucgaccucggcgccggcacccggcacgucgcagucgagcccgagguggccaaccuggacauaaucgggcaacgcaucgaaaacaucaaaaacgagcacaagagcacauggcauuacgacgaagacaaccccuacaagacaugggcguaccacggcuccuacgaggugaaaccgagcgggagcgccucguccauggucaacggugugguccggcugcucaccaagcccugggacgugauccccauggucacccagaucgccaugacggacaccacccccuuugggcagcaacgcguguucaaggagaagguggacacccggacgccacgcgccaagcggggcaccacccagaucauggaggucaccgccaaauggcuguggggcuucuugagccguaacaaaaaaccccggaucugcacucgcgaagaguucacccguaaagugcgcucaaacgcggccaucggggcuguguucgucgaugagaaccaauggaacagcgcgaaggaggcgguagaagaugaacgguucugggacuuagugcaucgcgagagggagcugcacaagcaaggcaagugcgcgaccugcguauauaacaugaugggaaaacgcgagaagaaacugggggaguucggaaaggccaaggguagccgggccaucugguauauguggcucggcgcccgcuuccuggaguucgaagcgcugggguucaugaacgaggaccacugguucucacgggagaacucccucuccggcguggagggggagggccugcacaagcucggguacauccuucgagacaucuccaagauccccggcggaaauauguacgccgacgacacugccgggugggacacgcguaucacggaagacgauuugcaaaaugaggccaagaucacggagaucauggagccggagcaugcgcugcucgcgacgucgaucuucaagcugacguaucagaacaaaguggucaggguccagcgacccgccaagaacggcaccgugauggacgucauuagccggcgcgaccagcgcggguccggccaagugggaaccuacgggcugaacacguucacgaacauggaagugcagcucauccgccagauggagagcgagggcaucuuccugcccagcgagcuggagacccccaaccucgcggagcggguccuugacuggcuggagaagcacggggccgagcgacucaagcggauggcgaucagcggcgacgacugcgugguaaaaccgaucgacgaucgcuucgcgacagccuuaacggcccuuaacgacauggguaaaguccggaaggauaucccccagugggagcccuccaaaggcuggaacgacuggcagcagguccccuucugcagccaccacuuccaccagcucaucaugaaggacggccgcgagaucguggucccgugccggaaccaggaugagcugguggggcgugcccgggugucucagggcgccggguggagccugcgcgagacggcgugcuuaggcaaguccuacgcacagauguggcagcugauguacuuccaccggcgcgaccugcggcucgccgccaacgcgaucugcucggcuguccccguggacuggguccccacgagccguaccaccuggucgauccacgcucaccaccaguggaugaccacggaagauaugcugagcgucuggaaccggguguggaucgaggagaauccauggauggaagacaagacccacguguccagcugggaggaaguaccguaccuggguaaacgcgaggaccaguggugcggcagucuuaucggccuaaccgcacgcgccaccugggcgacgaacauccagguggccaucaaccaggugaggcgccugaucgggaacgagaacuaccucgacuacaugacgagcaugaaacgguucaagaacgaguccgaccccgagggcgcccuuugguga

SEQ ID NO: 23897 - RNA, 9879 nt, Artificial Sequence
  derived and/or modified CDS sequence (opt11) from DENV-1__GQ868531__SS-prME
aguguuacaaugcugcuaaugcugcugcccacugcuuuggccuuccauuugaccacccggggcggagagccccacaugauagugagcaaacaggagcggggcaagagccuuuuauucaagaccucugcuggcgugaacauguguacacugaucgccauggaucuaggagagcuuugugaagacaccaugacauacaaaugcccccaaaucacugaggcagagccugacgacguggacugcuggugcaaugcaacagauaccugggugaccuacgggaccugcagccagaccggagaacaucgccgggacaaacgcaguguggcgcuugcgccccacguuggcuuggggcucgagaccagaaccgagaccuggaugagcuccgagggcgcuuggaagcagauacagcgcguugaaaccugggcccuucgucaccccggauucaccgugauugcccuguucuuagcgcacgcgauaggcaccucaaucacccagaaggggauaaucuucauccugcugaugcuagugacucccagcauggccaugaggugcgucggcaucggaaaccgggacuucguggaggggcucagcggcgcgacguggguggaugucgugcuggagcacgguuccugcgugaccaccauggccaaaaacaagcccacgcucgacaucgagcugcugaagacggaggucacgaacccagcgauccucagaaagcuuuguaucgaggcuaagaucuccaacacaacgacggacucccggugcccaacccaaggcgaagcgacucucguagaagaacaggacgccaacuucgugugcaggaggaccuucgucgacagaggaugggggaacggcugcggccuuuucggcaagggcagccuacugacaugcgccaaguucaagugcgugaccaagcuugaaggcaagaucgugcaguacgaaaaccuaaaguauuccgucauugugaccguacacaccggcgaucagcaucaggucgggaaugaaacaacagaacacggcaccauugccaccaucacgccccaggcccccacgagcgagauacagcugacugauuacggggcacucacccuagacugcagcccccggaccgggcuggacuucaacgaaauggugcuccugacgaugaaggagaaauccuggcugguccacaaacagugguuccuugaccugccgcugccauggaccagcggggcgaguacgagccaagagacauggaacagacaggaccuccugguuaccuucaagaccgcacacgccaagaagcaagaggucgucguccugggcagucaggaaggcgcaaugcacaccgcccucaccggcgcgacagagauacagaccagcggcacuaccacgaucuucgcggggcaccuaaagugccgccugaagauggacaaauuaacccugaagggcacgagcuacguuaugugcaccgggagcuucaagcuggagaaggaggucgcggagacgcagcacggcaccguauuggugcaggucaaguacgagggcaccgacgcacccugcaaaauucccuucucaacgcaggaugaaaagggggugacgcagaacggccgccuaaucaccgccaacccuaucgugacugacaaggagaaaccggucaacaucgagacagagccgcccuucggagaaucauacaucgugguuggcgcuggcgagaaggcgcugaaacuguccugguucaagaagggcagcagcaucggcaagauguucgaggccacugcccgcggcgcccgucggauggccauccucggggacaccgcgugggauuucgggagcauaggcggcgucuucaccuccguggggaagcuggugcaccaagucuuuggcaccgccuacggagugcuguucagcggcguuuccuggacgaugaagaucggaauagggaucuuacuuacuuggcugggccucaacagccgcuccaccagcuuauccaugaccuguaucgccgucggcauggugacguuguaccuuggggugaugguccaggccgacucugggugugugauaaacuggaagggccgcgagcugaagugcggcuccggcauuuucgucaccaacgagguccacaccuggaccgagcaguacaaguuucaagccgauagcccaaagcgacugagcgcugccaucgggaaggccugggaggagggcgucugcgggauacguuccgccacccggcucgagaauauaauguggaagcagauuagcaacgagcucaaccauauucugcucgaaaacgacaugaaauucacgguggucgugggagacgccaacggcaucuuagcccaagguaagaagaugauccgcccccaaccaauggagcauaaauacuccuggaagucguggggcaaagccaagaucaucggcgccgauauccaaaacaccacuuuuauuaucgacggcccagacaccccggaaugccccgauaaccaacgggcuuggaacauaugggagguagaggacuacgguuucgggaucuucacaaccaacaucuggcugaagcuacgcgacaguuacacccagaugugcgaucaccgacuaaugagcgcggcgauaaaagauagcaaagcaguccacgcagauauggguuauuggaucgagucagagaagaacgaaacguggaagcuggcccgcgcguccuucaucgaggugaagacgugcaccuggcccaaaagccacacccuaugguccaacggcguccuugagagcgaaaugaucauaccgaaaaucuacgguggcccgauaagucaacauaacuaccggcccggguacuucacccagacugccggcccauggcaccuggggaagcucgagcuggauuucgaccugugcgagggcaccacggucgugguggacgagcacugcggcaaccgcgggccaagucucaggaccacgaccguaaccgguaagaucauccacgaauggugcugccggaguugcacccugcccccccugcguuuccggggcgaggacggcugcugguacgggauggaaauucggcccgugaaggagaaggaagagaaucugguuagaucaauggucuccgcagguuccggugaggucgacaguuucucccuggggauccugugcguaucgauuaugaucgaggaaguaaugcggucccgcuggagccggaagauguuaaugacgggaacccuggccguauuccuguuacucgugauggggcaauugaccuggaacgaucucauccgccuuugcaucaugguuggcgcaaaugcaucagaccggauggggauggguaccacguauuuagcccucauggcuacguucaagaugcggccaauguuugcgguggggcugcuguuucgccgguuaaccagucgcgagguguugcugcuaaccauaggucugucccuggucgccucuguggaguuaccuaacucccuggaggaacuuggcgaugggcucgcgaugggcaucaugaugcugaagcuguugacggaguuucaaccccaccagcuguggacgaccuugcucagcuugacguucaucaagacuacgcuguccuuagacuacgcuuggaagaccaccgcuauggcgcugagcaucgugucccuguucccuuugugccuuuccacgaccucacagaaaacgaccuggcugccggugcuccuuggcagcuucggguguaagccccugacgauguuccuaaucacagaaaacaagaucuggggccgcaaguccuggccgcucaacgaagggaucauggcuaucggcauugugagcaucuuguuauccagccucuugaagaacgauguaccucucgccggaccgcugaucgccggcggaauguugaucgccuguuacgugaucucggguuccucugcggaccucagcuuggagaaggcggccgaggugucuugggagcaagaggccgaacacuccggcaccagucacaacauacugguagaggugcaggacgacgguacgaugaagaucaaggacgaggaacgcgaugacaccuugacgauauuacugaaggccaccuuacucgcuguguccggcgucuaccccaugucgauccccgccacccuguucgucugguacuucuggcagaagaagaagcaacgguccggagugcucugggacacccccagcccaccugaggucgagcgggccgugcuggacgacggcaucuaucggauccugcagaggggccugcugggucggucccaggugggcgucggcguguuccaggauggcguguuccauacuauguggcaugucacgcgaggagcaguucugauguaccaaggcaagcguuuagagccauccugggcuuccgugaagaaggaccucaucagcuacggagguggcuggcgauuccaagggucuuggaauaccggagaggagguccagguuaucgccguugaacccgguaaaaauccuaagaacguccagacgacucccggaacuuuuaagacuccagagggcgagguaggggcgauugcacucgacuucaaacccggcaccagcggcagcccuauugugaaccgggaaggcaagaucguuggguuauacgggaacggcgucgugacaacuuccgggaccuacgucuccgccauugcccaggcuaaggcgucgcaggagggaccuuuacccgagauugaagaugagguguucaagaagcgcaauuuaaccaucauggaccugcauccgggcagcggcaagacucggcgcuaccuccccgcgaucgugcgugaagccauuaaacgcaagcugcggacccugauccucgccccgacccgcgucgucgcaucugagauggcugaggcccuuaaggggaugcccauucgcuaucagaccaccgcggucaagucagagcacacggggcgggaaauagucgaccuuaugugccacgcgacuuucacaaugaggcuguugucgccagugcgggugcccaacuauaacaugaucaucauggacgaggcgcacuucacggaucccgcgucaaucgcagccaggggcuauaucucuacucgggucggcaugggcgaggccgcggcuaucuucaugacagccacgccgcccgggagcgucgaagccuuuccccaaaguaacgccgugauccaggacgaggagagggauaucccggaacggagcuggaacuccggcuacgacuggaucacugacuuccccggaaaaacggucugguucgugccaagcaucaagucuggaaaugacaucgcgaauuguuugcgcaaaaacggcaagcgggugauccagcucucacgcaagaccuucgauaccgaguaccaaaagacgaagaacaacgacugggacuaugucgugaccaccgacaucucggagaugggggccaauuuccgggccgacagaguaaucgacccccgucggugccuuaagcccgucauccuaaaagacgggcccgagcgggugauacuagccggcccgaugcccgugaccgucgcgucugccgcccagcgccggggucgcaucgggcguaaccaaaacaaggagggagaccaguacguguacaugggucagccccuaaacaacgacgaagaccacgcgcauuggacggaggccaagaugcugcucgauaacaucaacacccccgaagggauuauaccagccuuauucgagccggagcgcgagaagucggccgcuauagacggcgaguaccgccuacguggggaggcccgcaagaccuucguagagcucaugcggcgcggcgaccuaccagugugguuaagcuacaaaguagccucagagggcuuccaguacagcgaccgccgcuggugcuuugauggugagcggaacaaccagguacuugaggagaacauggacguggagaucuggacgaaggaaggugagcgcaagaaacucaggccccgguggcuggacgcgaggacuuauuccgacccccuggccuuacgcgaguucaaggaauucgcugccgggaggcgaagcguuucaggcgacuuaauccucgagauuggcaagcugccccagcaucugacauuacgggcccagaacgcgcuagauaaucuggucaugcuacacaacagcgagcagggugggaaggcguaucgucacgccauggaagagcugcccgacacgaucgagaccuuaauguuauuagcccugauugcagugcucacgggcggcgugacccuguucuuccucagcgggaagggacugggcaagaccuccaucgggcugcugugcgucaccgccucaucagcccuccucuggauggccagcgucgagccgcauuggaucgcugcgagcaucauccuggaguucuuccucaugguucugcugaucccggaacccgacaggcagcgcacgccccaggacaaucaacucgcguacgucgugauagggcugcuguuuaugauucugacuguggccgcaaaugagauggggcuacuggagaccacuaagaaggaucuuggcaucgggcacgucgccgccgagaaccaccagcaugccaccaugcuggauguugaccugcggcccgcgagcgcuuggacguuauacgcaguggccacuaccguuaucacccccaugaugcgccacacgauugagaauaccaccgcgaacaucucccugaccgcuauugccaaccaggccgcaauccuaaugggccuagacaagggguggcccaucucaaagauggacauuggggugccucugcuagcgcuugggugcuauagccaggugaauccacuuacccugaccgccgcuguccucaugcuuguggcgcacuaugccaucauaggucccggucuacaggcaaaggccacccgcgaggcucagaaacgcacagcugcuggcauuaugaaaaaccccacgguggaugguaucguggcuaucgacuuagaccccguggucuacgacgccaaguuugagaaacaacuagggcagaucaugcugcucauccugugcacuagccaaauccugcucaugcgcacuaccugggcccucugcgagucuaucacucuggcgacagggccgcucacgacccucugggagggcagccccgggaaguucuggaacacgaccaucgccgucuccauggccaacauauuccggggcagcuaccuugcaggcgccggccucgccuucagucugaugaagucccugggcgggggccgcagagggacgggggcccagggcgagacacucggggaaaaguggaagcgccagcugaaccaauuguccaagagcgaguucaacacguauaagaggagcggcauaauggagguggacagaagcgaggcgaaggaggggcucaaacggggcgagaccaccaagcaugcagugagucgaggcaccgcgaagcuccggugguucgucgagcgaaaccuggugaagcccgagggcaaggugaucgacuugggcugcgggcggggcggguggucuuacuacugcgcuggcuugaaaaaagucacagaggucaaggguuacacgaaaggcgggcccggccaugaggagccgaucccuauggccaccuacggguggaaccuagugaaacuucacagcgggaaggacgucuucuucaugccaccugaaaagugugacacccuccucugugacauuggggagucaucuccuaacccuaccaucgaggaagggcgcacgcugcgggugcucaagauggucgagcccuggcugcguggaaaccaguucugcauuaagauacugaaccccuacaugccuagugucguggaggcccuagagcagaugcagcggaagcacggggggaugcuugugcgcaacccccucagucggaauuccacccacgagauguacugggucucaugugggacagggaacauaguuagcgccgugaacaugaccagccgcaugcuguugaaccgguucacgauggcgcauagaaagccuaccuacgagcgggacgucgaccugggcgcaggcacccggcacguggcggucgagcccgagguugcgaaccucgauauuauaggccaacgcauagaaaacauaaagaaugagcacaagaguaccuggcacuacgacgaggacaauccguacaagacgugggcguaccacgguagcuaugaggugaagccauccgguagcgcaucgagcaugguuaacggcgucgugcgcuuacucaccaagccuugggaugucauccccauggugacucagaucgcaaugaccgauacaaccccguucgggcagcagcgcguguuuaaggagaaggucgauacacggacgccacgggcgaagcgggguacgacgcagaucauggaggucaccgcuaaguggcucuggggcuuccugucacgcaauaagaagccacggauuugcacccgagaggaguucacgcggaagguccgcucuaacgccgcgaucggggccgucuucguggacgagaaccaguggaauucggccaaggaggccguggaagacgagcgguuuugggaccugguucaccgcgagcgggagcuacauaaacagggcaaaugcgccaccugcguguacaauaugauggguaagcgcgagaagaaacugggcgaguuugggaaagccaagggcucaagagccaucugguacaugugguugggcgcgcgcuucuuggaguucgaggccuuaggguucaugaaugaggaccauugguucagccgggagaacucucugagcggagucgagggggaggggcuucacaaauuggguuacauccugcgcgacaucaguaagaucccgggcggcaacauguacgccgacgacacugccgggugggauaccagaaucacggaggacgacuugcagaacgaggccaagauaaccgagaucauggaacccgagcacgcacugcuggcaaccagcaucuuuaaguuaaccuaucagaauaaggugguucgcguucagcgccccgcgaagaacggcacggucauggacgucauuucccggcgcgaucagagggggagcggccaggucggcacguacgggcugaacacauuuacgaacauggagguacaacugaucaggcagauggaguccgaggggaucuuucucccaagugaguuagagacgccuaaccuggccgagcgggugcucgacuggcuagaaaagcacggggccgaacgcuuaaagagaauggccaucuccggcgacgauugcguggucaagcccaucgacgaccgauuugccaccgcgcucaccgcacugaacgacaugggaaaggugcgcaaggacaucccacagugggagcccagcaagggcuggaacgacuggcagcaagugccguucugcucccaccacuuccaccagcugaucaugaaggacgggcgugaaauagucguuccuugccggaaccaagacgagcucgugggacgcgccagggugagccagggggccggguggagucugcgcgagacggccugucugggcaaaagcuacgcccagauguggcagcuaauguauuuucaccgacgagaucuucgguuggccgccaacgccauauccagcgcagugcccgucgacugggucccuacgucccgcacuaccuggucaauccacgcccaccaccaguggaugacaaccgaggacaugcucagcguguggaaccggguguggauugaggagaacccguggauggaagacaagacucacgucucuagcugggaggagguuccguaccuggguaaacgcgaggaccagugguguggaucccuaauuggccuaacggcccgcgccacuugggccaccaacauccagguggcgaucaaucaaguacggcgccugauagguaacgagaauuaccucgauuacaugacaucuaugaagcgguucaagaacgaguccgaucccgaaggcgcacucugguga

SEQ ID NO: 23898 - RNA, 9879 nt, Artificial Sequence
  derived and/or modified CDS sequence (opt11) from DENV-1__GU131983__SS-prME
ucagugaccaugcugcucauguugcugcccaccgcccucgcauuccaccuaaccacccgggguggggagccccacaugauagugagcaagcaggagcguggcaagagccuccuguucaaaacgagcgcgggcgugaacaugugcacacugauugccauggacuugggggagcuaugcgaggacacuaugaccuacaagugcccccagauuaccgaggcagagcccgacgacguggacugcuggugcaacgccaccgacacaugggugaccuacgguaccugcagucagacuggcgagcaucgccgggacaagcgcucgguugcauuggcgccccacguggggcuugggcucgagacgcggaccgagaccuggaugagcucggagggcgccuggaagcagauacagcgcguggagaccugggcgcugaggcaccccggguucacggugauagcccuuuuccucgcgcacgccaucggcaccagcaucacacagaaggggaucaucuucauccugcugaugcucguuaccccuuccauggccaugcgcugugucggcaucgguaaccgggacuucguggaggggcucagcggcgccacguggguggacgucgugcuggaacacggauccugcguaacaaccauggccaaaaacaagcccacacucgauaucgaacugcugaagacggaggucacaaaccccgcaauccucagaaagcugugcaucgaggcaaagaucagcaauaccacaacggauucgagaugcccgacacagggcgaggccacccugguggaggagcaggacgccaacuucgugugccgccggaccuucgucgaccguggcugggggaaugggugcggccucuucggcaaggggagccugcugacgugcgccaaguucaagugcguaacuaaacucgagggcaagaucgugcaguacgagaaccugaaauauuccgucaucgugaccgugcacaccggcgaccaacaccaagucgggaacgagacgaccgagcacgguaccaucgcgaccauaacgccccaggccccgacgagcgagauccaacugaccgacuacggggcccucacccuggacugcagcccccggaccggcuuggacuucaacgagaugguguuacugacgaugaaggaaaaguccuggcugguacacaaacagugguuucucgaucugccgcugccauggaccuccggggcaagcaccagccaagagacauggaaccggcaggaccucuuggugacguuuaagaccgcgcacgcgaagaagcaggaggugguggugcugggcucccaggaaggcgccaugcacaccgcucucaccggggccacggagauacagaccagcggaaccaccacgaucuuugccgggcaccugaagugccggcugaagauggacaagcucacccuaaaggguaccuccuaugugaugugcaccgggagcuucaagcuggagaaggaggucgcggagacgcaacacggcacagugcuggugcaggucaaguacgagggcaccgacgcccccugcaagauccccuucucgacucaagacgagaagggggucacgcagaaugguaggcucauaaccgccaacccgaucgugacggauaaggagaagcccguaaacaucgagaccgaaccgcccuucggcgagagcuacaucguggugggcgccggcgagaaggcccucaagcugucuugguucaaaaagggaagcuccaucgggaagauguucgaagccacggcccgaggggcgcgcaggauggccauccucggcgacaccgcgugggacuucggaucgaucggcggggucuucaccuccguggggaagcuggugcaccaggucuuuggcaccgccuacggggugcuguucagcggcgucucuuggacgaugaagaucgggaucggcauccucuuaaccuggcuuggccucaacagccgcuccaccagccuguccaugacuugcaucgccgucgggauggugacgcuguaccucggcgucaugguccaggccgacagcgggugcgugaucaacuggaaggggagagagcugaaaugcggguccggcaucuucgugaccaacgagguccacaccuggaccgagcaauacaaguuccaggccgacagcccgaagcgguugagcgcggcuaucggaaaggcaugggaggagggggugugcggcauucguucggccacgaggcuugagaacaucauguggaagcagauaagcaacgagcugaaccacaucuuacuggagaacgacaugaaguucacgguggucgugggcgacgccaacggaauccuggcgcaggggaagaagaugauccgcccacagcccauggagcacaaguacuccuggaaguccuggggcaaggccaagaucaucggugccgacauccagaacaccaccuucaucaucgaugggcccgacaccccggagugccccgacaaccagcgggccuggaacauaugggagguugaggacuauggcuuuggaaucuucacgaccaacaucuggcugaagcuccgcgacuccuacacccagaugugcgaccaccgucugaugagcgcggccaucaaggacuccaaggcuguccacgccgacauggguuauuggaucgagucugagaagaacgaaaccuggaagcuggcccgugcguccuucaucgaaguaaaaacgugcaccuggcccaaaagccacacccuaugguccaauggcguccuggagagcgagaugaucauccccaagaucuacgggggcccuaucucccaacacaauuacagacccggguacuuuacccagacugccggacccuggcacuuagggaagcucgagcuggacuucgaccuuugugagggcaccaccgucgugguggacgagcacugugguaaccgcgggccgagucuucggaccacgaccgucaccgguaagaucauccaugaguggugcugccgcuccugcacccugccgccucugcgguuccggggggaggacgguugcugguacgggauggagauccggcccgugaaggagaaggaggagaaccucgugcggagcauggucuccgccggaagcggcgagguggacagcuucucacuggggauucugugcgccagcauuaugaucgaggaggugaugcggucccgcuggagccggaaaaugcucaugauuggcacgcuggccgucuuccugcuccucguaauggggcagcugacauggaacgaucucauccgccuaugcaucauggugggggcgaacgccuccgaccgcauggggaugggcaccaccuaccuggcccucauggccacguucaagaugcggccgauguucgccgucggccuccuguuccgccguuuaaccucacgcgaggugcugcugcucacgaucgggcugucccugguggcgagcgucgagcugcccaacucccuggaggaacugggugacggccucgccaugggcauuaugaugcucaagcuccucaccgaguuccagccccaccaacuguggaccacccugcucagccugaccuucaucaagaccacguuaucccucgacuacgccuggaaaaccaccgcuauggcucucagcaucgugucccucuucccccucugccugagcaccacgucccagaagacuaccuggcugccgguccuccugggcucguucggaugcaaaccccugacaauguuucucauuacagagaauaaaauuuggggacggaaguccuggccccugaacgagggcaucauggccaucggcaucgugagcauccuguuauccucucugcugaagaacgacgugccgcucgcagggccgcugaucgccggcggcaugcugaucgccugcuacguaaucagcgggaguucugcggaccucagccuagagaaggccgccgaggugagcugggagcaagaggccgagcauuccggaacgagccacaacauccugguagagguccaggacgacgggaccaugaagaucaaggacgaagagcgcgacgacacacucaccauccuucugaaggcaacgcuccuggcgguguccggcguuuaccccaugagcauccccgccaccuuguucgucugguacuucuggcagaagaagaagcagcgguccggcguucucugggauacccccagcccgcccgagguggaacgcgcuguccuggacgacggcaucuaccgaauccuucagcguggccuacucgggcgaucgcaggugggaguaggggucuuccaggacggcgucuuccacaccauguggcacgugacgaggggggccguacugauguaccagggcaagcggcuagagcccagcugggcauccgugaaaaaggaccucaucagcuacggagggggcuggcgcuuccaggggucuuggaacaccggggaagaagugcaggucaucgcgguggagcccgggaagaaccccaagaacgugcagaccacucccggcacguucaagacccccgaaggcgaggucggggcaaucgcccuggacuuuaagcccggcaccagcggguccccgaucgucaaccgggagggcaagaucgugggccuguacggcaacggcgucgugaccacgagcgggaccuacguauccgcaaucgcccaggcgaaggccucccaggaggguccccuccccgagaucgaagacgagguuuucaagaagaggaaccugaccauaauggaccugcauccugggagcggcaaaacccggcgauacuuacccgcuauuguacgggaggccauaaagcgcaagcugcgaacgcugaucuuagcgcccacacgcguugucgccuccgagauggccgaggcccugaagggcaugcccauccgcuaccagacuaccgcagucaagagcgagcacacggggcgggagaucguggaccugaugugccacgcaaccuucaccaugcgccuucuaucuccaguccgggugcccaacuacaacaugaucaucauggacgaggcccacuucaccgaccccgccagcaucgccgcccgcgguuacaucuccaccaggguggggaugggcgaggcggccgccaucuucaugaccgccacgccgcccgggagcgucgaagcuuucccccaguccaaugcggucauacaggacgaggagcgcgacauccccgagcgcagcuggaacuccggguacgacuggaucaccgacuucccgggcaagacggugugguuuguccccagcaucaaguccgggaacgacaucgccaacugccugcgcaagaacgggaaacggguuauucagcucagccgcaaaacuuucgacaccgaguaccagaagaccaaaaacaacgacugggacuauguggugacgaccgacaucuccgagaugggugccaacuuccgggccgaccgcgugaucgaccccagacgcugccugaagcccgugauccugaaagacgguccggagcgggucauccucgcagggccaaugccugugaccguggccagcgccgcccagcgccggggccggaucggucgcaaccagaacaaggagggggaccaauacgucuacaugggccagccuuuaaauaacgacgaggaccaugcacacuggacggaggccaagaugcugcucgauaacaucaacacccccgaggggaucaucccagcccuguucgagcccgagcgcgagaagucggcugccauagacggcgaguaccgccugcguggcgaggcccgaaagaccuuuguggagcucaugcgucgcggcgaucugcccguauggcugagcuauaaagucgcgucagagggcuuccaguacagcgaccggcgcugguguuucgacggggagcggaauaaccagguacucgaggagaacauggaugucgagaucuggaccaaggagggcgagcgcaagaaguuacggccccgguggcuugacgcccggaccuacuccgauccuuuggcccugcgcgaauucaaagaguucgcugccgggcggcgcucgguguccggcgaccugauccucgagaucgggaagcugccccagcaccugacccuccgugcgcagaacgcuuuggacaaccuggugaugcuccauaacagcgagcagggcgggaaggccuaccgccacgccauggaagaguuaccagacacuauagagacccugaugcuccuggcgcugaucgcgguccuaacggggggcgugacccuguucuuccugagcgguaagggccucggcaagacaucaaucgggcugcugugcgugacggccuccuccgccuuacuguggauggccagcguggagccccacuggaucgcggccuccaucauacuggaguucuuccuuauggugcugcugaucccggagccagaccggcagcgcacuccccaggacaaccaacucgccuacguggucaucggccugcuguucaugauccucaccguggccgccaacgagauggggcuguuggagacgaccaagaaggaccucggcaucgggcacguggcggccgagaaccaccagcacgcaaccaugcuggacgucgaccugcggccggccagcgccuggacccucuaugcuguggcuacgaccgugauuaccccaaugaugagacacaccauagagaacacgacugccaauaucucccugacugccaucgccaaccaggcggccaucuugauggggcuugacaagggcuggcccaucagcaaaauggacaucggggucccccugcuggcccucggcugcuacucccagguuaacccgcugacucucacggccgcgguucucaugcuagucgcccacuacgcuaucaucgggcccggccugcaagccaaagcaacucgggaagcgcagaagcgcaccgcagccgggaucaugaagaaccccaccguagaugguaucguggcaaucgaccucgaccccgugguguacgacgccaaguuugaaaagcaacugggccagaucaugcuccucauccuguguacgagccagauccugcucaugcgcaccacaugggcgcucugugaguccaucacccuggccacggggccucucaccacccugugggagggcucgcccgggaaguucuggaacacgacgaucgccguguccauggccaacaucuuccggggcucauaccuggccggcgcggggcucgccuucucccucaugaaaucccugggcgggggccgccggggcacgggcgcccagggcgagacccuaggggagaaguggaagcgccagcugaaccaacuuuccaagagcgaguucaacaccuacaagcggagcggcaucauggaggucgaccgcuccgaagccaaagaaggacucaagcggggugagacaaccaagcacgcggugagccgagggaccgccaagcugcggugguucguggagagaaaccuagucaagcccgagggcaagguaaucgaccugggcugugggcgggguggauggucguacuacugcgcuggccucaagaagguaaccgaggucaagggguacaccaagggcgggcccggccaugaggagccgaucccuauggccacguacggcuggaaccucgugaagcuccacucaggaaaggacguguucuucaugccgcccgagaagugcgacacccucuugugcgacaucggcgaguccagcccgaaccccacgaucgaggaggggcgcacgcugcgcguccucaagaugguggagcccuggcugagggggaaucaguucugcaucaagauccuaaaccccuacaugccguccguugucgagacgcucgagcaaaugcagcguaagcacggcggcaugcuggugcgcaacccccugagcaggaacuccacccaugagauguacugggugagcuguggcaccgggaauaucgucagcgccgugaacaugaccagccgaaugcuacugaaccgguuuacgauggcgcaccgcaagcccacuuacgagcgcgacguggaccugggcgccggcacccggcacguagccguggagcccgagguugccaacuuggacauaaucgggcagcggaucgagaacaucaagaacgaacacaaguccaccuggcauuacgacgaggacaacccguacaagacgugggccuaccacggcagcuacgagguaaagcccuccgggagcgcguccagcauggugaauggcgugguucggcugcugaccaagccaugggacgugauccccauggucacccagaucgccaugaccgacacgaccccguucgggcagcaacgcguguucaaggagaagguagacacccggacgcccagggccaagcggggcacgacucaaaucauggaggucaccgccaaguggcucuggggcuuccuuucccgcaacaagaagccccggauaugcacgcgcgaggaauuuacgcggaaggugcgcagcaacgccgcgaucggggccguguucgucgaugagaaccaguggaacagcgccaaggaggcaguggaggacgagcgguucugggaccuagugcaccgcgagcgggagcuacacaagcagggaaagugugcgaccugcgucuacaauaugauggggaagcgcgagaagaagcugggcgaguucgggaaggccaagggcagucgggcuaucugguacauguggcugggcgcccgcuuccucgaauucgaggcccugggguuuaugaaugaggaccacugguucagccgugaaaacucgcuaagcggcguggaaggggagggccuccacaaacuuggguacauccugcgagacauuuccaagaucccggguggcaacauguacgcggacgacacggccgggugggauaccaggauaacggaggacgacuugcaaaacgaggccaagauuacggagaucauggagcccgagcacgcccugcuugccaccucaaucuucaagcucaccuaccagaacaaggugguccgcgugcagcgccccgcgaagaacggaacggucauggacgucaucagucgacgcgaccaacgagggagcggccagguggguaccuacggccugaacaccuucaccaacauggaggugcaguuaauacgccagauggaguccgaagagaucuuccuccccagcgaguuagaaacgccgaaccuggccgagcggguccucgacuggcuggagaagcacggcgccgagcgcuuaaagcggauggccauuuccggggacgauugcguggugaagcccauugacgaccgcuucgccaccgcgcucaccgcuuugaacgauauggguaagguccggaaggacaucccccagugggagcccaguaagggguggaacgacuggcagcaggucccguucuguucacaccacuuccaccaguugaucaugaaggacggacgcgagaucgucgucccaugccgcaaccaggacgaacucgugggccgcgcccggguaagccagggggccggcuggucccugcgagagacagcaugccuuggcaaaagcuacgcgcagauguggcaacucauguacuuucaccggagagaccugcgucuggccgcaaacgcgaucugcuccgcgguccccguggacugggugccuacgagccgcacaacuuggucaauucacgcccaccaccaauggaugaccaccgaggacauguuguccgucuggaaccggguguggauagaagagaacccguggauggaggacaagacgcacguaagcucgugggaggagguccccuaucugggcaagcgcgaggaccaguggugcgggagucuaaucggccucaccgcgcgcgccacaugggccaccaacauacagguggcgauaaaccagguccggcgccucaucggcaacgaaaacuaccuggacuacaugaccuccaugaagagguucaagaacgagagcgaccccgagggggcccucugguga

SEQ ID NO: 23899 - RNA, 9879 nt, Artificial Sequence
  derived and/or modified CDS sequence (opt11) from DENV-1__GQ868532__SS-prME
agcgugaccaugcuccucaugcugcugccaaccgcccuggcauuccaccugacgacccggggcggggagccacauaugaucguaagcaagcaagagagggguaagagcuuacuguucaagaccucagcgggggugaauaugugcacccucaucgccauggaccuaggggagcucugcgaagacacgaugacuuauaagugcccccagaucaccgaagcagagcccgaugauguagacugcuggugcaaugccaccgacacaugggucacauacgggacaugcagccaaaccggcgagcaccgccgggauaagagauccguggcgcucgccccucacgucggguuggggcuggagacucggaccgagaccuggaugagcuccgagggcgcauggaagcaaauccagcguguugagacuugggcccugcggcacccgggguucacggugaucgcccuguuucucgcgcacgccaucgggaccagcaucacgcagaaggggaucaucuucauucuucugaugcucguuacccccuccauggcgaugcgcugcgucggcaucgggaaccgggacuuuguggaaggguuaaguggcgcaaccugggucgacgucguguuagagcacggcaguugcguaaccaccauggccaaaaauaagccuacguuggacaucgaauuacuuaagacagaggucaccaacccggcgaucuugcgcaagcuguguauugaagcuaagauaagcaauaccaccacugacagccgcugccccacgcagggcgaggcgaccuuaguagaggagcaggacgcgaacuucgugugucgccggaccuucgucgacagggguugggguaacgggugcggccuguucggaaaagggucacuacuaacgugcgccaaguucaagugcguuacuaaacuugagggcaagaucgugcaguacgagaaccuaaaauauagugucauagugaccgugcacaccggggaccagcaccaagucgggaacgaaacgacggagcacggcaccauagcgaccaucacgccccaggcacccaccagcgagauccagcuaaccgacuauggagcccucacccucgauugcagcccaagaaccggccuggauuucaacgagaugguccugcugacgaugaaggaaaagucuuggcuggugcauaagcaaugguuccucgaucugccgcugcccuggacgagcggcgcuagcacaucccaggaaacguggaaccgccaagaccugcuggugacauuuaagacugcccacgcuaagaagcaggagguuguuguccuggguucucaggagggagccaugcauacugcccuuacgggggccacagagauccagaccuccgggacgaccacgaucuucgccggucaccuaaagugccgguugaagauggacaagcucacacuuaagggaacgagcuaugugaugugcaccgggagcuucaaacuugagaaagaaguggcggagacgcagcacggcacagugcugguccaggucaaguaugaaggcaccgaugccccguguaagaucccguucucgacccaggacgagaagggggugacgcaaaacgggcgacucauuacggccaacccuaucgugaccgacaaggagaagccggugaacaucgaaacggagccaccauucggggagagcuauaucgucgugggcgccggggagaaagcccugaagcuguccugguucaagaaggggucauccaucggcaagauguucgaggcaaccgccagaggggcgagacggauggccauccucggcgauacggcgugggacuuugggagcaucggcggcgucuucaccucaguggguaagcucguucaucaggucuucggcaccgccuacggggugcuuuucuccggcguuuccuggacgaugaaaaucgggaucggcauccuacugacuuggcuuggucuaaauucacgcucgaccagccugucgaugaccugcaucgcagucgggauggugacgcuguaccucggagugaugguccaggcugauagcgguugugugauuaacuggaagggccgcgaguugaaaugugggaguggcauuuucgugaccaacgagguccauacguggaccgaacaguacaaauuccaggcagacucgccgaagcggcugagugcggccaucggaaaggccugggaagagggcguuugcggcaucagaagugcgacccggcucgagaacaucauguggaagcagaucuccaacgagcugaaccacauacugcucgagaacgacaugaaguucacuguggucguuggugacgcaaacggcauccuggcacaggggaagaagaugauccgcccacagcccauggaacacaaguacucauggaaguccugggguaaagcaaagaucaucggcgccgacauccaaaacacuacguucauuaucgauggccccgauacgccggagugcccggacaaucaacgagcuuggaacaucugggaagucgaggacuacggcuuugguaucuucacgaccaacaucuggcuaaaguugcgugacuccuauacucaaaugugcgaccaccgacugaugagcgcggccaucaaggauuccaaggccguucacgccgacaugggcuacuggaucgagucagagaaaaacgagaccuggaaauuggccagagcuuccuucauagaggugaagacuuguaccuggccuaagagccacacccucuggaguaacggcguguuggagagugagaugauuauccccaagauauacggcggcccgauuucacagcacaauuaccggcccggauacuucacccagacggcggggcccuggcaccuggggaaacucgaacuagauuucgacuuaugcgaagggacaacuguaguaguggaugagcacugcggcaaccgcgguccaagccuuaggacuacgacgguaaccggcaagaucauccacgaguggugcugccgcuccugcacccucccgcccuugcgauuucgaggcgaggacggcugcugguacgggauggagauccggcccgugaaagaaaaagaggagaaccuugugagaagcaugguguccgcaggaagcggugaagucgacaguuuuucuuuagggauccugugugccuccauaaugaucgaagaggugaugcggucccguuggucgcggaaaauguugaugacuggaacacuggcggucuuccuucuccuggugauggggcagcugaccuggaacgaccucauucgcuuauguaucauggugggcgcuaaugcguccgaccgcauggguaugggcaccacguaucuagcacuaauggccaccuucaaaaugagaccgauguucgcggucgggcuccuguuccgucggcuaaccagucgcgaggugcuguugcucaccauuggucuaagucuaguggcaagcguugagcucccgaacucgcuggaggagcuuggcgacgggcuggccaugggcaucaugaugcucaagcugcucacggaguuccagccccaucagcuauggaucacccugcucagcuuaacuuuuauaaagaccacguuaucccucgauuaugccuggaagaccaccgccauggcgcugucuaucgugucccuguucccccuaugccugucgacuacgucacagaagacuaccuggcuaccgguacuuuuaggcagcuucggauguaagccuuugaccauguuccuuaucacggagaacaagaucuggggacggaagucauggccucucaacgaggggaucauggccaucgggauagugucaauccuguuauccucgcugcuaaagaacgacgugccucucgcugggccccucauugccggagguaugcugauagccuguuacgugauuuccggaaauuccgcggaccuaagccuagaaaaggccgcagaaguguccugggagcaggaggccgaacauagcggcacgagccacaacauucugguggaaguccaagacgaugguacaaugaaaaucaaggaugaagaacgcgacgacacgcucacgauccuguuaaaggcuacucuacuugcggugagcggaguguacccgauguccauaccagcgaccuuguucgucugguauuuuuggcagaaaaagaagcagcgcagcgggguucugugggauaccccuuccccaccggaaguggagcgggccguacuugacgacgggauuuaccgaaucuugcagcgcggccugcucgggcguagccagguugggguagggguguuccaggacgguguguuccacacuauguggcacguuacuagaggggccguucugauguaccagggcaagcggcuugaacccuccugggcgucggucaagaaggacuuaaucaguuauggcggcggcuggcgcuuccaggggucguggaauaccggagaggagguucaggucaucgccguagagccagguaagaacccgaagaacguacagacaaugcccggaacguucaagacccccgaaggcgaggucggggccaucgcccuggauuucaagcccgggaccucagggucuccgaucgugaaucgggagggcaaaaucguaggccuauaugggaacggcguggugaccaccuccgggacauacgucagcgccaucgcccaggcaaaggccucccaggaagggccgccgcccgagauugaggacgaagucuuuaagaagcgcaaucugaccaucauggaccuccauccaggcuccggcaagacucguagguaucuacccgccauggugcgagaagcgaucaagcgaaaacuccggacucugauccuggcgccaacgcgcguggucgcuagcgagauggcagaggcgcucaaggguaugccaauccgcuaccagaccacggcaguaaagucugagcacaccgggcgggaaaucguggaccugaugugccacgcgaccuucaccaugcgccugcugagccccgucagggugcccaacuacaacaugauaauuauggacgaggcccacuuuacagaccccgccucgaucgccgcucgcggguacaucucaacccggguggggaugggcgaggcggcugcaaucuuuaugaccgcgacaccacccgguuccguugaggccuucccccagucuaaugcagugauccaagacgaggaacgcgacaucccugaacggucuuggaacucuggcuacgacuggaucaccgacuucccgggcaagaccguaugguucguucccuccaucaagagcgggaaugauaucgccaauugccugcgcaagaauggcaagcgcguuauccagcugucccgaaaaacauuugauaccgaauaccaaaagaccaagaacaaugauugggacuauguggugaccacggauaucagcgagaugggggccaacuuucgagccgaccguguaaucgauccacggagaugccuuaaaccugugaucuuaaaggacggacccgagcgggucauccucgcgggacccaugcccgugacaguugccucggccgcacagcgacggggccguaucggccgaaaucaaaacaaggagggggaccaguacgucuacaugggccagcccuuaaacaacgaugaagaucacgcgcacuggacugaggcgaagaugcugcuggacaauauuaacacgccggaggggaucauccccgcccucuucgagcccgagcgggagaagagugccgccauagacggcgaauacaggcuaagaggggaggcccguaaaacguucguggagcucaugcggagaggagaccuccccguuugguuguccuacaagguggcaucggagggcuuccaguauucggaccggcgcugguguuucgacggcgaacggaacaaccagguucucgaggagaauauggacguugagaucuggacuaaggagggggagcguaagaaacuccggccgagguggcuggacgcucguaccuauagugauccgcuagcccuccgggaguuuaaggaguucgccgccggcagacguagcgugagcggcgaccuaauucuggaaaucggaaagcucccgcagcaccugacccugcgggcgcaaaacgcccucgauaacuuaguuaugcugcacaacuccgagcagggagggaaggcauaccgccaugccauggaggaacuccccgacacaaucgagacgcugaugcuguugacguuaaucgcgguccugaccgggggcgugacccuguucuucuuguccgggaaaggucugggcaagaccagcauaggauugcucugcgugaccgccuccucugcacugcuuuggauggccucaguggaaccucauuggaucgcugcgagcauaauucuggaauuuuucuugauggugcuccugauccccgagcccgaccggcagagaaccccgcaagacaaccagcuggccuacgugguaauuggacuacuguucaugauccugacaguagccgccaacgagaugggacuccuggaaacgaccaagaaggaccuuggcaucgggcacguggccgcggagaaccaccaacaugccacaaugcucgaugucgauuugagacccgccuccgcauggacacucuacgcaguggcgacgaccguaaucacacccaugaugcgucacaccauugagaacacgaccgccaacauuagccucaccgccaucgccaaccaggcagcgauacuaauggggcuggacaagggcuggccaaucuccaagauggacaucggggucccgcugcuagcccugggguguuacagucaggucaacccccucacucucaccgcggcgguccuaaugcucguggcucacuacgcuaucaucgggcccggccugcaggcuaaggcuacacgggaagcgcagaagcgcaccgcggccgggaucaugaagaaccccacaguggacggcaucguggccaucgacuuagacccgguuguauacgacgccaaguucgagaagcaguugggccagaucauguugcuuauucugugcacgagccagaucuuacugaugcgcaccacgugggccuugugugagucuaucacccuggcaacggggccuuuaacaacgcucugggagggcucccccgggaaauucuggaacaccacaaucgcugugucaauggccaacaucuucagaggcagcuaucuugccggcgcagggcuggcguucagccucaugaagucacuaggugggggccggcgggguaccggagcacagggcgaaaccuugggagagaaguggaagcgccagcucaaucaacugagcaagagugaguucaacacguacaaacgcucugguaucauggaggucgacaggagcgaggccaaggaagggcucaaaagaggcgaaacgacuaagcacgcugugucccgcgggaccgcuaagcuacggugguucguggagcgcaaucuggugaagccugagggcaagguuauagacuugggaugcgggcggggcggcuggagcuacuacugugccggccugaagaaagugacggaaguaaagggcuacaccaaaggagggccgggacacgaggagcccaucccuauggccacguacggcuggaaccuugucaagcugcacuccgggaaggacguauucuucaugcccccagagaaaugcgacacccugcucugcgauaucggggaaagcucccccaaccccaccauagaggagggucgcacccuacggguccugaagaugguggagcccuggcuccgaggcaaucaguucugcaucaagauccugaacccauacaugcccaacguggucgagacgcuggaacaaaugcagcggaagcacggcgggaugcucguacguaacccucugucucggaacuccacccacgagauguacugggucuccugcggcaccgggaacaucgucuccgcagucaacaugaccucgcggauguugcucaaucguuucacuauggcccaccgcaagccaaccuacgagcgcgacguggaucugggcgcgggcaccaggcaugucgccguggagccagagguggcuaaucuggacaucaucgggcagcgcaucgagaauaucaagaacgagcacaaguccaccuggcacuaugaugaggacaaucccuacaagacgugggcguaccacgguagcuacgaggucaagccguccgggucggccucaaguauggugaauggagugguccgacuguuaaccaaaccuugggacgguauaccaaugguaacccagaucgcgaugaccgauaccaccccuuucgggcagcagcgcgucuucaaggaaaagguagacacgcggacaccgcgagccaaacggggaacaacucagaucauggagguaaccgcaaaguggcuguggggguucuuaucccgcaacaagaagccgcggaucuguacccgcgaggaguuuacgcgcaaggugcgcucgaacgcagccaucggagcaguguucguggaugagaaccaauggaacuccgccaaggaggccguugaggacgagcgguucugggaccuggugcaccgcgaacgggagcugcacaagcagggaaagugcgcaacuugcguguacaacaugaugggcaaacgcgaaaagaagcugggggaguucggcaaggcgaagggcucgcgggccaucugguacauguggcugggggcacgcuuuuuggaauuugaggcccucggauucaugaacgaggaccacugguuuucaagagaaaacaguuuguccggcgucgagggcgaagggcuacacaaacugggcuacauucugagggacauauccaaaaucccaggagggaacauguacgccgacgacacugccggcugggacacccggaucaccgaagacgaccugcagaacgaggccaagauuacugaaaucauggagcccgagcacgcccugcuugccaccagcaucuuuaagcucacguaccaaaacaagguggugaggguucagcgccccgcgaagaacgggacggugauggacgugauaucacgccgcgaccagcgggggucgggccagguugggacguacggucucaacaccuucacuaacauggaggugcagcugauucgucagauggaaucagaggggaucuuccugccaucugagcucgagacucccaaccuggcggagcggguucuggacuggcucgagaagcacggugcggaacgccuuaagcggauggcaaucucuggugacgacugcgucguuaaacccauugaugaccgauucgcaaccgcgcucaccgcgcucaaugacaugggcaaggugaggaaggacauaccccagugggagccaagcaaaggcuggaacgacuggcagcaaguccccuucugcucucaccauuuccaucagcucaucaugaaggacggucgcgagaucguagugcccugccggaaccaggacgaacugguuggcagagcacggguaagccaaggagcaggcuggucccuccgcgagaccgccugcuugggaaaauccuaugcccagauguggcaguuaauguacuuccaccggcgcgaucuacggcuugcggcuaacgcuauaugcuccgccguacccgucgauugggugccuaccagccggacgaccuggagcauccacgcucaccaccaauggaugaccacugaggauaugcugaguguguggaaucgggucuggauugaagagaauccuuggauggaggauaagacgcacgugagcuccugggaagaggugccauaccuuggaaagagggaggaccaaugguguggcagccugauagggcugaccgcacgcgcuacaugggcuacuaacauucagguggccaucaaucaggugcggcgccucaucgguaacgagaacuacuuggauuacaugacuuccaugaagcgguucaaaaaugagucugaccccgagggggcccugugguga

SEQ ID NO: 23900 - RNA, 9879 nt, Artificial Sequence
  derived and/or modified CDS sequence (opt11) from DENV-1__GQ868533__SS-prME
agcguuacaaugcuguugaugcugcugccaaccgcccucgcauuccaccugaccacccgagguggggaaccgcacaugaucgugucaaaacaggagcgugggaagagccugcucuucaagaccuccgccggggucaacauguguacacucaucgccauggaccugggcgagcugugugaggacacuaugacauauaagugcccccagauaaccgaggccgagccugacgacgucgacugcuggugcaacgccaccgacaccugggugaccuacgguacgugcucgcagaccggcgagcacagacgggacaagcgcuccguagcucuggcgccccaugugggccugggucuugagacgcggaccgaaaccuggaugagcuccgagggugcuuggaagcagauucagcgcguggagaccugggcccuccgacauccuggcuucacgguuaucgcccuguuccuagcccacgcgauagggaccuccauaacccagaaaggaauaaucuucauacugcugaugcucgugaccccauccauggccaugaggugcgucggcaucggcaaucgggacuucguggaggggcugagcggagccacguggguugacgucguauuagaacaugggaguugugucacaacaauggcgaagaacaagcccacccucgacauagaguuacucaagacagaagucacaaaucccgcgauacuucgcaagcuuugcauugaggccaagaucucuaacacgaccacggacuccaggugcccgacccagggcgaggcuacccuuguugaagagcaggaugccaacuucgugugccgccgcacuuuuguagaccgcggcugggggaacgggugcgggcucuucggcaaggggagccuauugacuugcgccaaguucaagugcgucacuaagcuagagggcaagaucgugcaguacgagaaccugaaauacucugucauugugacuguccacacaggcgaccagcaccaggucggaaacgagacuaccgagcauggaaccaucgcuaccaucacgccccaggccccuacgucugagauccagcugacggauuacggggcacucacgcuugauugcucaccacggaccggccuggacuuuaacgagaugguccuccugacgaugaaggagaaauccuggcugguucacaagcaaugguuucucgaccugccgcugcccuggaccuccggggccagcaccagccaagagacguggaaccgccaggacuuguugguuaccuucaagacagcccacgccaaaaagcaggagguggucguucuggggucccaagagggcgcgaugcauaccgcccucaccggggccacagagauccagaccucgggcaccacuacgauuuucgcuggucaccugaagugccgacugaagauggacaagcucacguuaaaaggcaccuccuacgugaugugcaccgggaguuucaagcuggagaaggaggucgcggagacgcagcauggcaccgugcuggugcagguuaaguacgaaggcacagaugcccccuguaagauccccuucucuacacaggaugaaaaaggagugacgcaaaacggccgccucaucacggcaaaucccauagugaccgacaaggagaagcccgucaacaucgagaccgaaccgccuuuuggggaaagcuacaucgucgugggcgccggagagaaggcucugaaauuguccugguuuaagaagggaagcaguaucggcaaaauguucgaggccacggcccgcggggcccgccggauggccauccucggcgauacggccugggacuucgggagcaucggcggcgucuucaccuccgucgggaagcuggugcaccaggucuucggcaccgcuuacggggugcuguucagcggcguguccuggacaaugaagaucgguaucggcauccuccuaaccuggcucggccucaacagccgguccaccagccuuuccaugacuugcaucgcgguugggauggugacgcuguaccucggcgugaugguccaggcagacucggggugcgucaucaacuggaagggucgagagcugaagugcggguccggcaucuucgugaccaaugagguacacacauggaccgaacaguacaaguuccaggccgauagcccgaagaggcuguccgcggcgaucggcaaggccugggaggaaggggucugcgggaucagaucagccacucggcucgagaauaucauguggaagcaaauaagcaacgagcugaaccacauccuacucgagaaugacaugaaguucacgguagucguaggggacgccaaugguauccuggcgcaagggaagaaaaugauccguccccaacccauggagcacaaguacuccuggaaauccugggguaaagccaaaauaaucgaagcagacauccagaauaccaccuucaucaucgacggcccggacacccccgagugcccugacaaccagagagcauggaacaucugggagguagaggacuauggguucggaaucuuuacgacgaacaucuggcugaaacucagggacuccuacacucagaugugcgaccaucggcucaugagcgccgcgaucaaggauuccaaggccguccaugccgauaugggguauuggauagagucugagaagaacgagaccuggaagcuugcccgcgcgagcuuuaucgaggugaagacgugcaccuggcccaaaagccacacccucugguccaauggcgugcuggaaagcgagaugaucauccccaagauauauggcggcccaauaagccaacacaacuaccggcccggcuacuucacucaaacugccgggcccuggcacuugggcaagcuugaguuggacuucgaccuaugugaggggaccacuguggugguggacgagcacugcgguaacagagggccaagucuccgcaccacgacaguuacgggaaagaucauccacgaguggugcugccgcucaugcacgcucccgccucuucgguuccgcggagaagacgggugcugguauggcauggagauccggcccgugaaagaaaaggaggagaaccucgugcgcagcauggucuccgccgggagcggcgagguugauagcuucucucugggaauccugugugccagcauuaugaucgaggaggugaugcgaagucgauggucacggaagaugcucaugacggggaccuuagccgucuuucuucuccuggugaugggccaacuuaccuggaacgaccucauccggcugugcaucauggugggggcgaacgccuccgaccgcaugggcauggggaccaccuaucuggcccucauggccaccuucaaaaugagaccgauguucgcuguugggcugcuguuccgccggcucacgagccgagaggugcuacugcucacaaucggccugucucuaguagccagcgucgagcuuccgaacucuuuggaagagcucggggacggccucgccauggggaucaugaugcugaagcugcucacagaauuucagccccaccaauuauggaccacauuacugucacugaccuuuaucaaaacgacccugucccucgacuacgccuggaaaaccacugccauggcgcugagcaucgugucccuguuuccucucugccugagcacgacgucccaaaagacgaccuggcugccaguccuccugggcagcuuuggcugcaagcccuugaccauguuccucaucacugagaacaagaucugggggcggaaguccuggccacugaaugagggcaucauggcgaucgggauugugagcauccuccucuccagccugcugaagaacgacgugccacucgcgggcccacucaucgccggcgggaugcugaucgccuguuacgucauuagcggcuccagugcagaucucagucuggagaaagcagccgaagucagcugggaacaggaggccgagcacagugguaccagccacaacaucuuaguugaaguccaagacgacggcacaaugaagaucaaggaugaggagagggacgauacucucacgauccugcugaaggcuacgcuccuugcgguguccgggguguaccccaugaguaucccugccacccuuuuccucugguacuuuuggcagaagaagaagcaacgguccggaguccuaugggacacccccagcccgcccgagguugagcgcgccguacuugacgaugggaucuaccggaucuugcaacgcggccuccugggcaggucgcaggugggagugggcgucuuucaggauggggucuuucacacgauguggcacgucacacgcggcgccgugcugauguaucaggggaagcggcuugagcccagcugggcauccgucaagaaggaccugaucucuuacggagggggauggagauuucagggcuccuggaauaccggggaggagguccagguaaucgcggucgaaccuggcaagaauccaaagaacguacagaccacgcccgguaccuuuaagaccccagaaggcgaagugggcgcaauugcccuggacuucaagccgggaaccagcgguaguccgaucguaaacagagaggguaaaaucguuggacucuauggcaacgggguggugaccacuaguggcaccuacguguccgcgaucgcccaagcgaaagcgagccaggaggggccucuccccgaaaucgaagaugagguguucaagaagcgcaacuuaacuaucauggaccuccacccggggagcgggaagacgcggagauaccugcccgccaucguacgcgaagcaaucaaaagaaagcuccggacguuaauccuugcgcccacccgcguuguggccuccgagauggccgaggcccugaaaggcaugcccauccgguaucagacgacggccguaaagucugagcacaccggccgggagaucguagaccucaugugucacgcgaccuucaccaugcgacugcuguccccggugcggguaccuaacuauaacaugaucauuauggacgaggcucacuuuacggaucccgcgucaaucgcugcccgaggguacaucucuacgcguguuggcaugggggaagcggcggccauauucaugacagcuacgccgcccggcagcgucgaggcguucccgcaguccaacgcuguaauccaagacgaagagcgcgacaucccugagcggagcuggaacuccggguacgauuggaucacggacuuccccggcaagaccgugugguucgugcccucuauaaagagcgggaacgacauugccaauugucuccggaagaacgggaagcguguaauccaacuaagccgcaaaacuuuugacaccgaguaucagaagacuaagaacaaugacugggacuacguggugaccaccgacaucuccgaaaugggagccaacuuccgggccgaucguguaauugacccccgccgcugccugaagcccgugauccucaaggacggacccgaacgggugaucuuggcuggcccgaugcccguaacaguggcaagcgccgcccagcgaagggggcggaucggccggaaccagaauaaggagggggaccaguacguguacaugggccaaccgcuaaauaacgaugaggaccaugcccacuggacggaggcgaagaugcuacuggacaacauaaacacccccgagggaaucauccccgcucuguucgagccagaaagggaaaagucggcggccauugacggggaguaccgccuucggggcgaggccaggaagaccuucguugagcugaugcggagaggagaccuacccguaugguuaagcuacaaggucgcauccgagggcuuccaauacagugaccguaggugguguuucgacggugagcguaacaaccaggugcuagaggagaacauggacguggagaucuggaccaaggagggggagagaaagaagcugcggccccgcuggcucgacgcccguaccuacuccgacccguuagcccugcgcgaguucaaggaguucgcggccgguaggcgaagugugagcggugacuuaauccuugagaucggcaagcugccccagcaccucacaucucgugcucagaacgcccuugacaauuuaguuaugcuccacaacagcgagcaggggggcaaggccuaccgccacgccauggaagaacugcccgacaccauugagacccugaugcuccuagcgcugaucgccgugcucaccggcggcgucacgcucuucuucuuguccggcaagggacuagguaagacuagcaucggcuuacugugcgugacugcguccagcgcccuacuguggauggccuccguagagccacacuggauugcggcgagcaucauccuggaguucuuuuuaaugguacugcugauaccagagcccgaccgccagcgcacgccccaggacaaccagcuggcuuacguaguaaucgggcuucuguucaugauccucaccgucgccgccaacgagaugggacuccuggagaccacgaagaaggaccuugggaucggccacguggcugcagagaaccaccagcacgccaccaugcucgaugucgacuugaggccugcuucugccuggacgcucuacgcggucgcaaccaccgugaucacgcccaugaugcgccacacgaucgagaacaccaccgccaacauaucccugaccgcuauagccaaccaggcggccauccugaugggccuugacaagggcuggccaauuuccaagauggacaucggcgugccccugcuagcgcuugguugcuauucucaagucaacccacuuacuuugaccgcggcgguccuaaugcugguggcccacuacgccaucaucgguccggggcugcaggcaaaggcaacuagggaagcgcaaaagcggacugcagccgggauaaugaagaaucccacgguggaugggaucguggccauagaccucgaccccguggucuaugaugccaaguucgagaagcaacuggggcagaucaugcugcucauccugugcacuucccaaauuuuacucaugcgcacuacuugggcacugugugagucgaucacgcucgcuacagggccgcucaccacucugugggaagguaguccaggcaaauucuggaacacgacaaucgcagugucgauggcgaacauauuccgcggcuccuaccuggccggcgcgggccucgccuucagccugaugaagucccucgguggaggacgccgggggacuggggcccaaggcgagacccucggagaaaaguggaagcgccaguuaaaccagcugagcaaaucagaauuuaauacguacaaacgguccgguaucauggagguggacaggucugaggccaaggagggucucaaacguggggagaccaccaagcacgcgguuagucgcggcacagcgaaacucaggugguucgucgaaagaaaucugguaaagcccgagggaaaggucauagaccugggguguggacgcggcgguuggagcuacuacugcgccgggcugaagaaaguuaccgaggugaaaggguacacaaagggcgguccuggccacgaggaaccuaucccgauggcgacauauggauggaaccuggcaaaacuacacuccggcaaggacguauucuucaugccucccgagaagugcgacacccuccuaugcgauaucggggagagcaguccgaacccgacgauagaagagggccgcacgcugagaguguugaagaugguggagccgugguugcgggggaaucaguucugcaucaaaauccugaacccauacaugccgagcguaguggagacccucgagcagaugcagcgaaaacacggcggcaugcugguccgcaacccgcuaucucgaaacagcacccaugagauguacugggucuccugcgguaccggcaacaucgugagcgcagugaacaugacguccaggaugcuccucaaucgguuuaccauggcccauagaaagcccaccuacgagcgcgacgucgaccuaggugccggcacccggcacguggccguggaacccgagguugcgaaccuugacaucauaggccagcgaauugaaaacaucaagaacgagcacaagucgacguggcauuacgacgaagauaauccguacaaaaccugggcauaucacggguccuacgaggucaagagcaguggcagcgcaagcucaauggugaacggagucgugcggcuguuaacgaagcccugggaugucauuccuaugguaacucaaaucgcaaugacggacaccaccccguucggccagcaacgaguguucaaggagaagguugacacccggacgccgcgcgcaaagcgagggaccacccagaucauggaggucacagcuaaguggcucuggggcuuccucucacgcaacaagaagccccggaucugcacgcgcgaggaauucacucggaaagugagaucaaacgcugcaaucggugccguguuuguggacgagaaccaguggaacagcgccaaggaggcggucgaggacgagcgguucugggaccugguccauagggagcgggagcuccauaagcagggaaagugcgcuaccugcguguacaacaugauggguaagcgcgagaaaaaauuaggggaguucggaaaggcaaaggggucccgggccauuugguacauguggcuuggcgcgagauuccuugaguucgaggcucugggcuucaugaacgaggaccacugguucagucgggagaacucccugucagggguggaaggcgaggggcuccacaaacugggcuacauucugcgggacauuucuaaaauccccgggggcaacauguacgcggacgacacggccggcugggacacucguauaaccgaggacgaccuccagaacgaggccaagaucaccgagaucauggagccggagcaugcccugcuggccacaagcaucuucaaguuaacauaccagaacaagguugugaggguccagcgccccgcaaaaaacgggacagucauggacguaauuucccggcgcgaucagagagguagcggccaaguggguacuuacggacugaacaccuucaccaacauggagguccagcucauccgccagauggaguccgaagggaucuuccuucccagcgagcuagaaacccccaaccuggcggaaaggguacucgauuggcuggagaaacacggugccgagaggcuuaagcggauggccauuuccggggacgauugcgugguuaagccgauugacgaccgguucgcgacugcccucacugcccugaaugacaugggcaaaguccggaaagacaucccacaaugggagcccucaaagggguggaaugauuggcagcagguccccuucugcucccaccacuuccaccagcuuaucaugaaggacggccgcgagauagucguuccaugcagaaaccaagaugagcuggugggccgcgcucgggucagccaaggggcgggguggucccugcgagagacugcgugccuuggcaagagcuacgcccagauguggcagcuuauguacuuccaccggcgggaccuucggcuggccgccaacgcgaucugcagcgcaguaccaguggacuggguccccacgucccgcacaaccugguccauccacgcccaccaccaguggaugacgaccgaggacauguugucagucuggaacagaguguggaucgaggagaaucccuggauggaagacaagacgcacgucuccaguugggaggaagugccguaucugggcaaacgggaggaccaguggugcggcagccugauaggccucaccgcacgcgccaccugggcaacgaacauccagguggccauaaaccaggugaggcgacugaucggcaacgagaacuaucuggauuauaugacauccaugaaacgcuucaagaaugagucugacccggaaggggcccucugguga

SEQ ID NO: 23901 - RNA, 9879 nt, Artificial Sequence
  derived and/or modified CDS sequence (opt11) from DENV-1__GQ868534__SS-prME
agcgucacgaugcugcucaugcuucugcccaccgcauuggccuuccaccuaaccacccggggcggggaaccgcacaugauugugagcaagcaagagcggggcaagucacuacuguucaagaccagugccggagugaacaugugcacccugauagcuauggacuuaggcgaacucugugaagauacaaugacguacaaauguccccagaucaccgaggccgagcccgacgacguggauuguuggugcaaugcuaccgacacguggguuaccuacgguacuuguagccagaccggcgaacaccgccgggacaaacgcucaguggcccucgcgccccaugucggccugggucuagaaacacggaccgaaacguggaugagcucugagggcgccuggaagcagauucagcgcgucgagaccugggcccugcggcaccccggguucaccguaaucgcucuguuccucgcgcacgcuaucgguacaucgaucacgcagaaagggauaaucuuuauacucuugaugcuugugacccccuccauggccaugcggugcgucggcaucgggaaucgggacuucguggaagggcuaucaggagccacguggguggacgucguacuugagcaugggucgugcgugaccaccauggcgaagaacaagcccacacucgauaucgaacugcugaaaacagagguaacaaacccagcuauccugcgaaagcugugcaucgaggccaagaucagcaacaccacuacugacucccguugccccacgcaaggcgaggccacccuaguggaggagcaagacgccaacuuugugugucggcggaccuucguagaccgcggcuggggcaauggcuguggacucuucggcaaggggagccuucucaccugcgccaaguuuaagugcgucaccaagcuugaaggcaagauaguccaauaugagaaccugaaauauucaguaaucgugaccgugcauaccggcgaccaacaccagguagggaacgagaccaccgaacacggcaccaucgcaacaaucaccccucaggcacccacgucggagauacagcugaccgacuauggugccuugacucuggacuguucuccuagaacuggucuggauuucaacgagauggugcugcugacaaugaaggagaaguccuggcugguucacaagcagugguuccuagaccugccgcuucccuggacuagcggcgccagcaccagucaggagacauggaaccggcaggaccuucuagugacuuucaagacugcucacgcgaagaaacaggagguagucgugcugggcagccaggagggcgccaugcacaccgcccucaccggggcgacggagauccagaccucaggaaccacaacgauauucgccgggcaccugaagugucgucugaagauggauaaguugacacugaagggcaccuccuacgugauguguaccggcagcuucaaacuggagaaagagguugcggagacccaacacggcaccguuuuggugcaggucaaguacgaggggacggacgcccccugcaagaucccuuuuaguacccaggacgagaaaggggucacgcaaaacggucgucucaucaccgcgaacccgaucgugacggacaaagaaaagccggucaauauagagaccgagccaccauucggggagagcuacauaguggugggcgccggcgagaaggcuuuaaagcugucuugguuuaagaaggggagcuccaucggcaaaauguucgaggcuacggcccgcggggcccgaagaauggccauacucggcgacaccgcgugggauuucgguagcaucggcgguguauucacaagugugggaaagcuggugcaccaggucuuuggcaccgccuacgguguucuuuucagcgguguguccuggacgaugaagaucgggauaggcaucuugcucacauggcuggggcucaauucccgguccacuagccugucuaugaccugcaucgccgucgguaugguaacgcuguaccucggcgucaugguccaggccgacagugggugugugaucaacuggaagggcagagagcuaaagugugguucuggaaucuucgugaccaacgagguccacaccuggacggagcaguacaaauuccaagcggacagcccgaagagacuuucugcagcaaucggcaaggcgugggaggaggggguauguggcauucgcuccgccacccggcucgagaacaucauguggaagcagauaucuaaugagcucaaccacauccugcucgagaaugacaugaaguucacgguggucgucggggacgcaaacgguauacuggcccagggcaagaagaugauccgaccccaaccuauggaacacaaguacucauggaaaagcugggggaaggccaaaaucaucggcgcagacauccagaacaccacauuuauaaucgacgggcccgauacccccgagugccccgauaaccaacgggcauggaauaucugggagguagaagauuacggcuucgggaucuucacgacaaauaucugguuaaagcuccgcgacucauacacccagaugugcgaccaucggcugaugagcgcggcaauaaaggacuccaaggccguccacgccgacauggguuacuggaucgaaucggagaagaacgagacguggaaacuggcccgggcguccuucauugaagugaaaacgugcaccuggccaaagagccauacccucugguccaacggcguacuggagagcgagaugaucauucccaagaucuacggggguccgaucucucagcacaauuacagacccggguacuucacccagacggccgguccauggcaccuggggaaguuagagcuggacuucgaccugugugagggcaccacggucgugguggacgagcacugcggaaaccgcgggccgagucuccguaccacgacuguaaccggcaagauaauccacgaauggugcugccgcuccugcacccucccgccucugagguuccgcggggaggacggcugcugguacgggauggagauccggcccgugaaagagaaggaagagaaccuugugcgcagcauggucagugccggcagcggagagguggacucuuucagucuggggauccugugcgugagcaucaugaucgaggaggucaugagaagccgcuggucccggaagaugcuaaugacgggcacccuggccguguuccuacuacuggugaugggucagcugaccuggaacgacuuaauccgccuguguaucauggugggcgccaacgcguccgaucguauggggaugggcaccaccuaccuggcccucauggccaccuuuaagaugcgaccgauguucgcugugggguuguuauuccgcagguugaccagccgcgaggugcuacuguuaacgauaggccugucacuugucgccagcguggaguuaccgaacucgcuggaggaacugggcgacggcuuagccaugggcauuaugaugcugaagcuacucacggaguuucagccacaccaacuguggacgacgcugcuaagccugaccuucaucaagacgacgcugagccucgacuaugccuggaaaaccaccgcaauggcccugagcauagucucacuguucccacucugccugaguacgaccagucaaaagaccaccuggcuacccgugcuccuuggcucauucgggugcaagccacucacgauguucuuaauaacggaaaacaagauauggggccgcaaguccuggccuuuaaacgaggggaucauggcgauuggcaucgugagcauucugcucuccucacuucugaaaaacgaugucccccucgccgggccgcugaucgccggcggcaugcugaucgccugcuacgugaucagcgggaguucugccgaccucucccuugaaaaggcggcggaggugagcugggagcaggaggccgagcacagcggcacaucgcacaauaucuugguugaggugcaagacgacgggaccaugaagaucaaggacgaagaacgggaugacacguugacgauccuucucaaggccacccugcuggccguguccggcgucuauccaaugucaaucccagccacccucuucgugugguacuucuggcagaaaaagaagcagcgauccgggguucucugggauacucccucgccgccugagguggagagagccgugcuugacgauggcaucuaucgcauccuucagcggggcuugcuagggcggucccagguaggcgucgggguauuccaggacgguguauuccacacgauguggcacgucacgcgcggggccguccuaauguaccagggcaagcgucuggagcccagcugggccuccgucaaaaaggaucucauaagcuauggcggggguuggcguuuucagggguccuggaacacgggagaggaaguccagguuaucgcgguggagccgggaaaaaacccgaagaacguccagacgacgccgggcaccuuuaagaccccggaaggcgaaguaggcgcgaucgccuuggacuucaagccgggcaccagcggcaguccaauugugaacagggaggguaagauagucggacuguacgguaacggaguagugacaaccagcgggaccuaugucuccgccaucgcccaggcaaaggcaucucaggagggaccucuccccgaaaucgaggacgagguguucaagaaacgcaaccugaccaucauggaccugcacccugggucaggcaaaacgcggcguuaucucccugcgaucgugcgggaggcaauaaagagaaaacugcggaccuuaauauuagcaccuacccgcgucgucgcguccgagauggccgaggcgcugaagggcaugcccauccgauaccagaccacggcuguuaaauccgagcacacuggucgggagaucguagaccugaugugccacgccaccuucaccaugcgucuccugagcccgguacgagugcccaacuacaacaugaucaucauggacgaggcccacuuuacggauccagccagcaucgcugcccgcggcuacaucuccacccgggucggaaugggugaggcugcugcgaucuucaugaccgccacgcccccugggagcguagaggccuucccacaaaguaacgcggugauccaggacgaggagcgcgacauccccgagcgaagcuggaacuccggguacgacuggauuacugacuuccccgggaagaccgugugguuuguccccaguaucaaguccgggaacgauauagcgaacugccugcgcaagaacggcaagcggguuauucagcucagccgcaagaccuuugacaccgaauaccaaaagacgaagaacaaugacugggacuacgugguuaccaccgacaucucugagaugggggccaauuuccgcgccgaccgcgugaucgacccccggcgcugccugaagccaguuauccucaaggacggacccgagcgcgugauccucgccgguccgaugcccgugacugucgcgagcgcugcccagcgaagagggcgcauuggccggaaucagaacaaagaaggggaucaguauguguacaugggccagccucugaacaacgacgaggaccacgcacauuggacggaggccaagauguuacucgacaacaucaacacacccgaggggauuaucccggcgcuguucgagccagagagagaaaagaacgccgcgaucgauggagaauaucgauuacguggcgaggcucgcaagaccuucgucgaacucaugcgucgcggcgaucugcccguguggcuaucauacaaggucgccagcgagggauuccaguacagugaccggcgaugguguuucgacggggagcggaacaaccagguccucgaggaaaacauggauguggagaucuggaccaaagagggcgagcgcaagaagcugcggccccgcuggcucgacgcucggacguacuccgacccacucgccuuaagagaguuuaaagaguuugcggccgggcgccguuccgugucuggcgaccuaauuuuagagaucggcaaacugccccagcaucucacucugcgggcucaaaacgccuuagauaaccuagucaugcuccacaacagugagcagggugggaaagccuaccgccacgccauggaagagcugccggacaccaucgagacacugaugcucuuggccuuaaucgcgguguugaccgggggcguuacgcucuuuuucuugucggggaagggucucggcaaaaccucaaucggucugcugugugugacggccuccagcgcccuccuguggauggccucuguugagccccacuggaucgcggcgaguauuauucucgaguucuucuugauggugcugcugauuccggagccagaccggcaacgcacuccccaggauaaccaguuggccuacgucgugaucggccuacuguucaugauccuuacgguggccgccaacgagaugggacugcuggagacuaccaagaaggaccugggcaucgggcauguugccgccgagaaccaccagcacgcuaccaugcucgauguggacuuaagaccggccucugccuggacgcuguacgcaguggcgaccaccguuaucacccccaugaugcgccacacgaucgagaauacaacugccaauauuagccuaacggccaucgcgaaccaggccgcgauccugaugggccuggauaagggcuggccuaucaguaagauggacaucggggugccacugcuugcucuaggcugcuacagccagguaaacccacugacacugaccgccgccguccucaugcugguugcgcauuacgcgaucaucgggcccggucugcaggcuaaggccacaagggaggcccagaagcgcaccgcggcaggaauuaugaagaaccccacgguggacggcauagucgcaauugaucucgaccccgugguauacgacgcaaaguucgagaagcagcuaggccaaauuaugcugcucaucuugugcacaucacagauucuguugaugcgaaccacaugggcccugugcgaauccaucacccuggccacggggccacuaaccacacuuugggagggaagccccgggaaguucuggaacacuaccauugccgucaguauggcuaacauuuuccggggauccuaccuggccggcgccgggcucgcguucagccucaugaagucccugggugguggcaggcgggggaccggcgcccagggagaaacacucggggagaaguggaagcgacagcugaaccagcucagcaaguccgaguucaacacguacaagcggaguggcauuauggaggucgaccgcucggaggccaaggaggggcucaagcggggcgaaacuaccaaacacgccgugucgcgcgggaccgcuaaguuacggugguuuguugagcgcaaucuggugaaacccgagggcaaggugaucgaccugggcugcggucggggcggguggagcuauuauugcgccgggcucaagaaagugaccgaggugaagggguacacaaagggcggaccagggcacgaggaaccgauccccauggcaaccuacgguuggaaccuugugaaguuacacuccgguaaggacguuuucuucaucccucccgagaagugugacacccuacugugcgacaucggcgagagcuccccgaauccgacgaucgaagaggggcguacgcuacggguccuuaagaugguagagcccuggcuucgcgguaaccaauucugcaucaagaucuugaaccccuauaugccaucugucguggaggcgcucgagcaaaugcagaggaagcacggagggaugcuugucagaaacccauuaucgcggaacucgacccaugaaauguacugggucuccuguggaaccgguaacaucgugagcgccgugaauaugaccucuagaaugcuacugaaccguuucacgauggcacaccgcaagcccacguacgaacgcgacguagaucucggugccggcacccggcacguggcuguggagcccgaagucgccaauuuagauauuaucgggcagcgcaucgagaacauaaagaaugagcacaaaucuaccuggcacuacgacgaggauaacccauacaagacgugggcguaccaugguuccuacgaggucaagcccagcggguccgcaagcuccauggugaacggcgucgugcgucugcugacaaagccaugggacgucauccccauggugacccagauugccaugaccgacacgaccccuuucgggcaacaacgcguguucaaggagaaagucgacacacgaaccccccgagccaagagaggcacgacccagauaauggaggugacugccaaauggcucuggggcuuucugagccgcaauaagaagccccggaucugcacccgcgaggaauucacccggaaggucaggucaaacgccgcgaucggggccguauucguagacgagaaccaguggaacagcgccaaggaggccguggaggacgaacgguucugggacuuagugcaccgcgagcgggaguugcauaagcaagggaagugcgcgacaugcguguacaauaugauggggaaacgugagaagaaacugggcgaguucgggaaggccaaggguagcagggccaucugguacauguggcugggcgcccguuuccuagaguucgaggcccugggguucaugaacgaggaucacugguuuucccgggagaacagccuuuccgguguggaaggggagggucuccacaagcugggguauauccugagggacauuagcaagauaccgggaggcaacauguacgcggaugacaccgccggcugggacacccgaaucacggaggaugauuuacagaaugaggccaagaucaccgagauaauggaacccgagcacgcacugcuagccaccuccauauucaaguugacguaccagaauaaggucgugcggguccagcgccccgccaagaacggcacggucauggacguaauaucccggcgugaccagcgggggaguggccaagugggaacuuacggucucaauaccuucaccaacauggaaguccaacugauucgccagauggaaagugaaggcauauuucuacccucugaacuggagacgccgaaccuggcagagcgggccuuggacugguuagaaaagcacggggccgaaagacuuaagcggauggccaucuccggcgacgauugcguugucaagcccaucgacgaucgcuucgcgacugcccugaccgcccugaacgacauggggaaggucagaaaggacaucccccagugggaacccuccaagggguggaacgacuggcagcaggucccguucugcagccaccacuuccaccagcugaucaugaaggauggccgcgagauagugguccccugucggaaccaggacgagcucguggggcgcgcccgggugucccaaggggccggguggagcuugcgcgagaccgcuugccugggcaaauccuaugcacagauguggcaacucauguacuuccaccgucgcgaccugcgcuuagccgcaaaugcgaucugcagcgccgucccaguggacugggugcccaccaguagaacgaccuggagcauccacgcacaccaccaguggaugaccacagaggacaugcucagcgucuggaaccggguauggauugaagagaaccccuggauggaggauaagacgcauguaucaagcugggaggagguccccuaucuaggcaaacgcgaggaccaauggugugggucucugaucggacuuacagccagagccaccugggcaaccaacauucaaguggccauaaaccagguucggcgccugaucgguaacgagaacuaucuggauuacaugacguccaugaagcgguucaaaaaugaguccgaucccgagggagcgcucugguga

SEQ ID NO: 23902 - RNA, 9879 nt, Artificial Sequence
  derived and/or modified CDS sequence (opt11) from DENV-1__GQ868535__SS-prME
agcgucacgaugcugcucauguugcugcccacggcccuugccuuccaucugacaacccggggcggggagccucauaugauagucuccaagcaagaacgaggcaagagccuuuuauucaagacaagcgcgggggugaauaugugcacccugaucgcgauggaccugggugaacuuugcgaggacaccaugaccuacaaguguccucagaucaccgaggccgagcccgacgacguggacugcugguguaacgccaccgacaccugggucaccuacgggaccugcagccagacgggcgagcacagacgggacaagcgcucaguggcacuggcgccccacgugggacuggggcucgaaacccggacugagaccuggaugagcuccgagggcgccuggaaacagauccagcgcguggaaacgugggcccugcgacaucccggguucacggugauugcucuguuucucgcgcacgcgaucggcaccagcauuacccagaaggggauaaucuucauucugcugaugcucgugacgccaagcauggcuaugcgaugcgugggcaucggcaaccgagacuucgucgaggggcugagcggcgccacguggguggacgucgugcuagaacaugguuccugugucaccaccauggccaagaacaagcccacccucgacaucgaacugcuuaagacggagguagcgaaucccgcuaucuuacgcaaacuuugcaucgaggcuaagaucagcaacaccaccaccgacucgcgaugcccuacgcagggcgaggccacucugguggaggaacaggacgccaacuucgucugcagacggacguucguggacaggggcugggggaacggcuguggccuuuucggcaaggggucacuacugaccugugcgaaguucaagugcgugacgaaguuggagggaaagaucgugcaguacgagaaccugaaguacuccgucaucgugaccgugcacacgggcgaccagcaccaggucgguaacgagaccacagagcauggaaccaucgccaccaucacgccucaggcccccaccagcgagauccagcugacggacuacggugccuugacccuggacuguagcccacggacgggucucgacuucaaugagauggugcucuuaaccaugaaggagaaguccuggcuggugcacaagcagugguuccucgacuugccguuacccuggacguccggggccaguaccucccaggagaccuggaaccgccaggaucuccuggucaccuucaagacugcgcaugcuaagaagcaggagguagucgugcugggaucacaggagggcgcaaugcacaccgcccucaccggggcgaccgagauccagacgagcgguaccaccacaaucuuugcagggcaccugaagugccggcugaagauggacaaacucacgcugaaaggcaccuccuacgugaugugcacugggagcuucaagcuggagaaagagguugccgagacccagcacggcacgguccuggugcaagucaaguacgaaggaaccgaugcacccugcaagauacccuucuccacucaggacgaaaagggugugacucagaacggccgccucaucacggcaaaccccaucgugacggacaaggagaagcccgucaacaucgagaccgagccuccuuucggggagagcuacaucguggugggcgcgggcgagaaagcucuuaaacuguccugguuuaagaagggguccuccauugguaagauguucgaggcaaccgcccgcggggcgagacggauggcgauacugggcgacacggcaugggacuucgggagcaucgguggcgucuuuacauccgugggaaaguuggugcaccaggucuucgguacggcuuacgggguucuauucagcggcgucucauggaccaugaagaucggcauuggaauacuccugacguggcuggggcucaacagccgcuccaccagccugucgaugacuuguaucgccgucgggauggugacacuguaucucggcgugaugguccaggccgacucggggugcguaaucaacuggaaaggacgcgagcuaaagugcggguccggcaucuuugugacgaaugagguccauaccuggaccgagcaguacaaguuucaagcggauagcccgaaaaggcugagugcagccauaggcaaggccugggaggaggggguguguggcauccgcuccgcuacccgguuggaaaacaucauguggaagcaaaucaguaacgaguuaaaccacauauugcuugagaaugacaugaaguucaccguggucgugggggacgcgaacgguauccuggcccagggaaagaagaugaucagaccccaaccuauggagcacaaauacucguggaaguccuggggaaaagccaagaucaucggagcggauauccagaacacgacauucaucaucgauggacccgacacgccugaaugcccugacaaccagcgggcguggaacauuugggagguggaggacuacggauucgggaucuucaccaccaauaucuggcugaagcugcgcgacuccuacacccaaaugugcgaccaccggcuuaugagcgccgcgaucaaggacuccaaggccguccacgcggacauggguuacuggaucgagucggagaagaacgagacuuggaagcuagcgcgggccuccuucaucgaggugaagaccugcacuuggcccaagagccacacccucugguccaacggcguauuagagucggagaugaucauccccaagaucuacggugggccuauaagucagcacaauuaccggcccggcuacuucacccagaccgccggccccuggcaccuagggaagcucgaacuggacuucgaccugugcgaaggcacgaccgucguggucgacgagcacugcggcaaucgcgggccgagucuuaggacgaccacggucaccggcaagaucauacacgaguggugcugucgauccugcacgcugccgccgcugcgguuucgcggggaggacgggugcugguacgggauggagauccggcccgugaaggagaaggaggagaaccuaguucggagcaugguguccgccggcagcggcgagguggacagcuucuccuuagguauccuaugcgcuaguaucaugauugaggaggugaugcggucccgcuggagccggaagaugcucaugacgggcacgcuggcgguguuucugcuccugaucauggggcaguugacuuggaacgaccugauccgccugugcaucauggugggcgccaacgccuccgaucgcaugggaaugggcacaaccuaucucgcauugauggcaacguucaaaaugcggcccauguuugcagugggacugcuuuuucgccgacucacaucuagggagguacuguuacucaccaucgggcucucccucguggccagcguggagcucccaaacucguuggaagagcugggcgaugggcuugccaugggcaucaugaugcugaagcuucuaaccgaauuucaaccccaccaguuguggacuacccuguuaagucugaccuuuaucaagacuacgcugucccuagacuacgccuggaagaccacagcgauggcacugagcaucgucucccuauucccccucugccugucaaccacgucccagaagacuaccuggcugccgguucuucuggguucauucgggugcaaaccccugaccauguucuugaucaccgaaaauaagaucuggggcaggaaguccuggccccugaacgaggggaucauggcaaucggcauaguguccauccugcucucuagccuacugaagaacgacgugccucucgcuggcccccugaucgccggaggaauguugaucgcuugcuauguaauaagcggguccagugccgaccucucccuggaaaaagccgccgagguaagcugggagcaggaggccgaacacuccggcacgagccacaacauuuugguugaggugcaggacgacgggaccaugaagaucaaggacgaagagcgcgaugacacccucaccauucuucugaaggcgacguugcuggccgucagugguguguaccccaugagcauacccgccacccuguucguaugguacuucuggcagaaaaagaagcaacggucugggguccucugggacacccccagcccgcccgagguggaacgcgccgugcuggacgacggcaucuaccggauacuucagcgcggccugcucgggcggucccaggucggcguggggguguuccaggaugguguuuuucacaccauguggcaugugacgcgaggggccgugcugauguaccaggguaagcggcuggagcccagcugggcauccgucaagaaggaccuuaucagcuacggcgggggguggcguuuccagggaucuuggaacaugggcgaagaggugcaagugaucgcugucgagcccgggaaaaacccgaagaacgugcagaccacacccggcaccuucaagacgccggagggugaggugggcgccaucgcccuggacuucaagccugguaccucaggaagucccaucgucaaccgagaagggaagaucguuggucuguacgggaacggcguugugaccaccucggggacguacguguccgccaucgcccaggccaaggcaagccaggaaggaccacuccccgaaaucgaggacgagguguucaagaagcgaaaccugacuaucauggaucugcacccggggagcggcaagacucggcgcuauuugcccgccauaguccgggaggcaauuaagcgcaagcugaggacccuaauccucgcucccacgcgcgugguggccucagagauggccgaggcccugaagggcaugccaauccgcuaccagaccaccgcggucaagucggagcacaccgggcgggagauagucgaucugaugugccacgcuacuuuuaccaugcgccuccugucuccggugcgggucccgaacuacaauaugaucaucauggacgaggcccacuucaccgacccggccagcauagccgcgcguggcuacauauccacccggguggguaugggcgaggcggccgcaaucuucaugacagcaacgccgcccgggagcguagaggcguuuccccaguccaacgccguaauccaggaugaggagcgcgacauccccgagcggagcuggaacuccggcuacgacuggaucaccgacuuccccggaaagacugugugguucgugcccagcauaaaauccggaaacgacaucgccaacugccuucgcaagaacgggaagcgggucauacaguugagccgcaagacguucgauaccgaguaccagaagaccaagaauaaugacugggacuacguggugacaacggacaucuccgaaaugggggccaacuucagagcggaccgcgucauugacccccgccgcugccugaagcccgugauccugaaagauggccccgagcgggucauucucgcggggccgaugccagugaccguggccagcgccgcccagcgccggggccgcauuggucggaaccagaauaaggagggugaccaguacguguacaugggccagccacugaacaacgacgaggaccacgcgcacuggacagaagccaaaaugcugcucgacaacauaaacaccccggaggggauaaucccugcccuguucgagcccgagcgcgagaaaucugccgcaauugauggcgaguaucgucugcgcggggaagcgcgcaagacguucgucgagcucaugcggcgcggcgaccugccaguauggcuauccuacaaggucgcuagcgagggcuuccaguacagugaccggcgcuggugcuucgacggggagaggaauaaccaggugcuagaagaaaacauggacgucgagaucuggaccaaggaaggcgagcgcaagaagcugcggccccgcuggcuggacgcccggacuuacuccgauccguuggcccugcgcgaguucaaggaguucgccgcggggcgucgaagcguaagcggcgaccugauccucgagaucggcaagcugccacagcaccugacccugcgggcucagaacgcccuggauaaccuagugaugcuccacaacuccgaacagggagggaaggccuaccgacacgcgauggaagagcuaccagauacaauagagacgcuaaugcuccucgcccugauugccguucucaccggagguguaacccuguucuuccugagcgggaaaggccucggcaagaccucuaucgggcuguugugcgugacggccagcuccgcucuccuguggauggcgagcguugagccccacuggaucgccgccuccaucauacuggaguuuuuccucaugguccuguugauuccagagcccgaccggcagagaacgccccaggacaaccagcuugccuauguaguuauuggccugcuguucaugauuuuaaccgucgccgcgaacgagauggggcugcucgagaccacuaagaaagaucucggcaucggacacguagccgccgaaaaucaccagcacgccacuaugcuggauguggaucugagaccagccagcgcguggacacuguacgccgucgccaccacggugauuacuccaaugaugaggcacaccaucgagaacaccacggccaacaucucucugaccgcuaucgcgaaccaagccgccauccugaugggucucgacaaaggguggcccaucagcaagauggacaucggaguuccccugcuggcccucgguugcuacucucagguuaacccgcugaccuugaccgccgccguucucaugcugguggcccacuacgcaauuauaggccccgggcugcaggccaaagcgacgcgggaggcccaaaaacgcaccgccgccgggaucaugaaaaaucccaccgucgacggcaucguagccaucgaccucgaucccguggucuacgacgcuaaguucgagaagcaacugggccagauuaugcugcucauccugugcaccagccagauacugcuaaugaggacgaccugggcccugugcgagaguaucacuuuggcgaccgggccucucacgacucugugggaaggcagccccgggaaguucuggaauaccaccauagcaguguccauggccaacaucuuccggggcagcuaccuggcgggcgccgggcucgccuuuucccugaugaagucccugggagggggccgacgggggacaggcgcacagggugagacccucggagagaaguggaagagacagcugaaucagcuguccaagagcgaguucaacaccuacaagcggagcggcaucauggagguggaccgcuccgaggcgaaagagggguugaaacggggcgaaacgaccaagcaugcagugagccgcgggacggcuaagcugaggugguucguggagcgcaaccucgugaagcccgagggcaaggucaucgacuugggcugcgggcgugguggguggucauacuacugcgccggacuaaagaaggugaccgagguuaagggguacaccaaggguggccccgggcacgaagagccgauccccauggccaccuacggguggaaccuugucaagcugcacagcgggaaagacgucuucuucaugccgccugagaagugcgauacgcuccugugcgacaucggcgaguccagcccgaacccuaccaucgaggaggggcguacccugcgggugcuuaagaugguugagccauggcugcgcggcaaccaguuuugcaucaagauccugaacccuuacaugccuagcgugguggagaccuuggagcaaaugcagcguaaacacggugggaugcugguccgcaauccacugagccggaacuccacgcacgagauguacugggugagcugcggcacgggcaauaucguguccgcggucaacaugacuagccgaaugcuccugaaccgauuuaccauggcccaccgcaagccuacguucgagcgcgacguggaccugggcgccggcacccggcacguggcuguugagcccgagguggccaaccucgacaucauugggcagaggaucgagaacauaaaaaaugagcacaaguccaccuggcacuaugacgaggacaacccauacaagacaugggcuuaccacggcagcuacgaagugaagcccuccgggagcgcuucgagcauggucaacggcguugugcggcugcugacgaaacccugggaugucauucccauggugacccagaucgccaugacugacaccacuccguucgggcagcagcgagucuucaaggagaaggucgauacccggacgccgcgggcuaagcggggcacaacgcagaucauggagguuacggcuaaguggcucuggggauuccugagccgcaacaagaaaccccggaucugcacucgcgaggaguucacgcgaaagguucgcucaaacgcggccaucggggccguauucguagacgagaaccaguggaauagcgccaaggaggcggucgaggaugagcgguucugggaccuggugcaccgcgaacgagagcuccacaaacagggcaaaugcgccacgugcguguacaacaugauggggaagcgcgaaaaaaagcugggcgaguucggcaaggccaagggcucccgggcaaucugguauauguggcugggcgcccgcuuccucgaguucgaggcgcuuggcuucaugaacgaggaccauugguucucccgcgagaacucccugagcggcguugagggggagggcuugcacaaacugggguauauccugagggacaucuccaagaucccaggcggcaacauguacgccgaugacaccgccgguugggauacccgaaucaccgaggacgaccuccagaacgaggccaagaucacagacauaauggagccugaacacgcguuauuagcgaccagcaucuucaagcucacguaccagaacaagguggugaggguccagcgccccgccaagaacggcacgguuauggacgugaucucccggcgcgaccagcggggcagcggccaggucggaacauacggauuaaacacuuuuaccaacauggaggugcagcugauucgccaaauggaguccgagggcaucuuccuucccuccgagcuggaaacuccuaaccuggccgagcgggugcucgacuggcucgagaagcauggggccgagcgcuuaaagcggauggccaucuccggugacgacugcgucgugaagcccaucgaugaccgcuucgcgaccgcccucacggccuugaacgacauggggaagguucggaaggacauaccccagugggagcccaguaagggcuggaacgauuggcagcaagucccguuuugcucucaccacuuccaccagcugaucaugaaggauggccgcgagauagucgugccuugcaggaaccaagacgaacucguggggcgcgcucgggucagucagggcgccggguggucccuacgcgagacagcuugccuggggaagucguaugcccagauguggcagcucauguacuuccaccggcgcgaucugcggcuggccgccaacgcaauaugcuccgccgugccugucgacugggugccuaccucacgcacgacguggaguauccacgcccaccaucaguggaugaccacggaggacaugcucagcguguggaaccgggucuggaucgaggagaacccguggauggaggauaaaacgcacgugaguuccugggaggaggugcccuaccuggggaagcgcgaggaccaguggugcgguagccuuaucggccucacagcccgggcuaccugggcaacgaacauccaggucgcaauuaaucagguccggcgccugaucgggaacgagaacuaccuggacuacaugaccucaaugaagcgguucaagaacgaaagcgacccugagggugcccucugguga

SEQ ID NO: 23903 - RNA, 9879 nt, Artificial Sequence
  derived and/or modified CDS sequence (opt11) from DENV-1__KJ189306__SS-prME
agcguaaccaugcugcuaaugcuuuuaccaaccgcgcuagcguuucaccucacgacaaggggaggcgagccacacaugauagugucaaaacaagaacgugguaaaucgcuccuauucaaaaccagcgccggaguuaacaugugcacccuaauagccauggacuuaggcgaguuaugcgaggauacaaugacguauaaauguccacaaauuacugaggcugaaccagaugauguagacugcuggugcaacgcuacagacacauggguaaccuacgggacgugcucgcaaacuggcgagcauaggcgcgacaaacggucaguggccuuagcgccucacguaggcuuaggccuagaaacccgcacggagacuuggaugucaucugagggcgcauggaaacaaauucaacgggucgaaacgugggcucuccgccacccaggauuuacugugauagcguuguuccuagcccacgccaucggaaccuccaucacacaaaaagggaucauauucauacugcuuaugcuugugaccccgucaauggccaugcgaugcguuggaaucgggaaccgugacuucguggaaggcuuaagcggagccaccuggguagacgucguccuggaacauggcucauguguaacaacuauggccaaaaacaaacccacucuagauauagaacuccuuaaaacagaagugacaaacccagcaauauuacggaaacucugcauugaagcgaaaauaagcaacacaaccacggacucccgauguccaacacaaggcgaagccacucucguagaagaacaagacgcgaacuucguuugccgccgaacauucguagaucggggcuggggcaacggaugcggauuguucggcaagggauccuugcuaaccugugcaaaguuuaaaugcgugaccaagcuggaaggcaagauaguccaauaugagaaccuuaaguacuccgugaucgucacggugcacaccggcgaccaacaccaaguaggaaaugaaacaacagaacacggcacaauagccacgauaacuccccaggcacccaccuccgaaauccaacugaccgauuacggagcgcugacucucgauugcaguccucgcacggguuuggauuucaacgagauggucuugcuuacaaugaaagaaaaaucguggcuaguacacaaacaaugguuucuagaccuaccucuaccguggaccaguggugcaucaacaucucaggaaacguggaaccgacaagaucuccuagugacauucaaaaccgcacacgcgaagaaacaggaagugguuguucucgggagccaagagggggccaugcauaccgcccucacgggcgcgacggaaauacagacaucgggaacaaccacgauuuucgcgggucaucuaaaaugcagacucaaaauggacaagcuaacccucaaaggcacaucauacgucaugugcacgggcccuuucaagcucgagaaagaaguagcggaaacucagcacggcacuguccugguccagguaaaguaugaaggaacggacgcgcccugcaagauaccguuccucacacaggacgagaaaggcguaacgcaaaacgggcgauuaauuacggcgaaccccaucgucaccgacaaggaaaagccaguaaauaucgagacugagccaccauucggcgagagcuauauugucgucggggcaggagagaaagcccuaaaacucucaugguucaaaaagggaaguagcauaggaaaaauguucgaggcaacagcaagaggggcccggcggauggcuaucuugggcgacaccgcgugggauuucggaagcauagguggggucuuuacaagugucggcaaguugguacaccaaguauucggaacugcauacggaguacucuucucaggcguaagcuggaccaugaaaauaggaauuggaauccugcugacauggcuaggccugaacagccguagcacuagccuuagcaugacaugcauagcuguagggaugguaacucucuaucucggugucaugguccaggcggacagcgggugugugauaaacuggaaaggaagagagcucaaaugcggaucggguauauucguaacaaaugagguccacacguggaccgaacaguauaaauuccaagccgacagcccgaagcgccugagugccgcaaucggcaaagccugggaagaagguguaugcggcauacgauccgcuacgagguuagagaacauaauguggaaacaaauaucaaaugagcucaaccauaucuuacuugaaaacgauaugaaguucacgguagucgucggggaugccaacggaauccuagcucaaggcaagaaaaugauacgcccacagccaauggagcauaaguacagcuggaagucauggggcaaagccaaaauuauuggcgcagacauacaaaacaccacauucauaaucgacgggccugacacuccagaaugcccggacaaccaacgugcuuggaauauaugggagguagaagacuacggcuucggaaucuucaccacgaacaucuggcucaagcuacgggacucauacacccaaaugugcgaccacagacuaaugucugcggcaauaaaagacucaaaggcaguacacgccgacaugggauacuggauagaaucagagaaaaacgagacguggaagcucgcuagagcguccuucaucgaggugaaaacauguacguggccgaaaagccauacgcuguggucaaauggcguacucgaguccgagaugaucauaccaaaaauuuacgguggaccgaucagccagcauaauuaccggccuggguauuucacgcaaacagccggaccguggcaccuaggcaaacuagaauuagauuucgacuugugcgaaggcacgacgguaguaguagacgaacauugcggcaauagaggcccuagccuccguaccacuaccguaaccgguaagauaauacaugagugguguugcaggaguugcacccuacccccacuaagguucaggggagaagacgggugcugguacggcauggaaauucgaccgguaaaagaaaaagaggaaaaucucguccgcucaauggugagugcgggcaguggagagguagacucauuuucccucgggauauuauguguaucaaucaugaucgaagaagugaugagaagcagauggucgcgaaagauguugaugaccggaacucuggcgguguuccuacuuuuagugaugggacaacucacauggaacgaccuuauucgacugugcauaaugguuggagcgaacgcguccgaucgcauggggaugggcacaaccuaccucgcgcugauggcaaccuucaagaugcgccccauguucgcuguaggacuccucuucaggcgccucacgagccgagagguccugcuucuaacaaucggccucagccuaguagccucagucgaacuccccaacucgcuagaagaacuuggggacggccucgccaugggcauaaugauguugaaacuccugacagaguuccaaccgcaucagcuauggacuacacuacugucccugacuuucauaaagacaacauugucauuggacuaugcauggaaaaccacagccauggcucuaagcauaguaucccuauucccacuaugccucuccaccacaucucagaaaacgacuuggcucccaguacugcugggcagcuuuggaugcaaaccccuaacuauguuucuuauaacugaaaacaagauauggggccguaaaucguggccuuugaaugagggcaucauggcgauuggaauagucaguauacuucucaguagccuacugaagaacgacguuccacuggccggcccacucauagccgggggcaugcucaucgcauguuacgugauaucgggauccagugcggaccuaucauuagaaagggcggccgaagucucgugggaacaagaagcagaacacucgggaacuagccacaauauccuaguggaagugcaagaugauggcaccaugaagaucaaagaugaagaacgagacgauacgcuaaccauccuccuaaaagccacgcuacuagcggugucgggcguauacccgauguccaucccugccacacucuucguaugguacuuuuggcagaagaagaaacaacgaucaggaguacucugggacaccccgucaccaccagaggucgaaagagccguccuggacgauggcaucuaccgaauacuucagaggggccuccucgguagaagccaggucggcguaggcgucuuccaagacggagucuuucauaccauguggcaugugacaagaggagcuguguuaauguaccaagggaaaagguuagaaccuucuugggcuucggucaagaaagaccuaauaucauacgguggcggauggcguuuucagggcucauggaauaccggggaagaaguccaaguuaucgcgguagagcccgggaagaacccuaaaaacguucaaacgacgccgggcacauuuaaaacgccugagggcgaaguuggagcgaucgcucucgacuuuaaaccaggcaccucaggaucccccaucguaaaccgcgagggaaaaaucgugggacuuuacggaaacggcguuguaacaacgagcgguacguacguaagcgcaauagcccaggcaaaggcuucgcaggaagggcccuugccagagauagaagaugagguauucaagaagagaaaccuaaccaucauggacuuacaccccgggagcggaaaaacacgacgguacuugccugcaauagugcgggaggcaaucaaaagaaaacuucgcacucuaauucucgcaccgacgcggguagucgcauccgagauggcagaagcucuuaaggggaugccaauccgauaccaaacaaccgcaguaaaaucagaacacacaggccgagaaauaguugaccugaugugccacgcgacuuucaccaugaggcugcugucaccgguuagagucccgaauuacaacaugaucauuauggacgaagcccacuucacggacccggccagcauagcggcgcggggguacauuuccaccagagugggaaugggagaggcagcagcgaucuucaugacggccacacccccgggcuccgucgaagcauucccacaguccaacgccgugauucaagacgaagagagagacaucccugagcgaagcuggaacagcggauacgauuggauaacugauuuccccgguaagacagugugguuugugcccucgauaaaaucgggaaacgacauugccaacugccugcggaaaaauggcaaaagagucauacagcucuccagaaaaacauuugacaccgaguaccagaagaccaaaaacaacgauugggauuacguagugacgacugauaucagcgaaaugggugcaaacuucagagcggaucgaguaauagacccacgccgaugucuaaagcccgucauacugaaagacggcccagaaaggguaauccuagcgggaccuaugccugucacaguugcgagcgccgcucagcggaggggccgcaucggacgaaaucagaacaaggaaggagaccaauauguauacauggggcaaccacuaaacaacgacgaagaccacgcucacuggacagaggccaaaauguuacucgacaauaucaauacgccagaaggaauuauaccagcacuguucgagccagagcgggaaaaaucagcagcaauugauggugaauaccgccuacgaggggaagcaaggaaaacuuucguagaacuaaugcgacggggagaccuaccagucuggcuuuccuacaagguagcaagcgaaggauuccaauauucagacagacgcuggugcuuugacggggaacggaacaaccaggucuuagaagagaacauggacguugagauauggaccaaagaaggcgaaaggaagaaauuacggccuagauggcuggacgcgaggaccuacucugaccccuuggcuuugagggaauuuaaggaguucgccgcgggacgccgaagcguauccggcgaccucauacuggagauaggcaaacuaccccagcaccucacccuacgagcccaaaacgcuuuagacaaccuggugaugcuacauaacuccgagcaaggaggcaaagcguacagacacgcaauggaagaacugccggacacgaucgaaaccuuaaugcuccucgcacuaaucgccgugcuuacagggggagucacacuguucuuucucuccgguaaaggccucgggaaaacaucaaucgguuugcucugcguaaccgccagcagcgcacuauuauggauggcaagcgucgagccccacuggauagcggcaagcaucauucuagaguuuuuccuaaugguacuacucaucccugagccagaucggcagcgaaccccacaagauaaccaacuugcguacguaguuauaggucuacuguucaugaucuuaacaguggcggcgaacgagaugggacuccuagagacaacgaagaaagaccucggcauaggucacguugcagcugaaaaucaccaacaugcaacaaugcucgaugucgaucuacgccccgccagcgcauggacucuauacgcuguugccacaacgguuaucacaccaaugaugagacauacaauugagaacaccaccgcaaacaucucacugaccgcaauagccaaccaggcggcgauccuaaugggccucgacaagggcuggccgauauccaaaauggauauaggaguaccccuccucgcccucggcuguuacagccaaguaaauccucugacacugaccgcggccguucuaaugcuaguugcacacuacgcgaucauuggaccaggacuccaagccaaggcaacccgggaggcgcaaaagcgcaccgcugccggcauaaugaagaacccaacgguagacggcaucgucgcaaucgaucucgacccaguaguguacgacgccaaguucgaaaaacaauuggggcaaauaauguugcuuauuuuguguacaucccagauccuccuaaugcgaaccaccugggcccuaugcgaauccaucaccuuagccaccggaccccuaacaacgcuaugggagggcucacccggaaaauuuuggaacacaaccaucgcaguauccauggccaacaucuuccgaggcucauaccuggccggagccggacuagcguuuagccugaugaagaguuugggaggcggacgcagggguaccggagcucaaggagaaacacugggagagaaguggaaaaggcagcuaaaucaacucagcaaaagcgaguuucauauauauaaacgcucgggcauaauggaaguagaccgcuccgaagcgaaagaagggcuuaagcgaggagaaacuacgaaacacgcagucucacgcggcacggcaaaacugagaugguucgucgaaaggaaucucguaaagcccgaaggcaaaguuauagaccuuggaugcggcagagggggcuggagcuauuacugcgcagggcucaaaaaggucaccgaagucaagggguacacaaagggcggcccuggacacgaagaacccauacccauggcaacauacgguuggaaccucgucaaacuccacaguggaaaggacguguucuucaugccgccggaaaagugugacacccuacuaugcgacauaggggaaagcuccccgaacccaaccauagaagaaggacguacgcuacgaguguuaaaaaugguagaaccauggcuucgugggaaucaguucugcauuaaaauacuaaacccguacaugccgucaguaguagagacgcuugaacaaaugcagcggaaacacggagggaugcucguucggaauccucucucucgaaacagcacgcaugaaauguauuggguaucuugcggaacuggaaauauaguaagcgccgucaacaugacaagucggauguugcuaaaccgauucaccauggcccaccggaagccuaccuaugagagagacgucgaccuaggggccggcaccaggcacguggcaguugaaccggaaguggcaaaccuugacaucauaggccaaaggauagaaaauaucaaaaaugaacacaagaguacuuggcacuacgacgaggacaauccguauaagacgugggccuaucauggcucauacgaggucaaaccaaguggaagcgcaagcuccauggugaauggaguaguaagguugcugacuaaaccuugggacgugauacccauggugacccaaauagccaugacagauacaacacccuuuggacagcagagagucuuuaaggaaaaaguggacacccgcacaccccgagcaaagagggggacaacgcagaucauggaaguuacggcaaagugguuauggggcuucuugagcagaaacaagaaaccacggaucugcacacgggaggaguuuaucaggaaagugcgcagcaacgcagccaucggcgcgguguucguugacgaaaaccaguggaacucagcaaaagaggcggucgaggacgagagauuuugggaccuaguccaccgcgaacgagaauuacacaagcaaggcaaaugcgcgacgugugucuacaacaugaugggcaaaagagagaagaaacugggggaguucggcaaggcaaagggcaguagagcgauuugguauauguggcucggcgcacgguuucucgaguucgaagccuugggauucaugaacgaggaccacugguucucacgggagaacucacuaucgggcguagaaggugaaggucuucauaaacucggcuauauccuucgcgacaucagcaaaauaccgggugggaacauguacgcagaugacacggcaggcugggacacccgcauaacggaagacgaccuccaaaacgaggcaaaaauaacagagauuauggaacccgagcacgcacuguuagcaacaagcaucuuuaaacuuaccuaccaaaacaaaguaguaagagugcagcgcccagccaagaacggaacaguaauggacguaaucagucgacgggaccagcgggggucaggucaaguaggaaccuacggcuuaaacaccuucacgaacauggagguacagcucauacggcaaauggaguccgaaggcaucuuccuccccagcgaauuagagacgcccaaucuagcggagcggguauuggacuggcuagaaaaacauggagcggaacggcuaaagcgcauggcaauaucuggugacgacugcgucguaaaaccgauagacgaccguuuugcaacagcacuaaccgcgcugaaugauaugggcaaaguacgcaaagacauaccccaaugggagcccucaaaagguuggaacgacuggcaacaagucccauucugcucccaucacuuucaccagcucauaaugaaggacggaagagagauagucgucccgugccgcaaccaagacgaguuggugggacgagcacgagucagccaaggggccgguugguccuugcgcgaaaccgccugccugggaaaauccuaugcucaaauguggcaacucauguacuuccacagacgcgaccuacgccuagcggccaacgcuaucugcucggccguaccggucgacuggguaccgaccucgcgcaccaccuggucaauacacgcgcaccaucaauggaugacaacggaagacaugcugagcgucuggaaucgggucuggaucgaagagaacccauggauggaagacaagacccacguaucaaguugggaagaaguaccauaccugggcaaacgggaagaccaauggugcgggagcuugaucgggcuaacugcaagagcaacaugggccacaaacauacaaguggcaaucaaccaaguccggcgacugauaggcaacgaaaauuaucucgacuacaugaccucgaugaagcgauucaaaaacgaaagcgaccccgaaggagcccugugguga

SEQ ID NO: 23904 - RNA, 9879 nt, Artificial Sequence
  derived and/or modified CDS sequence (opt11) from DENV-1__KJ189307__SS-prME
agcgugacuaugcugcuuauguugcugcccacugcucuggccuuccaccugacuacccgcggcggagagccgcauaugauuguauccaagcaggagcggggaaagagccugcuuuucaaaaccuccgcgggggugaacaugugcacccugaucgccauggaccugggugagcucugcgaggacacgaugaccuacaagugcccccagauaaccgaggccgagcccgaugacguggauugcuggugcaacgccaccgacacaugggucacguaugggacgugcucgcagacuggcgagcaccgccgggacaaaagaagcguggcccuugcgccccaugugggccugggcuuagagacgcggaccgagaccuggaugagcuccgagggcgccuggaaacagauucagcgcgucgagaccugggcccugcggcacccuggguucacgguuauagccuucuuccuggcgcacgcaaucggaaccagcaucacgcagaaggggaucaucuuuaucuugcugaugcuggugacccccucuauggccaugcgcugcgucggcaucggcaaccgggacuucguggagggccucagcggcgccacgugggucgacgucgugcuggagcacggguccugcguaacaaccauggccaagaacaagcccacccuggacaucgagcuccugaagacggaggucaccaacccggcgauccugcgcaaguuaugcaucgaggcuaaaaucuccaauaccaccacggacuccaggugcccgacacagggcgaggccacccugguugaggagcaggacgccaauuucgugugccgccguacauucgucgaccgcggcuggggcaacgguugcgggcuguucggcaagggcucacuccugacuugcgccaaguucaagugcgugacaaagcuugaaggcaaaaucgugcaguacgagaaccuuaaauacuccgucauagucaccguccauaccggcgaccagcaccaggucgggaacgagacgacagaacauggcaccauagcgaccaucacgccccaggcccccacgagcgaaauacagcugaccgacuacggugcccugacacucgacuguuccccgcgaaccggccuggauuucaacgagauggugcugcucacgaugaaggagaagagcuggcuuguccacaagcagugguuccuggaucucccgcugcccuggaccuccggggccucuaccagccaggagacguggaaccgccaagaccugcucguaacguucaagaccgcacacgcgaagaagcaggagguggucgugcugggcucacaagagggcgcaaugcauaccgcucuaaccggggccacggagauacagaccagcggcaccaccacgaucuucgccggucaccucaagugcaggcugaagauggacaagcuuacccuuaagggcaccuccuaugugauguguaccgggagcuucaaguuggagaaggaggucgcggagacgcaacaugguacagugcuggugcaggucaaguacgagggcaccgacgcccccugcaagauccccuucuccacccaggacgagaagggggugacacagaacggccgccugaucaccgccaacccgaucgugaccgacaaagagaagcccguuaacauugaaaccgagccccccuuuggggagucuuacauugucgugggagccggagagaaggcucucaagcuguccugguucaaaaaggggagcuccaucggcaagauguuugaggccacggcccggggggcccgccgcauggcgauccugggcgacaccgcgugggacuucgggagcaucggcggggucuucaccucgguugguaaacucgugcaccaggucuuuggcaccgccuacggggugcuguucagcggcgugagcuggacgaugaagaucgggaucggcauucugcucacuuggcugggccugaauucucgcuccaccagccucagcaugacaugcauugccgucgggauggucacgcuguaucugggcgugaugguccaggccgacuccgggugcgugaucaacuggaagggcagggaguugaaguguggguccggcaucuucgugaccaacgagguccacacuuggaccgagcaguauaaguuccaggcugacagcccgaagcgguugucugcggcgaucggcaaggccugggaggagggggugugcggcauccgcuccgcuacacggcuggagaacaucauguggaagcagaucagcaacgagcucaaccacauccugcuggagaacgacaugaaguucacgguggucgugggggacgccaacggcauucucgcgcaggggaagaaaaugauccggccgcaacccauggagcacaaguacuccuggaagagcuggggcaaagccaaaaucaucggcgcggacauccaaaacaccaccuucaucaucgacgggccugacacuccggagugccccgacaaccagagggccuggaacauuugggagguugaggauuacggcuuugguaucuucacgaccaacaucuggcugaaguugcgcgacagcuacacucaaaugugcgaccacagacucaugagcgcggccaucaaagacuccaaggccguucaugccgacaugggcuacuggaucgaauccgagaagaaugaaaccuggaaguuggcccgcgcgucuuucaucgaggugaagacgugcacguggcccaaaucacacacccugugguccaauggugugcuugaaagcgagaugaucauccccaagaucuacgggggcccgaucucccagcacaacuaccggcccgguuauuucacccagacagcaggccccuggcaccugggcaagcuggagcuugacuuugaccugugugagggcaccaccgucgugguggacgagcauugcggaaaucgcgggccgagccugcggaccacgaccgucaccggcaagauaauccacgaguggugcugccgcuccugcacgcuccccccccugcgauuccgcggggaggacggcugcugguacgggauggagauccggcccgugaaagagaaggaggaaaaccuggugcgaagcaugguauccgccggcagcggcgaggucgacagcuucucccucgggauccugugcgugagcaucaugaucgaggaggucaugcggucccgauggagccggaagaugcugaugacgggcacccucgcuguguuccuguuauuggugauggggcagcugaccuggaacgaccucauccgccucugcauuaugguaggcgccaaugcgucugaucgcauggggauggggaccacguaccuggcgcugauggccacuuucaagaugcggccgauguucgccgugggucuccuguuccgccgacugaccagccgcgaggugcuccugcugacaauugggcucucccuggucgccagcguggaacugcccaacucccucgaggagcugggcgacgggcuggcgaugggcauuaugaugcugaagcuacugaccgaguuucagccccaccagcucuggaccacccuucugagccucaccuucaucaaaacgacccugucccuggacuacgccuggaaaaccacugcuauggcccucagcaucgucucccuuuucccccugugccucagcaccaccucccagaagacuaccuggcugccggugcugcuagguagcuucgggugcaagccguugaccauguuccucaucacggagaauaagaucuggggcagaaagaguuggcccuugaacgaggggaucauggccaucggaauagugucgauacugcuguccagccuccugaagaaugauguucccuuagccgggccacucaucgcaggcgguaugcuaaucgccugcuacgugauuagcggauccagcgcugaccugucgcucgagaaggcggcagaggucagcugggagcaggaggccgagcacuccggaacgagccacaacauccccgucgagguucaagacgaugggaccaugaagauaaaggacgaggagcgcgaugacacccugacgauccugcucaaggccaccuugcuggccgugucuggcgucuaccccauguccauuccggcgacccucuuugugugguacuuuuggcagaagaagaagcaacggaguggcgugcugugggacaccccgagcccccccgaggucgaacgcgccgugcucgaugacggcaucuaucggauacuccagcgcggacugcuggggcguucccaagugggcgucgggguguuccaggacggcguuuuccauacgauguggcacgucacccgcggagccgugcugauguaucagggcaagcggcucgagccgaguugggccuccgugaagaaggaccugauaagcuacggagggggcuggcgcuuccagggguccuggaauacuggagaggagguucaggucaucgccguggaaccagggaaaaaucccaaaaauguccagaccacccccggcacguucaagacgcccgagggugaggugggggcaaucgcccuggacuuuaagccgggcaccagcgggucccccaucgugaaccgggaaggcaagaucgucggauuauaugggaauggcguugucacgaccagcgggacguacgucuccgccaucgcccaggccaaggcgagccaagaggguccucugccggaaauugaggaugagguguucaagaagcgcaaccugaccaucauggaccuccaucccgguagcggcaagacgcggcgcuaccugcccgccaucguccgggaggccauuaagcgaaagcugcggacucucauccuugcgccgacccgcgucguggcguccgaaauggccgaagcccugaagggcaugccgauccgcuaccagacuacggccguaaagagcgagcauaccggacgugagaucgucgaccucaugugccacgcaaccuucaccaugcgccugcugucccccgugcgggugcccaacuauaacaugaucaucauggacgaagcgcacuucacggacccggccagcaucgccgcccgcggcuacaucuccacucgggucgguaugggugaggccgcggccauuuucaugaccgccaccccgccaggaagcguggaggcguuuccccagucaaacgccguuauucaggaugaggagcgcgacauccccgagcggagcuggaacuccggcuacgacuggaucaccgauuuuccagguaagaccgucugguucgugccuagcaucaaguccgggaaugacaucgcuaacugccuccgcaagaacggcaagcgugugauccagcugagccgcaagacuuucgacaccgaguaccagaagacgaagaauaacgacugggacuacgucgugaccaccgacauuucggagaugggggcaaacuuccgggccgaucgcgugaucgacccucgucgcugccugaagcccguaauccucaaggacggaccggagcgggugauacuggccgggccuaugcccgugaccgucgcuagcgccgcccagcgcaggggccguaucggcaggaaccaaaacaaagagggggaccaguacguguacaugggccagccccucaacaacgacgaggaccacgcccacuggacggaggccaagaugcuccuggauaacaucaacaccccggaggggaucauacccgcuuuauuugagccagagcgcgagaagaacgccgccauagacggcgaauaccgacuccggggugaggcccgcaagacuuucgucgagcugaugcggcgcggcgaccugcccguguggcucuccuacaagguggccagugagggcuuccaguacuccgaccggcgauggugcuucgacggagaaagaaacaaccagguucuggaagaaaauauggacguagagaucuggacaaaggagggcgagcgcaaaaagcugcggccgcgcuggcucgacgcgaggaccuauagcgauccucuggccuuacgcgaguucaaggaguucgccgccgggcggcgcagcgugagcggcgaccucauacuggaaaucgguaagcugccccagcaccuaacgcugcgcgcccagaacgcgcuggacaaccucguaaugcugcacaauagcgaacaagggggcaaggcuuaccgccacgccauggaggagcugcccgauaccaucgagacccucaugcugcuggccuuaaucgcggugcugaccggcggcgugacacucuuuuuccucuccggcaagggccuugggaagacuagcaucgggcugcucugugucacagcguccagcgcccuucuuuggauggcuuccguggagccgcacuggaucgcggcgagcaucauucuggaguucuucuugaugguacugcucauccccgagccugaccggcagcgcaccccgcaggauaaccagcuggcguacgucgugaucggccuucuguucaugauccucacgguggccgcuaacgagaugggucugcucgagacgaccaagaaagaccugggcaucgggcacgucgccgcggaaaaccaccagcacgccaccaugcuggacguggaccuccggcccgccagcgccuggacgcuguaugcaguggcaaccaccguaaucacccccaugaugcgccacacgaucgagaacaccacugccaacaucagucugaccgccauagcuaaccaagccgcgauacucaugggccuggacaagggcuggcccauuuccaagauggacauaggggugccguugcucgcguuaggcugcuauagccaggugaauccccuaacgcuuaccgccgccguccuaaugcugguggcgcacuacgccaucauugggcccggccuccaagcuaaggccacccgagaggcccaaaagcgcaccgcggccggcaucaugaagaaccccaccguggacggcauagucgcgauugaccuggaucccgugguguacgacgccaaguucgaaaagcagcugggccagaucaugcucuuaaucuugugcacuucccaaauccuccugaugcgcaccaccugggcacugugcgagucgaucaccuuggcgaccgggccccugaccaccuugugggaggguucccccgggaaauuuuggaacacgaccaucgccguuagcauggccaacaucuuccggggauccuaccuagccggcgcaggguuagcguucagccugaugaagucccucggagggggccgccgcgggaccggugcgcagggcgagaccuuaggggagaaguggaagcgccagcugaaccagcucagcaagucagaauucaacacguacaaaagaagcggcaucauggaggucgaccgcagcgaggccaaggaaggucuuaaacggggcgagaccaccaagcacgcggugucacgcgggacggcaaagcugcggugguucgucgagcguaaccucgugaaaccagagggcaaggugaucgaccugggcugcgggaggggcggguggagcuauuacugcgccggucugaagaagguuacggaggugaagggguauacgaagggcggaccggggcaugaggagcccauccccauggccaccuacggguggaauuuggugaagcuacacuccgggaaggacgucuucuucaugcccccggaaaagugcgauacccugcugugugacaucggcgagagcucccccaacccuaccauugaagaggggcgcacgcuccgggugcugaagaugguagagcccuggcugcgcggcaaccaguucugcaucaagauccucaaucccuacaugcccagcgucguggagacccuggagcagaugcaacggaaacacggcgggaugcuggugcggaacccgcucagccgaaacagcacccacgagauguacugggucagcugcggcaccgggaacaucgugagcgccgugaacaugacgucccgcaugcugcucaaccgguucaccauggcccaucggaagcccacauacgagcgcgaugucgaccucggcgcgggcacccggcacgucgccguggagccagaggucgccaaccuggacauuaucgggcagcgcaucgagaacaucaagaacgagcacaagagcacguggcacuacgacgaggacaaccccuacaaaaccugggccuaucacggcuccuacgaggugaagcccagcggguccgcuagcuccaugguuaacggcguaguuaggcuacucaccaagccaugggacguuauccccauggugacacagauugcuaugacggacaccacccccuucggccagcaaaggguguucaaagaaaaggucgacacccggacgccgcgcgcgaaacggggcaccacucagaucauggaggugaccgccaaauggcuguggggauuccugagccgcaacaagaagccgcggaucugcacgcgggaggaguucacccgcaaggugagauccaacgccgccaucggagcggucuucguagacgagaaucaguggaacucagccaaggaggccguggaggacgagcgguucugggaccucguccaucgggagcgggaacugcacaaacagggcaagugcgccacuugcguuuauaacaugauggggaagcgcgagaagaagcugggcgaguucgggaaggcgaagggcagccgggccaucugguacauguggcucggcgcacgcuuccuagaauucgaggcgcugggguucaugaacgaggaccacugguuuucuagagagaacagccugagcggcguggagggagagggcuuacacaagcugggguauauccucagagacaucucgaagauucccggcggcaacauguacgccgacgacaccgcggggugggacacgcggaucacggaagacgacuugcagaacgaggcuaagaucaccgagauuauggagcccgagcacgccuuauuagccacauccauuuucaagcugacguaccagaacaaggucgugcgcguccagcgccccgccaagaacggcaccgucauggacgugauaucccggcgagaccagcgggggaguggacaaguggguaccuacggucugaacaccuucacgaacauggagguccagcugauucgccagauggaaagcgaggguaucuucuuaccguccgagcuggagacccccaaccucgccgagcgggugcuggacuggcuggagaagcacggggccgaacgccucaagcggauggccaucagcggcgacgacugcguggucaagcccaucgacgaccgcuucgccaccgcucugaccgcgcugaacgauauggggaaggugagaaaggacauaccgcaaugggagcccuccaagggcuggaaugacuggcaacaggugcccuucugcagccaccacuuccaccaauuaauuaugaaggacggcagggagauugucgugccuugccggaaccaggaugagcuggugggccgagcccgggucucccaaggugccggguggagccugcgugagacagccugccucgguaaguccuaugcccagauguggcagcugauguacuuccaccgccgugaccugcggcucgcggccaacgcuaucugcucggccgugcccgucgacugggucccgacguccagaaccacauggagcauccacgcgcaccaccaauggaugaccacggaggacaugcugagcguuuggaacagaguguggauagaggagaaccccuggauggaggacaaaacccacgucuccagcugggaagaagugcccuaccuggggaagagagaggaccaguggugcgguucccucauaggccugaccgcccgcgccacgugggcuacgaauauccagguggccaucaaccagguuagacgucuuaucggaaacgagaacuauuuagacuacaugaccagcaugaagcgguucaaaaacgaguccgaccccgagggcgcgcuuugguga

SEQ ID NO: 23905 - RNA, 9879 nt, Artificial Sequence
  derived and/or modified CDS sequence (opt11) from DENV-1__KJ189318__SS-prME
uccgugaccaugcuccucaugcugcuccccaccgcucucgcguuccacuuaaccaccagagggggcgaaccgcauaugaucguguccaagcaggagcgaggcaaaagccucuuguucaagaccagcgcuggggugaauauguguaccuugauagccauggaucuaggcgagcucugcgaagauacgaugaccuacaaguguccccagaucacggaggcugagcccgaugauguggacugcuggugcaacgcuacggacacgugggucacuuaugguaccuguagccagaccggcgagcaccggcgggacaagcgcagcguggcacuggcgccccacgugggccugggucuggaaacccggacggaaaccuggaugucauccgagggcgcuuggaagcagauacaacgcgucgagacgugggcauuacgucaccccgguuucacugugaucgcgcuguuucucgcgcacgcgaucgggaccagcauuacccaaaaggggaucauauuuaucuugcugaugcucgugacacccucgauggcuaugcgcugcguugggauugggaaccgggauuucguggaggggcugagcggggccacguggguugaugucgugcucgaacauggguccugcgugacgaccauggccaagaacaagccgacccuggacauugaacugcucaagacggaagucacaaaucccgcgauccuccgcaaacuuugcaucgaggcgaaaaucagcaauaccacaacggacagccgcuguccuacccagggcgaagccacgcugguggaagaacaggaugcuaacuuuguuugccggcgcaccuuugucgaccgcgguugggggaaugggugcggccuuuucgguaaggggagccuauuaacgugugccaaauucaaaugcgugacgaagcuggagggcaagaucguucaauaugaaaaccugaaguacuccgucauagugacaguccacacaggcgaucaacaccaggucgggaacgagacgacugagcacggcaccaucgcgacgauaacaccccaggcacccacgagcgagauccaacugacggacuacggggccuugacccuggacugcagcccccguaccgggcuggacuucaaugaaauggugcuccugacgaugaaggagaaguccugguuggugcacaagcagugguuccuagaccugccgcuacccuggacguccggggcgucgaccagucaggaaaccuggaaccgccaggaccucuuagucacguucaagacagcccacgcuaagaagcaggaggucgucgugcugggcucucaggagggggcgaugcauaccgcccuaacaggggcuacagagauacagacgagcgggacuaccacgauauucgccgggcaccugaagugccggcuaaagauggauaaacugacauugaaggggacuucguacgugaugugcaccgguucuuucaagcuagagaaggaggucgcggagacgcaacauggcaccguccuuguccaggucaaguacgaggguacagaugccccguguaagaucccguucagcacucaggacgagaagggggugacucaaaacggucgguuaauaacagccaacccgaucguaaccgacaaggagaagcccguuaacaucgagaccgagccgcccuucggugagagcuacaucguggugggagccggcgagaaagcccugaaacugagcugguucaaaaagggaucuucaaucggcaaaauguuugaggccacggcacgcggcgcucgcaggauggccauccugggugacaccgcgugggauuuuggaaguauaggcggcgucuucaccuccguuggcaaauugguucaccagguuuuugggaccgcuuacggcgugcuguucucaggugugagcuggacgaugaagauaggaaucgggauccuccugacuuggcugggauuaaacagccgauccaccagccugaguaugacuugcauagccguugggaugguaacgcuguaccucggcgucaugguucaagccgacucaggcugcguuaucaauuggaagggcagagaguuaaagugcggguccggcaucuucgucacaaacgagguccauaccuggacugaacaguacaaguuccaggcggauucaccuaaacgccugagcgcggcuaucggcaaagccugggaggagggugugugcgggauccgcucagccaccagacucgagaacaucauguggaagcagauuuccaacgagcugaaccauauuuuacucgaaaacgacaugaaauucacuguugucgucggagacgccaacggcaucuuggcccaagggaaaaagaugauucgcccgcagcccauggagcauaaguauucuuggaagucguggggcaaggccaagaucaucggcgccgauauucagaacaccaccuucaucaucgaugguccggacaccccggaaugccccgacaaccaacgggccuggaacaucugggagguugaggacuauggauucgggauauuuacgaccaacaucuggcucaaguuacgcgacaguuauacgcaaaugugcgaucaucgguugaugucugcggcaaucaaggacucaaaggcgguccacgccgauaugggcuacuggauugagagcgagaagaaugagaccuggaaacuggcaagagccucuuuuaucgagguaaaaacauguaccuggccaaagagccauacuuuauggucuaauggcgugcuggaaagcgagaugauaauacccaagauauacggcggcccgaucucucagcauaacuauagacccggcuacuuuacccagacagccgggcccuggcaccuugggaagcuggagcuggacuucgaccugugugaggguaccaccgucguuguugaugagcauugcggcaaccgcgggccgagucugaggaccacgaccgucaccggcaagaucauccacgagugguguugccgcuccugcacccugccgccccuacgguucagaggggaagacgguugcugguaugguauggagauacguccggugaaggagaaggaggagaacuugguacgcuccauggucagcgccggaaguggcgagguagacagcuucucacucggaauccugugugccucaaucaugaucgaggaggugaugcgaucccgcuggucgcggaagaugcugaugacuggcacucuggcgguuuucuugcuccucaucauggggcaguugaccuggaacgaccugauccgccuguguaucauggugggcgcgaaugccagcgacaggauggggauggguacuacguacuuagcccuuauggccaccuucaagaugcguccgauguucgcagugggccugcuguuucgccgccucacaagccgggaggucuuauuguugaccaucgggcugagccugguagcgucagucgagcuccccaacucacuggaggaacugggcgauggucucgcaaugggcauaaugaugcugaagcugcucacggaguuucagccccaccagcuguggacgacccugcucagccugacguucauaaaaaccacccugucucucgacuacgcguggaagaccacagcaauggcgcuuaguauaguuucacuguuuccgcucugccugucaacgaccucccaaaagacuacguggcugccgguucugcuagggagcuucgggugcaaaccucugaccauguuccucauuacugagaacaaaaucuggggacgcaagucauggccccugaacgaagggaucauggcgaucggcaucgucucgauucugcucucaagccuccucaagaacgacgugccgcucgccgggccgcucauagccggcggcaugcugauagccuguuacguaaucuccggguccuccgcggaccucagccuugagaaaaccgccgagguaagcugggagcaggaggccgagcauuccggcaccagccacaauauauuggucgaggugcaagaugacggcacaaugaagaucaaggacgaggaacgcgacgacacgcucaccauccuccuuaaggcaacacuccuagccgucuccggcguguaccccaugagcauccccgcgacccucuucguuugguacuucuggcagaagaagaagcaacgguccggaguguuaugggacacgcccaguccacccgagguggagagagcagugcuggacgauggcauauaccggauucugcagcgcggccugcuuggacggagucaggucggcguaggggucuuccaggacggaguuuuccacaccauguggcacguaacccgcggggcuguucuaauguaccaaggcaagcggcuugagcccagcugggcguccguaaagaaggaccucaucucuuacggagggggcuggagguuccaaggcucuuggaacacgggugaggaagugcaggucaucgcugucgagcccgggaaaaaccccaagaacguucagacgacgcccggaacguucaagacccccgagggggagguuggggcgaucgcacuagauuucaagcccggcacguccggaucuccgaucgugaaccgcgagggcaagauugugggcuuauacggaaauggggucguuacaacuagcggaacguaugugucggcuauagcacaggccaaggcgucccaggaaggaccccucccagagaucgaggacgagguuuucaagaaacgcaaccugacgaucauggaccugcacccggggucuggcaagacgcggcgguaccucccagcuauuguccgagaggcuaucaaacgaaagcugcguacucuuauucuagcuccgacccgcgugguugcguccgagauggccgaggcucuaaaggggaugcccauacguuaucagacaaccgccgucaaaagcgagcacacaggucgagagauaguggaccucaugugccacgccacguucacgaugagacuccuguccccuguccggguaccuaacuacaacaugaucauaauggacgaagcgcacuucacggaccccgccucuaucgccgcgcgaggcuacaucucaacgcggguaggaaugggggaggccgcggcaaucuucaugaccgccacgcccccggggagcguggaggccuucccccagagcaacgcggucauccaagacgaggagcgcgacaucccggaacggagcuggaacaguggcuacgacuggaucaccgauuuccccggcaagaccguaugguucgugccgagcaucaagagcgggaaugacaucgccaacugccugcgcaagaacggcaagagggucauccagcucagcaggaagaccuuugacaccgaguaucagaagaccaagaacaacgacugggauuacguagugaccaccgauaucuccgagaugggugcaaacuucagggccgaucgcgucauagacccacggcgcugccuaaagcccgugauccugaaggauggccccgaacgggucauccucgcugggccuaugcccgucaccgucgcgagcgccgcccagcguaggggucgcaucggacggaaucaaaacaaagagggagaucaguauguguacauggggcagccccugaauaacgaugaggaccacgcucacuggacagaagcuaagaugcugcucgacaauaucaacacucccgaggggaucaucccagcacuguuugagcccgagcgugaaaaguccgccgcaaucgacggggaguaccgccugcgcggggaggcuagaaagacuuuuguagaacucaugagaaggggcgaccuuccgguguggcuaucauauaaaguugccagcgagggguuccaauacagcgaccggcgauggugcuuugacggagagaggaauaaccagguccuugaagagaacauggauguggagaucuggaccaaggagggcgagcgcaagaagcugcggccgcgaugguuagacgcgcgcacuuauuccgacccccucgcccugcgggaauuuaaggaguucgccgccggccgucgcagcgucagcggagacuugauccucgagauuggcaaacugccccaacaccugaccuugcgugcacagaaugcgcuggacaaccuugugaugcuccacaauuccgaacagggcgggaaggcauacagacacgccauggaggagcuucccgauacgauugagacgcucaugcuccuagcccucaucgcaguacucaccggcggcgucacccuguucuuucugagcggaaaggggcucggcaagaccuccaucggucugcugugcgugacugcuagcucugccuuguuguggauggcaagcguagagccccacuggaucgccgcaucgaucauccuagaguucuuccuaaugguacugcugaucccggagcccgaccggcagcgcacaccccaggacaaccagcuugcuuaugugguuauaggccugcuguucaugauccugaccguagccgccaacgaaauggggcuucuggagacgaccaagaaggaccucggcaucgggcauguggcggccgaaaaccaccagcacgcgacuaugcuggacguagaucugcgacccgccagcgccuggaccuuguaugcagucgccacuacggugauaacgcccaugaugcgccauaccaucgagaacacgacagcgaacaucagcuugacggccauagccaaccaggcagcuauucuaaugggucucgauaaagguuggcccaucucuaagauggauaucggggugccccuucuggcccucggcugcuacucccaggucaauccguuaacccugacagccgccguccucaugcuggucgcgcacuaugcuaucauaggccccgguuugcaggccaaggccacccgugaagcccagaagcgcacggcugcagggaucaugaagaaccccaccgucgacggcaucguggccaucgaccucgacccagugguguacgaugcgaaguuugagaagcaguuaggccaaauaauguugcucauccugugcaccagccagauucugcuaaugcggaccacaugggcacugugcgagucaaucacccuagcgacgggaccccucacaacgcugugggagggcucgcccgggaaguucuggaauaccacuaucgccguuucuauggcaaacaucuuccggggcagcuaucucgcgggggccggccuugcguucucccucaugaaaagccugggcgggggcaggagaggaaccggugcccagggcgagacgcucggggaaaaguggaagcgccaacugaaccagcuguccaagagcgaguucaacacuuacaagcggaguggcaucauggagguugaccgcucagaagccaaggaagggcucaagcggggcgagaccaccaaacacgcugucagccgcggcaccgcgaaacugcggugguucguggagcgcaacuuagugaagccggaaggcaaaguuaucgaccugggaugcgggagaggcgggugguccuacuacugugccggccucaaaaagguaacggagguuaagggguacacuaagggcggccccggccacgaggaaccaauacccauggcgaccuacggguggaaccuggugaagcugcacagcgggaaagacgucuucuucaugccaccagagaagugcgacacgcugcuuugcgacaucggggagucaagcccgaaccccacaauugaggaagggaggacacugcgugugcucaagauggucgagcccuggcugcgcgggaaccaauucugcauuaagauacugaauccguauaugccuuccgugguggagacuuuggagcagaugcagaggaagcauggcgggauguugguccgcaacccucugucaagaaacuccacacacgagauguauugggucagcugcggcacgggaaauaucguuucugccgucaacaugaccagccgcaugcucuugaaucgauucacaauggcccaccgcaagcccaccuuugaacgcgacgucgacuugggggcgggcacccggcacguggcaguagagcccgagguggccaaucucgacaucauaggccagcgcauagagaacauuaagaaugagcauaaguccaccuggcacuacgacgaggacaacccguacaaaacaugggcuuaucauggcuccuaugaggugaaacccuccgggagcgcguccaguauggugaacggaguuguacggcugcugaccaaacccugggacgucauucccauggugacgcagaucgcgaugaccgauaccaccccguuuggacaacagcgagucuuuaaagagaaaguggacacgcggacgccacgagcaaagcggggcacaacucagaucauggagguuacggccaaguggcuguggggguuccugucccgcaauaagaaaccgcggaucuguacucgcgaagaguucaccagaaaagugcgcucuaaugccgcaaucggggcggucuucguggacgagaaccaguggaacagcgccaaagaggcgguggaggaugagagauucugggaccuggugcaccgcgaacgagaacugcacaagcagggcaaaugcgcgaccugcgucuacaacaugauggggaaacgggagaagaagcugggcgaguuugggaaggcgaagggcucacgggcaauaugguacauguggcugggcgccagguuccucgaguucgaggcccuuggauucaugaacgaggaccacugguuuagucgggagaacucuuugagcggcguggagggggagggacuccauaagcuggguuacauccugcgagauaucuccaagaucccgggcggcaacauguacgcugacgacacggccggaugggauacccggaucacggaggacgaccugcagaaugaggccaagaucaccgacaucauggagcccgaacacgcgcugcucgcaacuagcaucuuuaagcucaccuaccagaacaagguagugcgcguccagagaccugccaaaaacggcaccgugauggacgugaucucuagaagggaucagcgggggagcggccaagucggcacuuaugggcugaacacguuuaccaacauggaagugcaauuaauccgucagauggaauccgaaggcauauuucuccccuccgagcuggagaccccgaaccuggccgaaagggugcucgauuggcuggagaagcacggggcggaaagguuaaagcgaauggccaucuccggggacgacugcgucguuaagccuauagacgaccgcuucgccacggcccucaccgcucugaacgacauggggaaaguaagaaaagacauaccccagugggagcccagcaagggcuggaacgauuggcagcagguaccguucugcucccaccacuuccaccagcugaucaugaaagacggccgcgagaucguggugcccugccggaaccaggaugagcuugucggcagagcccgagucagccagggcgcaggguggucucugcgcgagacggcaugccugggaaagagcuaugcacagauguggcagcuuauguacuuccaucggagagaccugcggcuggccgcaaacgcuaucugcuccgcggugcccgucgacugggugcccaccagcagaaccacguggucuauccaugcgcaucaucaguggaugacuacugaagauaugcuauccguauggaaucgcguauggaucgaggagaauccguggauggaagacaagacucacguuagcucgugggaggaagugccguaucuggggaaacgcgaagaccaguggugcgggagccuuaucggccucacagccagggcgacaugggccaccaacauccagguggccauuaaccagguucgccgccugauagguaacgaaaauuacuuagacuacaugaccucaaugaagcgauuuaaaaacgagagcgacccagaaggagcguugugguga

SEQ ID NO: 23906 - RNA, 9879 nt, Artificial Sequence
  derived and/or modified CDS sequence (opt11) from DENV-1__KJ189319__SS-prME
ucgguaaccaugcuacugaugcuacuaccgacggcacuagcuuuucaucuuaccaccaggggaggagaaccccacaugauaguauccaaacaagaaagagggaaaucgcuacuguucaaaacaucggcgggaguaaacauguguacuuuaauagcgauggaucugggcgaacucugcgaagacacuaugaccuacaaaugcccgcaaauuacggaggccgagcccgacgacguagacugcuggugcaaugccacagacacaugggucaccuacgguaccugcucgcaaaccggcgagcacagacgcgacaaaagaagcguagcgcuagcaccccacgugggacuuggucucgaaacgcggacagagaccuggauguccucagagggagccuggaaacagauacagcgugucgaaacgugggcacuacgacaucccggcuuuacaguaauugcucuauuccuugcccaugcaauagguacaucgauaacccaaaaaggcauaaucuuuauacucuuaaugcuggugacccccucgauggccaugagauguguaggcauaggaaaccgugacuucgucgaaggacuaucaggagccaccugggucgauguaguccuggaacacggaagcugcguaaccacgauggccaaaaauaaaccaacccuagacauugagcuacuaaaaacagaaguaacgaacccagcgauacuacguaaacugugcauagaggcaaaaauaagcaacacgacuacagauucccgcugcccaacucagggggaagccacgcuagucgaagaacaggaugcaaacuucguaugucgccggacauuuguugaccgcggauggggcaacggcuguggcuuguucgggaaaggcagccuccugacuugcgcaaaauucaaaugcguaaccaaauuagaggguaaaauuguccaauacgaaaaccugaaauacagcguaaucguaacuguacacaccggagaccagcaucaagucgguaaugaaacaacggagcauggcacgauagccaccauaacaccacaggccccuaccuccgaaauacagcucacugacuacggcgcacucacacucgacuguucaccccgaacaggcuuagacuucaacgaaauggugcuccuaaccaugaaggaaaagagcuggcucgugcacaaacaaugguuccuggaucugccgcuacccuggacgagcggcgccucgacaagccaagagacauggaaccgccaggaccuguuggucacguucaaaacugcccaugcaaagaaacaagagguagucgugcuaggcucccaagagggcgcgaugcauaccgcacugaccggagccacugaaauacaaacuuccggcacaacgaccauauuugcggggcaccuaaaaugucgacugaaaauggacaaacuaacacuaaagggcacaagcuacgugauguguacggguagcuucaagcucgagaaagaaguagcagaaacgcaacacggaacagucuuaguucagguaaaauacgagggaacagacgcaccuugcaagauaccguuuucaacccaagacgagaaagggguaacucagaacggacgucuaaucaccgcuaacccgauaguaacugacaaggagaagccuguaaacauagaaaccgagccgccguuuggcgaaagcuacauagucgugggggccggggaaaaggcccugaaacuguccugguucaagaagggcagcaguauaggcaagauguuugaggcaaccgcacgcggagccaggcguauggcaauccucggagacacagcaugggacuucggaucaauuggcggaguguucaccagugucggaaaacugguacaccagguguucggcaccgcauauggaguacuauucuccggcgucucauggacuaugaaaaucggaauaggaauccuccuaaccugguugggacucaacucccgcuccacaucccucucgaugaccuguauagccguagggaugguaacacucuacuuaggggucauggugcaagcugauagcgguugcguaauaaauuggaaaggacgagaacugaaguguggauccggaauauucgugaccaaugaaguacauacguggacagaacaguacaaauuucaggcggacucucccaagagacuaagcgccgcaaucgggaaggcgugggaagaagggguaugcgggauacgcuccgccacccgccuagagaacauuauguggaagcagaucucaaaugaacuaaaucacauacuccuggaaaacgacaugaaguucacaguagucguuggagacgcuaacggaauacuugcgcagggaaagaaaaugauacgcccccagccaauggaacacaaauacuccuggaagucaugggggaaagcuaaaauaauaggcgcagacauucaaaacaccacguucaucaucgacggucccgacacaccggaaugccccgacaaccagcgagccuggaacauaugggaaguagaggacuacggguucgggauauucaccaccaacaucuggcugaaguuacgagacucguacacccagaugugugaccaucgcuugaugucggccgcaaucaaagauuccaaagcaguucaugcagacaugggcuacuggaucgaaagcgaaaagaacgagacguggaaacuugccagggccuccuuuauagaagucaaaacuugcacauggccaaagagccacacgcuauggucgaacggaguacuagagucagagaugaucaucccuaaaaucuaugggggccccauaucucagcacaacuaccgaccggguuauuucacccaaacugcaggcccuuggcaccugggaaaacuggaacucgacuucgaccuuugugaagggaccacagugguaguagacgagcacugcggaaaccgcggcccaucccuucggacaacaacagucacgggcaagauaauccaugaguggugcugccgcucaugcacacuaccaccccucagguucagaggggaagacgggugcugguacggaauggaaauacggccagucaaagaaaaagaggagaaccucguacgcuccaugguaucagcggguucaggagagguugacucuuucagccuaggcauacucugcgcaucgaucaugaucgaggaggucaugagaucgcgauggucgaggaaaaugcucaugacgggaacauuggcgguauuucuucugcuaaucaugggucagcuaacauggaacgaccucauacgcuuaugcaucauggucggagcaaacgcuucggaccggauggggauggggacgaccuaucuugcacuaauggccacauucaagaugagaccuauguucgccguggggcuacuguuuaggcgacuaacaagccgagaaguccucuugcucacaauaggccucagccucgucgccucgguggaauuaccaaacagucuugaggaacucggcgacggacuagcaauggggauaaugaugcugaaacuacugacggaguuccaaccucaccaacuauggaccacccuucuuuccuugacuuucaucaaaacgacacugucccucgacuacgcauggaagaccaccgcgauggcccucaguaucgucucacuuuuuccacuaugccuuucaacuacuucccaaaagacaacaugguugcccguccuacugggcagccuugguuguaaaccacucaccauguuucuaauaaccgagaauaagauauggggacggaaaaguuggccgcuaaacgaaggaauaauggccauugggauuguuagcauccuacuaucgucccuacucaaaaacgacgugccguuagcaggcccgcuaaucgcugggggcaugcugauagcaugcuacguuauaagcggaagcuccgcagaccuaagccuggaaaaggccgccgagguauccugggaacaagaagccgagcauuccggaacuagccacaacauccuaguagaaguccaagacgaugguacaaugaaaauaaaggacgaagaacgggacgacacgcuaaccauacuacuaaaggccacccuccuagcggugucgggcguguacccgaugucgauuccggcaacgcuguucguaugguauuuuuggcaaaagaagaaacaaaggucaggggugcucugggauacgccgaguccacccgaagucgaacgcgcaguucuggacgacggcaucuaucgaauauugcaacgaggucuccucggacggucccaggugggaguuggcgucuuccaagauggaguauuccacacaauguggcaugugacucggggcgcuguacuaauguaccaggggaaacgucuagaaccuuccugggcuagcgucaagaaagaccugaucagcuauggaggaggguggcgauuccaaggauccuggaacacuggagaagagguacaaguaauugcagucgaacccggcaaaaacccuaaaaacguacaaaccacaccaggaacguucaaaacccccgagggcgaggucggcgccaucgcacuugauuucaagccgggaacgagcggcucaccgaucgucaauagggaggggaagauugucggccucuacggcaacggaguugucaccaccuccggaacauacguaucagcuauagcucaagccaaagccucacaggaagggccacugccugaaauagaagacgaaguuuucaagaaaaggaaccuaacaaucauggacuuacaccccggcaguggcaaaacgcgccguuaccugccagcgaucguccgugaagcgauuaaacggaaacuacgaacauugauacuagcccccaccaggguaguagccucggaaauggcggaggcgcuaaaggguaugccaauacgauaccagacaacagccguuaaauccgagcacaccggaagagaaauaguggaccuaaugugccacgcaacuuucaccaugcguuuacuuucgcccguucgagucccgaauuacaacaugauaauaauggacgaggcacacuuuacagauccggcgucaauagcagcuagggguuauaucagcacccgggugggcaugggggaggcggcugcgaucuucaugacagcaacaccacccgggaguguagaagccuucccgcagagcaacgccguaauccaggacgaagaacgggauauucccgaaagaagcuggaauagcggguacgauuggauaacugacuuccccggcaagacggugugguucgugccuucuauuaaauccggaaaugacaucgcaaauugccugcggaagaacggcaaacgcgugauccaacuguccagaaaaacauucgauacagaguaucagaaaaccaaaaacaaugauugggacuacgucguaaccacugauaucuccgaaaugggcgcgaacuucagggccgaccgggugaucgacccacgacgaugccugaaacccguaauccuuaaggaugggccugagagagugauccucgccggcccuaugccagugacaguagcuagcgccgcccagcggcgaggacgcaucggcagaaaccagaacaaggaaggagaccaguauguauacaugggacagccgcuaaacaacgacgaagaucacgcccacuggacagaagccaaaaugcugcuggacaacaucaacaccccggaagggaucauaccggcccuguucgaaccugaaagggaaaaaucagcggcuaucgauggggaauacagacuaagaggcgaagcccgaaaaacguuuguagaacuaaugcggagaggcgaccuaccaguguggcugucauacaaagucgcgagcgaaggcuuccaguacucagacagaaggugguguuuugacggagaaaggaacaaucagguacucgaggaaaacauggacgucgaaauauggacuaaggaaggcgagagaaagaaacuccgaccacgguggcucgacgcgagaacuuacucggauccgcuagcucuacgcgaguucaaggaguucgccgccggcagaaggucggugucuggggauuugauucuagagaucggcaagcucccgcaacaucuaacguuaagagcccaaaacgcccuggacaaccuugucauguugcacaacucugaacaaggaggcaaagccuaccgccacgcaauggaagaacuuccggacacaaucgagacgcuuaugcuccucgcccucauagcgguacuaacgggagguguaacucucuucuuccugagcgggaagggccuuggaaaaacgucaaucgggcuacuaugugugaccgcaagcagcgcgcuacuguggauggccucagucgagccgcauuggaucgcagccagcaucauauuggaguuuuuccucaugguacuucuaauaccugaaccggaccggcagagaacuccgcaagauaaccaacuagcauacguagugauuggacuccucuucaugauacucacgguagcggccaaugaaaugggccuccuugaaacaacaaagaaggacuuaggcauaggccacguggcagccgagaaucaucaacaugcgacuaugcucgacguagaccuacgcccugcaucggcauggacccuguacgccguagcgacaacagucauaaccccuaugaugaggcacacaaucgagaacacgacggccaacauaagccucacagcaauagcaaaccaagcggcgauucuuauggggcuggacaagggguggccaauauccaaaauggacauaggcguaccgcugcucgcguuaggaugcuacucgcaaguuaaucccuuaacacuuaccgccgcgguacuaaugcuugucgcacauuacgccauaaucggacccgggcuacaggccaaggcaacgagggaagcccagaaacgaacggcugcugguaucaugaagaaccccacggucgacgggaucgucgcaauagaccuugaccccgucguguacgacgcaaaauuugaaaaacaguuaggucaaaucaugcugcuaauacuaugcacuucacagauacugcuaaugcgcacaacaugggcacuaugcgaauccauuacgcuagccacaggaccccucaccaccuugugggaggguagcccugggaaguuuuggaacaccacaaucgccgugagcauggcaaacauauuccgagggucauaccuagcgggugcgggccucgcauuuagccugaugaaaucccucggaggagggcggagggggacgggcgcgcagggugagacacugggcgaaaaauggaagagacaguuaaaccaacucagcaaaagcgaguuuaauaccuauaaaaggagcggcauaauggaaguagaccgcucagaagcaaaagagggucugaagcggggagaaacuaccaaacaugcggucaguagggggacugccaaacuaaggugguucguagagcgcaaccuggucaaaccagaaggaaaaguuauagaccuaggaugcggacgcggaggguggucguacuacugcgcgggccucaagaaagucacagaaguaaaaggguacacuaaaggcgggcccggccacgaagaacccauacccauggcaacguauggauggaaccugguaaagcuccacucggggaaagacgucuuuuucaugccuccugagaagugcgauacacuccucugcgacaucggagaaucgucaccgaacccaacgaucgaggaagggcgcacacuacgaguccuuaaaaugguagagccguggcuccgagggaaccaauuuugcauaaaaauccucaauccguauaugcccagugugguagaaacgcuagaacaaaugcaacgaaaacacggcgguaugcucguacgaaacccucucucgaggaacagcacucacgaaauguauugggugucaugcggcaccgggaauauaguaucggcggucaacaugaccucgcguaugcugcucaaccgguuuacgauggcccacagaaagccgacguucgagagggacguagaccugggugcagguacaagacacgucgccguagaacccgagguggcaaaccuagacaucauaggucaacggaucgaaaauaucaaaaaugagcacaaaagcacauggcacuacgaugaagacaaccccuacaaaacgugggcguaucauggaagcuacgagguaaagccgucgggaagcgcaucaucgaugguaaacggagucguucgccuacucacgaaaccuugggacgugauccccaugguuacacagauugccaugaccgauacgaccccauuuggacaacaacgcgucuuuaaagaaaaaguagacacaaggacaccgcgugcaaagcgggggacgacccaaaucauggaagugacagcaaaauggcuauggggauuucugucacgcaacaagaagccccgaaucugcacccgggaggaauuuacgcgcaaggugagaagcaaugccgcuauaggagccguauucguagaugaaaaccaauggaacucagccaaagaggcuguagaggacgagagauucugggaucuagugcaccgugagcgcgaauuacacaaacaggguaaaugcgcuacgugcgucuauaauaugauggggaagcgggaaaagaaauuaggggaguucggcaaagcgaagggcucgagagcuaucugguacauguggcucggcgcacgcuuccucgaguucgaagcucucggcuucaugaaugaggaccauugguucaguagagaaaauucacugucaggcguagagggcgaagggcugcauaagcucggcuacauccugcgggauaucuccaagauuccgggagggaacauguacgccgacgacacagcggggugggacacccgaauaacagaggacgaccuacaaaacgaagccaaaauaacagacaucauggaaccggagcaugcacugcuagcuacgagcauuuuuaagcucacuuaccagaauaaggucguacgggugcagagaccggcuaaaaauggcaccguaauggacgucaucucaaggcgggaucaaagaggcucgggacaaguggggacauacggacuaaauacuuuuacgaacauggaaguccaacuaauuagacagauggaguccgaaggaaucuucuuaccaucagaauuagaaaccccuaaucuggcagagaggguacucgacuggcuugaaaaacacggggccgaaagacucaaacgaauggcuauauccggagaugacugugucguaaaaccaauugacgauagauucgcuaccgcccuuacagccuuaaacgauaugggcaaaguucgaaaagacauaccgcaaugggagccgucgaagggcuggaacgauuggcaacaagugccuuucugcagccaccacuuucaccagcucauaaugaaagacgggagggagauagucgugccgugccgcaaucaagaugagcuaguaggaagggcgcgggucucacagggagcaggguggucuuugagagaaacugcgugccugggcaaaagcuacgcacagauguggcaacuuauguacuuccaccggcgggaucuacggcuugcagcuaacgccauauguucagcaguaccuguggauuggguaccaaccagccgaacuaccuggucgauacacgcccaccaccaauggaugacaaccgaagacaugcuuucuguguggaauagagucuggauugaagaaaauccauggauggaagacaagacccacguuucgagcugggaagagguaccauaucugggaaaacgagaagaccaguggugcggaucacucaucggacugacugcgcgcgccaccugggcgaccaacauccagguagcgauaaaucaggucaggcgccuaauaggaaacgaaaacuaccuagacuacaugacauccaugaaacgauucaagaacgaauccgaucccgaaggggcguuaugguaa

SEQ ID NO: 23907 - RNA, 9879 nt, Artificial Sequence
  derived and/or modified CDS sequence (opt11) from DENV-1__KJ189320__SS-prME
agcgugaccaugcuguugaugcugcuaccgaccgcccuggcguuccaccugaccacgcggggcggggagccgcacaugaucgugucuaagcaggagcgcggcaagagccuccuguucaagaccagcgcaggggugaacaugugcacucugaucgccauggaccuaggcgagcuaugugaggacacgaugaccuacaagugcccccagaucacagaggccgaaccggacgacguugauugcuggugcaacgcaaccgauaccugggucacauacgguacgugcagccagacgggugagcaccgacgggauaagcgcuccgucgcccuagccccucacguaggccugggacucgagacgcggaccgagacuuggaugagcuccgagggggccuggaagcaaauccagcgcguagagaccugggcccugcggcaucccggauucacugugaucgcccuguuccucgcacacgccaucggcaccucuauuacucagaaggggaucaucuucauucuacugaugcucgugacucccuccauggcaaugcgcugcgugggaauuggcaaccgggacuucguggaggggcucaguggcgcgacguggguggaugucguucuggagcacgggagcugcgugacuaccauggccaagaacaagcccacccuugacaucgagcugcugaagacggaggucaccaaucccgcaauccuccguaagcugugcauugaagcaaagaucagcaacaccacgacggacucccgcuguccaacccagggcgaggcuacccugguggaggagcaggacgcuaacuucguuugucgccgaaccuucguugaucgaggcugggggaacgggugcggcuuauuugggaagggcagccugcugacgugcgccaaguucaagugcgugaccaagcucgagggcaagaucgugcaguacgagaaccucaaguacuccgugauugugaccgugcauacaggcgaccagcaccaagucggaaacgaaacaaccgagcacgguaccauagcgacuaucacgccccaagcccccacguccgagauccagcugaccgacuacggagcccucacacuggauugcucuccacguaccggccuggacuucaaugagauggugcuccugacaaugaaggaaaaguccuggcucguccacaagcagugguuucucgaucuaccacugcccuggacuuccggggcguccacgagccaggagaccuggaaccgccaggaccuccuggugacguucaagacagcucaugcgaagaagcaagaggugguagugcuagguucucaggagggcgcaaugcacacagcccucaccggggccacggagauucagacgagcggcaccaccacgauuuuugccgggcacuugaagugccgucugaagauggauaaguuaacccugaagggcaccaguuaugugaugugcacggggaguuucaaacuggaaaaggaagucgcggagacccagcacggcacugugcuagugcaggucaaguacgagggcaccgacgcccccugcaagaucccauuuuccacccaggaugagaagggggugacgcagaauggucgucucaucacugccaacccgauugugaccgacaaggagaagccagucaauauugagacggaacccccuuucggggagagcuacauugugguaggcgccggcgaaaaggcgcucaaguuguccugguucaagaaggggagcuccaucggcaagauguuugaggccacggcccgcggggcccgccggauggcuauccucggcgacaccgcuugggacuuuggcagcaucggaggcgucuuuaccuccguugggaaacuggugcaccaagucuucggaacggccuacggggugcuguuuagcggcgugucauggacgaugaaaaucggaauuggcauccuccuuacauggcugggucucaacucacggaguaccagucuguccaugaccugcaucgcagucggaauggucacucuauaucucggcgugaugguccaagccgauagcgggugcgugaucaauuggaagggccgcgagcugaagugcggauccgguauauucgugaccaaugaggugcacacuuggaccgaacaguacaaguuucaagcagacagcccgaagcggcugagugcggccaucggcaaggccugggaggaaggagugugcgguauccgaagugcaacccggcucgaaaacaucauguggaaacagaucagcaaugagcugaaccacaucuugcucgagaaugacaugaaguuuacggugguggugggggacgccaauggcaucuuggcccaggggaagaagaugauccgcccacagcccauggagcacaaguauucauggaaguccuggggaaaggccaagaucaucggagcagauauccagaacacaacguucaucauagauggacccgacaccccggaaugccccgacaaccagagggcguggaacaucugggagguggaggacuacggcuucgggaucuucacgacuaauauuuggcugaagcugcgagauuccuacacccagaugugcgaucaccggcucaugagcgcggccaucaaggacuccaaggcgguccaugccgauaugggcuacuggaucgagagcgagaagaacgagacauggaaacuagcccgugcguccuuuaucgagguuaagacgugcaccuggcccaagagccacacgcucugguccaacggcguccuggagagcgagaugaucauuccuaaaaucuacgggggcccgauuucccagcauaauuaccggcccggguacuucacccagaccgcgggaccauggcaccuggggaagcucgagcuggacuucgaucugugcgaggggaccaccgucguaguagacgagcacugcggcaaccgcgggccaucccuccggaccacuaccgucaccggaaagauuauccaugaguggugcugccgcuccugcacccugccuccccugcgguuucgcggagaagacggcugcugguacgggauggaaauccggccggucaaggagaaggaagagaaccucgugcgcagcauggucuccgcugguucgggcgagguggacagcuucucccuggggauccugugcgcaucaaucaugaucgaggaggucaugagaucccgguggagccggaagaugcucaugacaggcaccuuagcugucuucuuacuucugauuauggggcagcugaccuggaacgaucucauccgccugugcauuauggugggugcgaacgccuccgaccgaaugggaaugggaaccacguacuuagcccucauggccaccuucaagaugcggccuauguucgccguaggacugcuguuccgccgguuaaccagcagagagguccuccuucucacaauuggguugucccuaguggcgagcguagagcuccccaacucccuggaggaacugggcgacgggcucgccaugggaaucaugaugcuaaagcuacucacggaauuucagccgcaccagcuguggaccacgcugcucagccugaccuucauaaagaccacccugagucucgacuaugccuggaaaacaaccgccauggcgcugagcaucgucagucuguucccuuugugccuuucgacgacaucucaaaagaccaccuggcuaccgguccugcugggaagcuucgggugcaaaccccugaccauguucuuaaucacggagaauaaaauaugggggcggaaauccuggccgcuuaacgaggggauuauggccaucggcaucgucagcauccugcucucaagcuuacugaagaacgacgugccccucgcggggccgcuuauagcggguggcaugcugaucgccugcuacgugauuagcggguccagcgcugaccucucccuagagaaggccgcagaggucagcugggagcaggaagcagagcacaguggaaccagccacaauaucuuaguggaggugcaggacgacggaaccaugaaaaucaaagacgaggagcgcgacgacacccucacaauauuacuaaaggcgacccuccuggcggucuccggcgucuacccaaugagcaucccggccaccuuguucgugugguacuucuggcagaaaaagaagcaacgauccggcguucucugggauacccccagcccccccgagguggaacgggccgucuuagaugacggcaucuauagaauccugcagagaggucuguuaggccggucccaggucggcguggggguguuccaggacggcgucuuccacacgauguggcacgugaccagaggugccgugcugauguaucaggggaagcggcuggagcccagcugggccucuguuaagaaagaccucaucagcuacggcggggguuggcgcuuccaggggaguuggaacaccggcgaggagguccaggucaucgcgguggaacccgggaagaacccgaagaacgugcagacaacgcccggcaccuucaagacacccgagggcgaggugggagcgauugcccuggacuucaagcccgggacaagcggguccccgaucgucaaccgugaggguaagauaguuggccuguacgggaacggcguggucacgaccagcggaaccuacgugucggccaucgcccaagcuaaggccucacaggagggcccccuaccagagaucgaggacgagguauucaaaaagcgcaaccugaccauuauggaccuccacccggggaguggcaagacacggcgcuauuugcccgccaucguccgcgaggccaucaagcgcaagcugcggacacucauucuugcgcccacccggguggucgccuccgaaauggcggaggcucucaagggcaugcccauccgcuaccagacuacagcggucaagagcgagcauacgggacgagaaaucguggaccugaugugccacgccacuuucacgaugcggcuccuguccccagugcggguccccaacuacaacaugauaaucauggacgaggcccacuuuacugaccccgcuagcauagccgcccgugguuacauuaguacgcggguggggaugggagaggccgcugcuaucuucaugacggcuacgccgccagggagcguggaggccuucccccaguccaacgcggucauccaggaugaggagcgugacauccccgagcggagcuggaauaguggcuacgacuggaucacggacuucccaggcaaaacagucugguucguaccgagcaucaaguccgggaacgauauagcuaacugccugcgcaagaauggcaaacgggucauucagcucagccgaaaaacauuugacacggaauaccagaagacgaagaacaacgacugggacuacguggugaccaccgacauauccgagaugggagccaauuuucgggccgacagagucaucgacccgcggcgcugucugaaacccguuauccugaaggacggccccgagcguguuaucuuagcggguccgaugcccgucaccgucgcuagcgcggcccagcgacggggccgcaucggccggaaccagaacaaagagggcgaccaguacguguacaugggccagccgcugaacaacgacgaagaucacgcccauuggacagaggccaaaaugcugcucgacaacaucaauacgccugaggguaucauaccggccuuauucgagcccgaacgcgagaaguccgccgccauugacggcgaauaccgccuacggggcgaggcccgcaagaccuucgucgagcucaugcggcgaggcgauuugcccguguggcuguccuacaagguagccuccgagggcuuucaguauagcgaccggaggugguguuucgacggggaacggaacaaccaggugcucgaggagaacauggacguagaaaucuggacaaaagagggagagcggaagaagcuccggccgcgcuggcuagacgcccggaccuacagcgacccucucgcccuccgcgaauucaaggaauucgccgccggacggagaagcguaaguggcgaucugauacucgagauugguaagcugccccagcaccugacgcuccgugcgcaaaacgcccucgacaaccugguaauguuacacaacagugagcaaggcgggaaagcuuaccgccacgccauggaggagcuaccugacaccauugaaacccugaugcuacuggcacugaucgcagugcucacugggggggucacccuuuuuuuccugagcggaaaaggccucggcaagaccuccaucggguuguugugcgugaccgccagcuccgccuuacuguggauggcuagcgucgagccccacuggauagccgccuccaucauccucgaguuuuuccucaugguccugcugauaccggagcccgaccggcagcgcacgccccaagauaaccagcucgccuacgucgugauaggacugcuguuuaugauacucacggucgcugccaaugagaugggacuccuggagaccacuaagaaggaccucggaaucggucacgucgcugcagagaaucaucaacacgccacaauguuggacguggaucuucggccggccagcgcuuggacgcucuacgcggucgcaacuaccgugauaacgcccaugaugcgccauacuaucgagaacacaaccgcuaacaucagccugacagccaucgccaaccaggcggcaaucuugaugggccucgacaagggcuggccuauaaguaaaauggacaucggaguaccccugcuggcccucgggugcuacucccaggucaauccgcugacgcugaccgccgcgguacugauguugguggcccacuacgccaucaucgggcccgggcugcaggcaaaagcgaccagggaggcgcaaaagagaaccgccgcagggaucaugaagaaccccacagucgauggcaucguggccaucgaccucgauccgguggucuacgacgcuaaguuugaaaagcagcuggggcagaucaugcugcuaauccugugcacgucucagauccuccucaugcguacuacgugggcguuaugcgaaucgaucacacuggcaaccgggccccucacgacacuuugggaaggcagcccagggaaguucuggaacaccaccaucgccguaucaauggccaacauauuccgaggcagcuaucuggcgggcgcggggcucgccuucucgcugaugaaguccuugggugggggccgcaggggaaccggcgcccagggcgagacccucggugagaaguggaagcgccaacugaaccagcugucgaagagcgaguucaacacauacaaacguagcggcaucaccgagguggaccgcagugaagccaaggaaggccucaagcgaggcgagaccaccaagcacgcggucagccgcgguacugccaagcugcggugguucguggaacggaaccuggugaagcccgagggcaagguaauagaccuaggcugcgggcggggugggugguccuacuacugcgccggcuuaaagaaggugacggaggugaaaggguauaccaaagggggcccgggucacgaggagccaaucccaauggccaccuacggauggaaccuuguuaagcugcacucagggaaagacguguucuucaugccgcccgagaaaugugacaccuuacugugcgacaucggcgaguccagcccgaauccaacgauugaggagggccgcacccugcgugucuuaaagauggucgagccauggcugcgaggcaaccaguucuguauuaagauccuuaaucccuacaugccgucagucguggagacauuggaacaaaugcagcgcaagcauggaggaaugcugguccgcaacccccuuagucguaacuccacccaugagauguauugggugagcuguggcaccgggaauaucgugagcgccgucaauaugaccucgcgcaugcugcugaaccgguucacgauggcgcaccggaagcccacguuugagcgcgacguggaccugggcgccgguacgcggcacguggccgucgagcccgagguagcaaauuuagacaucaucggacaacgcaucgagaacaucaagaacgagcauaaauccacauggcacuaugacgaagacaauccauacaagacgugggccuaccauggcaguuacgaagugaagcccuccgguagugcgucuagcauggucaacggcguugugcggcugcugaccaagcccugggacgucauccccaugguaacgcaaauagccaugaccgacacuacgccuuucggccagcagcgcgucuucaaggagaagguggacacgcggacgccccgcgccaagcgggggaccacccagauaauggagguaaccgccaaauggcuuugggguuuccuuucacgcaacaagaagccccggaucugcacucgcgaggaauucacccggaagguccgcagcaacgccgcgauaggggccguguucguagacgaaaaucaauggaacuccgccaaggaggccguggaggacgaacgguucugggacuuagugcauagagagcgggaguuacauaagcagggcaaaugugcgaccugcguauacaauaugauggggaagcgcgagaaaaaguugggagaguucgggaaggcaaagggcucccgggccauaugguacauguggcugggcgccagauuccucgaguucgaagcucugggguuuaugaacgaggaccacugguuuagccgggaaaacuccuuaagcgguguagagggggagggccuccacaagcugggguacauccuacgcgacauaagcaagaucccuggcgggaacauguacgcggaugacacggcgggcugggacaccaggaucaccgaggacgaccuccagaacgaggccaaaaucacagauaucauggagcccgagcacgcacugcuggcgaccucgauauucaaguugaccuaccagaauaagguggugcggguacagcguccagcgaagaacgguacagugauggacgugaucucucggagggaccagcgggggagcggccaggucggcaccuacggguugaauacuuuuacgaacauggagguacaauuaauccgccaaauggaguccgagggcaucuuccucccaagcgagcuggagacuccgaaucucgcagaaagagugcucgacuggcuggagaagcauggggccgagcggcucaagcggauggccaucuccggugacgauugcguggugaaaccaauugaugaccgguuugccaccgcgcucaccgcucuaaacgacauggguaagguccggaaggacaucccccagugggagcccaguaagggcuggaaugacuggcagcaagucccauucugcucccaucauuuucaccaacugaucaugaaggacggcagggagauugugguccccugccggaaccaggaugagcucguugggagggcccgggucucucagggcgccggguggagucugagggagacggccugccuggguaagucauacgcacagauguggcaguuaauguacuuccaccggcgcgacuuacggcuggccgccaacgcaaucugcuccgcggugcccgucgauuggguucccaccagccgcaccacuuggagcauacacgcccaccaccaauggaugacgacagaagacaugcucucuguguggaacagagucuggaucgaggagaaccccuggauggaggacaagacccacgucagcuccugggaagaagugcccuaccucggcaagcgugaggaccaguggugcggaagccugaucggccuuaccgcccgcgcaacgugggccaccaauauacaggucgcgaucaaccaggugcggaggcugauugggaaugagaacuaccuggacuacaugacuaguaugaaacgguuuaagaacgaaagcgaccccgagggugcccucugguga

SEQ ID NO: 23908 - RNA, 9879 nt, Artificial Sequence
  derived and/or modified CDS sequence (opt11) from DENV-1__KJ189323__SS-prME
agcgugacgaugcugcucauguugcugcccaccgcucucgcauuccacuugaccacccgggguggcgaaccccacaugaucguguccaagcaggagcggggcaaaagccugcuguucaaaacuucugccggggugaacaugugcacccugaucgcgauggaccugggcgaacucugcgaggacacgaugaccuacaaaugcccgcagauuaccgaggccgagccugacgacguggacugcuggugcaacgccaccgacacgugggucacguaugggaccuguucacagacaggcgagcaccggcgggacaagcggucgguggcccuggcuccacacguagggcuggggcucgagacgaggaccgagacuuggaugagcucugagggcgccuggaagcagauacagcgagucgagacgugggcccugcgccaccccgguuucaccgugaucgcccuguuccucgcgcacgccauugggaccuccaucacccagaaagggaucaucuuuauccugcuuaugcucgugaccccuucaauggccaugcggugcguugggaucgggaaucgggacuucguggaggggcugucaggcgccaccuggguggacgucguccuggagcacggguccugugugacuacuauggccaagaacaagcccacccucgacaucgagcugcugaagacggaggucaccaacccugcuauccucaggaagcugugcaucgaagccaagaucagcaacacuacgacggacagucggugcccgacacagggcgaggccacgcugguagaggagcaggacgcuaacuuugugugcagacggaccuuuguagaccgcggaugggggaaugggugcggucucuucggaaaggggaguuugcugacgugcgccaaauucaagugcgugaccaagcucgagggcaagaucgugcaguacgagaaucugaaguacagcgucaucgugacaguucacacuggcgaccagcaucaagucgguaacgagacgaccgagcaugguacuaucgccacaaucacgccccaggccccaacgagcgagauccagcugaccgacuauggggcccuuacccuggacugcagcccacggacgggccuagacuucaacgagauggugcuccugacaaugaaagagaaguccuggcugguacacaagcagugguuccuagaccugccccugcccuggaccuccggggccuccaccagccaggagaccuggaaucgccaagaccuacuggugacguucaaaacugcccacgcgaagaaacaggagguggucgugcugggcucccaagagggcgcgaugcauaccgcacucaccggcgccacggagauccagaccucgggcacuaccaccauuuucgccgggcauuugaagugccggcucaagauggacaaguugacacugaaggguaccuccuauguaaugugcaccggcccauucaagcuggagaaggaggucgcugagacgcagcauggcaccgugcugguacaagucaaguacgaggguacugaugccccuuguaagauuccguucagcacgcaggacgagaagggcgucacucagaaugggcgucucauuaccgccaaccccauugugaccgauaaggagaagcccguaaauaucgagaccgagccuccauucggggagaguuacaucguggugggcgcuggugagaaggcccugaagcugucgugguucaagaaggggucaaguauaggcaagauguucgaggccacagcccgcggggcaaggcggauggcgauccucggcgacaccgcgugggauuucgguuccaucgguggcgucuucaccucgguggggaaguuggugcaccagguuuucggcaccgcuuacggaguguuguucuccggcgugucguggacgaugaagauagggaucggcauccuccugaccuggcugggccucaacucacgcagcaccuccuuaagcaugaccugcaucgccguagggauggugaccuuauacuugggcgugaugguccaggcugacuccgggugugugaucaacuggaagggccgcgagcucaaaugcgguagcggcaucuucgucacuaacgagguccacaccuggaccgagcaguacaaguuucaggccgacucccccaaacggcugagcgcggccaucggcaaggccugggaggaggggguuugcggcauccgcucggccacucggcucgagaacaucauguggaaacaaaucuccaacgagcugaaccauauccugcucgagaacgacaugaaguucacgguggucgugggggacgccaacgguauccuggcgcaggggaaaaagaugauccgcccccaaccaauggagcacaaauacucauggaaguccuggggcaaggccaagaucaucggcgccgacauccagaauacaaccuuuaucaucgacgggccggacacacccgaaugccccgacaaccaacgggccuggaacaucugggagguggaagacuacggcuucgggauuuucacgaccaacauuuggcucaaacugcgcgacucguacacccagaugugcgaucaccgguugaugagugcggccaucaaagauagcaaggccguacacgccgacaugggcuacuggaucgaguccgaaaagaacgagaccuggaaacuugcccgcgcuagcuucauagaggugaagacgugcaccuggcccaagucgcacaccuuguggaguaauggcgugcuggaguccgagaugauuaucccgaagaucuacgggggcccaaucagccaacacaacuaccggcccggguacuucacacagaccgccggcccguggcauuuggggaaacucgagcuggacuuugaccugugugagggcaccaccguaguaguggacgagcacugcggcaacagagggcccucccuaaggaccacgacggucaccggcaaaaucauccacgaguggugcugccgcagcugcaccuugccgccccuucgauuccgcggagaggacggaugcugguacgggauggagauccggccggugaaggagaaagaagagaaccucguucgcagcauggucagcgccggcuccggcgaggucgacaguuucagccuggggauccugugcgugucuauuaugaucgaagaggucaugagaaguagauggucccggaagaugcuaaugacgggcacccuagcuguguucuuacucuuggugauggggcagcugaccuggaacgaccugauccgcuuaugcaucaugguuggagccaacgcaagcgaccgcauggggaugggcaccacguaccuggcccucauggcaacauuuaagaugcggcccauguucgccguggggcugcuguuccgcagacucacuucccgcgaaguucuacugcuaacuaucggccucagccuggucgccuccguagaguugcccaacagccuggaggagcugggcgacggccucgccaugggcaucaugauguuaaagcugcucacggaguuccagccacaccaacuguggaccacacugcucucccugacuuucaucaagacgacccugagccucgacuacgcuuggaagaccacugcaauggcccugaguaucgucagcuuguucccgcucugucugaguacgacuucccagaagaccaccuggcugccugugcuucugggcucauucgguugcaagccccugaccauguucuuaaucacggaaaacaagaucuggggccgcaaguccuggccccugaacgaggggauaauggcgaucggcaucguguccauccuucucucuucucugcugaagaaugacgucccgcuugccgggccccugaucgccgguggcaugcugaucgccuguuacgugaucucaggguccuccgccgacuuguccuuagaaaaggcggccgagguguccugggagcaggaagccgagcacagcggcacgucccacaauauccuagucgaggugcaggacgacgggaccaugaagaucaaggacgaagaacgggaugauacccucacgauccugcugaaggccacccuccuggccgugagcggcgucuaccccauguccauccccgcgacccuguucguuugguauuucuggcaaaagaagaagcagaggagcggggugcucugggauacgccgagcccgccugagguagagcgcgccgugcuggacgacggcauauauaggauccuccagaggggucugcuagggcggagccaggugggcgucgggguuuuccaaggcggggucuuccauacgauguggcacgucaccaggggcgccgugcugauguaccaggguaagcggcuggagcccucuugggccagcgugaagaaggaucuaaucuccuacgguggcggguggcgcuuccagggcagcuggaacacuggugaggagguccaggugaucgcgguggagccgggcaaaaaucccaagaacguccaaaccacgccgggcaccuucaagacccccgagggcgagguaggagcgauugccuuggauuucaagcccgguaccuccggcagccccauagugaacagggaaggcaaaaucguagggcuguacggcaacggggugguaacgaccuccggcaccuacguuagcgccaucgcccaggccaaggcgucccaggaagggcccuugccggagauugaggacgaaguguucaagaaacgcaaccuaaccauuauggacuugcaccccggcuccgggaaaacgcggcgcuacuuacccgcuaucgugcgggaggccauaaagcgcaagcuacgaacccugauccuggccccgacccgcgucguggcuagcgagauggccgaggcccugaagggaaugccgauccgcuaucagaccacggccgugaaguccgagcauacuggucgagagauaguagaccugaugugccacgcaaccuucaccaugcgccugcuaagcccggugcgggugcccaacuacaauaugauuaucauggacgaggcgcacuucacggacccggcaucaaucgccgcccgcggauacauuagcacccgagucgguaugggcgaggccgccgccaucuucaugaccgccaccccgccggggucuguggaggccuucccucagagcaacgccgugauucaggacgaagagagggacauccccgaacgguccuggaacucuggcuacgauuggauaacggacuuucccgggaaaacuguaugguuuguacccuccaucaagagcggcaacgacaucgcgaacugccugcgcaagaacgggaagcgggugauccagcucucccguaagaccuucgacaccgaguaucagaagacgaagaacaacgacugggacuacgucgugaccacugacauuagcgaaaugggcgcaaauuuucgggccgaccgcgugaucgacccccggagaugccugaagcccgucauauuaaaggacgguccugagcgggugauccucgcuggccccaugccagugaccguggcaagugcggcacaacgccguggacguaucgggcggaaccagaacaaagagggcgaccaguacguguauauggggcagccacugaacaacgaugaggaccacgcccacuggacugaggcuaagaugcuacuugauaacaucaauacaccggaggggaucauucccgcguuauucgagccagaacgcgaaaaguccgccgccaucgauggggaauaucggcuaagaggggaagcccgcaagaccuucgucgaacucaugcggcgcggcgaccugccaguuuggcugucauacaagguggcaagcgagggguuucaguacuccgaccggagguggugcuuugacggcgagcggaacaaucagguacucgaggagaauauggacguggaaauuuggacaaaggagggggagcgcaagaagcugcguccgcgguggcuugacgcgcggacauacagugacccucuagcccuuagggaguucaaagaguucgcagccggccggaggucagugagcggcgaucugauccucgaaaucggaaaguuaccccagcaccugacccuacgggcccaaaacgcgcuugauaaccuggucaugcuccacaacagcgagcagggcgggaaggcauaccgccacgccauggaggaacugcccgacaccaucgagacccugaugcuucuggcccugaucgcggugcucacaggcggcgugacgcuguucuuccugucgggcaagggccucgggaagacgaguaucggccuguugugcgucacggccuccagcgcccucuuauggauggccucaguggagccgcacuggaucgccgcgagcaucauacuggaguucuuccucauggugcuguugaucccagagcccgaccggcagagaaccccgcaggacaaucaacuggccuaugucgugaucgggcugcuguuuaugauacucacgguugccgcgaacgagaugggcuugcuggagacaacuaagaaggaccuagggaucggacaugucgccgcugagaaccaccagcacgccacaaugcuggacguggaucugcgucccgccucagccuggacgcucuacgccguggccaccaccguaaucacccccaugaugcgccacaccaucgagaauacgacggccaacauaagccugacugccauugcuaaucaggcugccaucuuaaugggccucgauaaaggguggcccaucucaaagauggauaucggcgugccauuacuagcccucggcugcuacagucaggugaacccccugacccugaccgccgccgucuuaaugcugguggcgcacuaugcgaucaucggcccugggcugcaagccaaggcgacccgggaagcgcaaaagcgcaccgcggccggcauaaugaagaaccccacgguggacggcaucgucgccaucgacuuagacccugugguguacgacgccaaguuugagaagcagcugggucagauuaugcugcugauccugugcaccagucagauccugcucaugcgcacgaccugggcacugugugagagcauaacgcuggcuacuggcccccucacuacgcugugggaagggucccccggcaaguucuggaacacgaccauagccguaaguauggcaaacauauuccgaggcuccuaccuggccggggccggccucgcguucagccugaugaaguccuugggaggagggcgccggggcacgggcgcucagggggagacccucggcgagaaauggaaacgccagcugaaccaguugagcaaguccgaguucaauacauacaagcggagcggcaucauggagguagaccgcagcgaggccaaggaaggccucaagcgcggggagaccaccaagcacgccgugucccgcggcaccgcaaagcugcggugguuugucgaacgcaaccuggugaagcccgagggcaaggugaucgaccuggggugcggccgcgguggcuggagcuauuacugcgccggguugaagaaggucacagaggugaagggcuacacaaaaggagggccuggccacgaggagccaauccccauggcgaccuacggguggaaucuggugaagcugcacuccgggaaggacgucuucuucaugcccccagagaagugcgacacacuccugugcgacauuggggaaagcucccccaauccaacgauugaggagggccgcacgcugcgugugcuaaagaugguggaaccguggcuccgcggcaaccaguuuugcauaaagauccugaacccguauaugcccucuguuguggagacgcucgagcagaugcagcgcaagcacggagggaugcuggugcggaauccucugucccggaacagcacccaugagauguauugggucuccugcgguaccggaaacauaguaagugccgucaacaugacgucccgaaugcuucugaaccguuucacuauggcccauagaaagcccaccuaugagcgcgaugucgaccuuggcgcggggacacggcauguagccguggaaccggagguggccaacuuagacaucaucgggcagagaauagaaaacaucaagaacgaacacaaaagcaccuggcacuaugacgaggacaaccccuacaagaccugggcauaccacggguccuacgaggugcggcccucagguuccgccucguccauggugaauggggucgugcgacugcuaaccaagcccugggacgucaucccgauggugacccagaucgcgaugacggacacaaccccauucggccagcaacgugucuuuaaggagaagguagauacgcgaacuccccgagcgaagaggggaaccacccagaucauggaggugaccgccaaguggcucuggggguuccuaagcaggaacaagaagccgcgcaucuguacgcgggaggaguucacccgcaagguucgguccaacgcugccaucggagcggucuucguggacgagaaccaguggaacagcgcgaaggaggcaguggaggaugagcguuucugggaccugguucacagagagcgcgagcugcacaaacaggggaagugcgcgaccugcguguacaacaugaugggaaagcgggagaagaaacuaggggaguucggcaaggcgaaaggcucacgcgccaucugguacaugugguugggugcucgguuccucgaguucgaagcccugggcuucaugaacgaggaccauugguucucacgcgagaacagccugagugggguggagggggaggggcuccacaagcugggcuauauccuacgugacaucagcaaaaucccaggcgggaacauguaugccgacgacaccgcgggcugggauacgcgaaucaccgaggacgaccuccagaacgaggccaagauuaccgagauaauggagccagagcacgcccugcuggccaccuccaucuucaagcucacguaccaaaacaaggucgugcggguccagcggcccgccaaaaacgggaccgucauggacgugaucagccggcgggaccagcgcggcuccggccaagugggcaccuauggccugaauaccuucacgaacauggagguccaacucauccgccagauggagagcgaggggauuuuccucccgagugagcuggagacgccaaaccuggcggaacgcgugcucgauuggcuggaaaagcacggcgccgaacggcugaagcgcauggccaucagcggggacgacugcguggucaagcccaucgacgaccgcuucgcgaccgcauugaccgcgcugaacgacaugggcaaggugcgcaaggacaucccacaaugggagccguccaaggguuggaaugacuggcagcagguccccuucuguagccaccacuuccaccagcugaucaugaaggacgggcgggagaucgucgugcccugucgcaaccaagacgagcuagugggccgggcacgugugucccagggggcaggcuggagccugcgggagaccgccugccuggggaaguccuacgcccagauguggcaacucauguacuuccaccgacgggaccuacgccucgcggccaacgccaucugcagcgccguaccgguggauugggucccgacgucccggacuacauggagcauacacgcgcaccaccaguggaugacgacggaggacaugcucagcguguggaaccgaguguggaucgaggagaaccccuggauggaggacaagacacacguguccucgugggaggagguacccuacuugggaaagagggaggaccaguggugcggguccuuaaucgggcuuaccgcccgggcuaccugggccacuaacauccagguggcaaucaaccaaguccgccgguuaauuggcaacgagaacuaucuggacuauaugacgagcaugaagcgcuucaaaaacgaguccgaccccgagggcgcgcucugguga

SEQ ID NO: 23909 - RNA, 9879 nt, Artificial Sequence
  derived and/or modified CDS sequence (opt11) from DENV-1__KJ189324__SS-prME
agcguaaccaugcugcucaugcugcugcccacugcccucgccuuccaccugaccacccgcggaggggaaccccacaugauagugagcaagcaggagcggggcaagucucuucuuuuuaagacgucagcgggggugaacaugugcacuuugaucgcuauggaccugggggaacucugcgaggacaccaugaccuacaagugcccccaaaucacagaggccgagccggacgauguugacugcuggugcaaugcuaccgacacaugggugacauacgggacuugcagccaaaccggggagcaucgaagggacaagcgcagugucgcgcuggcgccacacgucggccucggccucgagacgcggaccgaaaccuggaugagcucugagggcgccuggaagcagauucagagggucgagaccugggcucuccgucacccuggguuuacugugaucgcccuguuccucgcacacgcuauuggcacaucuaucacccagaagggcaucauuuucauccugcugaugcuagugacccccucaauggccaugcguugcgucggcaucggcaaccgggacuucguugaggggcugucaggugcaacuuggguggaugucgugcuggagcacggguccugcgugaccaccauggccaagaacaagcccacccucgacaucgaacuacugaagacggagguuacgaaccccgcgauucuccgcaagcucugcaucgaggccaagaucagcaacacgaccacggacucccgguguccgacccagggcgaggcgacacugguugaggaacaggaugccaacuucgugugccgccggacauuugucgaccgcggcuggggaaacggcugcggcuuguuuggaaaggggagccugcugacgugcgccaaguucaagugcgugaccaaacucgagggaaaaaucgugcaguacgagaaccugaaguauuccguuaucguuaccgugcauacgggcgaccagcaccaggucgggaacgagacgacagagcacggaaccaucgcgaccaucaccccgcaggcucccaccucggaaauccagcugaccgacuacggggcucucacccuggauugcucaccccguacuggucuugacuucaaugaaaugguccuccugacgaugaaagagaaguccuggcugguccacaagcagugguuccucgacuugccacugccauggaccuccggggccagcaccucucaggagaccuggaaucggcaagaccuacugguuacguucaagaccgcccacgcgaaaaagcaggagguggucgugcugggcucccaggaaggcgccaugcacacugcccucacuggggccacggagauccagaccuccggcaccaccacgaucuuugcugggcaccuaaagugcagauugaagauggauaaguugacucugaagggcaccuccuacguuaugugcacugggagcuucaagcuggagaaggaggucgcggagacgcagcacggcaccgugcuggugcaggucaaguaugagggaacagacgccccgugcaagauccccuuuucaacccaggacgaaaagggugugacgcaaaacggcagacucauuaccgcaaacccuaucgugaccgacaaggaaaagcccgucaacaucgaaaccgagccgcccuucggggagaguuacaucguggugggcgccggcgagaaggcgcugaagcugucuugguucaagaaagguaguuccaucgggaagauguucgaagccacggcacgcggggcgcgccggauggccauucuaggcgauacggcuugggacuucgggucaauaggcggggucuuuacuuccgugggcaaacuggugcaccagguauuuggcaccgcuuacggcgugcuguucagcggcguguccuggacaaugaaaauaggcaucgguauacuccuaaccuggcugggacucaacagccgcuccaccucacuguccaugacuugcauagcugucggcauggugacgcuguaccucggcgugaugguccaggccgauagcgggugcgugauuaacuggaagggccgcgagcuuaaaugcgggagcggaaucuuugugaccaacgaaguccacaccuggaccgaacaguacaaauuccaggccgacagcccgaagcgguuaagugcggcuauaggcaaagccugggaggaaggugugugcggcaucagauccgccacccgacuugaaaacauaauguggaagcagaucagcaacgaacugaaccacauccugcucgagaacgacaugaaauucacgguggucgugggggacgccaacggcaucuuagcgcaggguaagaagaugauccgcccccagccgauggagcacaaauacuccuggaaguccuggggcaaagcuaagauuauuggcgcagacauccaaaacaccacauucaucauagauggccccgauaccccugagugccccgauaaccagcgggccuggaacauuugggaaguggaggacuacggcuucgggaucuuuacgaccaauaucuggcugaaguuacgcgauuccuacacccaaaugugcgaccaccggcugaugagcgccgcaaucaaggacuccaaggcgguccacgcggacaugggcuacuggaucgagagcgagaagaacgagacguggaagcuggcccgcgcguccuucaucgagguaaagacgugcacauggccacgcagccauacccucugguccaacggcguccuagaaagcgaaaugauuauccccaagaucuauggggguccgaucucccagcauaauuaccgccccggcuacuucacccagacggccggucccuggcacuuaggaaagcucgaacuggacuucgaccugugcgagggcaccacaguagugguggaugagcacugcgggaaccgggggccgucccuccgcacaacaacagucaccggcaaaaucauccacgagugguguugccgguccugcacacugccgccccugcgcuuccgcggggaagacgguugcugguacgggauggagauccgccccgugaaggagaaggaggaaaaucucguucggagcauggucuccgccggcagcggugaggucgacagcuucucuuuaggcaucuugugcgccucuaucaugaucgaggaggugaugcgcucacgguggagccgcaagaugcucaugacaggcacccuggccguguuucugcuccuggugauggggcaacuuaccuggaacgaccucauccgccugugcaucauggugggcgcgaacgccucugaccggauggggaugggcaccacguaccuggcccucauggccaccuucaagaugagaccgauguuugccgugggucugcuguuccggcgcuugaccucacgggaagugcugcugcucaccauagggcucucccucguggcgagcgucgaacucccgaacagucuggaagaauugggcgacgggcucgccaugggcaucaugaugcugaaacuucucacugaguuucagccccaccaguuauggaccacccuguuaagccuaaccuucaucaagacgacccucagucucgacuacgccuggaagaccaccgccauggcgcugucuauuguaucccuguucccacucugccugagcacuacaucccagaagaccaccugguuaccgguccuccuaggcagcuuugggugcaagccccugacgauguuccucaucacggagaacaagaucuggggccgcaaguccuggccccugaacgaagggauuauggccauagggauagugaguaucuuguuauccucgcugcugaagaacgacgugccgcucgccggaccgcugaucgccggugguaugcugauugcgugcuacgucaucaguggauccagcgccgaccucucgcuggagaaggcagccgaggucaguugggagcaggaggccgagcacaguggcacaucgcacaacauccugguggaaguccaggaugacgggaccaugaaaaucaaggacgaagaacgggacgacacccucacaauccugcugaaggccacccuucuggccguguccggcguguaccccaugagcaucccggcaacccuguuugucugguacuucuggcagaaaaagaagcagcgcuccgggguguugugggacacccccaguccucccgagguggagagggcaguccuggaugacgggauauaccguauacuccagcggggccugcucggccgcucccaagugggcgugggggucuuccaggacggcguguuccacacgauguggcaugugacacgcggggccguucugauguaccagggcaagcgccuggagcccagcugggccuccgugaagaaggaccucaucucguacggcggcggcuggcgguuccaaggguccuggaacacuggcgaggaaguucagguuaucgccguagagccggggaagaauccgaagaacgugcagaccacacccgggaccuucaagacccccgaaggcgaagucggggcaaucgcccuggacuucaaacccggcaccuccggauccccgauagucaaccgcgaggggaagaucgugggccuguacgggaacggcgucgugacgaccucggggaccuacguguccgccaucgcccaggcaaaggcaagccaggaagguccccuccccgagaucgaggacgaggucuucaaaaagcggaaccugaccaucauggaccugcacccaggaucgggcaagacacgccgguaccuccccgccaucguccgcgaagcuaucaaacggaagcugcgcacccuaauucucgcgccaacccgcguggucgccuccgagauggcggaggcccugaagggaaugcccauccgguaucagaccacagccguuaagagcgagcauaccgggcgcgagaucguggaucugaugugccacgcgaccuucacgaugcggcuccuguccccgguccgcgugccuaacuacaacaugaucaucauggacgaggcccacuuuacggacccugccagcaucgccgcccggggcuauaucuccacacgcgucggcaugggggaggcggccgccauauuuaugacagcaacgccgcccgggagcguggaggccuucccccaauccaacgcggugauccaggacgaggaacgcgacauccccgagcgcagcuggaacuccggcuacgauuggaucacggacuuccccggcaaaacugugugguucgucccgagcaucaaguccgggaaugacauagccaauugcuuacggaaaaauggaaagcgcgugauccaacucagccggaaaaccuucgacaccgaguaccagaagacgaaaaauaacgauugggacuacguggucacaaccgacaucuccgagaugggggccaacuuuagggccgaccggguuaucgacccccgccggugccugaagcccgugauccugaaggacgguccggagcgugucauacucgcggggccgaugcccgugacaguugcgagcgcggcccaaagacgcggccggauaggccgcaaccaaaacaaggagggggaccaauauguuuacaugggucagcccuugaauaacgacgaggaccaugcccacuggacugaggcgaagaugcugcucgacaacaucaacacccccgaggguaucaucccggcucuguucgagcccgagcgugagaaauccgccgccaucgacggggaguacaggcugcgcggggaggcgcggaagaccuucguggagcucaugcggcggggcgaucuacccgucuggcugagcuacaagguggcguccgagggcuuucaauacagcgaucgccgguggugcuucgacggggagcgcaauaaccagguguuagaagagaacauggacgucgagauauggaccaaggagggggaacgcaagaagcuccgcccucgguggcuggaugcgcgcaccuauucagacccgcucgcucugcgggaguucaaagaguucgccgccgggcgucggucugugaguggcgaccugauccucgaaaucggcaagcugccccagcaccugacgcuccgcgcgcagaacgcccuggacaaccugguaaugcuccacaacuccgagcaaggcgggaaggccuaccggcaugccauggaggaguugccagauaccaucgagacccugaugcuccuagcgcuaaucgcuguccucaccggaggggugacucuguucuuccugucgggaaaaggccucggcaagacgucaaucgggcugcugugcgugaccgcauccuccgcacucuuauggauggccagugucgagccccauuggaucgcggccucaauaaucuuggaguuuuuccucaugguguugcugaucccggaaccggaccgccagcggacaccccaggacaaccagcucgcguacgugguuaucggccugcuguucaugauccucaccguggccgccaacgagaugggccuucucgagacgacuaagaaggacuugggcaucggacacguggcugcggagaaucaccaacacgccaccaugcuggaugucgacuugcgcccugccagcgcguggacgcucuacgcaguggccacuaccgugauuacccccaugaugcggcacacgaucgaaaauaccaccgccaacauuuccuugaccgccauugcuaaccaagcggcaauccugaugggccucgacaagggcuggcccaucucuaagauggacauuggagucccccuacuggccuuaggcugcuacucccaggugaacccgcugacgcugaccgccgcugugcucaugcuggucgcccacuacgccaucaucggccccggacugcaggccaaagcuacaagggaggcgcagaaaagaaccgccgccgggaucaugaagaaccccacgguggacggcauaguggccaucgaccucgaccccgucguguacgacgccaaguuugaaaagcagcugggccaaaucaugcugcugauccucugcaccucccagauccuacucaugcguacaaccugggcauuaugcgaaaguaucacccuggcuaccgggccgcucaccacucugugggagggcaguccggggaaguucuggaacacgaccaucgcugugucaauggcgaacaucuuccgcggcucuuaccucgccggcgcggggcucgcuuucucccugaugaaaucccuaggggguggccggcgcgggaccggggcucagggggagacccucggggaaaaguggaagaggcagcugaaccagcuguccaagucugaguucaacaccuacaagaggucggggaucauggagguagaccgguccgaggccaaggagggguuaaaacgcggcgagacaaccaagcacgcugugagccgggguacugccaagcuacgcugguucguggagcggaaccugguaaaacccgagggaaagguuauagaccugggcugcggacguggcgggugguccuacuacugcgccggccucaagaaggugaccgaggucaagggcuacacgaagggcggcccgggacacgaggagccgauucccauggccaccuacggcuggaaccuggugaaacuucacagcgggaaggacguguucuuuaugccgcccgagaagugugauacacuccugugcgacaucggcgaauccagcccgaaccccacuaucgaagaaggucggacgcuccggguccuaaagaugguggagccauggcugcgggggaaccaauuuugcauuaaaauccugaacccuuauaugcccuccguggucgagacauuagagcagaugcagcgaaagcacggcggcaugcuggugcggaacccccugagccgaaacagcacccacgagauguacuggguguccugcggcacgggaaauauagucuccgccgugaacaugaccagccguaugcuccugaaccgcuucaccauggcgcacagaaagcccacuuacgagcgagacguggaccugggcgcggguaccaggcacguggccguugagcccgagguggccaacuuggacauaaucgggcagcguaucgagaacaucaagaacgagcacaaguccacguggcacuaugacgaggauaacccuuacaagaccugggcguaccacggcucuuaugaagucaagcccuccgguucugcguccagcaugguaaauggcgucguacgccugcugacaaagcccugggacguuauccccauggucacccagauugccaugacugauaccaccccguuugggcagcaacggguguucaaagaaaagguggacacccgcacgccccgggccaagcgcggcacuacacaaaucauggaggucacggcaaaguggcuuuggggauuccugucccggaacaagaagccacgcauuugcacgcgggaggaguucacccgaaaggugcggaguaacgccgcgaucggcgccguguucgucgacgagaaccaauggaacucagccaaagaggcuguggaggacgagcgauucugggaccuggugcaccgggagcgcgagcuucacaagcaaggcaaaugcgcaaccugcgucuacaacaugauggggaagcgagagaagaagcuaggcgaguucgggaaggccaaggggucccgcgccauuugguacauguggcugggcgcccgguuuuuggaguucgaggcccugggauucaugaacgaagaccacugguucucaagagaaaauucccugagcggaguggagggggagggccuacacaaguuaggguacauccugcgggacaucuccaagaucccagggggcaauauguacgcggacgacaccgccgggugggacacgcggauaacugaggacgacuugcagaacgaggccaagauaaccgagaucauggagccugagcaugcccugcuggccaccagcaucuucaagcuaacguaccagaacaagguaguccgcgugcagcgucccgcgaaaaauggcaccgugauggacgucaucagccgcagggaccagcgggggaguggccagguaggcaccuacggacugaauaccuucacgaacauggaggugcagcugauccgacagauggaguccgaggagaucuuccucccaagcgagcuagagaccccuaaccuggcggagcgcguccucgacuggcuggagaagcauggugccgagagacugaagcgcauggcgauuuccggggacgacuguguggugaagcccaucgacgaccgguucgcuacagcgcucaccgcccuaaacgauaugggcaagguacggaaggacauuccccagugggagcccuccaaaggguggaacgauuggcagcaggucccauucugcucgcaccauuuccaccagcugauuaugaaggacgguagagaaaucgugguuccaugccgaaaccaggacgagcucguggggcgggcuagggugagccagggggccggcuggucccuucgggagaccgccugccugggaaagagcuacgcgcagauguggcagcuuauguauuuccaccggcgggaucugcgccuggccgcgaacgccaucugcuccgcgguccccguggacugggugcccacgagccgcacaaccuggagcauccacgcccaucaccaguggaugacaacggaggacaugcucuccgucuggaaccgcguguggaucgaagaaaaccccuggauggaagacaagacacaugugagcagcugggaggagguccccuaccuggguaagcgagaagaccaguggugcgggucacugauuggccucaccgcccgagccaccugggccacgaacauccagguagcgauaaaccaggugcgccgucugaucggcaacgagaacuaccuggacuacaugaccuccaugaagcgcuucaagaacgaaucugaucccgagggggcacucugguga

SEQ ID NO: 23910 - RNA, 9879 nt, Artificial Sequence
  derived and/or modified CDS sequence (opt11) from DENV-1__KJ189325__SS-prME
agcgugaccauguugcucaugcuauugccaaccgcccuagccuuccaccugaccacgcggggcggcgaaccgcacaugauuguuagcaagcaggagcggggcaagagccuccuguuuaaaacuucggcgggggugaacauguguacccugauugcuauggaccugggcgaguugugcgaggacaccaugacuuacaaaugcccgcaaauaacugaggccgagcccgaugacguggacuguuggugcaacgcuaccgacaccugggugaccuacggaaccugcucgcagaccggagagcaccgccgggacaagagaucaguagcccuggcgccccaugugggccuugggcucgaaacgcguaccgagaccuggaugagcuccgagggcgccuggaaacaaauacagcgcgucgagaccugggcccugcggcaucccggcuucacagugauugccuuguuccuugcgcaugccaucggcaccagcaucacccagaaggggaccaucuucauccugcugaugcuugugacccccuccauggccaugcgaugugucggcaucggcaacagggacuucguugaggggcugucaggagccaccuggguggacgucgugcuggagcacggguccugcgugacaacuauggccaaaaacaagcccacccucgacaucgagcugcugaagaccgagguuacgaaucccgcgauccuccgcaagcugugcaucgaggccaaaauaagcaacaccacgaccgacucacgaugcccgacccagggugaggccacccugguagaagaacaggaugccaacuucgugugccgccggacguucgucgaccgcggcugggggaacggcugcggacucuuuggcaaggggucacugcugacuugcgccaaguucaagugcgugaccaagcucgagggcaagaucgugcaguacgaaaaccugaaguauagcguaaucgugacaguccacaccggagaccagcaccagguaggcaaugagaccacagaacacggcacgauagcgaccaucacgccccaggcgcccaccucagagauccaguuaacagacuauggagcguugacccuggacugcagcccccggacgggacuggacuuuaacgaaauggugcuccugaccaugaaagagaagucuuggcugguccacaagcagugguuuuuagaccugccguugcccuggaccuccggggccagcaccagccaggagacguggaaccgccaggaccugcuggucaccuucaagaccgcccacgcgaagaagcaggagguggucguccugggcucccaggagggugccaugcacacugcucucacgggggccaccgagauccagaccucaggcaccacgaccaucuucgccgggcaccuaaaaugccggcugaagauggacaagcucacccugaagggcaccuccuacgugaugugcacagggagcuucaagcuggagaaggaggucgcggaaacccagcacggcaccgugcuggugcaggucaaauacgaaggaacugacgcccccugcaagauccccuucuccacgcaggacgagaagggggugacacagaacggccgccucauaaccgccaacccuaucguuacggacaaggagaagcccgucaacaucgagacugagccgccguucggggagaguuacaucguggugggcgcaggcgagaaggcucugaagcucuccugguuuaagaaggggucauccaucggcaagauguucgaggccaccgcccgcggggcccgucggauggcaauccucggcgauaccgcgugggacuuugguagcaucggcggcgucuucaccagugugggaaaacuggugcaccaggucuucggcacugcguacggcguacucuucagcggcguuaguuggaccaugaagaucgggaucggcauacuccugaccuggcuggggcucaauagccgcuccacgagucuguccaugacguguauagccgucgggauggugaccuuguaccucggcgucauggugcaggccgauucgggaugcgugaucaacuggaagggccgugaacugaagugcggguccgggauauucgugaccaacgagguccacaccuggaccgagcaguacaaguuucaggccgauagccccaaacgguugagcgcggccaucggcaaggccugggaggagggggugugcggcauccgcuccgccacgcggcucgagaacaucauguggaagcagaucagcaacgagcugaaccacauccugcucgagaacgacaugaaauucaccguggucgugggggaugccaacggcauccuggcucaggguaagaagaugauccgcccccagcccauggaacacaaguacucguggaaaucaugggggaaagccaagaucaucggcgcagauauccaaaauacuaccuucaucaucgacgggcccgauacgccggagugcccugacaaccagcgggccuggaacaucugggagguugaggauuauggcuucgggaucuucaccaccaauaucugguugaaacuccgcgauuccuacacccagaugugcgaccaccgguuaauguccgccgccaucaaggauucuaaggcuguccaugccgacaugggauacuggaucgagagcgagaagaacgagacguggaagcuggcucgcgccuccuucaucgaggugaaaacuuguaccuggcccaagagccacaccuuguggucgaacggcgugcuagagagcgagaugaucauucccaagaucuacggaggcccuaucagucagcacaacuauagacccggguacuuuacgcagaccgccgggcccuggcaucuggggaagcucgagcuggacuucgacuugugcgagggcaccaccgucgugguagacgagcacugcggcaaccgcgggccaagccuccguacgacaaccgucaccgguaagaucauacaugaguggugcugccgcuccuguacgcuuccgccccugcgcuuccgcggggaggauggcugcugguacgguauggaaauccggcccgugaaagagaaagaagagaaccucgugcgcaguauggucucagccggcagcggcgaaguggauagcuucucccuagggauccugugcgccagcaucaugauagaggaggugaugcggucccgauggucgcggaagaugcucaugaccggcaccuuggccguguuccugcuacuuguuauggggcagcugacauggaacgaucucauaagacugugcaucauggugggcgcgaacgccuccgaccgcauggggauggggacgaccuaccuggcacucauggcaacauucaagaugcggccaauguuugccgucgggcuguuguuucgccgacugacgucaagggaagugcugcuacuaacaaucggucugucgcuaguggcgucgguugagcucccaaacagccuugaggaacugggcgacggguuagccauggguaucaugaugcugaagcugcuaaccgaguuccagccacaccagcuuuggaucacucugcucagccugaccuucaucaagacuacccugucccucgacuaugccuggaagaccacggcgauggcccugaguaucgugucccuguucccacucugccucagcacuaccucacagaagaccaccuggcucccgguucuccugggcagcuucgggugcaaaccgcugaccauguuccucaucacugagaacaagauuuggggccggaaguccuggccccuaaacgaagguaucauggccauuggcaucgucagcauccuuuuaucgagccuccugaagaaugacgugccccucgccgggccgcugauagccggcggcaugcugaucgccugcuaugucauaucgggguccagcgccgacuugucccuggaaaaagccgcagaggugagcugggagcaagaggccgaacauuccggcacuucucacaacauccugguggaggugcaggaugacgggacgaugaagaucaaagaugaggagcgcgacgauaccuugaccauccugcugaaggccacccuucuggcggugucggggguguaccccaugucgauccccgccacccuguucgucugguacuucuggcagaagaagaagcaacgguccgggguccucugggacacacccagcccgccggagguagagagggccguccuggacgaugggaucuaccggauccugcagcgcggccugcucgggcgaucccaggugggggugggggucuuccaggacggcguuuuccacaccauguggcaugugacccgcggcgccguccugauguaccagggcaagcgccuggagcccagcugggccuccgucaaaaaggaccucaucucuuacggcgggggcuggcgcuuccaggggucuuggaacacgggcgaagaggugcaggucaucgcaguagagcccggcaagaacccgaagaacguucaaaccaugccaggcacguuuaaaacccccgagggcgagguaggcgccaucgcccuggacuuuaagccuggcaccuccgggucgccgaucgugaaccgggagggcaagauugugggcuuauacgggaacggcgucgugaccacgagugggaccuacguguccgccaucgcccaggccaaggccagccaagaaggcccccuccccgagaucgaggacgaggucuucaaaaagaggaacuuaaccaucauggaccuacacccggggagcggcaagacgagaagauaccuacccgcuauggugcgggaggccaucaagcgcaaguuacggacgcugaucuuagcgcccaccaggguggucgccuccgagauggcugaggcccugaagggcaugcccauuagguaccagaccaccgccgucaagagcgagcauacggggcgggagaucgucgaccucaugugccaugccaccuucaccaugagacuccuguccccggucagagugcccaacuacaacaugauuauuauggaugaggcccacuucaccgaccccgccagcaucgccgcacgcggcuacauauccacgcggguggggaugggcgaggcggccgccauuuuuaugaccgccacgccgccugggagcgucgaggccuucccccaguccaacgcggugauucaggacgaggaacgcgacauacccgaacguagcuggaacagcggcuacgacuggaucacagacuuucccggcaagacugugugguuuguccccagcaucaaguccgggaacgacaucgccaauugucugcgcaagaacgggaaaagggugauccaacucagccgcaaaaccuucgacaccgaguaccagaaaaccaaaaacaacgacugggauuacgucguaacaaccgacaucuccgagaugggggccaacuuccgggccgaccgcgucaucgacccccggcgaugcuuaaaaccggugauccugaaggacggcccggagagggugauucucgcggggccgaugcccgugaccguggccagcgccgcccagcgucggggucggaucggaagaaaucagaauaaggagggggaccaguaugucuacaugggccagccccugaacaacgacgaggaccacgcccacuggacggaggcgaaaaugcuucucgacaacaucaacacccccgaggggaucaucccagcccuguucgagcccgagcgggagaaguccgcugcuaucgauggcgaauaccgucuccgcggggaggcccgcaagaccuucguagagcucaugcggcgcggcgaccugccuguguggcugagcuacaagguggcguccgagggcuuccaguacagcgaccggcgaugguguuucgacggggagcggaacaaccagguacucgaagaaaacauggacgucgagaucuggaccaaggagggggagaggaagaaguuacguccccgcuggcuggacgcccggaccuauagcgacccccucgcccugagagaguucaaggaguucgccgccgggagacgcagugugagcggcgaccuaaucuuggagauaggcaaacuuccccagcaccugacccuccgggcacagaacgcccuggacaaccuggugauguugcacaauuccgagcagggcgggaaggccuaccgccacgccauggaggaguugccagacacgaucgagacccuaauguuacuggcguuaaucgccguccucaccggcggggugacccuguucuuucugagcgggaaaggccugggaaagacuuccaucgggcugcugugcgugacugccagcuccgcccuucuguggauggccagcguagagccccacuggaucgcggccuccaucauccuugaauucuuccucauggugcugcugauuccggaacccgaccggcagcgcacaccgcaggacaaccagcucgcauauguggugaucggucugcuauucaugauccuuacgguggccgcuaacgaaauggggcuccuggagacgaccaagaaggaccucggcaucggacacguggcggcugagaaucaccagcacgccaccaugcuggacgucgaccugcggccugccagcgccuggacccucuacgcgguggcaaccaccgugauaacccccaugaugcggcauaccaucgagaacacgaccgccaacaucucccuaacagccaucgcgaaccaagcugcgauccugauggggcuggacaagggcuggcccauuucuaagauggacaucggggucccccuguuggcccucggcugcuacucccagguaaauccacuaacccugacggcugcggugcucaugcuggucgcgcauuacgccauaaucggucccggccugcaggcaaaagccacccgggaggcgcagaaacgcaccgccgcggggauaaugaagaacccgaccgucgauggcaucguggcaaucgaccucgacccagucguguaugacgccaaauucgaaaagcagcugggccagauaaugcuguugauccugugcacgagccaaauccuguugaugcgcaccacuugggcgcugugcgaauccauuacccuggccacggguccacucacuacguuaugggagggcagccccgggaaauucuggaacacgacaaucgccguguccauggccaauauuuuucgcggcucguaucuggccggcgcggggcucgccuuuucgcugaugaagucccugggcgggggacggagagggaccggcgcacagggcgaaacccucggggagaaguggaaacgccagcugaaccagcuguccaagagugaguucaauacauacaagcggagcgguaucauggaggucgaccguuccgaggccaaggaggggcuaaagaggggugagaccacuaagcacgcggugagccgcgggacagccaagcugagaugguucguugagcgcaaccugguuaagccugagggcaaggugaucgaccugggcugcgggcggggcgggugguccuacuacugcgccggccucaagaaggugaccgaaguaaagggguauaccaagggcggccccgggcacgaagagcccauccccauggcaacguauggauggaaccuggucaagcugcacucuggcaaggacguuuucuuuaugccccccgagaaaugcgauaccuuacugugugacaucggcgaaucgagcccgaaccccaccauagaagaggggcgcacacugcgggugcucaagaugguggagcccuggcugagaggcaaccaauucugcaucaagauccugaaccccuacaugccgucuguggucgagacucucgagcagaugcagcggaagcacggcgggaugcugguccgcaacccccugagccguaacucuacucaugagauguacugggugagcugcggcacgggaaacaucgucuccgcuguaaacaugaccagccgcaugcuccugaaccgguucacgauggcgcacaggaagccuacuuacgaaagagauguggaucugggcgcaggcacacggcacgucgcgguggagcccgaaguggcuaaccucgacaucaucggccagcgcauagagaacaucaagaacgagcacaaauccacguggcauuacgacgaggacaacccguacaagacgugggccuaccacggcucguacgaggucaaacccucagggagcgcuucgaguauggugaacggggugguccggcugcugacgaagcccugggacgugauccccaugguuacucagauagcgaugacugacacgaccccguucgggcagcagcgcguguucaaagagaagguggacacccggacgccccgggcgaagcguggcacgacucagaucauggaaguaaccgccaaguggcucuggggcuucuugucgcgaaacaagaagccccgaaucugcacccgggaggaguucacgcggaaggugcgcagcaacgcagccaucggugccguguucgucgacgagaaucaguggaacagcgccaaagaagccguggaggacgagagauuuugggaucuagugcaucgcgagcgggagcuccacaagcagggcaagugcgcgacuugcgucuacaauaugaugggcaagcgcgagaagaagcugggagaguuuggcaaggccaagggcucucgcgccaucugguauauguggcuuggcgcccgcuuccuggaauucgaggcacugggguucaugaacgaggaccacugguucagccgggaaaacucucugagcggcguagaaggggagggucuccacaagcugggguacauccugcgcgacaucuccaaaaucccuggcggcaacauguacgcggacgacaccgccgggugggacaccaggaucacagaggacgaccuucaaaaugaggcaaagauaacagagauuauggaacccgagcacgcccuucuagccaccaguaucuucaagcucacguaucagaauaaggugguccgcgugcagcgccccgccaaaaauggcaccguaauggaugucaucucccggagagaccagagggggucaggccagguuggcaccuaugggcugaauacguuuaccaacauggagguacagcucauccggcagauggaguccgagggcauuuuucuccccucugagcuggagacgccuaaccuggcggagcggguccucgacuggcuggagaaacacggggccgagcgccugaagaggauggccaucuccggugaugacugcguagugaagccgauagacgaucgcuucgccaccgcgcucaccgcccuaaacgauauggguaagguccggaaagauaucccccaaugggagcccagcaaaggcuggaacgacuggcaacaggucccuuuuugcucucaccacuuucaccaacucaucaugaaggacggccgcgaaaucgucgucccaugccgcaaccaggacgagcucgugggacgggcccgugugagccagggcgccggguggucccugcgcgagaccgccugccuuggcaagagcuacgcgcagauguggcagcucauguacuuccaccggcgcgaccugcggcucgcugccaaugcgauuugcucggcggugcccguggacuggguacccaccucacgcaccaccuggucgauccacgcccaucaccaguggaugaccaccgaggacaugcuguccguauggaaccggguguggaucgaggagaacccguggauggaggacaagacgcaugugagcucgugggaggagguccccuaccuggggaagcgcgaagaccaguggugcggcagccugauaggucucaccgcccgcgccaccugggcaaccaacauucaagucgcgauaaaccaagugcggcgccugaucgggaaugagaacuacuuagacuacaugacguccaugaagcgguucaagaacgaaucugaccccgagggcgcccucugguga

SEQ ID NO: 23911 - RNA, 9879 nt, Artificial Sequence
  derived and/or modified CDS sequence (opt11) from DENV-1__KJ189326__SS-prME
ucugugaccaugcugcugauguuacugcccaccgcccuggcauuccaccuaacgacucgcggcggcgaaccccacaugauugugagcaagcaagaacggggcaagucgcuccuguucaaaaccucugcagggguuaacaugugcaccuuaaucgcuauggaccugggcgaauugugcgaggauacaaugaccuauaagugcccacagaucaccgaggccgagccugaugacguggacugcuggugcaacgccaccgauacguggguuaccuacgggaccugcagccagacuggcgagcaccgccgggacaagcgauccguagcccuggcgccacacgugggccucgggcuugaaacgcggaccgagaccuggaugucuagcgagggcgccuggaagcagauucagcgcgucgagaccugggcccugcggcaccccggguucacggugaucgcccuguuccucgcgcaugcgaucggcaccucgaucacucagaaaggcaccaucuucauacugcucaugcucgucacgcccuccauggccaugcgcugcgucggcaucgguaaccgggacuucguggaggggcugaguggcgccaccuggguggacguagugcuagagcacgggucaugugugaccacuauggcaaagaacaagcccacuuuagauaucgagcugcuuaagacugaggugaccaauccugcuauucuccgcaagcuguguaucgaggccaagaucagcaacaccacgaccgacucaagaugcccuacccagggcgaggccacccugguggaagaacaggacgcgaacuuuguaugccgucggacguucguggaccgcggcugggggaaugguugcggccuguucggcaaagggagccuguugaccugcgccaaguucaagugcguaaccaagcucgagggcaaaauuguacaauacgagaaccuuaaguacucggucaucgugacggugcacacgggagaccagcaccaagucgggaacgagaccacagaacauggcaccaucgccaccaucacuccccaggcgcccaccagcgaaauccaacugaccgacuacggggcacuuaccuuggacuguaguccccggaccggccuggacuuuaacgagauggugcuacuuaccaugaaggagaaguccuggcugguccacaaacaaugguuccucgaccugccguuacccuggaccuccggggcgagcaccucucaggagacguggaaccgccaggaucuccuggugaccuucaagaccgcccacgcgaagaaacaggaggucgucgugcuggguagccaagagggcgcuaugcauaccgccuugacgggugccacagagauccagacaagcgguaccacgacuaucuucgccgggcacuuaaagugcaggcuaaaaauggacaaacucacucuaaagggcacguccuacguuaugugcacuggcagcuucaagcuugagaaggaaguagcagagacccaacauggcacagugcuggugcaggucaaauaugagggcacagaugccccaugcaagauucccuucucuacgcaggacgagaaaggggugacucaaaacgggcggcucauaaccgccaacccgauuguuaccgauaaggagaaaccggucaacaucgagacggagccgccauucggugagagcuacaucgucgugggcgccggugaaaaggcguuaaagcugucgugguuuaagaaggggagcuccauuggcaagauguucgaggccaccgcccgcggggcacgccggauggccauccucggggacaccgcgugggacuucgggagcaucggcgggguguucacauccguggggaagcuggugcaccaagucuucggaacggcguacggcgugcuguuuucuggcguguccuggaccaugaagaucggcaucggcauccuacugaccuggcugggccuaaauagccgcuccacaagccuauccaugacguguaucgccgucggcauggugacccuguaccucggcgugaugguccaggcagacagcggcugcgugauaaacuggaaagggagggaacuaaagugcgggaguggcaucuucgugaccaaugaaguccacacauggacggagcaguacaaguuccaggccgacuccccgaagcgccugagcgcggccaucggcaaagcuugggaggagggugucugcggcauacgcuccgccacacggcucgagaacauuauguggaagcagaucaguaacgagcugaaucacauacugcucgagaacgacaugaaguucaccguggucgugggggacgcuaacggcauacuggcgcaggggaagaagaugauccgcccgcagccgauggagcauaaguacucauggaagucuuggggcaaggcgaagaucaucggugccgacauccaaaacaccaccuucauaaucgacgggcccgauacgccggagugccccgacaaccagagggccuggaauauaugggaggucgaggacuacggcuucgggaucuuuaccacaaacauauggcugaagcuccgcgacucguacacccagaugugcgaccaccggcugaugagcgcggcaaucaaggacaguaaggccguccacgcugauaugggguacuggaucgagagcgagaagaacgagaccuggaagcuggccagagcguccuuuaucgaagugaagacuuguaccuggcccaagagccacacccuaugguccaacggcgugcucgagagcgaaaugaucauccccaagauauaugggggcccgaucucccagcacaacuaccgacccgguuacuucacgcagacugcagguccauggcacuuggggaagcucgagcuggacuucgaccugugcgagggcacgacagucguuguggacgagcacugcggcaaccgcgggcccagccuccggacaaccacuguuaccggcaagauaauccaugaguggugcugccgcuccuguacgcugccgccccugagauuccgcggggaggaugguugcugguacggaauggagauccggcccguaaaagagaaagaggagaacuuagugcgaucaauggucucggcuggcagcggcgagguggacagcuucucccugggcaucuuaugugcgagcauuaugaucgaggaggugaugcggagccgcuggagcaggaagaugcucaugacuggaacccuggccgucuuccuguuguuggugauggggcagcugaccuggaacgacuuaauccgccugugcauaauggucggcgcgaacgccucagaccgcauggggaugggcacgaccuaccuggccuugauggccacauucaagaugcggccgauguucgcagucggccugcuuuuccgcagacuaaccucgagagagguccugcuguugacgaucgggcugagucugguagcgagcgucgagcucccgaacucuuuagaagagcugggcgacggcuuagccaugggaaucaugaugcugaagcuccucaccgaauuccagccacaccagcuauggaccacucuacucucucugacguucauaaagacaaccuuauccuuggacuacgccuggaagaccaccgccauggcgcugagcaucgugucccuguuuccccucugccugaguaccaccagccagaagacgacguggcucccggugcuacuuggcuccuuugguugcaagcccuugacgauguuccucaucaccgagaauaagauauggggccgcaaguccuggcccuuaaaugaggggaucauggccaucggcaucgugucgauccugcucuccagccuucugaagaacgacgugccccuagccgggccacugauugccggcggcaugcugaucgcauguuacgucauaagcggguccucugcggaccuuucucuugaaaaggccgccgaagugagcugggagcaggaggcugagcacuccggcaccucucacaacauccugguggagguccaggacgaugggaccaugaagauaaaagaugaggaacgcgacgacacccucacaaucuugcugaaggccacccuccuggcagugucaggcguguaccccaugaguauacccgcuacccuguucguaugguacuucuggcagaagaaaaagcaacggucgggggugcugugggacacgcccagcccacccgaggucgagagggccguucuggaugacggcauauaccggauccuccaacgcggccugcucgggcggucacaaguggggguagggguuuuccaggacggcgucuuccacaccauguggcauguuacccgcggugccguccugauguaucaaggcaagcgacuggagccuagcugggccuccgugaagaaggaccucaucucguauggcgguggguggagguuccaggggcuauggaauaccggggaagaagugcaggucaucgcgguugagccagggaagaacccgaagaacgugcaaaccacccccgggaccuucaaaacccccgagggcgagguuggggccaucgccuuagacuucaaacccgggacguccggcagcccgauagugaaccgggagggcaagaucgugggacucuacgggaauggagucgucaccaccuccgggaccuauguaagcgccaucgcccaagcaaaggcaucccaggaggggccccugccggagaucgaagacgaggucuucaagaagcgcaauuuaacgaucauggaccuccauccgggguccggcaagacaaggcgcuaccugcccgccauggugcgggaggccaucaaacggaaacugcguacccucauccuugcaccgacccgcgugguugccagcgagauggccgaggcgcugaagggcaugcccauccgcuaccagacgaccgccgugaaguccgaacacaccggccgggagaucguggacuugaugugucacgcgaccuucacgaugcgccugcugagcccgguccggguaccgaacuacaacaugaucaucauggacgaggcccacuuuacggaccccgcaucaaucgcagcccgaggcuacauaagcacccgggugggcaugggcgaagcugcggcaaucuucaugacugcaacgcccccgggguccgucgaggcguucccccagagcaacgcugugauccaggacgaggaaagggauauccccgagcgguccuggaauagcggcuacgacuggaucaccgacuucccgggaaaaaccgugugguucguuccguccaucaagagcgggaacgacauugccaacugucuccgcaaaaacggcaagcggguuauacagcugucucguaagacuuucgacacagaauaccaaaagaccaagaacaacgauugggacuacgugguaaccacagacaucagcgaaaugggugccaacuuccgggccgaccgggugaucgaccccagacgcugccugaagcccguuauccucaaggacggccccgagcgggucauauuggcggggcccaugcccgugacggucgccuccgcagcccagcgccggggccggaucggccggaaccagaauaaggagggggaccaauaugucuacaugggccagccucugaacaacgacgaggaccacgcccacuggaccgaggcgaaaaugcuccuggacaacauuaauaccccagagggcaucaucccggcccuguucgagcccgaacgcgagaaguccgccgccauugauggagaauaccgccuccgcggagaggcccgaaagaccuucguggagcugaugcggcgcggcgaucugccggucuggcuauccuacaaaguggcgucggagggcuuccaguauuccgaucggcgcuggugcuucgauggcgagcgcaacaaccaggugcuggaggagaacauggacguugagaucuggacgaaggagggcgagcguaagaagcuacgcccccguuggcuggacgcccggacguacagcgacccccuggcccugcgugaguucaaagaguucgccgccgggcgaagguccgugagcggugaccucauccucgagaucgguaagcuuccacagcaccucacgcugcgggcgcaaaaugcccuggauaauuuagugaugcugcacaacagcgagcagggaggcaaggccuaccgccacgcuauggaggagcugccggacacgaucgagacauuaaugcuucuugcguugaucgccguccugaccggcgggguaacccuguuuuuccucuccgggaaggggcuuggcaaaaccucgauugggcuucuaugcgucaccgcaucaagcgcccuacuguggauggcauccgucgagccgcacuggaucgcggccuccauaauauuggaguucuuucugaugguccuucucaucccggagccagaucgacaacgcacgccccaggauaaccaacuggcuuacguggucauaggccuccucuuuaugauacuaaccguggcagccaacgagauggggcugcucgagaccaccaaaaaggaucucggcaucgggcacguagccgcugagaaccaccagcaugccacgaugcuggacgucgaccuccgccccgcguccgccuggacccuguaugcgguggccacgaccgugauaacgcccaugaugcgacacacaaucgaaaacaccaccgcgaacaucagucugacggccauagccaaccaagccgccauccucaugggccucgacaaaggcuggcccaucuccaagauggacaucggcgucccccuguuagcccugggauguuacagccaggucaacccgcugacccucacagcugccgugcucauguuggucgcccacuacgccaucaucggacccggccuccaagccaaggcuacccgggaggcucagaaacgcacggccgccgggaucaugaagaaucccacggucgacggcaucguggccauugaccuggacccagucguguacgacgccaaauuugaaaagcaguuaggccaaauaaugcucuuaauucuguguaccucccagauccuccuuaugcgcaccacgugggcgcugugcgagucuaucacgcucgccaccgggccgcucaccacgcucugggaaggcucccccgggaaauuuuggaacaccacuaucgccgugagcauggccaacauuuuccgaggcuccuauuuagccggcgcggggcuggccuuuucucugaugaagaguuugggugggggccgccgagggacuggcgcgcaaggcgagacgcuaggcgagaaguggaagcgccaacugaaccagcucuccaaauccgaauucaacaccuacaagcggucaggaaucauggaaguggaccgcagcgaagccaaggagggguuaaaacggggcgagaccaccaagcacgcgguguccagagggacggccaaacuccggugguuuguggagcgcaaccuggucaagccugagggcaaagugaucgaccucgggugugggcgggguggguggucuuauuacugcgccgggcugaaaaagguaacggaggucaagggguacaccaaggguggcccagggcacgaagaaccgauccccauggccaccuaugguuggaaccuggucaagcuccacuccggcaaggacguguucuucaugccgcccgagaagugugacacccugcugugcgacaucggcgaaagcaguccaaaccccacuaucgaggagggacgcacccuccgggucuugaagauggucgagccguggcugcgcggcaaccaguucugcaucaagauccucaacccauacaugccuagcgugguggagacccuggagcagaugcagcggaagcacggugggaugcugguccgcaacccccuaucccggaacagcacccacgagauguacugggugucaugcgguacugggaacauagugucggccgucaacaugaccucccgaaugcugcugaaucgguucaccauggcgcaucgcaagcccaccuaugagcgcgacguggaccucggcgccggcacgcgacacguugccguggaacccgagguggccaaucuagacaucaucgggcagcguauagagaacaucaagaacgagcacaagagcacuuggcauuacgacgaagacaacccguacaaaaccugggcuuaucacggcuccuacgagguaaaacccagcggguccgcaagcuccauggugaacggcgugguccggcuucucacaaagcccugggaugugaucccuauggucacccagaucgcgaugaccgacacgaccccguucgggcaacagcguguguucaaggaaaaaguagacacgcggacgccgcgggcuaagcggggcaccacccagaucauggaggucacagcaaaguggcuauggggcuuccucucgcgaaacaagaaaccccgaauuugcacucgcgaggaguucacccggaaagugcgcaguaacgcggcgaucggggccguguucgucgacgagaaccaguggaacagcgcaaaggaggccguggaggacgagcgguuuugggacuuagugcaccgcgagcgggaacugcacaaacagggcaagugcgcgacuugugucuacaacaugauggggaaacgggagaagaagcugggcgaguuugggaaggccaagggcucccgagcuaucugguacauguggcucggggcccgcuuccuggaguucgaggcccugggauucaugaaugaggaccacugguucucccgggagaacagccucuccgggguggaaggggagggccuccacaagcugggguacaucuuacgugauaucucaaaaaucccgggcggcaauauguaugcggacgauacggccgggugggauacgcggaucaccgaggacgaccugcagaacgaagcuaagaucaccgagaucauggagcccgaacaugcccugcucgccacgaguauuuucaagcugaccuaccaaaauaaggugguccgcgugcagagaccggcgaaaaacggcacgguuauggacguaauuaguaggcgugaucagcggggauccggacaggugggcaccuacgggcucaauacguuuaccaauauggaggugcagcugauacgccaaauggaaagcgagggcaucuuucuaccuuccgaacuggagacaccgaaccuggccgagcgcguccuggacuggcuggagaagcauggggccgagcgccucaaacggauggcuauuuccggcgacgacugcguggugaaacccaucgacgaccgcuucgccacagcgcuuacggcucugaacgacauggguaagguccggaaggacauaccacaaugggagcccuccaaaggauggaacgauuggcagcagguuccguuuugcagccaccacuuccaccaacucaucaugaaggacggccgagagauugugguccccugcaggaaccaggacgagcuuguggggcgugccagggugucccagggggccggguggucucuccgagagacggccugcuuaggcaaauccuaugcgcagauguggcaacucauguacuuccacagacgcgaccugcggcucgcugccaacgccaucuguagcgcaguccccguggauuggguccccacuuccagaaccacgugguccauccacgcccaccaccaguggaugacgaccgaggauaugcugagcguuuggaaccggguauggaucgaggagaacccguggauggaggacaaaacacacgugucaucgugggaggaggucccguaccucgggaagcgcgaggaucaguggugcggaucucucauuggucugaccgcgcgcgcgacgugggcgaccaacauccagguggcgaucaaucaagugcggcgccugauagggaacgaaaacuaccucgacuacaugaccagcaugaagagauuuaagaacgaauccgaccccgagggcgcccugugguga

SEQ ID NO: 23912 - RNA, 9879 nt, Artificial Sequence
  derived and/or modified CDS sequence (opt11) from DENV-1__KJ189327__SS-prME
agcgugacgaugcuacucauguuacugcccaccgcccuugccuuccaccugaccacccggggcggggagccccauaugaucgugucaaagcaggagcgggggaagucacugcuguucaagaccagcgcgggagugaacaugugcacacugaucgccauggauuugggagagcucugcgaggacacgaugaccuauaaguguccccaaaucaccgaagccgaacccgacgauguggacugcugguguaaugccaccgauaccugggucaccuacgggacuugcucccagaccggcgagcaucgucgggaaaagcgcuccguggcccuagccccacauguggggcugggccuagagacgcgcaccgagaccuggaugagcuccgagggcgccuggaagcagauucagcgugucgagaccugggcgcugcggcaccccggguucacggugaucgcgcuuuuccucgcgcaugcuaucggcaccagcauaacccaaaaagggauuauuuuuauccugcugaugcucguuacucccuccauggccaugaggugcgucggcaucggcaaccgagacuucguggagggccugagcggcgcgacguggguggacgucgugcuggagcacgggucaugcguaaccaccauggccaaaaacaagcccacucucgacaucgagcuccugaagacggagguuaccaaccccgcuauccuccgcaagcugugcauugaggccaagauuucuaacaccacgaccgacucccgcugcccuacccagggcgaagccacccugguggaggagcaggacgcaaacuucgucugcaggcggaccuucgucgaccgagguugggggaacgggugcggccucuucggcaaagggagccugcugacgugcgccaaguuuaagugcgugaccaagcucgagggcaagaucgugcaguacgaaaaccucaaguacucggucauagugaccgugcacaccggcgaccagcaccagguaggcaaugagacgaccgagcacggcaccaucgcaaccaucacaccccaggcccccacgucggagauccagcucacagacuacggggcccucacccuggacugcagcccccggaccggccuggauuuuaaugagauggugcuccugacgaugaaggagaaguccugguuaguccacaagcagugguucuuggaucugccgcugccguggacauccggagccagcacgucucaagagacguggaaccgacaagaccuccuggugacuuucaagaccgcccacgcgaagaagcaggaagucgucguucugggcucacaagagggggccaugcacacagcccucaccggggccacggagauucagacgagcggcaccaccacaauuuucgcgggccaccugaaaugccgucugaaaauggacaagcucacgcugaagggcaccuccuacgugauguguaccgggucuuucaaguuagagaaggaggucgcggagacgcagcacggcacuguacuggugcaggucaaauacgagggcacggacgcccccugcaagauacccuucagcacccaggacgagaagggagugacgcagaacgggcgccucaucacagccaacccgaucgugaccgacaaggagaagcccgugaacaucgaaaccgagccgccuuucggggaaucauacaucguggucggcgcgggcgagaaggcuuuaaagcuguccugguucaagaaggggagcagcaucgggaagauguucgaggccacggccagaggggcccgccggauggccauccucggggauacggccugggacuucgggagcaucggcggcgucuucaccuccguggggaaguuaguccaucaggucuucggaacggccuacggcguucuguuuagcggcguguccuggacgaugaagaucgggaucggaauccuccugaccuggcugggucuaaauucacgcucgacaagccugucuaugacuugcaucgccgucgggauggucacgcuguaccucggcguuauggugcaggcggacucagggugugugaucaacuggaagggccgcgaacugaagugcgggucgggcaucuucguaaccaacgagguccacacuuggaccgagcaguacaaguuccaagcagacuccccgaaacggcugucggcggcaaucggcaaggcgugggaggagggggugugcggcauccgcuccgccacccgguuggagaacaucauguggaagcagaucagcaacgaacucaaccacauccuccuagagaacgacaugaaguuuacgguaguggugggcgaugcgaacggcauccuggcgcaagggaagaagaugauccgcccccagccgauggagcacaaguacagcuggaagucauggggcaaggccaagaucaucggcgccgacacacagaacaccacuuuuauaaucgacgggcccgauacgccggagugcccggacaaccaacgggcuuggaacauuugggaaguugaggacuauggcuucgggaucuucaccaccaacauauggcucaagcuccgcgauuccuacacccagaugugugaucaccgguugaugagcgcggccaucaaggacuccaaggccgugcaugccgauaugggcuacuggaucgaaagcgagaagaacgaaacguggaagcuggcccgcgcauccuucauagaagugaagacuugcaccuggcccaagagucacacccucugguccaacggugugcuggagucagagaugaucauccccaagaucuacgguggcccgauuucccagcacaacuaccgcccgggguacuucacgcagaccgccgggcccuggcauuuggguaagcucgagcuggacuucgaccugugcgaaggcaccacagucgugguggaugaacacugugggaaucgcgggccgagccuccggacgaccacagucaccggcaagaucauccaugaguggugcugucguuccugcacuuuaccgccgcugcguuuccgcggagaagacgguugcugguacgguauggaaauccgaccggugaaagagaaggaggagaaccucguacgcuccaugguuucagcuggcucuggcgagguagacucguucucccuggggauccugugcgccagcaucaugaucgaggaagugaugcggucccgcuggagccgaaaaauguugaugaccggcacccuggccgucuuccuucuccugaucauggggcagcugaccuggaacgaccucaucaggcugugcauaauggugggugcaaaugccucugacaggauggggaugggcacgaccuaccuggccuugauggcaaccuuuaagaugcggccgauguucgccgugggccuguuguuccgacgacucaccucucgcgagguccuccugcugacgaucggguuaucccugguggccagcguggagcuccccaacuccuuggaggagcugggcgacgggcucgccaugggcauaaugaugcugaagcuguuaaccgaauuucaaccccaccaacucuggaccacccugcucagccugacguuuaucaagaccacgcuaucccuugauuaugcuuggaaaaccacugccauggcgcucucgaucgucucgcuguucccccucugucugagcaccaccucccagaagaccaccuggcugccggugcuccugggcagcuucgggugcaagcccuuaacgauguuccucauuaccgaaaacaaaaucuggggcagaaagagcuggccccugaaugaggggaucauggccaucggaaucgucagcauccugcugucuucucuguuaaagaaugacgugcccuuagccggcccgcugaucgccggcggcaugcugaucgccugcuacgugauuagcggguccagcgcggacuuaucccuggagaaggccgccgaggucagcugggagcaggaggccgaacacucuggcacaucccacaacauccugguagaggugcaggacgacggcaccaugaagaucaaggacgaggaacgcgaugauacgcucaccauccugcugaaggcaacgcuccuggccgucuccggcguguaucccaugagcauccccgccacccuguucgugugguauuucuggcagaagaagaagcagcgguccgggguucuuugggauacucccaguccacccgagguggagcgcgccgucuuagacgacggcauauaucggauacugcagaggggccugcucgggcguucccaggucggcgugggcguguuccaggacggcgucuuccacaccauguggcacgugacgcgcggcgccgugcugauguaccagggcaagaggcuggagcccaguugggccagcgucaagaaagacuugauuagcuacggcggaggcuggcgcuuccagggguccuggaacaccggcgaggagguccaggucaucgcgguugagcccgggaagaaccccaaaaauguccagacgacccccgggacuuucaaaacccccgaaggcgaggugggugcgaucgccuuggauuucaagcccggcacaagcggguccccgaucgucaaccgggaggggaaaaucguaggacuguaugggaacggcguggucaccaccagcggaaccuacguguccgccauugcccaggcuaaagcaagccaggaagggccgcuuccggagaucgaggacgaggucuucaagaagcgaaaucugacgaucauggaucugcacccgggcagcggcaagacccggcgcuacuugcccgcgaucguccgggaggccauaaagcgcaagcugcggacccugauccucgcgcccacaagaguggucgccuccgagauggccgaggcccugaaggggaugcccauccgcuaccaaacgaccgccgucaagucagagcacaccggacgcgagauaguagacuugaugugucacgccacauuuacgaugcgccuccugaguccggugcgaguccccaacuacaacaugaucaucauggacgaggcccacuucaccgacccggcuaguaucgccgcccgcggcuacaucuccacccgaguaggaaugggggaggcggccgcuaucuucaugaccgcgacgccuccgggcagcguagaggccuucccccaguccaacgcagucauucaggacgaggaacgcgauauccccgagcggucuuggaacuccggcuaugacuggaucaccgacuuccccggaaagacugugugguucgugccgagcaucaaguccggcaacgacaucgccaacugccuccguaagaauggcaagcguguuauccagcucagccguaagaccuucgauacggaguaccagaagaccaagaacaacgauugggacuacguugugacuaccgacauauccgagaugggagcgaacuuccgggccgaccgcgucaucgaccccagacgcugccucaagcccgugauccugaaggacggccccgagcggguuauccucgcggguccgaugccggucacgguugccagcgccgcccaacgccggggccgcaucggccggaaccaaaauaaagagggggaccaguacgucuacaugggccagccguuaaacaaugacgaagaccacgcucacuggaccgaggcgaagaugcuacucgacaacaucaacacgcccgagggcauaaucccggccuuguucgagcccgagcgcgagaaguccgccgccaucgacggcgaauaccgccugagaggggaggcccgaaagaccuuugucgagcucaugcggcgcggugaccugcccguuuggcucagcuacaagguggccuccgaggguuuccaauacagcgaccgacgcuggugcuucgacggugagcgcaacaaccaaguguuagaagagaacauggacguugaaaucuggaccaaggagggagaacggaagaagcuacggccccgcuggcucgacgcccgcacguacagugacccguuggcccugcgugaguucaaggaauuugccgccgggcggcgcagcgucagcggagaccuaauccucgaaaucggcaagcugccccagcaucugacacuccgggcucagaaugcucuugauaaccuggugaugcuccacaacuccgagcagggcgggaaggccuaccgccaugccauggaggagcugcccgacacuaucgagacccuaauguugcuggcauuaaucgccguucucaccgguggugucacccuguucuuccuuagcgggaaggggcucgggaaaacgagcaucgggcugcugugcgugacagcgagcuccgcccuccuguggauggcaagcguggaaccucacuggaucgcggcgucaaucauucuggaguucuuucucaugguccucuuaaucccggaacccgaccgucagcgcacgccccaggauaaccagcucgccuacgugguuaucgggcugcuguucaugauccucacagucgccgccaaugagaugggguugcuagagacaaccaagaaggauuuaggcaucgggcauguggcggcagagaaucaccagcacgccacaauguuagacguggaccugaggcccgccagcgccuggacccucuacgcggucgccacaacugucaucacucccaugaugaggcacaccauugagaacaccaccgcgaacauuucccugaccgccaucgccaaccaggcggccauccugaugggccucgauaagggcuggccuauaagcaaaauggacaucggggugccccugcuggcccuuggguguuauucccaggucaacccgcugacccugaccgccgcggugcugauguugguggcacacuaugccaucauugggccaggccuucaggccaaggcuacccgggaagcucagaaacgcacggccgccgggaucaugaaaaacccuaccguggacggcaucguggccaucgaucuggaccccguggucuaugacgccaaguucgagaaacagcugggccagaucaugcuccucauccugugcaccagccagaucuugcucaugaggaccacaugggcucuuugcgagucaaucacccuggccaccgggccucuaaccacgcuuugggaaggcagccccggcaaguucuggaacacaaccaucgccguguccauggcgaauaucuuccggggcagcuaccuggccggcgcgggacucgccuucucccugaugaagucgcugggugggggccgccggggcaccggggcacagggcgagacgcuaggggagaaauggaagagacagcugaaucaacuguccaaaagcgaguucaacaccuacaagcguuccggcauuauggagguugaccgcuccgaggccaaagagggccucaagcggggagagaccaccaaacacgcggucagcagggggaccgcuaagcugcggugguucguggagcgaaaucuugugaagcccgagggcaaggucauagacuuaggcugcgggcggggcggauggucguacuauugcgccggccucaagaaggugacggaagugaagggauacaccaaaggcggcccugggcacgaggagccaauccccauggccaccuacgguuggaaucucgugaaacugcacagcgggaaggacguguuuuucaugccgccagagaagugcgacacccuucugugcgacauaggcgaguccucaccgaacccuacuaucgaggaggggaggacacugcgggugcucaagaugguagagcccuggcugcgggggaaucaguuuuguaucaagauccugaaccccuacaugccgaguguggucgagacacucgagcagaugcagcggaagcacggcgggaugcugguccgcaacccacucagccggaacaguacccacgaaauguacugggugagcuguggcacgggcaacaucgugucugcggucaauaugaccagccgcaugcugcugaaucgauucaccauggcacaccgcaagcccaccuucgagcgcgauguugacuuaggcgccggcacgcggcacguggccguugagccugaaguggccaaccucgauaucauaggccagcggaucgaaaacauuaagaaugaacacaaguccaccuggcacuacgaugaggacaacccguacaaaaccugggccuaccacggcuccuacgaggugaagcccuccgggagcgcguccagcauggucaacggaguggugcgguugcugaccaagcccugggacgucaucccgauggugacgcagaucgcgaugaccgacaccacgccguucgggcagcagagagucuucaaggagaagguagacacacggacgccacgggccaagcggggcaccacgcaaaucauggaagugacggcuaaguggcucuggggcuuccugucccgcaauaaaaagccacggaucugcacucgggaggaguucacccggaagguucgaagcaaugccgcgaucggcgccguguucguggacgagaaccaguggaauagcgccaaggaggcugucgaagacgagagauuuugggaccuggugcaccgagagcgggagcuccauaagcaggggaagugcgcgaccugcguguauaacaugauggggaagcgcgaaaagaaacugggcgaguuuggaaaggcuaagggcucccgagccauaugguacauguggcugggcgcucgcuucuuggaguuugaagcccugggguucaugaaugaggaccauugguucagccgggaaaauucccugucgggcguggagggugagggccuccauaaguugggcuauauccugagagacaucuccaagauccccggcggcaacauguacgcggacgauacggccgguugggauacccggaucacugaagacgaccugcagaacgaggccaaaaucacggauaucauggagccagagcacgcccuucuggccacuagcaucuucaagcucaccuaccagaacaaaguggugagaguccaacggcccgcaaagaacggcaccguuauggaugugaucucccggcgcgaccaacgggggucgggucaggucggcaccuacggguugaacacguuuacaaacauggagguucagcuuauucgccagauggaguccgagggcauauuccuuccuagcgaauuggaaaccccgaaccuggccgagcgggugcucgauuggcuggaaaagcacggggccgagcgucucaagcggauggccaucuccggcgacgacugcgucgucaagccaaucgacgacagauucgccaccgcgcuaacugcauuaaacgacauggggaagguccggaaggacauuccccagugggagccuagcaaaggcuggaacgacuggcagcaggucccguuuugcucgcaccacuuccaccagcugauuaugaaggacgggcgcgagaucguaguacccugccggaaucaggacgagcuagucgggcgcgcgcgagugucgcaaggcgccggguggucccugcgcgagacggcaugccugggcaagagcuaugcgcagauguggcagcucauguacuuccaucggcgcgaccugagacuggccgccaacgccaucugcucggccgugcccgucgauuggguccccaccagccgcacuacguggagcauacacgcccaucaucaauggaugacgaccgaggacaugcucuccgucuggaaccgggucuggauugaggagaacccguggauggaggauaagacccaugugaguucgugggaggaagugcccuaccuggggaagagagaagaccaauggugcggcagccugaucggccucacggcccgagccacgugggccaccaacauccaggucgcgauaaaccaggugcggcgccugauagggaacgagaauuaccuggacuacaugacuuccaugaagcgguucaagaacgaaagcgaccccgagggcgcccugugguga

SEQ ID NO: 23913 - RNA, 9879 nt, Artificial Sequence
  derived and/or modified CDS sequence (opt11) from DENV-1__KJ189328__SS-prME
agugugacaaugcugcucaugcuacugcccaccgcccucgccuuucacuugaccacccggggcggggaaccccauaugaucgucagcaagcaagagcggggcaagagccuacuguucaagaccagcgccggcgugaauaugugcacccugauagccauggacuuaggcgagcuuugcgaagacaccaugaccuacaaguguccgcagaucaccgaggcugagcccgacgacguugacugcuggugcaacgccaccgacaccugggugacuuacgggaccugcagccagaccggagagcaccggcgggagaagcgcuccguggcauuagcgccccacgugggccuggggcucgagacgcggaccgagaccuggaugagcagcgaaggggccuggaagcagauccagcgcguugagaccugggcgcugcggcaccccggguucaccgugauagcccucuuccuagcgcacgccauuggaacaagcaucacccaaaaggggaucaucuuuauccugcuaaugcucgugacccccucaauggccaugcgaugcgugggcauugguaacagggauuucguggagggccugagcggcgccacguggguggacgucguacuggagcacggguccugcguuaccaccauggcgaagaacaagcccacccuagacaucgaguugcugaaaacggagguuaccaacccagcgauccuccguaagcucugcaucgaggccaagaucagcaauaccaccacggacucccggugcccgacccagggcgaggccacgcugguagaggagcaggacgccaauuucgugugcaggcggaccuucgucgaucgcgguugggggaacggcugcgguuuauucggcaaggguagccuuuugacgugcgccaaauuuaagugcgugaccaagcucgagggcaaaaucgugcaguacgagaacuugaaguacuccguaaucgugaccgugcacacuggcgaccaacaccaggucgggaacgagacgacugagcacggaaccauagccacaaucacgccacaggccccgacgagugaaauacagcugaccgacuacggggcccucacucuggauugcagcccucguaccggccuggacuuuaaugagaugguccuccugacuaugaaggagaaaucuuggcuuguccacaagcaaugguuccucgaccugccacuucccuggacuucuggggccagcaccagccaggagaccuggaaccgccaggaccuccucgugacguuuaagaccgcccacgcaaagaaacaggagguggucguacugggcucucaggagggcgccaugcacaccgccuugacgggggcaacggagauacaaaccagcgggaccacaacgaucuucgccgggcaccugaaaugccgguugaaaauggacaagcucacccugaagggcaccucguacgugaugugcaccgggagcuucaaguuggagaaagaggucgcggagacgcaacacggcaccguguuggugcaggucaaguacgagggcaccgacgcgcccugcaagauccccuuuuccacccaggacgagaaaggugugacgcaaaacggccgacucaucaccgccaauccgauuguaaccgacaaggagaaaccagugaacaucgagacagagccgcccuucggugagagcuauaucgugguaggcgccggcgagaaggcccuuaagcugagcugguucaagaagggcagcuccaucggcaagauguuugaggccacggcccgcggggccagacgcauggccauccuuggggacaccgcgugggacuucgggagcauaggcggcgucuucacgagcgugggaaagcuggugcaccaggucuucgguacggcauacgggguucuguucucgggcguguccuggacaaugaagaucggaauuggcauccuccuaaccuggcucggccucaacagccgcucgaccagccuguccaugacaugcaucgcgguggggauggugacacuguaccucggcgugaugguccaggccgacucagggugcgugauaaacuggaaagggcgcgagcugaaaugcggcuccggaaucuucgugaccaacgagguccacaccuggaccgagcaauacaaguuucaggcggauagcccgaagcggcuguccgcggccauugguaaggcgugggaggagggcgugugcgguauucgcuccgccacgcggcuagagaauauaauguggaagcagauauccaacgagcucaaucacauacugcucgagaacgauaugaaguucacgguggucgugggcgaugcaaacggcauccuggcgcaggggaagaagaugauccgcccgcagcccauggagcacaaguacuccuggaagucauggggaaaggccaagauuauaggcgccgacauccagaacaccacuuucaucaucgacgggcccgacaccccggagugccccgacaaccagcgagccuggaacaucugggagguagaagacuacgguuucgguaucuucacgacaaacaucuggcuaaagcuccgcgacuccuacacccagaugugcgaccaucggcugaugucugcggccaucaaggacuccaaggccguccacgccgacaugggguacuggaucgagagcgaaaagaacgagaccuggaagcuggcccgcgccagcuucauagaagugaagacgugcaccuggcccaagagccacacacuuugguccaacggugugcuggaguccgagaugaucauccccaagaucuacgggggcccgaucagucagcacaauuaucggccuggguacuucacccagacggccggcccauggcaccuggggaaguuggagcuugauuucgaccugugcgagggcaccaccgucguugucgacgagcacugcggcaauagaggaccgagccuacggacaacaacgguuacgggcaagaucauccacgaguggugcugccgcucuugcacccuuccgccguuacgguuccgcggcgaggacggcugcugguacggcauggagauccggcccgugaaggagaaggaggagaaccucguacgcagcaugguuuccgccggcagcggggagguugauucuuucucccuugggauccugugcgucagcauuaugaucgaggaggucaugcguucgcgcuggucccggaagaugcucaugaccggcacuuuagcaguguuccuacuccugaucaugggucaacugacauggaaggaucucaucaggcugugcaucauggugggcgcuaacgcauccgauaggaugggcaugggcaccaccuaucuggccuuaauggccaccuucaagaugcggccaauguuugccgucgggcuguuguuccgccggcucaccucccgcgaggugcugcugcucaccaucggacugucacugguggccagcguggaacugcccaacucccuggaggagcugggagacgggcucgcuaugggcauaaugaugcugaagcugcucacggaguuccacccucaccagcuguggacaacccugcucagccugaccuucauaaagacgacacugucucucgauuaugccuggaagacgacggccauggcccugagcaucgugucccucuucccacucugcuuaucuacuaccucccagaagaccaccuggcugccgguccuccuaggaaguuuugguugcaagccccugaccauguuccucaucacugagaacaagauuuggggccggaaguccuggccccugaacgaggggaucauggcgaucgggaucgugagcauccugcuauccucgcuacugaagaacgacgugccucuugccgggccgcugaucgccggcggaauguuaauugccugcuacgucaucagcggguccagcgccgaccucucacuagagaaggcggccgaggugagcugggaacaggaggccgaacacuccgggaccagccacaacauccuggucgagguccaggacgacgggacaaugaagaucaaggacgaagagcgcgacgauacccucaccaucuugcuaaaagccacgcuucuggcgguguccgguguguacccuaugagcauaccagcgacccuguucguuugguacuucuggcagaagaaaaagcaacggucgggagugcugugggacacccccagcccgcccgagguggagagagccguccuagacgauggcaucuaccggauccugcagcgcggccugcucgggcguagccaaguaggcguggggguauuccaggacggcguguuccacacgauguggcacguuacgcgcggggccguccugauguaccagggcaagcggcuggagccgagcugggccuccgugaagaaggaccucauuagcuacggcgggggcuggcgcuuccaggggagcuggaacaccggcgaggaggugcagguuaucgccguggagccagggaaaaaucccaagaacgugcagaccacgccuggaaccuucaaaacgcccgaaggggaggucggggcgaucgcccucgacuuuaagcccgggacuucugguucgccuaucguuaaccgggagggaaaaauagugggucuuuacggaaacggcguagucacgaccuccggaaccuauguguccgccaucgcgcaggcaaaggcgagccaggagggccccuuaccagagaucgaggacgaggucuucaagaagcgcaaucugaccauaauggaucugcaccccgggucuggcaagacacggcgcuaccuccccgccaucgugcgcgaggccaucaaacgcaaguuacggacccugauccucgccccuacccgcguugucgcguccgagauggcagaagcccugaaggggaugcccauccgcuaccagaccacggccgucaagagcgaacacacagggcgggagaucguggacuugaugugccacgccaccuucacgaugcgccuccuguccccggugagaguuccuaacuauaauaugauuaucauggacgaggcgcacuucacggaccccgccuccaucgccgcccgcggcuacaucuccacacggguggggaugggcgaggccgcugcuauauuuaugaccgccacgcccccggggagcgucgaagccuucccccaguccaacgccgugauccaggacgaggagcgagacaucccugagcggagcuggaacuccggcuaugacuggaucacagacuuccccgguaagacaguaugguucguucccagcaucaaguccgggaaugacaucgcgaauugccuccgcaagaacggcaagcgggugauccagcucagccgaaagaccuuugacacugaauaccaaaaaacgaagaacaaugacugggacuacguggucacaaccgacauauccgagaugggugcaaacuucagggcggaucggguuaucgacccccggaggugccugaagccggugauucuuaaggacggacccgagcggguaauccuagccgggccaaugcccgugaccguggccucugcggcccagcgccggggccggaucgggcggaaccagaacaaagagggggaccaauacgucuacaugggccaacccuugaauaacgacgaggaccacgcgcacuggacggaggccaaaaugcuccucgacaacaucaacaccccggaggggauaauacccgcgcuguuugagccagagcgcgaaaagagcgccgcgaucgacggcgaauaucgccuucgcggugaagcccgcaaaaccuuuguggaacucaugcggcgcggcgaucugcccgucuggcugagcuacaagguggcguccgagggcuuccaguacucggaccggcgcuggugcuuugacggggagcggaacaaccagguucucgaggagaacauggacgucgagauauggaccaaggaaggcgagcgcaagaagcugcgcccacgcuggcuggaugcccggaccuacucggacccgcuugcccugcgagaauucaaggaguucgccgccgggcgacggagcguaucuggcgaccuaauccucgaaaucgguaagcugccacagcaucugacgcuccgggcccagaacgcccuagacaaccuggugaugcuccacaacuccgaacagggcgggaaagcguaccgccacgccaucgaggagcucccugacaccaucgagaccuugaugcuccuggcccugaucgcgguucucaccgggggcguuacgcuguuuuuucugagugguaaaggacucggcaagaccuccauugggcuguugugcguuaccgcaagcuccgcucuccuguggauggcgagcgucgagccccauuggauagccgcguccauaauccuggaguucuuccucauggugcugcugaucccggaacccgaccggcagcgcacgccccaggacaaccaacucgcauacguggugaucggucugcucuucaugauccucacaguggcggcuaacgagauggggcugcuggagaccaccaagaaggaccucggcaucgggcauguggcagcggagaaucaucagcacgccacaaugcuggacgucgaccugcggccggccagcgccuggacacucuacgcuguggccacgaccgucauaaccccuaugaugcgucacacgaucgagaacacuacugccaauaucucgcugacggccauagccaaccaggccgccauccugaugggccucgacaagggcuggccuauuagcaaaauggauaucggcguccccuugcuugcccucggcugcuacucccaggugaacccguugaccuuaaccgccgccguucucaugcuugucgcgcauuacgccauuaucgggcccggccugcaggcaaaagcuaccagagaggcccagaagcggaccgcggcuggaaucaugaagaaucccaccguggacggcaucguggccaucgaccucgacccagucguguacgacgccaaguucgagaagcagcugggucagauaaugcugcucaucuuaugcacgagccagauccugcucaugaggaccaccugggcccucugugaguccaucacgcuggcgaccgggccucucacuacccucugggaaggcagccccgggaaguuuuggaacacgaccaucgccgugucuauggccaacaucuuucggggcagcuaucuugcgggggccgggcucgcguuuagccugaugaagucccugggcgggggccgccgggggaccggcgcccagggcgagacccucggggagaaguggaagcgccagcugaaccagcuguccaagagcgaguucaacaccuacaagcggagcggcauaauggaagucgaucgcagcgaggccaaggaaggucucaagcggggcgagaccaccaagcaugccgugucacgcggcaccgcgaagcuucggugguuuguggaaagaaaccuggucaaacccgagggcaaagucaucgaccuggguugcgggcggggaggaugguccuacuacugcgccggccucaagaaggugaccgaggucaagggguacacgaagggcgggccagggcacgaggaaccaaucccuauggccaccuacggcuggaaccucgugaagcugcacagcgggaaggauguuuuuuucaugccgcccgagaaaugugacacacuccugugcgacaucggcgaaucaagcccgaaccccacgaucgaggagggccgcacgcugcggguccucaagaugguggagcccuggcugcgcggcaaccaguucugcaucaaaauccugaaccccuacaugccguccgucgucgagacccucgagcagaugcagcggaagcacggcgguaugcuggugcguaauccccugagucggaacuccacacacgaaauguauugggugagcugcggcacggguaacaucgucagugccgugaacaugacgagccgcaugcuccuuaaccgguucaccauggcacacagaaagcccaccuaugagcgcgacguggaccucggggcggggacccggcaugucgccguggagcccgagguggccaaccucgacaucaucgggcagcgcauugagaauaucaagaacgagcacaaauccacguggcacuacgacgaggacaacccguacaaaacuugggccuaccacgguagcuacgaagucaagccgaguggaagcgccuccagcauggugaacggcguagucaggcugcugaccaagcccugggacgugauccccauggucacccagaucgcgaugacggacaccaccccguuugggcagcagcgcguguucaaggagaagguggacacccggaccccccgcgccaaacggggaaccacccagaucauggaggucacagccaaguggcucugggguuuccugucgcgcaauaaaaagccccggaucugcacgagggaggaguucacccggaaggugcguagcaacgccgcaaucggcgccguauucguugacgagaaccaguggaacagcgccaaagaggccguggaggacgaacgguuuugggacuugguucaccgcgaacgagagcuccacaagcagggcaagugcgcgaccugcguauacaacaugauggggaagcgcgagaagaaacugggcgaguuugggaaggcgaaggggucgcgggccauaugguacaugugguuaggcgcccgcuuccucgaguuugaggcccugggguucaugaacgaggaccacugguucagccgggaaaacucgcugucuggcguggagggggagggccugcacaaacuaggguacauacugcgcgacaucuccaaaaucccgggcggcaacauguacgccgaugacacagcggguugggacacgcggaucaccgaagacgaccuccagaacgaggccaagauuaccgauaucauggaacccgagcaugcacugcucgccaccagcaucuucaagcucacguaccagaacaaggugguucgcgugcagcgucccgccaagaacggcaccgugauggacgugaucagucggcgcgaccagcgggggagcggccaggugggcacuuacgggcugaacacuuucacgaacauggaagugcagcuuauccgccagauggagucugagggcaucuuccuccccagcgagcuggagacgccgaaccuggcugagcggguccuggacuggcuggagaagcauggcgcagagcgccuuaagcggauggcaaucucaggcgacgacuguguuguuaaacccaucgacgaccgcuucgccaccgcccucacagcgcugaacgacauggggaaggugcggaaggacaucccacagugggagcccagcaagggguggaaugauuggcagcaggucccguucugcucccaucacuuucaccagcugaucaugaaggacggccgcgagaucguggucccgugucggaaccaagacgagcuaguggggagagcucgggugagccagggcgccggguggucccucaaggagaccgcgugcuuaggcaagucguacgcucagauguggcagcucauguacuuccaccgccgggaccuccgccuggcggccaacgccaucugcuccgcuguccccguugacugggugcccacgucccggaccaccugguccauccacgcgcaccaccaguggaugaccacggaagauaugcucucugucuggaaccgcguguggaucgaggagaacccguggauggaggacaagacccacgugaguaguugggaggagguccccuaccuagggaagcgggaggaccaguggugcggaagccugaucggccucaccgccagagccaccugggccaccaacauccagguggccaucaaccaggugcgccggcugauagggaacgaaaauuaucuggacuauaugacauccaugaagcgcuuuaaaaacgagagugauccugagggcgcgcucugguag

SEQ ID NO: 23914 - RNA, 9879 nt, Artificial Sequence
  derived and/or modified CDS sequence (opt11) from DENV-1__KJ189329__SS-prME
ucggugacaaugcugcugaugcugcuucccaccgcccuggcguuucaccugaccacccggggcggggagccccacaugaucgugagcaagcaagagaggggcaagucucucuuauuuaagaccuccgcuggagugaacaugugcaccuuaauugccauggaccugggcgaguugugugaggacacaaugaccuacaagugcccacagaucacagaagccgagcccgacgacgucgacugcuggugcaacgcuaccgacgccugggucaccuacgggaccuguucgcagaccggagaacaccggcgggacaagcguucuguggcacuagccccucacgugggacugggacuggagacgcggacggaaaccuggaugagcuccgaaggcgccuggaaacaaauacagcggguagagacuugggcccugcggcaucccggguucaccguuauugcuuucuuccuggcccacgccauagggaccagcaucacccagaaggggaucaucuucauccuguuaaugcugguaacccccucgauggccaugcgcugcgucggcauagggaaccgggacuucguggaagggcuaagcggcgccacuuggguggacguuguacuagaacacggauccugcgugacgaccauggcgaagaacaaacccacuuuagauaucgagcucuugaaaaccgaggucacgaaccccgcgauccuucgcaaacucugcaucgaggccaagauuagcaacaccaccaccgacagccggugcccuacucagggcgaggccacccugguggaggagcaggacgcgaacuucgugugccgccgcaccuucgucgauagaggcugggggaauggcugcggucuuuucgggaaggggagccucuugacaugcgcgaaguuuaagugcgugacgaaguuggagggaaaaaucguccaguacgaaaaccuaaaguacuccguaauagucaccgugcacaccggcgaccagcaccaggucggcaacgagaccacugagcacggaacaaucgccacaaucacgccccaagcccccaccagugagauccaacuuacggacuacggggcccugacccucgacugcuccccccggaccggccuugacuucaacgagauggugcugcucaccaugaaggaaaaguccuggcugguccacaagcaaugguuccuggaccucccguugccuuggacguccggggccagcaccucccaggagaccuggaaccgccaggaccugcucguuaccuuuaagacggcccacgcaaaaaagcaggagguugucgugcugggcucucaggagggagcaaugcauaccgcccugaccggggccaccgagauacagaccaguggcaccaccaccaucuucgcugggcaccucaagugucggcugaagauggauaaguugacccucaagggcaccucguacgugaugugcacgggaagcuucaaguuagaaaaagaggucgccgagacacagcauggcacggugcuggugcagguaaaguacgagggcacugacgcccccugcaaaauccccuucucuacccaggacgagaagggagugacccagaacggccgcuuaaucacagccaacccaauagugaccgacaaggagaagcccgucaauaucgagacugagccgcccuucggggaaagcuacaucguggugggagcgggcgaaaaggcccucaagcuuuccugguucaagaaggggagcuccaucgggaagauguuugaggccacagcccgcggggcccgccgcauggcuauucugggugacaccgccugggacuucggcagcaucggcggcgucuucaccuccguggggaagcucgugcaccagguauucggcaccgcuuacgggguacuguucucagguguguccuggaccaugaagauaggcaucggcauacugcucacguggcugggucucaacucaagguccacgagccucucgaugaccugcaucgccgucgggauggugacacuguaccugggcgugauggugcaggcugacucggggugugugauaaauuggaaggggcgcgagcucaagugcggauccggcauauucguaacgaaugagguccacacauggacggagcaguacaaauuccaggcggacagcccgaaacgucugucugccgccaucggcaaggccugggaggaggggguguguggcauucgcuccgcgacccggcuggagaacaucauguggaagcagauuagcaacgagcucaaccacauccuguuggagaacgacaugaaauucaccgucgucguuggagacgcgaacgggauucucgcacaggggaagaaaaugauccgcccccaacccauggaacacaaguacuccuggaagucuuggggcaaggccaagaucaucggcgccgacauccagaauacaacguucaucauagacggacccgacaccccggagugccccgacaaccagcgggccuggaacauaugggaggucgaggacuauggcuucgggaucuucaccacgaacaucugguugaaacugcgcgacuccuacacacagaugugcgaccaccggcucaugagcgcugcaaucaaggacucgaaagccguccacgccgauaugggguauuggaucgaaagcgagaaaaacgagacauggaagcuggcucgcgccuccuuuaucgaagugaagaccugcacguggccaaagucccauacccugugguccaauggcgugcuagagagcgagaugaucauaccgaagauuuacgggggcccgaucucccaacacaacuacaggagcggguauuucacccagaccgccggcccuuggcaccuggggaaacuugagcucgacuucgaccuaugcgaggggacgaccguaguuguagacgaacauugcggaaaccgcgggcccucccuucgaacuaccacggucacuggcaagaucauccacgagugguguugucgcagcugcacccucccaccccuccgguuccgcggggaagacggcugcugguacgggauggagauacggccuguuaaggagaaggaggagaaccugguacgcuccauggucucggccggcagcggcgagguggacuccuucagccucgggauccucugcgccuccaucaugaucgaggaaguuaugagaagccgcuggucccggaagaugcucaugacgggaacgcuggcugucuuccugcugcucgugaugggucaauugaccuggaacgaccugauccgccucugcauuauggugggcgccaacgccagcgaccgcauggggaugggcaccaccuaccuggcacugauggccacguucaagaugcggcccauguucgcggucggccugcuguuccguagacuaaccagcagggaagugcuacugcugacuaucgggcucagccugguagcguccgucgagcugccaaauagucucgaagagcugggagauggacuagccaugggcauuaugaugcucaagcuucugaccgaauuucagccacaccagcucuggacgacccuucugucccucacuuucaucaagaccacgcuaagcuuggacuacgccuggaaaaccacugcgauggcccucuccaucgugagcuuguuuccccugugccucuccaccacgagccaaaagaccaccuggcugcccguucuacucggcuccuucgguugcaagccgcuaacuauguuccuuaucacggagaacaaaaucugggggcgcaagagcuggccccucaaugaagggaucauggcuaucggcaucguguccauucugcugagcagccuccucaagaacgacgugccauuggccgguccuuuaaucgccggagggaugcuuaucgcuuguuacguuauauccgggagcuccgccgaccucagccuagagaaggccgccgagguguccugggagcaggaggccgagcacucgggcacgucccacaacauccugguggagguccaagacgacgggaccaugaaaaucaaggacgaggagcgcgaugacacucuaaccauccuccugaaggcuacgcugcuugccgugagcgggguguacccgaugucuauacccgccacccuguucgucugguacuucuggcagaagaagaagcaacggucgggggugcugugggacacgcccagcccgcccgaggucgagcgcgcaguccucgaugacggcaucuaccggauccuacaacgcggccugcuggggcggagccaggugggcguggggguguuccaagacggcguauuccacacaauguggcacgugacgcgcggggccguccuuauguaccaggguaagcggcuggagccuuccugggcguccgucaagaaggaccugaucuccuacggcggcggcuggcgcuuccaagggucguggaacaccggggaggaggugcaagucauugccguugaacccgggaagaaccccaagaacgugcagaccacccccggcaccuucaagacccccgagggcgaggucggggccaucgcccucgacuuuaagccuggaaccagugggucacccauugugaauagagaggggaagaucgucggccucuaugggaauggcgucgugaccacguccgguaccuacgucagcgccaucgcgcaggccaaagccagucaggagggcccgcugcccgaaaucgaggacgaagucuuuaagaagcgaaaccucaccaucauggaccugcaccccggguccggcaagacccggcgcuaccugccggccaucgugcgggaagcgaucaagcgaaaguugcggacgcuaauccuggccccuacccgaguggucgccucugaaauggcggaggcccucaaggggaugccuauccgcuaccagaccaccgcggugaagagcgagcacacggggagggaaauuguggaccugaugugucacgccaccuuuacuaugcggcuucucagcccuguccgggugccaaacuacaacaugauuaucauggacgaggcccacuucaccgaccccgccuccauugcugcacgcggcuacauuagcacgcggguggggaugggcgaagccgccgcuaucuucaugacagcaacgccgcccggguccgucgaggccuucccgcaguccaacgcugugauccaggacgaggagcgggacauacccgagcgcuccuggaauagcggcuacgacuggaucaccgacuuuccugggaagacgguaugguucguaccguccaucaagagcgggaacgacaucgcuaauugccugcgcaagaacggcaagcggguuauccagcugucccgcaagaccuucgacaccgaguaccagaagaccaagaacaacgacugggauuacguggucaccacggacauuagcgagaugggugccaacuuccgggcggaucgcgugaucgacccgcggcgcugccucaagcccguuauccugaaggauggucccgagcgggucauccuggcggggccaaugccggugaccguggccuccgccgcucagcgccggggucgaaucggccggaaccaaaacaaagagggugaccaguacgucuacaugggccagccgcugaacaaugacgaggaccacgcccacuggacugaggccaagaugcuccuggacaacauaaacacgcccgaggggaucaucccagcauuauucgagccggagcgcgagaagagcgccgcaaucgacggagaguacagacugagaggugaggcgcguaagaccuucguggagcucaugaggcgcggagaccucccuguuuggcuauccuacaagguggccagcgagggguuccaguacuccgaccggcgcuggugcuucgacggggagcggaacaaucaggugcuggaagagaacauggacgucgagaucuggacgaaggagggcgagcgcaagaagcuccgccccagguggcuagacgcccgcaccuacagcgacccccucgcccuaagggaguuuaaggaguuugccgcggggcggcgcagcguguccggugacuugauccuggagaucggcaagcucccucagcaccugaccagccgggcccagaacgcccuugacaaccucgugaugcugcacaauagcgagcagggcgggaaagcuuaccgccacgcgauggaggaguugcccgacacgauugagacccucaugcugcuggcccugaucgccguccuuaccggaggugugacccuguuuuuccucuccgggaagggccuggguaagacguccaucgggcugcucugcgugaccgccagcuccgcccugcuguggauggcguccguugagccccacuggaucgccgcauccaucauccucgaguucuuccugauggugcugcuuauucccgagccggauaggcagcggacgccucaggauaaccagcuugcauacguggucaucggguugcuguucaugauccugaccguggccgcgaacgagauggggcugcucgagacgaccaagaaggaccugggcaucggacacguggcggccgagaaccaccagcacgcaaccaugcuagacgucgaccuccgcccugccagcgcguggacccuguaugccguggccacuaccgugaucaccccgaugaugcgccacaccauugaaaauacgacugcgaacauaucccugaccgccaucgcgaaucaggccgcaauccucaugggccuugacaagggcuggcccaucagcaagauggacaucggggucccccugcucgcccugggcugcuauucccagguuaacccccuaacccucacagcggccgugcugaugcugguggcgcacuaugccaucaucgggccgggacuacaagcgaaggcgacccgagaggcccaaaagcgcaccgccgccgggaucaugaagaaucccacgguggauggcauuguggccauugaccuggacccggucguauacgacgcgaaauucgagaagcagcugggccagaucaugcuccugauccugugcacaagccagauucuccugaugcgcaccaccugggccuuaugcgaguccauaacccucgcaacaggaccgcucaccacccuaugggaggguagcccgggcaaguucuggaacaccacgaucgccguguccauggcgaacaucuuccgagguagcuauuuagcaggcgccgggcuugccuuuucccugaugaaaucacucggcgggggccgccggggcacaggagcccagggcgagacccugggggagaaguggaagcgccaguugaaccagcucaguaagucagaguuuaacaccuacaagcguagcggcaucauggagguugaccgcucggaggcgaaagagggccuaaaacggggcgaaacgaccaaacacgccgugagucgcgggaccgcuaagcugcggugguuuguggagcgcaaccucguuaagcccgagggcaaggugaucgaucugggcugcggccggggcggauggaguuauuacugcgcgggccugaaaaaggugaccgaggucaagggguacaccaagggcggcccaggccacgaggagcccaucccgauggccacguacggcuggaaccucgugaagcuccacuccggcaaggacguuuucuucaugccgccagagaagugcgacacccugcugugugacauaggcgaguccagccccaacccgaccaucgaggaggggcggacauugcggguccugaagaugguggagccguggcugcgcggaaaccaguucugcauaaagauccucaaucccuacaugcccaguguggucgagacgcuggagcaaaugcagcggaagcacggcgggaugcuggugcgcaauccgcucagccggaacuccacccacgagauguacugggugagcugcggaaccgggaauaucgucuccgcggugaacaugacaagucgcauguuacugaaucgguucacaauggcccaccgaaaaccaaccuacgagcgcgacguggaccucggcgccggcacccggcacgucgccguggagcccgagguggccaaccuggauaucaucgggcagcgcauagaaaauauaaagaacgagcacaaguccaccuggcacuacgacgaggauaaucccuaccgaacgugggcuuaucauggcagcuacgaggucaaaccguccgggagugccucuucaauggugaacggggugguccgucuucucacuaagccgugggacgugauucccauggucacccagaucgccaugaccgacacaacucccuucggccagcagcggguguucaaagaaaagguggacacaagaaccccgcgggcaaagcgcggcacgacccagauaauggaggugaccgccaaauggcucuggggcuuccuaagccggaacaaaaagccucgcauaugcacccgggaggaauuuacuagaaaggugcgcuccaacgcggccauaggggccguguucgucgacgagaaccaauggaacuccgcgaaggaagcgguagaggaugagcgcuucugggaucucguccaccgggagcgcgagcugcacaaacagggcaagugcgcuacuugcguguacaauaugauggggaagcgagagaagaagcugggcgaauucgguaaggccaaaggaucccgcgccaucugguacauguggcuuggagcucguuuucuagaguucgaagcgcucggguuuaugaacgaggaccacugguucagccgcgagaacucccucucuggcguggaaggagagggacugcacaagcucggguauauccuccgggacauuuccaaaauaccaggagggaacauguacgccgacgacaccgccgggugggacaccagaauuacggaagacgaccuucagaacgaggccaagauuaccgagaucauggagccggagcacgcccugcucgcuaccucuauauucaagcugacauaccagaacaagguuguccgcgugcagcggccugccaagaacggcacugugauggacgucauaucccgccgggaccagcgcgggagcggccagguggggaccuacgggcugaacacuuucaccaacauggaagugcagcuuauccggcagauggaguccgagggcauauuccugcccagcgagcuggaaacgccgaaccuugcagagcgcguccuggacuggcuggaaaaacacggggccgagcggcuaaagcgcauggcgaucuccggcgacgacuguguggugaagccgaucgacgaccgguucgcgacggcgcugacagcccugaacgacaugggcaagguccgcaaggacaucccccagugggagcccagcaagggcuggaacgacuggcagcagguacccuucugcagucaccacuuccaccagcuaaucaugaaagaugggcgggagauagugguuccgugcaggaaccaggacgagcuggugggucgggcccgcgugagccagggagcuggguggucccugcgggagaccgcuugccuaggcaagucguacgcucaaauguggcaacugauguacuuccaccgccgggaucuccgccucgccgccaacgcgauauguucagccguccccgucgacuggguccccaccucccggacgaccuggagcauccaugcgcaccaccaauggaugaccaccgaggacaugcugagugucuggaaccgcgucuggaucgaggagaaucccuggauggaggacaagacgcacguaagcagcugggaggaagucccauaucuggggaagcgcgaggaccagugguguggcagccucauuggacugaccgcccgggccaccugggcgaccaacauccaggucgccaucaaccaggugcggcggcuaaucgggaacgagaauuaccuagacuauaugacguccaugaagcgcuucaagaacgagagcgaccccgaaggcgccuuaugguga

SEQ ID NO: 23915 - RNA, 9879 nt, Artificial Sequence
  derived and/or modified CDS sequence (opt11) from DENV-1__KJ189331__SS-prME
agcgugacaaugcuguugaugcugcugcccaccgcccuggccuuucaccugaccacccggggaggggagccccacaugauagugagcaagcaggagcggggcaaaagccuccuguuuaagaccagcgcgggcgugaacauguguacccugauugcgauggaccugggugagcucugcgaggacaccaugaccuacaagugcccccagauuaccgaggccgagccggacgacguggauugcuggugcaacgccaccgacaccuggguaacauacgggaccugcagccagacuggcgagcaccggcgcgacaaaagauccguggcucuggcgccccacgugggccuggggcucgagacacggaccgagaccuggaugagcuccgagggggccuggaagcagauccagcgcgucgagacuugggcguuacggcaccccggguucacggugaucgcccuauuccuggcgcacgccaucggaaccagcaucacccaaaaggggaucauuuucauccugcugaugcuuguaacccccuccauggcuaugcgcugcgucggcaucggcaaccgggacuucguggaggggcugagcggcgccacguggguggaugucgugcuggagcacggguccugcgugaccacuauggccaagaacaagcccacccuagacauagagcugcugaagacggaggucaccaaccccgcaauccuucgcaagcuuugcaucgaggccaagaucagcaacacgacaacggacucccggugcccgacccagggcgaggccacucugguggaagagcaggacgccaauuucgugugccgucggaccuucgucgaccgcggcugggggaacggcugcggccucuucggaaaggggagccuguuaacgugcgcuaaguucaagugcgugacgaagcucgagggcaagaucgugcaguacgagaaucugaaguacuccgucaucgugacagugcauaccggcgaucagcaccaggucgggaaugagacgaccgagcacggaaccaucgcgaccaucacgccccaagcccccacgucugaaauacaacugaccgacuauggcgcccucacccuggacugcagcccccggaccggccuggauuucaacgagauggugcuccugacgaugaaggaaaaguccuggcugguucacaagcagugguuccucgacuuaccgcugcccuggacgucuggggccagcaccagccaggagaccuggaaccgccaggacuugcuuguaacguucaagaccgcccacgcaaagaaacaggagguggucgugcugggcucccaggagggggccaugcacaccgccuuaaccggggccacggagauccagaccagcggcacuaccacgaucuucgccgggcaccucaaaugccgucugaaaauggacaagcucacccugaaaggcaccuccuacgugaugugcaccgggagcuucaagcuggagaaggagguggcggagacgcaacacggaaccgugcugguccaggucaaauacgagggaaccgaugcccccugcaagauccccuucuccacccaggacgagaagggugugacgcagaacggccgccucaucaccgcuaacccaaucgugaccgacaaggagaagccagucaauaucgaaaccgagccgcccuucggggagagcuacaucgugguaggggccggcgagaaggcgcugaagcuguccugguucaagaaggggagcuccaucggcaagauguucgaggcgacggcccgcggggcccgccggauggcgauccucggcgacaccgcgugggacuucgggagcaucggcggcgucuucacuuccgucgggaagcucgugcaccaggucuucggaacagccuacggggugcuguucagcggagugucuuggacgaugaagauagggaucggaauuuugcugaccuggcuaggccuaaacagcagguccacaagccuguccaugaccuguaucgccgucggcauggugacgcuguaccucggcgugauggugcaggccgacagcgggugcgugaucaacuggaagggccgcgagcugaagugcgggagcggcaucuucgugaccaacgagguucauaccuggaccgagcaguacaaguuccaggcggacagccccaagcggcugagcgcggccaucggcaaggccugggaagagggggugugcggcauacgcuccgcaacccggcucgagaacaucauguggaagcaaauaaguaacgagcugaaucacauccugcucgaaaacgacaugaaguucacggucgucgugggcgacgccaacggcauacuggcccagggcaagaagaugauccgcccgcagcccauggagcacaaguacagcuggaaguccuggggcaaggccaagaucaucggugccgacauacagaauaccaccuucaucaucgacgggcccgauacaccggagugucccgacaaccagcgggccuggaacaucugggagguggaggacuacggcuucgguaucuucacuaccaacaucuggcugaagcuccgcgacucguacacccagaugugcgaccaucggcugaugagcgcggccaucaaggacuccaaggccguccacgccgacaugggcuacuggaucgaaagcgagaagaacgaaaccuggaagcuggcccgcgcguccuucauagaggugaaaacgugcaccuggcccaaaagccacacccucugguccaacggcguacuggagagcgagaugaucauccccaagaucuacgggggcccgaucucacagcacaacuaccggcccggguacuucacucaaacggccgggccauggcaccuggggaaguuggagcuggacuucgaccugugcgagggcaccaccgucgugguggacgagcacuguggcaaccgcgggccgagccuccggaccacgaccgucaccggcaagaucauccacgaguggugcugccgcuccuguacccugcccccccugcgguuucgcggggaggacggcugcugguacgggauggagauccggcccguaaaggagaaggaagagaaccucguccgcagcauggucuccgccgggagcggcgagguggacucauucucccuggguauccuaugcgccagcauaaugaucgaggaaguaaugcggucucgcuggagccggaagaugcucaugaucggcacgcuggccgucuuccuucucuuaaucauggggcagcugaccuggaacgaccucauccgccugugcaucauggugggcgcgaacgccuccgaccgcauggggaugggcacuaccuaccuggcccucauggccacguucaagaugcggccuauguucgccguggggcugcuguuccgccggcucaccagccgcgaaguccugcugcucaccaucgggcucucacugguggcgagcguggagcuccccaacucacuggaggagcugggcgacgggcucgccaugggcauaaugaugcugaagcugcuaaccgaguuccagccccaccaacuguggacgacucugcucagccugaccuucaucaagacuacgcugucccucgacuacgccuggaagaccaccgccauggcccugucaaucguuucccuguucccucucugccugagcaccacgucccagaagaccaccuggcugccggugcuacucggcaguuucgggugcaagccccugaccauguuccucaucaccgagaacaagaucugggggcggaaguccuggccccugaacgaggggaucauggccaucggaaucgucagcauccuccuauccagccugcugaagaaugacguccccuuagccgggccucugaucgcugguggcaugcugauugccugcuacgugaucagcggguccagcgcggaccuuuccuuagagaagaccgccgagguaagcugggagcaggaggccgagcacuccggcaccagucacaacauccugguggaggugcaagacgacgggacaaugaagaucaaggacgaggagcgugaugacacacucacgauuuuacugaaggccacccuccuggccgucagcggcguuuaccccaugagcauccccgcgacccuguucgugugguacuucuggcagaagaaaaagcagcggucggggguccucugggacacccccagcccgcccgagguggagagagccgugcuggacgacggcaucuaccggaucuugcagcgcggcuuacucgggcggucccaagucggcguggggguguuccaggauggcguuuuccacacgauguggcacgugacccgcggggccguacugauguaccagggcaagcggcuggagccgagcugggccuccguuaagaaagaccugaucagcuauggcgggggcuggcgcuuccaaggauccuggaacaccggcgaggagguccaagugaucgccgucgaacccgggaagaauccgaagaacgugcaaaccacgcccggcaccuucaagacccccgagggcgaggugggggcgaucgcccuggauuucaagccuggcaccagcggguccccgaucgucaaccgggaggggaagaucgugggccuguacgggaacggcguggucacuaccagcggcaccuacguguccgcaaucgcccaggccaaggcgucacaggagggcccgcucccugagaucgaggacgaaguguuuaagaagcgcaaccucaccaucauggaucuacacccggggagcggcaagacacggcgcuaccucccggcgaucguccgggaggccaucaagcgcaagcugcggacccugauccucgccccgaccaggguaguggcguccgagauggccgaggcccugaagggaaugcccauccgcuaccagaccacggccgucaagucggagcacaccgggcgggagaucguggaccucaugugccacgcuaccuucacaaugcgucuauuauccccggugcggguccccaacuacaacaugaucaucauggacgaggcacacuucacggaucccgccagcauugccgcccgcggcuacaucuccacccggguggggaugggcgaggccgcggccaucuucaugaccgcuacgccgcccggcagcgucgaggccuucccccaguccaacgccgucauccaggacgaggagcgcgacauccccgaacgcagcuggaacucaggauacgacuggaucacggacuuccccggcaagaccgugugguucgugccgagcaucaaguccgggaacgacaucgcgaacugccuccgcaagaacggcaagcgggucauccagcuaagccgcaaaaccuucgacacggaguaucagaagacgaagaacaacgacugggacuacguggugaccacagacaucuccgagaugggggcuaacuuccgggccgaccgcguaaucgauccccggcgcugccugaagcccgugauacugaaggauggccccgagcgggugauccucgcuggcccgaugccagucaccguggcgagcgcagcacagcgccggggccgcaucggccggaaccagaacaaggagggcgaucaguacguguacaugggccagccccugaacaacgacgaggaccacgcccacuggacggaggccaagaugcuacuugacaacaucaacaccccagagggaaucauaccggcgcuguucgagcccgagcgcgagaaaagcgcggccaucgacggcgaguaccggcugcgcggggaggcccgcaagaccuucguggaguugaugaggcgcggcgaccugcccguguggcuuagcuacaaggucgcgagugagggcuuccaguacagcgacaggcgcuggugcuucgauggggagcggaacaaccaggugcucgaggagaacauggacguggagaucuggaccaaggagggcgagcgcaaaaagcugcggccccgguggcuggacgcgcgaaccuacucugacccgcucgcccugagggaguucaaggaguucgccgccgggcgacguagcgucucuggcgacuugauccucgagaucggcaagcuaccucagcaccugacgcuccgggcccagaacgcgcuggacaaccuggccaugcuccacaacuccgagcagggagggaaggccuaccgccacgccauggaggaacugcccgacacuaucgagacccugaugcuccuggcucugaucgccguguuaaccgggggcgugacacuguucuuccugucggggaagggccucgggaagaccuccaucggguuauuaugcgucaccgccagcuccgcccuccuguggauggccucaguggagccacacuggaucgcugcguccauuauacuggaguucuuccucaugguccuccugaucccggagccggaccggcagcggacgccccaagacaaccagcucgccuacgucgugaucggauugcuguuuaugauccucacgguugccgccaacgagauggggcugcuggagaccacuaagaaggaccucggcaucgggcacgucgcggccgagaaccaccagcaugcuaccauguuagacguggaccugcggccagccagcgccuggacgcucuaugcgguggcgacuaccgucauuacccccaugaugcgccacacgaucgagaacaccacugccaacaucucccugaccgccaucgccaaccaggccgcuauccugaugggccucgacaaggguuggcccauuucgaagauggacaucggggugccccugcucgcccucggcugcuacucccaggugaacccgcugacgcugaccgccgcaguccucaugcugguagcccacuaugccaucaucgggcccggccugcaggccaaggccacccgggaggcgcagaagcgcacagcggccgggaucaugaagaaccccacgguugacggcaucgucgccaucgaccucgaccccgugguguacgacgccaaguucgagaagcaacugggccagauuaugcuucucauccugugcacuagccagauccugcucaugaggacgaccugggcguuaugcgaguccaucacgcuggcgacagggccgcucaccacccugugggagggcagccccgggaaguucuggaacacgaccaucgccgucuccauggccaauauauuccggggcagcuaccuggccggcgcggggcucgccuucucucugaugaagucgcugggcgggggccgccggggcaccggcgcccagggugagacacucggggagaaguggaagcgccagcugaaccagcugucgaaguccgaguucaacacguacaagcggagcggcaucauggaaguggaccgcuccgaggccaaggaagggcucaagcggggcgagaccaccaagcacgcugugagccgcgggaccgccaagcugcggugguucgucgagcgcaaccucgugaagcccgaggggaaggugaucgaccuggguugugggcggggcgggugguccuauuacugcgccggccucaagaaggucacagaggugaagggguacaccaaagggggccccggccacgaggaaccgaucccaauggcaacauacggcuggaaucuggugaagcugcacagcgggaaggacgucuucuucaugccgccggagaagugcgacacccugcugugcgacaucggcgaguccagcccgaacccgacuaucgaggaggggcgcacgcugcgggugcucaagaugguggagcccuggcuccgcggcaaucaguucugcaucaaaauucugaaccccuacaugccaucugucguggagacccuugaacaaaugcaacggaagcauggcgggaugcuggugcgcaacccccugagccggaacuccacccacgagauguacugggucagcugcggaacaggcaacaucguguccgccgugaacaugacgucgaggaugcuccugaaucgguucaccauggcgcaccgaaaacccaccuucgagcgagaugucgaccugggcgcagguacccggcacguggcuguggagcccgaggucgccaacuuagacaucauugggcagcgcaucgagaauaucaagaacgaacauaagagcacguggcacuacgacgaggacaacccguauaagaccugggcauaccacggcucguacgaggugaagccguccgggagcgcauccagcauggucaacggcgucgugcggcuguugaccaagcccugggacgugauccccauggucacccaaaucgccaugacggacacuaccccguucgggcagcagcgcguguucaaagagaaggucgacacccggacgccgcgcgcaaagcgggggacaacacagaucauggaggugaccgccaaauggcucuggggcuuccuaucccgcaacaagaagccccggaucugcacacgcgaggaguuuacccggaaggugcgcagcaacgccgcuauaggggccgucuuuguggacgagaaccaguggaacagugccaaggaggccguggaggacgagcgguucugggaucugguccaccgcgagcgggagcuccacaagcagggcaagugcgcgaccugcguguacaacaugauggggaagcgcgagaagaagcugggcgaguucgggaaggccaagggcucccgcgccaucugguacaugugguuaggcgcccgcuuccucgaguucgaggcccuaggguucaugaacgaggaccacugguuuagccgagaaaacucccugagcgggguggagggggagggucuccacaaacugggauacauacugcgcgacaucuccaaaauuccgggcggcaacauguacgcggacgacaccgcugggugggacacgcgcaucaccgaagacgaccuccaaaaugaggcuaagaucaccgacauuauggagcccgagcacgcccugcuggccacgaguaucuucaagcucacguaccagaacaaggucgugcgcgugcagaggcccgcgaaaaacggcaccgucauggacgugaucucccgucgcgaccagcgggggagcggucaggugggcacauacggguugaacaccuucacgaacauggagguacagcugauacgccagauggaguccgagggcaucuuccuccccucugaguuagagaccccaaaccuggccgagcgggugcucgacuggcuggagaagcacggggccgagcgcuuaaagcggauggccauauccggugacgacugcguggucaaacccaucgacgaccgcuucgccacugcgcuaacagcccugaacgacauggggaaggugcggaaggacaucccacagugggagccuagcaagggcuggaaugacuggcagcaggucccguucugcucccaccacuuccaccagcugaucaugaaggacggccgcgagauugucgugcccugccggaaccaggacgagcucgucgggcgcgcccgugucagccagggcgccggguggucccugcgcgagaccgcaugccugggcaagagcuaugcgcagauguggcagcucauguacuuccaccggcgcgaccugagacuggcugccaacgccaucugcuccgcggugcccguggacuggguccccacgagccgcacgaccuggagcauccacgcccaccaucaguggaugacgacggaagacaugcucaguguguggaaccggguguggaucgaggagaacccguggauggaggacaagacccacgucagcuccugggaggaagugccguaccuggggaagcgcgaggaucaguggugcggcucgcugaucggccucacugcccgcgccaccugggccacgaacauacagguggcuaucaaucagguccggcgccugaucgggaaugagaacuaccuggacuauaugacgagcaugaagcgguucaagaacgagagcgaccccgagggcgcccucugguaa

SEQ ID NO: 23916 - RNA, 9879 nt, Artificial Sequence
  derived and/or modified CDS sequence (opt11) from DENV-1__KJ189332__SS-prME
agcgugaccaugcugcuaaugcuacugccuaccgcccucgcauuccaccugacuacccggggcggggagccccacaugauagugucgaagcaggaacggggcaaaagccucuuauucaaaaccucggcggggguuaauauguguacgcugaucgccauggacuuaggggagcucugcgaagacaccaugaccuacaaaugcccacagauuacugaggccgagcccgacgacguagacugcuggugcaacgccaccgacaccugggugaccuacgggaccugcucccagaccggcgagcaccgcagagacaagcgcuccguggccuuggcgccccacgugggccuggggcucgagacgcggaccgagaccuggaugucgagugagggcgccuggaagcagauccagcgcgucgagaccugggcccugcggcaccccggguucacggucaucgcccuguuucucgcgcaugcuaucggcaccagcauuacccagaaggggaccaucuucauccugcugaugcuagugacgcccuccauggcuaugcgcugcgucggcauuggcaaccgggacuucguggagggucugucgggcgccaccuggguggacguagugcuggaacacggaucaugcgugacgaccauggccaagaacaagcccacgcucgacaucgagcugcugaaaaccgaagucaccaaccccgcgauccuccgcaaguuguguaucgaagcgaagaucagcaacaccacgaccgacucuaggugcccaacccagggcgaggccaccuugguggaggagcaggacgcaaacuuugugugccgucggacguucgucgacagaggcugggguaacggcugcggccucuucggcaaggggagccugcugaccugcgccaaguuuaagugcgugaccaaguuagagggcaagaucguccaguacgagaacuuaaaguacagcgucaucguuaccgugcacacaggcgaccagcaccaagucggaaacgagacgaccgagcacggcaccaucgcgacuaucacgccgcaggcccccaccagcgagauccagcucaccgacuacggggcccucacgcuggacuguagcccccggacggggcuggacuucaacgaaauggugcuccugaccaugaaggagaaguccuggcugguccacaagcagugguuucucgaccugccgcugcccuggaccuccggggccagcaccagccaggagacguggaacagacaggaccuucuggugaccuuuaagaccgcccacgcgaagaagcaggaggugguugugcuggguucccaggagggugccaugcacaccgcccucacgggggccacugagauccagaccagcggcacaacaacgaucuucgccgggcaccuuaagugccgguugaagauggacaagcucacgcugaagggcaccucauacgugaugugcacggggucauucaagcuggaaaaagagguggcggagacccaacacggcaccgugcuggugcaaguaaaguacgagggcacagacgcccccugcaagauccccuucuccacgcaagacgagaagggggugacacagaacggccgguugaucaccgcgaacccgaucgugaccgacaaggagaagcccgucaacauagaaacggagccgccguucggggagagcuacaucgugguaggggccggcgagaaggcccugaagcugucaugguucaagaaggguagcucaaucgggaaaauguucgaagccaccgcccgcggggcccgccggauggcaauccucggcgacacagccugggacuucgggagcaucggcggcgucuucaccuccgugggcaagcugguacaccaggucuucggcacggccuacgggguauuauucagcggcguguccuggaccaugaaaaucgggaucgggauccuccucacaugguugggccucaacagccgcuccaccucguuaucaaugacgugcaucgccguagggauggugacucuguaccucggcgugaugguacaagccgacucugggugcgugaucaacuggaaaggccgagagcugaagugcggcuccgggaucuuuguuaccaacgaaguccacaccuggacggagcaguacaaguuucaggccgauagccccaagaggcuaucagcggccaucggcaaagcaugggaggagggggugugcggcauucgcuccgccacgcggcuagagaacaucauguggaagcagaucucuaacgagcugaaccacauccugcuagaaaacgacaugaaguuuaccguugucguaggggacgccaacggcauccuggcgcaggggaaaaagaugauccgcccccagcccauggagcacaaguacuccuggaaguccuggggcaaggcuaagaucaucggcgccgacauccagaacacuaccuucaucaucgauggccccgauacgccggagugccccgacaaccagcgagccuggaacaucugggagguugaggacuacggcuucgggauuuucaccaccaacaucuggcugaaguuacgugacuccuacacccagaugugcgaucaccgguuaaugagcgcugccauuaaggauuccaaggccguccacgcagacaugggcuacuggaucgaguccgagaagaacgagacguggaagcuggcccgcgcuuccuucaucgaggugaagacgugcaccuggcccaagagccacacccucugguccaacggcgugcuggagagcgagaugaucauacccaagaucuacggcggcccaaucagucagcacaacuaccgucccggguacuucacgcagaccgccggcccguggcaucuggguaagcuagagcuggacuucgaccugugcgagggcacgaccgucgugguggacgagcacugcgguaaccgcgggccgagccuccggacgaccaccgucaccggcaagauaauccacgagugguguugcaggagcugcacccucccgccccugcgguuccgcggggaggacggaugcugguacgggauggagauccggccugugaaggagaaggaggagaaucucgugcguagcaugguguccgcaggcagcggcgagguggauucguucucccuggggauccugugcgcuagcaucaugaucgaggaggugaugcggucucgcuggagccggaaaaugcucaugaccggcacccuagcaguuuuccugcuccugaucauggggcagcugaccuggaacgaccucauccgcuuaugcaucauggugggcgccaacgccucugaccgcauggggaugggcacgaccuaucuggcccucauggccaccuucaagaugcggccgauguucgccguggggcugcuguuccgccgccucaccagccgcgagguacugcugcucacgaucgggcugucucuggucgcauccguggaacuccccaacucccuggaggagcuuggcgacggacuagccaugggaaucaugaugcugaagcugcucaccgaauuccagccccaucagcuguggaccacucugcucagccugacguucaucaagaccacgcugucccuagacuaugcuuggaaaacgacggccauggcgcugagcaucgucucccuauucccccucugccugagcaccaccucccagaaaaccaccugguuacccgugcuccugggcagcuucggcugcaagccccugacgauguuccucaucaccgagaacaagaucuggggccguaaauccuggccccugaaugaggguauaauggccaucggcauugucagcaucuuacucuccagccuuuugaagaacgacgugcccuuagccggcccgcugaucgccggcggcaugcugaucgcuuguuaugugaucaguggcuccagcgcggaucucucccuggagaagacagcugaggugucaugggagcaagaggccgagcacuccggcacaagccacaacauccugguggaagugcaggacgacgggaccaugaagauuaaggacgaggagcgcgacgacacccucaccauccugcucaaggccacccuccuggccguguccggcguguaccccauguccaucccggcgacacuguucgucugguacuuuuggcagaaaaagaaacagcggagcgggguccucugggacacacccaguccgcccgaaguagaacgcgccgugcuggacgacggcaucuaccggauacugcagcgcggacugcucgggcggucgcaggucggcguggggguguuccaggacggcgucuuccauaccauguggcacgugacacgaggggccgugcuaauguaccaggguaagcggcuggagcccuccugggccuccgucaaaaaggaccucaucagcuacggcgggggcuggagguuccagggaaguuggaacacgggcgaggagguucaggugaucgccgucgagccaggaaagaacccgaagaacgugcagacuacccccggcaccuucaaaacgccugaaggcgaggugggugcgauugcccuggacuucaagcccggcaccagcggguccccgauagucaacagagagggcaagaucgugggccuguacgggaacggcgucguuaccaccagcgggacuuacguuuccgccaucgcccaagccaaggcaagccaggaaggaccccuucccgaaaucgaagacgaggucuucaagaagcgcaaccugaccaucauggacuuacacccggggucgggcaaaacccggcgcuaccuccccgccaucgucagggaagcgauuaagcgcaaacuucggacccugauccucgcccccacgcgcgugguggcguccgagauggcagaagcccugaagggcaugcccauccgcuaccaaaccaccgccgucaagagcgagcacaccggucgggagaucguggauuugaugugucaugccacguucaccaugcgucuccuguccccggugcggguccccaacuacaauaugaucaucauggaugaagcgcauuuuacugaccccgccagcaucgccgcccgcggcuacaucuccacccggguggggaugggcgaggccgcggccaucuuuaugacggcgacaccgcccgggucuguggaagccuucccacagucuaaugccgucauccaggacgaggaaagagacauccccgaacggaguuggaacuccggcuacgacuggaucaccgacuuccccggcaaaaccguuugguucgugcccagcaucaaguccggaaacgacaucgcgaacugcuuacgcaagaacggcaagcgggucauccagcucagccgcaagacguuugacacggaguaccagaagaccaagaacaacgacugggacuacguggugaccacggacaucagcgagaugggggcgaacuucagagcagaccgcgugaucgacccccggcgcugccucaaacccgugaucuugaaggauggucccgagagggugauacucgcagggccgaugccagucaccguggcgagcgccgcccagcgccggggccgcaucggccggaaccagaacaaagagggagaccaauacguguacaugggccaacccuuaaauaaugacgaggaccacgcacauuggaccgaggcaaagaugcuguuggacaacauuaacacccccgaggggaucaucccggcauuguuugagcccgagcgcgagaaauccgccgcaaucgacggcgaguaccgcuuacgaggggaggcccgcaagaccuucgucgaacugaugcggaggggcgaccuuccaguuuggcugagcuacaaagucgccucagagggguuccaguacagcgaccggcgcuggugcuucgacggggagcgaaacaaccagguacuagaggaaaacauggacguggaaaucuggacgaaggagggcgagcgcaagaaacuccggccccgcuggcuggacgcgaggaccuauuccgacccgcucgcccugagagaauucaaggaauuugcagcugggcggcgcucagucagcggcgaccugauucucgagaucggaaagcugccucagcaccugacccugcgggcccagaacgcgcucgauaaccuggccauguuacauaacucugaacagggagggaaagcguaccgccacgccauggaggaauugcccgacaccaucgagacauugaugcuccuggcgcugauagccgugcucaccgggggcgugacccuguucuuccugagcgggaagggccucgggaagacguccaucgggcuacugugcgucacagccagcuccgcccuccuguggauggccuccguggaaccccacuggaucgcggccuccaucaucuuagaguucuucuugauggugcuucugauacccgaacccgaccgacaacgcacgccccaagauaaccaacucgccuacgucgugaucggccugcuguucaugauacucacaguggcggccaacgagaugggccugcuggagaccaccaagaaggaccucggaaucgggcacgucgcggccgagaaucaccagcacgccacgaugcuugacguggaccugcggccggccuccgccuggacccucuacgccguggcgacaacagucauaacccccaugaugaggcacaccauugagaacaccacggccaacauuucguuaacggccaucgccaaccaggcggccauccugaugggccucgacaagggcuggcccaucagcaaaauggauaucggugugccacugcuggccuugggcugcuauucccaggugaauccgcugacccugaccgccgcggugcucaugcuugucgcccacuacgccaucaucgggcccggccugcaggccaaggccacgcgggaggcgcagaagcgcaccgccgccgggaucaugaaaaaccccaccgucgacgguauagucgcuaucgaccuggaucccgugguguacgacgccaaauucgagaagcagcugggccagaucaugcugcucaucuuaugcaccucacaaauccuauuaaugcgcacuaccugggcgcugugcgagucgaucacccuggcuaccgggccucucacgacccugugggagggcagcccggguaaauucuggaacaccaccaucgcugucuccauggccaacaucuuccgcgguaguuaccuggccggcgcgggacucgccuuuuccuugaugaagucucugggaggcggccgccgggggacgggcgcccagggcgaaaccuugggggagaaguggaagcgccaacucaaucagcuguccaaaagcgaguucaacaccuauaaaagaagcgggaucauggagguggaccgcuccgaggcuaaggaggggcucaagaggggcgagaccaccaagcacgcggugagccgcgguacggccaaguuacggugguucgucgagcgcaaccuggugaagcccgaaggcaaggugaucgauuuggguugugggcggggaggguggaguuacuacugcgccggccuuaagaaagucaccgaggugaagggguauaccaaaggcggcccagggcacgaggagccgauccccauggccaccuacggcuggaaccuggucaaguuacacagcgggaaggacguauucuucaugccgcccgaaaaaugcgauacacucuuaugcgacaucggagagaguagcccgaaccccaccaucgaggaggggcgcacucugcggguacucaagaugguggagcccuggcugcgcggcaaccaguucugcaucaagauucugaaccccuacaugccguccgucguggaaacccucgagcagaugcagcggaagcacggcgggauguuggugcgcaaccccuuaagccggaacaguacgcacgagauguacugggucagcugcggcacgggcaacauaguguccgccgugaacaugaccagccgcaugcuccugaaccgguucacgauggcgcaccgaaagcccacuuucgagcgcgacgucgaccugggcgccggcacccgucacguggcgguggagcccgaagucgcaaaccucgauaucaucggccagcgcaucgagaacauuaagaacgagcacaaguccaccuggcacuacgacgaggacaacccguacaagaccugggccuaccacggcagcuacgaggugaagccgucgggcagcgcgucuagcauggucaacggcguggugcggcugcugacgaagccgugggacguuaucccgaugguuacccagaucgccaugaccgacaccacaccguucggccagcagaggguguucaaggagaaagucgacacccggacgccccgggccaagcggggaaccacgcagaucauggaggugaccgccaaguggcucuggggcuuccugucacgcaacaagaaaccccggaucugcacccgcgaagaauucacccggaaagugagauccaacgccgcgaucggcgccgucuucguggaugaaaaccaguggaacagcgccaaggaggcgguggaagacgagcgguuuugggaccuggugcaccgcgaacgggagcuccacaagcaggguaagugugcgacaugcguguauaauaugauggggaagcgugagaagaagcugggagaguucgggaaggccaaggggucucgggcaauuugguacauguggcugggcgcccgcuuccucgaguucgaagcccuuggguucaugaacgaagaccacugguucagccgggagaacucccugucuggcguggagggggagggccuccauaaacugggguacauucugcgagacaucuccaagaucccggguggcaacauguacgcggacgacaccgcugggugggacacccggaucacugaggaugaccuccagaacgaagcgaagauaacggacaucauggagcccgaacacgccuuacuggccaccagcauauucaaguugaccuaccagaauaaggucgugcgcgugcagcggcccgcgaagaacgggaccgucauggaugugaucuccaggcgagaccagcgggggagcggccagguggguacguacggguuaaacaccuuuaccaacauggaaguccagcuuauacgccagauggaguccgaaggcaucuuccucccgucagaguuagagaccccgaaccuggccgagcggguccuugacugguuagagaaacacggugccgaacgccugaaacggauggccaucuccggcgacgacugcguggucaaaccuaucgacgaccgcuucgccacagcucucacagcccugaacgauaugggcaaggugcggaaggacaucccccagugggagcccagcaaaggauggaaugauuggcagcaagugccguucugcucccaccacuuccaucagcucaucaugaaggacggccgcgagaucguugugcccugccguaaccaggacgagcucguggggcgugcccgggucagccagggcgccggguggucccuucgcgagaccgccugucugggcaagaguuaugcgcagauguggcagcucauguacuuccaccgccgcgaccugcggcuggccgccaacgcgauuugcuccgcggugcccguggacuggguccccaccagccgcacgaccuggagcauccacgcccaccaucaguggaugaccacggaggacaugcucuccguauggaaucggguguggaucgaagagaaccccuggauggaagacaagacccacgugagcuccugggaggaggugccguaccuggggaagcgcgaggaccaguggugcggcagccugaucggccucacggcacgcgcgaccugggccaccaacauccagguggcgaucaaccaggugcggcgccugaucgggaacgagaauuaucuggacuacaugaccuccaugaagcgguucaagaaugaaagcgaccccgagggcgcccucugguaa

SEQ ID NO: 23917 - RNA, 9879 nt, Artificial Sequence
  derived and/or modified CDS sequence (opt11) from DENV-1__KJ189334__SS-prME
agcgugaccauguugcucaugcuucugccaaccgcccuggcguuccaccugaccacccggggcggggagccgcacaugaucgugaguaaacaggagagagggaagagccugcuauucaagguguccgcaggggugaacaugugcacgcugaucgcgauggaucugggcgaguugugcgaggacaccaugaccuacaaguguccccagaucaccgaggccgagccagacgacguugauugcuggugcaacgccacagacaccugggugaccuacgggaccugcucucaaaccggugagcacagacgggacaagcgcucgguggcccuggcgccccacgucgggcuggggcucgaaacgcgcaccgagacauggaugagcuccgagggggcauggaagcagauccaacgcguggagaccugggcccugcggcaucccggguucaccgugauugccuucuuucuagcucacgccaucggcacgucgauaacccagaaagguauuaucuuuauccuccugaugcuggucacccccuccauggccaugagaugcgugggaaucgggaaccgcgacuuuguggaggggcucaguggcgcuaccugggucgacguggugcuggagcacggauccugcgucacgacuauggccaagaacaagcccacccuggacaucgaacuccugaagacagaggugacgaauccggcgauccugcgcaagcucugcaucgaggccaagauaagcaauaccaccaccgauucccggugcccaacgcaaggcgaggcaacucugguggaggagcaggacgcaaacuuugugugccgccgcaccuucgucgaccgcggaugggggaacggcugcgggcuguuuggcaagggcagccugcuuacgugcgccaaauucaagugcgucacgaagcuggaaggaaagaucguucaguacgagaaccucaaguauuccguuaucgugacgguccacaccggcgaccagcaccagguggggaacgaaaccacagagcauggcaccaucgcgaccaucacaccgcaggccccuaccagcgagauccaacugaccgauuacggggcccucacucucgacugcucaccccggaccggccuggacuucaacgagaugguccuacucaccaugaaggagaaguccugguuggugcauaagcagugguuccuagaucucccgcugccuuggacguccggggcaagcaccucucaggagaccuggaaccgccaggaucucuuagugaccuucaagacggcccacgcgaagaaacaggagguuguggugcuggggucccaagaaggcgcaaugcacaccgcccugaccggggcaaccgagauccagacgagcggaaccaccaccaucuucgccggacaccucaagugccggcugaaaauggacaaauuaacacucaagggcacauccuacgucaugugcaccgggagcuucaagcuggagaaagagguagcggagacucagcacggcacgguccugguccaggugaaguacgagggaaccgacgcccccugcaagauccccuucucgacucaggacgaaaagggggugacccagaacggucgcuuaaucacagccaacccgaucgucaccgacaaggagaagccaguaaacaucgagacugaaccgcccuucggggagagcuacauugucgucggcgcuggcgagaaggcccuuaagcuguccugguucaagaaggggagcuccaucggcaagauguuugaggccaccgcccgcggggccagacgcauggcuauccuaggcgacacggcgugggacuuugguagcaucggcggggucuucaccuccguugggaagcucguccaccagguguucggcaccgccuacgggguauuguuuagcggcgucuccuggaccaugaagaucgggaucggaauccuucucaccuggcuaggccuuaauagccguuccaccagccucuccaugaccugcaucgccguggggauggugacucuauaccugggcgucauggugcaggccgacagcggcugcguaaucaacuggaaaggccgcgagcuuaagugcgggucgggcauauucgucaccaacgaagugcacaccuggaccgagcaguacaaguuucaggcugacucaccuaaaaggcuuagcgcagccauaggcaaggccugggaggagggggugugcggcauccgcucagcaacccggcuggagaacauuauguggaagcaaauuagcaacgagcucaaccauauccuccuagaaaacgacaugaaauucaccgucguugugggggacgccaacgggauccucgcgcagggaaagaagaugauacggccucagcccauggagcacaaauacaguuggaaguccuggggcaaggccaagaucauuggggccgacauccaaaacacgaccuucaucaucgaugggcccgacacacccgaaugucccgacaaccaacgggcuuggaacauaugggaggucgaggacuaugguuucgggaucuucaccacgaauaucuggcugaagcugcgcgacuccuacacccagaugugcgaccaccgauuaaugagcgcggccaucaaggacuccaaagccguccacgccgacaugggcuacuggaucgaaagcgagaagaacgaaaccuggaaacuggcccgcgcauccuucaucgaggugaagacaugcacguggcccaagagccacacccugugguccaacggcguauuagagagcgaaaugaucauaccuaaaauauacgguggcccgaucucccagcacaauuaccggcccggguacuucacccagaccgccggaccguggcaccugggcaagcuggagcucgacuucgaccuuugcgaaggcacgacagugguggucgacgagcacuguggcaaccgcgggccgucgcugcggacaacuacggugaccgggaagaucauccaugagugguguugccgcuccugcacccugccaccccuccgguuccggggugaagauggcuguugguacgggauggagauccgccccgugaaggaaaaggaagagaaucugguccgcagcauggugucagccggcagcggugaggucgacagcuucucccucgggaucuugugugucagcaucaugaucgaggagguaaugcggagucgcuggagccggaagaugcugaugaccggcacgcucgccguguuccugcuccucgucaugggccaacuuacguggaacgaccugauccgccucugcaucaugguaggcgccaacgcauccgaucguaugggcaugggcaccaccuacuuagcgcugauggcaacuuucaagaugcgcccgauguucgccguggggcuucucuuccgccggcucaccagucgcgagguccuuuuacuaaccaucgggcucuccuuaguggccagcgucgaguuacccaacucccucgaggaacugggggacgggcucgcgauggggaucaugaugcucaagcugcugaccgaauuccagccccaccagcuauggacaacccuacucagcuugaccuucaucaagacaacgcugucccuggacuacgccuggaagaccaccgccauggcuuuaagcaucguaagucuauucccccuaugccucagcacaacgucccaaaagaccaccuggcugccggugcugcucggcagcuucggauguaagccacugaccauguuucugaucacugaaaacaagaucuggggccggaaguccuggccccucaacgaggguaucauggcgaucggcaucgugagcauauugcugaguucgcuccugaagaacgacgugccccuggccgguccguugaucgccggcggaaugcugauagccugcuauguaaucagcgggucgagugcugaucuuucccucgagaaggcggccgaggucagcugggagcaggaggccgagcacuccggcacgagccacaacauucuuguagaggugcaggacgauggaaccaugaaaauuaaggaugaggagcgcgacgacacccugaccauccuauuaaaggccacgcuccuugccgucuccggcgucuaccccaugagcauccccgcgacccuguucgugugguacuucuggcaaaagaagaagcagcgaagcgggguccugugggacacccccagcccaccugaaguggagcgcgcggugcucgacgauggcauuuaucggauucuucagcgcggccuccuagggcgcucucaggucggcgucgguguguuccaagauggcgucuuccacacuauguggcaugugacgcgcggagccguccucauguaccagggcaagcggcuggaacccagcugggccuccgucaagaaggaccugaucagcuacggcgggggcuggcgcuuccagggauccuggaacaccggggaagagguccaggugaucgcuguugagccugggaagaacccgaagaacgugcagaccacccccggcacguucaagacccccgagggcgaggugggggcgaucgcccuugauuucaaaccaggcaccucuggauccccgaucguuaaccgggagggaaagaucgugggccuguacgggaauggcgucgucaccacgagcgguaccuacgugagcgccauugcccaggcaaaggcgagccaagagggcccccugcccgagaucgaagacgagguauucaagaagcgcaacuugaccaucauggaccugcacccggggagcggcaagacccggcgcuaccugcccgccaucguccgggaggcaaucaagcgcaagcuccggacgcugauccuggcccccacucgcguaguugccucugagauggcugaggcccucaagggcaugccuauccgguaccagaccaccgccguaaagagcgagcauacggggcgugagauuguggaccugaugugccacgcuaccuuuaccaugcgccugcucagcccgguacggguccccaacuacaauaugaucaucauggacgaggcgcacuucaccgaucccgccucaaucgcggcccgaggcuacaucuccacucgggucgguaugggggaagccgccgccaucuucaugaccgccacgccuccuggcucgguggaggccuucccacaauccaaugccgucauccaggacgaggagagggauaucccagagcggagcuggaacuccggauacgacuggaucacugauuuccccgguaagacgguaugguucgugcccagcauaaaguccggaaacgauaucgcgaacugcuuacgcaagaacggcaagagaguaauacagcugucacgaaaaacuuucgacacggaguaccagaagaccaaaaacaacgauugggacuacguggugacgaccgauauuuccgagaugggggccaauuuccgggccgaccgcguuaucgauccccggcguugcuugaagcccguaauccugaaggauggucccgagcgggugauucuggccgggccaaugcccgucacggucgcgagcgccgcccagcgccggggcagaauaggccggaaccagaauaaggagggggaccaguacgucuauauggggcagccgcugaacaacgacgaagaccacgcgcacuggaccgaggccaagaugcugcuugauaauaucaacacccccgagggcaucauaccggccuuguucgagcccgagcgcgaaaagaacgccgccaucgacggcgaguaccgccuacgcggggaagcccgcaagaccuuuguggagcugaugcgccgcggugaccuuccuguauggcuguccuauaaggucgcaagcgaggguuuccaguacagcgaccguaggugguguuucgacggagaacgcaacaaucaggugcuggaagagaacauggacguugagaucuggaccaaggagggggagcguaagaagcuccggccucgcugguuagacgcgcggaccuauagcgacccacuugcccucagggaguucaaggaauucgccgcugggcggcgcuccgucucuggcgaccugauccuggagaucggcaagcucccccagcaccugacccugagagcccagaacgcgcucgacaaccuggucaugcugcacaauagcgagcagggggggaaggccuaucgccaugccauggaggagcugccagacacgaucgaaacucugaugcugcucgcucugaucgccgugcugaccgggggcgucacgcucuucuuccuguccgggaaaggccuaggcaaaacgucaaucggacuccuaugugugaccgccuccagcgcucuacuuuggauggccuccgucgagccucacuggauugccgccaguauuauccuggaauucuuucugauggugcuccugaucccggagcccgaccgacagcgcacuccacaagauaaccaguuagccuacguggugauaggccuccuguucaugauccugacugucgcagccaaugagauggggcuacuggagacgacaaagaaggaccucggcauagggcauguggccgccgagaaccaccagcacgccaccaugcuggacguggaucugcggccagccuccgcguggacgcuguacgcggucgcgacgaccguaaucacaccuaugaugcgucauacgaucgagaacaccaccgccaacaucagcuuaaccgcgaucgccaaccaggcugcgauccugauggggcuggacaagggcuggcccaucucuaagauggauaucgggguuccgcuccuggcccugggcugcuauucacaagucaacccuuugacccugacggccgccguucugaugcucguggcgcacuacgcuaucauagggccaggccugcaggccaaggccacccgggaggcacagaaacgcaccgcggccgggaucaugaagaaccccaccgucgacgguaucguggccaucgaccuggaccccgugguguacgacgccaaguucgagaaacagcucggccagaucaugcugcucauccuaugcacuucgcagauccugcugaugcgcacgaccugggcccucugugagucuauuacccuggcaacugggccgcugacaacccucugggagggguccccugguaaguucuggaacaccacgaucgccgugucaauggccaacauauuccggggcucauaccucgccggugccggucuggcauucagccucaugaaguccuugggcgggggccgccgggggaccggugcccagggcgaaacccugggugaaaaguggaagcgucagcugaaccagcucucaaagucggaguuuaacaccuauaagcggagcgggauaauggagguggacagaagcgaagccaaagaggggcugaagcgaggcgagacgaccaagcacgccgucucccgcgggacagccaagcugcggugguucguugagcgaaacuuagugaaacccgagggcaagguaaucgaucugggcugcgggcggggaggguggagcuacuacugcgcaggccugaaaaaagugacugaggugaaaggcuauaccaagggaggccccgggcacgaggagccgauucccauggccacguacggcuggaaccucguuaagcugcacagugggaaggacguguucuucaucccgcccgagaagugcgacacccugcucugcgacauuggagaguccucuccgaaccccacaauagaggaggggagaacccugaggguacugaaaauggucgaaccguggcuccgcgggaaccaguucugcaucaaaauuuuaaauccuuauaugcccagcgugguggaggcccuggagcagaugcagcggaagcacggcgggaugcucguccgcaacccauuaucccggaacaguacgcacgagauguacuggguguccugcggcaccgggaauaucgugagcgccgucaacaugaccucccgcaugcuacucaaucgguuuaccauggcgcaccgcaagccgacauacgagcgugacgucgaccugggcgccggcacacgccacguggccguugagccagagguggccaaccuggacaucaucgggcagcgcaucgaaaacaucaagaacgagcacaagucgacauggcauuacgacgaggacaaccccuauaaaaccugggccuaucacggguccuacgaggugaaacccucgggcuccgcgagcuccauggucaacggcgugguccgacucuuaacgaagcccugggaugucaucccgaugguaacccagaucgccaugaccgacacgacgccguucgggcagcaacgcgucuucaaggagaagguggacacgcggacgccccgggcgaagcggggcaccacgcagauuauggaggugacugcaaaguggcuguggggguuccugucgaggaacaaaaagccccggaucugcacacgugaggaauucacccggaaggucagguccaacgccgcgauaggggccguguucguugacgaaaaucaguggaacagcgccaaggaggccgucgaggacgagcgguucugggaucuggugcaucgcgagcgggagcuucacaagcagggcaagugcgccacguguguguacaauaugauggggaagcgugagaagaagcucggugaguucgggaaggcuaaggguagucgggccaucugguacauguggcuuggcgcgcgauuccuggaguucgaagcccucggguucaugaacgaggaucauugguucucccgggagaacucccugagcggggucgagggggagggccugcauaagcucggguacauccuccgcgacaucucuaagaucccgggagggaauauguacgcggacgacaccgccgggugggauacccggauuaccgaggaugacuugcagaacgaagccaagaucacagaaaucauggaacccgaacacgcccuccuggccaccuccaucuucaagcugaccuaccagaacaagguggugcgcguccagaggcccgcgaagaacggcaccgugauggacgugaucagccggcgcgaccagcggggcuccggacaggugggcaccuacggucucaacacauucaccaacauggagguucagcuuauccgccagauggagucggagggcaucuuccugccaucggagcucgagaccccgaaccucgccgagcgcguacuggacuggcucgagaagcacggggcggagcgccugaaacgcauggccaucaguggcgacgacugcgucguaaagccaaucgacgacagguucgccaccgcccugaccgcccucaacgacauggggaaagugaggaaagacaucccccaaugggagccuuccaaggguuggaacgacuggcagcagguaccuuucugcucgcaccacuuccaucaacugauaaugaaagauggccgagagaucguggugcccugucggaaccaggacgagcugguugggcgcgcucgggugucccagggagccggguggucgcuucgcgagaccgccugccugggcaaguccuacgcgcaaauguggcaacugauguacuuccaucggcgggaucugcggcuggccgccaacgccaucugcagcgcggugcccguagacugggugccuaccagccggaccacguggagcauacaugcgcaccaccaauggaugacgaccgaagauaugcuguccguguggaaccgagucuggaucgaggaaaauccguggauggaggauaagacgcacguguccagcugggaggaggugccuuaccuugggaagcgcgaggaccaauggugugggucccugauuggucugacggcccgcgccaccugggcgaccaacauccaggucgcaaucaaccaggugcggaggcucaucgggaacgagaacuaucuggauuacaugaccaguaugaagcgguucaagaaugaguccgaucccgagggcgcccuaugguaa

SEQ ID NO: 23918 - RNA, 9879 nt, Artificial Sequence
  derived and/or modified CDS sequence (opt11) from DENV-1__KJ189335__SS-prME
ucuguuaccauguuacuuaugcuguugcccaccgcgcucgcuuuccaccugaccaccaggggcggggagccucacaugaucguguccaagcaggagcggggcaagagccuccucuuuaagaccuccgcgggugugaauaugugcacgcugauugccauggaucugggcgagcuaugcgaggacaccaugacuuacaaaugcccccaaauuaccgaagcggagccagaugauguggacugcuggugcaacgccacggacaccugggugacguaugggaccuguagccagacuggagagcaccggcgggacaagcgcucuguggcccuggcaccccacguuggauugggacucgagacgcggaccgagaccuggaugagcuccgagggcgcuuggaagcagauccaacgugucgagaccugggcccuucggcaccccggguucacgguuaucgccuucuuccuugcgcaugcuaucgggacaucuaucacccagaaggggauuauauucauccuccugaugcuggugacccccucgauggccaugcgcugcgucggcaucgggaaccgggacuuuguagaaggacucagcggcgcaacgugggucgacgucguucucgagcacgggagcugcgugacuaccauggccaaaaauaagcccacccuggacaucgagcuccugaagacggaggucaccaacccugcgauccugcguaagcuaugcauagaggcuaagauaagcaauaccacuacggacucccgcuguccuacucaaggggaggccacccugguggaggagcaagacgccaauuuugugugccgccggaccuuuguggaucgcggcugggggaacggcugugggcuauucggcaaggggagccugcugacgugcgccaaguucaagugcgugaccaaacuagagggcaagauagugcaguacgagaaccuaaaguacuccguuaucguaaccgugcacacgggugaccagcaucagguagggaacgagacuaccgagcacggaaccaucgcgaccauuacgccgcaagcccccacgucggagauucaguuaaccgacuacggggcacuaacccucgacugcagcccgcggacaggccuggauuucaacgagauggugcuucucaccaugaaggaaaagagcuggcugguacauaagcagugguuuuuggaucucccccuccccuggaccuccggcgccagcaccagccaggagaccuggaaccgacaagaccuccuggucacguucaagaccgcucacgccaaaaagcaagagguugucguacugggcucucaggagggugccaugcacaccgcccugaccggggccacagaaauccagaccagcggcacuaccacuaucuucgccgggcaccucaagugccggcuuaagauggacaaacuuaccuugaaggggaccuccuacgugauguguaccgggagcuuuaaacuggagaaagagguagcagagacgcagcacggcaccgugcugguucaggucaaguacgagggcaccgaugccccuugcaaaaucccuuucuccacccaggacgaaaagggggugacccagaacggcaggcugaucaccgccaacccgauugugacagauaaagagaaacccguaaacaucgaaacggagccacccuucggggagagcuauaucguggugggagcgggugaaaaggcucucaagcuguccugguucaagaaggggagcuccaucggcaaaauguucgaggcuacugcgagaggggcgcgccgcauggccauccugggcgauaccgcgugggacuucgggucgauaggcggcgucuucacaaguguugggaagcucguccaccaaguguucggcaccgccuacggugugcuguuuucuggaguguccuggacaaugaagaucgggauagggauccugcucaccuggcuaggccucaacagccgcuccaccagcuuauccaugaccugcaucgccgucgggauggugacgcucuauuuaggcgugaugguccaggccgacuccgggugugugaucaacuggaagggccgcgagcucaaguguggaagcgggaucuucgugaccaaugaaguccacacuuggacugaacaguauaaguuucaggcugauagcccgaagcggcuaagcgcggccaucggcaaggccugggaagagggggugugcgggauacguuccgccacucggcucgagaacaucauguggaagcagauauccaacgaacucaaccacauccuguuagagaacgacaugaaguuuacgguggucgugggggacgccaacggcauccuggcgcaggggaagaaaaugauccguccccaacccauggaacacaaguauuccuggaaguccuggggaaaggcuaagaucauaggggcggacauccagaacaccaccuucauuaucgacgguccugacacuccggagugcccggauaaccaacgggccuggaacaucugggaggucgaggauuacggguucggaaucuuuacgaccaacauauggcugaagcugcgagacucuuauacccagaugugcgaucaucgucucauguccgcagccaucaaggacuccaaggccguccaugccgacaugggcuacuggaucgaaagcgagaagaacgagaccuggaagcuagcccgcgcguccuuuaucgaggugaagaccugcaccuggccuaagagccacacccugugguccaacgggguguuagagucggagaugauuauccccaagaucuauggaggcccgauaucccagcacaacuaccguccaggguauuucacccaaacggccggcccguggcaccuugggaagcuggagcuagacuucgacuuaugcgagggcacgaccgucgugguggacgaacacugcggcaaccgcgggccgagccuucggaccacgaccgucaccggcaagaucauccacgaguggugcugucgaucuugcacccuaccgccccuucgguuucgcggggaggacgggugcugguacgggauggagauccggcccgugaaggagaaggaggagaaccuggugcgcagcaugguuucugcggguuccggcgagguggacucguucucccuaggcauccuaugugugagcaucaugaucgaagaggucaugcggucccgcuggagcagaaagaugcugaugacgggaacccuugccguguuucuucugcuugugauggggcagcugacauggaacgaccugauccgccuaugcaucaugguuggagccaacgcauccgaccgcaugggcauggguaccacguaccuggcacugauggccaccuuuaagaugcggccgauguucgccgugggucucuuauuccgccggcugaccucccgcgaggugcuccuccuuaccaucgggcugucccuggucgccuccguagaacugccaaauucccuggaggaauuaggcgacggguuggcaaugggcaucaugaugcucaaacuucugacggaguuccagccgcaccaacucuggaccacacugcugagccucacguucaucaaaacgacccuuucccuggacuacgccuggaagaccacugcuauggcccuaagcaucgucucccuguucccccugugccugucuacaaccucgcagaaaaccaccuggcugccggugcugcucggcagcuucggcugcaagccccucaccauguuuuuaaucacggagaacaagaucuggggccgaaaguccuggccccucaaugagggcaucauggcgauugggauaguaagcauucuccuguccagccuccugaagaacgacgugccguuggcggggccuuugaucgcaggcggcaugcuuaucgccuguuacgugaucucugggaguucugccgaccuuagucucgagaaggcggcugagguaagcugggagcaggaagcagagcacagcggcacaagccauaauauccuggucgaggugcaggacgacggcaccaugaagaucaaggacgaggagcgcgacgauacccugacgauacuguugaaggccacccugcucgccgucaguggcgucuaccccaugagcauccccgccacccuguucguaugguacuuuuggcagaagaagaagcagcguucagguguccugugggacacccccagcccaccggaagucgagcgcgccgugcucgacgacggcaucuaucggauucugcagcgcggccugcuugggcggucgcagguuggcguugggguauuccaggacgguguauuccacacgauguggcaugucacccguggggccguacucauguaucagggaaaacggcuugagccguccugggcaucggugaagaaggaccugauaucauacggcgggggauggcgcuuccagggcucauggaacaccggggaggagguccaggugaucgccgucgagccagggaaaaacccgaagaacguccagaccacucccgguacauucaagacuccggagggggaggugggagcgaucgcccuggacuuuaagccaggaacuagcgguucccccauugugaaccgggagggcaagaucgucggccuguacgggaacggcguagugaccacgagcgggaccuaugucuccgcaauagcacaggccaaggcaagccaggagggccccuuacccgagaucgaggacgagguguucaagaagcgaaaccucacuaucauggaucugcauccggguagcggaaaaacgcggcgguaccugcccgccaucgugcgugaggcaaucaagaggaagcuccggacccugaucuuagcccccacucgaguaguagcuuccgaaauggccgaggcccucaaggguaugccuauccgcuaccagaccaccgcagucaagagcgaacacacaggucgggagaucgucgaucugaugugccacgcuacuuucaccaugcgccuacucucuccggugcgugugcccaacuacaacaugaucaucauggaugaggcgcacuucacagaccccgccagcauugccgcucgcggcuacaucucaacacgggucgggaugggcgaagcggcggccaucuucaugacggcuaccccgcccggguccguggaggccuucccccaguccaacgccgugauccaggacgaggagcgcgauauaccugagcggucuuggaacuccggcuacgacuggaucacggacuuccccgguaagaccgucugguucgugcccagcaucaagagcgguaaugacaucgcgaacugucugcgcaagaacggaaagagaguaauccaguugagucgaaagacauucgacaccgaguaccaaaagaccaagaauaacgauugggacuacguagugacgacagacaucagugaaaugggggccaacuuuagagcggaccgcguaaucgaccccagaaggugucucaagccggucauccugaaggacggccccgagcguguuauucuggcugguccgaugcccguuaccguugcgagcgcagcccagcgccggggucgcaucgggcgcaaucaaaacaaggagggggaccaguaugucuacaugggccagccccugaacaacgacgaggaccaugcccacuggacggaggcgaagaugcugcuggacaacaucaacaccccggaggguaucauccccgcccuauucgagcccgaacgcgagaagaaugccgccauagauggcgaguaucgacugcgcggugaggcccggaagaccuucgucgagcuuaugcgccgcggcgaccuccccguauggcuguccuauaaaguggccucagagggcuuccaguacuccgaccggcgcuggugcuucgacggugagcggaacaaccagguccuggaggaaaauauggauguggagaucuggaccaaggaaggggagagaaagaaauuacggccccgguggcucgacgcgcggaccuacagcgauccgcuggcacugcgcgaguucaaagaguucgccgcuggacggagguccgugucaggcgaccuuauccuagagaucggcaagcucccucagcauuuaacgcugcgggcccagaacgcacucgacaaccuggucaugcugcacaauagcgagcaaggcgggaaagcguauagacacgcuauggaggaguugcccgacacgauagagacccugaugcugcucgcccuaauagcggugcugaccggagggguuacucucuucuucuuaagugggaaaggucugggcaaaacuagcaucgggcuccugugcgugacagccuccagcgcgcuacucuggauggccuccguugaaccccacuggaucgccgcgagcauuauccuggaguucuuccugauggugcuccugaucccggaacccgaucggcaacgcacgccccaggauaaccagcuggccuacguggugaucgguuuacuguucaugauccucacggucgcugccaacgagaugggucuucuagaaaccaccaagaaggacuuagguaucgggcauguugcggcggagaaccaccaacaugcuaccaugcucgacguugaccugaggccggccagcgcuuggacgcuguacgcuguggcaaccaccgucaucacccccaugaugcggcacacgauugagaacaccaccgccaacaucagccucaccgcuaucgcuaaccaggccgcgaucuuaaugggccuggacaagggcuggcccaucuccaagauggacaucggaguaccccuccuggcgcugggcugcuacucccagguuaacccgcucacgcugaccgccgcggucuuaaugcucguggcgcacuacgcaaucauaggccccgggcugcaggcuaaggcgacccgggaggcccagaagaggaccgcagccgggauaaugaagaaccccaccguagacggcauugucgccaucgaccuggaucccgucguauacgacgcgaaguuugagaaacaacucggccagaucaugcuguugauucugugcacaucccagauccugcugaugcgcacaaccugggccuuaugcgaaagcauaacucuggcuaccgguccgcugaccacccucugggaggguuccccugggaaauucuggaacacaaccaucgccgucucaauggccaacaucuuccggggcuccuaucuggccggagccgggcuggcguucagccucaugaaaucccuggguggagggcgucgagggaccggcgcacagggcgaaacccuaggugagaaguggaagcgacagcucaaucagcugagcaagagugaguucaacacauacaagcggagcggaaucauggagguugaccgcagcgaggccaaagaagggcugaagaggggcgagaccaccaaacacgccgucuccaggggcaccgcgaagcugaggugguucguggagcgcaaccuggugaaaccggaagguaaggugaucgaucugggcugcggaaggggaggguggagcuauuacugugcuggccugaagaaggucaccgaggugaaggguuauaccaagggagggcccggacaugaggagccgaucccuauggcuaccuacggauggaacuuaguaaagcugcauuccgguaaggaugucuucuucauaccgcccgagaaaugcgacacauuacucugcgacaucggcgaauccuccccgaaccccacgaucgaggaggggagaacgcugagaguacugaagaugguggagcccuggcuccgcggcaaccaguucugcauuaaaauccugaacccauacaugccuucaguaguggaggcccucgagcagaugcaacggaagcauggcgggaugcuggugcgcaaucccuugucacggaacagcacccaugagauguacugggucuccugcggcaccgguaacaucgugagcgcggugaacaugaccagucgcaugcugcucaauagguucacgauggcgcaccggaagcccaccuaugagcgcgacguugaccugggcgccggcacacggcacguggcuguggaaccugagguagccaauuuggacaucauagggcagagaaucgagaacaucaagaaugaacacaaaagcaccuggcacuacgacgaggacaacccguacaagaccugggccuaucacggcuccuacgaggugaaaccgagcgggucggcgagcagcauggugaacggugucgugcggcuccuuaccaagccuugggaugucauccccaugguuacccaaauagccaugaccgacacgacaccguuugggcagcagcgcguguucaaggagaaagucgacacccggacaccccgggcuaagagaggcacuacccaaaucauggaggugacggcgaaauggcuguggggcuuucuuucucgcaacaagaaaccccggaucugcacccgcgaggaguucacgcggaaggugagauccaacgccgcgaucggggcugucuucguggacgagaaccaguggaauagcgccaaggaggccguggaggaugagcgauuuugggaccugguccaucgcgagcgggagcugcauaagcaggggaagugcgcgaccugcguguauaacaugaugggcaagcgcgagaagaagcucggcgaguucgggaaggcgaaaggcagccgggccauaugguauauguggcugggcgcccguuucuuggaguucgaggcccucggguuuaugaaugaggaccacugguucucccgggagaacagcuuauccggcguggagggugaaggccuccacaagcucggguacauccugcgagacaucucaaagauccccgggggcaacauguaugccgacgacacggccgggugggacacccggaucacagaggacgaccugcagaacgaggccaagaucaccgagauaauggaacccgaacacgcccuccuggccaccucuaucuuuaagcugaccuaucagaacaagguggugcgcguucaacgccccgcgaagaauggaacggucauggacgucauuagccgacgcgaccagcggggguccggccagguggguaccuacgggcucaacaccuucacuaacauggagguccaacugauccgccaaauggaaagcgagggcaucuuccuacccucugagcuugaaacgccgaaccuggcugagcguguacuggacuggcuggagaaacacggugccgagcggcugaaaaggauggccaucagcggcgacgacuguguggucaagcccauugacgaccgcuucgccacagcucucacggccuuaaacgacauggguaaggugcggaaggacaucccccagugggagcccagcaagggguggaacgacuggcagcagguuccguucuguagccaccacuuccaucaguuaaucaugaaggacggacgcgaaaucgucgugcccugccguaaccaggacgagcugguggggcgugcucgagucucccagggcgccggguggagccuccgcgaaaccgcaugcuuagggaaauccuaugcccagauguggcaacugauguacuuccaccgaagggaccuccgccuagcggccaacgccaucugcagcgcuguccccguggacuggguucccacaucccguacuaccuggagcauccaugcccaccaucaauggaugaccaccgaggacaugcugagcguguggaacagaguguggaucgaggaaaaccccuggauggaagacaagacgcacgucuccagcugggaggaagugcccuauuuggggaaacgagaggaccaguggugcgggagcuugaucggccuaaccgcccgcgccacaugggcuaccaacauccaggucgcaaucaaucaagucaggcgucucaucgggaacgagaacuaccuggacuacaugacgucgaugaagcgguucaagaaugaaagcgaccccgaaggugcccuaugguga

SEQ ID NO: 23919 - RNA, 9879 nt, Artificial Sequence
  derived and/or modified CDS sequence (opt11) from DENV-1__KJ189336__SS-prME
agcgugaccaugcugcucaugcugcugcccaccgcccucgccuuccauuugaccacccgaggcggggagccgcauaugaucguaagcaaacaagagcggggcaagagccuccuguucaagaccagugcggggguuaacaugugcacguugaucgccauggaccucggcgaguugugcgaggacaccaugaccuacaagugcccccaaaucaccgaagccgagccugacgacguggacugcuggugcaacgccacugacaccugggugacauacggcacgugcagccagaccggcgaacaucgacgggauaagcgcuccguugcccuggccccccacgugggccugggauuagagacccgaaccgagaccuggaugagcuccgagggagccuggaaacagauccagagagucgagaccugggccuuacgacacccgggguuuacggugaucgcgcuguuccuugcgcacgccauaggcacaagcauaacccagaaggggaucaucuucauccuacugaugcucgugacucccuccauggccaugcguugcgucggcaucggcaaccgcgauuuuguugaagggcugagcggcgcaacguggguggacgucguacuugagcacggguccugugugaccaccauggccaagaauaagcccacccuggauaucgagcugcugaagacggaaguuaccaaucccgcgauccuccgcaagcugugcaucgaggccaaaaucagcaacaccaccacugacucccggugcccuacucaaggggaggcaacacuggucgaggagcaggacgcaaacuucgucugucgcagaacuuucgucgauagaggcuggggcaacggcuguggccucuucggcaaggggagcuugcugacgugcgccaaguucaagugcgugaccaaguuggagggcaagaucgugcaguaugagaaccugaaauacuccgucaucgugaccgugcacaccggcgaccagcaucaaguuggaaaugagacgaccgagcacggcaccaucgcgacaaucacgccacaagcccccacgagcgagauccaacugaccgauuacggggcccuuacccuggauuguucgccacggaccggccuggauuucaacgagauggugcuccugacuaugaaggagaagucgugguuaguccacaagcagugguuccucgaccuuccgcugcccuggaccuccggggccaguaccagccaggagaccuggaaucgccaggaccuccucgugacguuuaagaccgcgcaugcgaaaaagcaggagguggucgugcugggcucccaggagggcgccaugcacaccgcacucacuggggccacggagauccaaaccaguggcaccaccacaaucuucgccgggcaccugaagugccggcuaaaaauggacaagcuuacccuuaagggcacuaguuacgugaugugcaccgguucguucaagcuggagaaggaggucgcggagacgcagcacggcaccguucucguucaggugaaguacgaggggaccgacgcacccugcaagaucccauucuccacccaggacgagaagggugugacucagaacggccggcucaucaccgcgaacccgaucgugaccgauaaggagaagccggucaauaucgaaaccgagccgccguuuggggagagcuacaucguggugggcgccggcgagaaagcacuuaagcucuccugguucaaaaaagggagcuccaucggcaagauguucgaggccacggccaggggggcucgccggauggccauccucggcgacaccgcgugggauuucgggucgauaggcggugucuucaccuccgugggcaagcugguacaccaggucuucggcaccgcguacggugugcuguucagcggcgugucguggacgaugaagaucgggaucggcauccucuuaaccuggcucggccucaacagccgcuccaccagccuguccaugaccugcaucgcggucgggaucgugacguuauaucugggcguaaugguccaggccgauagcggaugugugaucaacuggaaaggccgcgagcuaaaaugcgguuccggcauauucguuaccaacgagguucacaccuggaccgagcaguacaaauuccaggccgacagcccgaagcggcuaagcgcggccaucggcaaggccugggaggagggggugugcggcauaagauccgccacccgccucgagaauaucauguggaaacagauuuccaacgagcugaaccacauccuguuagagaacgacaugaaguucacgguggucgugggugaugccaacggcauccuggcgcaggggaagaagaugauccgcccccagccaauggagcacaaguauuccuggaaguccuggggcaaagcaaagaucauuggcgccgacauccagaacacgaccuucaucaucgacggaccagauaccccggagugccccgacaaucaacgggccuggaacaucugggagguggaggacuauggcuucgggaucuucacgaccaacaucuggcugaagcuccgcgauuccuacacccagaugugcgaucaccggcucaugagcgcugcgauuaaggacuccaaagcaguccaugcagacaugggcuacuggaucgagagcgagaagaacgagaccuggaagcuggcccgcgcguccuucaucgaagugaagacgugcaccuggcccaagucacacacucucugguccaacggcguucuggagucagagaugaucaucccgaagaucuacggcggcccgauuucccagcacaacuaccggccgggguauuucacacagacggcagggcccuggcaccuggggaagcucgagcuggacuucgauuuaugcgagggcaccaccgucgugguggacgagcacugcggcaaccgcgggccgagccuccggaccacgaccgugaccggcaagaucauccacgaauggugcugucgcuccugcacacugccgccccugcgguuccgcggggaggacggcugcugguacgggauggagauccggcccguuaaggagaaggaggagaaccucguacgguccauggucucagccggcagcggcgagguugacagcuuuuccuuagggaucuugugcgugagcaucaugaucgaggaggugaugcgguccagguggagucggaagaugcucaugacggguacgcuggccguguuccugcuccuagugaugggccaguugaccuggaacgaccucauccgucugugcaucauggucggagccaacgccuccgaccgcauggggaugggcaccacguaccuggccuuaauggccaccuucaagaugcggccuauguucgccguggggcugcuguuucgccggcucaccucacgagaaguuuugcuccuuaccaucggacuguccuuaguggcgagcguggaacuccccaacucccuggaggaacugggagacggguuagcgaugggcaucaugauguuaaagcugcucacggaguuccagccccaccaacuguggaccacgcuacuaucucugaccuucaucaagacgacccugagucuagacuaugcauggaagaccaccgccauggcccugucaaucgucucccuuuucccccucugccuaagcacgacaucccagaagaccacguggcugccggugcuccugggcucuuucggaugcaagccacugacuauguuccucauaacagagaacaagauauggggccgaaaguccuggcccuuaaacgagggcauuauggcgauagggaucgugagcauccuguuauccagccugcugaagaaugacguccccuuagccggcccgcugaucgccggcggcaugcugauugccugcuacgugaucucagggaguagcgccgaccuaucccuggagaaggcggccgaggugagcugggaacaggaagccgagcacucgggaaccucgcacaacauacucguagaaguucaggaugacggaacaaugaagaucaaggaugaagagcgcgacgacaccuugacgauccugcugaaggccacccuccuggccguuuccggcgucuaccccaugagcauucccgcgacgcuguucgugugguacuucuggcagaagaagaagcagagguccgggguguuaugggauacgcccagccccccugaggucgaacgugccguguuagacgacggcaucuaccgcauccuccaaaggggccugcucgggcggucccaagugggcgucgggguuuuccaggacggcgucuuccacacuauguggcacgucacccggggcgccguacugauguaucagggaaagagguuagagcccagcugggccagcgugaaaaaggacuugaucagcuacggcgggggcuggcgcuuccagggaucguggaacaccggcgaggagguccaggugaucgcuguggaacccgggaaaaacccgaagaacguacaaacaacgccaggcaccuucaagacccccgaaggggaggugggggcgauagcccuggacuucaagcccggcaccagcgggucuccgaucgugaaccgggaggguaagaucgucggacuguacgggaacggcguggugacgaccagcgguaccuacgucuccgcaaucgcacaggccaaggcaagccaagagggcccccucccagagauugaagacgagguauucaagaagcgcaaccugaccaucauggaccuacacccagggagcggcaaaacgcggcgcuaccuucccgccaucgugcgggaagccaucaagcgcaaguugcggacacuuauccucgcacccacccgcgucgucgcguccgagauggccgaagcccuuaagggcaugcccauccgcuaccagacaacggccgucaagucagagcacaccgggcgggagaucgucgaccugaugugccaugccaccuucaccaugcgccucuuguccccgguacgagugcccaacuacaauaugauaaucauggacgaagcccacuuuacggaccccgccagcaucgccgcccgcggguacaucagcaccagggugggaaugggcgaggccgcggccaucuucaugacggccacgccgccugggucaguagaagccuucccccaguccaacgccgugauccaggacgaggagcgcgacaucccugagcguagcuggaacuccggcuacgauuggauuacggauuucccgggcaagaccguaugguuugugcccagcaucaagucggggaaugauaucgcgaacugccuacgcaaaaaugggaagcggguaauccagcugagccggaagaccuucgacacagaguaccagaagacaaagaacaacgacugggauuaugugguuaccacugauauauccgaaaugggggccaauuuuagggccgaccgcgugaucgauccccggcgcugccugaagccugucauccugaaggacggccccgaacgggugaucuuagccggcccgaugccaguaacggucgcaagcgccgcccagcgccggggacgcauaggccggaaccagaacaaggagggggaccaguacguguacaugggccagcccuugaacaacgacgaggaucacgcgcacuggacggaggccaagaugcugcucgacaacaucaauaccccagaagggaucaucccggcccuguuugaacccgaacgcgagaaguccgcagcuaucgacggcgaguaccgcuuacguggggaagcccggaagaccuucguugagcuaaugcggcgcggugaccugcccgugugguugagcuauaagguagccuccgaggguuuccaguauagcgaccggcguuggugcuucgacggggagaggaacaaucaggugcucgaggagaacauggacguggagauuuggacgaaggaaggcgagcgcaagaaguugcggccacgcuggcuggacgcgcgcacauacuccgacccgcucgcccugcgcgaguucaaggaguuugccgcugggcgacguagcgugucuggcgaccugauccucgagaucggcaagcugccccaacaccugacacuccgggcccagaacgcgcuggacaaccuggucaugcuccacaauuccgagcagggcgguaaggccuaccggcacgccauggaagagcuccccgauacuauagagacacugaugcuccuggcccugaucgccgugcucacggggggcgugacccuguucuuccugagcgggaagggccucggcaaaaccuccaucgggcugcugugcguuaccgccagcuccgcgcucuuauggauggccagcguagagccccacuggauugccgcguccauaauccuggaguucuucuuaaugguccuccugaucccggagcccgacaggcaacgcacuccccaggacaaccagcuagccuacgucgugaucggccuccuguucaugauccucacugucgcugccaaugagauggggcuccuggagacuaccaagaaggaccucggaaucgggcacgucgccgcagaaaaccaccaacacgccacaaugcuggacguggacuuacgaccggccagcgccuggacgcucuacgcgguggcgacgaccgucaucaccccaaugaugaggcacacgauagagaacaccaccgccaauaucucauuaacugcuaucgccaaccaggccgcuaucuugaugggccuggacaagggcuggccgauuagcaagauggacaucggggugccucuucuggcccucggcuguuacagccaggugaacccucugacgcugaccgccgccguccucaugcugguggcgcacuacgcuauuaucgggcccggucugcaagccaaggccacccgagaggcacagaagcgcacggcggccgggauaaugaagaaccccacgguagauggaaucguggccaucgaccuggacccaguuguguacgaugcuaaauucgaaaagcaauuaggccagauuaugcuccugaucuugugcaccagucagauccuguuaaugaggacuaccugggcacugugcgaguccauuacacuggcgacugggccgcuaaccacucugugggagggcagcccugggaaauuuuggaacacgacaaucgccgucuccauggccaacaucuuucggggcagcuaccuggccggcgccgggcuugcuuucucccugaugaagucccugggaggcggccgccggggcacuggcgcccagggcgagaccuuaggagagaaguggaagcgccagcugaaccaacuguccaagagcgaguucaacacguacaaacggagcgggauaauggaaguugaccgcagugaggccaaggaggggcucaaaagaggcgagacaaccaagcacgccgugucacgcgggacugcgaaguugcggugguucguugagcggaaccuggugaagcccgaaggcaaggugaucgaccucggcugcgggcggggcggguggaguuacuacugcgcgggccucaagaaggucaccgaggugaagggguauacgaagggcggccccggacacgaagagccgauccccauggccaccuacggcuggaaccuggugaagcugcacagcgggaaagacgucuucuucaugccgccagagaagugcgacacccuccucugugacauuggcgaguccucgccgaaccccacgauugaagagggucgcacucugaggguuuugaagaugguggagccuuggcugcguggcaaucaguucugcaucaagauccugaaccccuacaugccguccgucgucgaggcccucgagcagaugcagcggaaacacggcggcauguuggucagaaaccccuuaagccggaacuccacccacgagauguacuggguuagcugcggcacuggaaauaucguauccgccgugaauaugacgagccgcaugcuccucaauagauuuacgauggcgcaucgcaagcccacuuaugagcgagacgucgaccugggcgccgguacccggcacguagccguggagcccgaagucgccaaccucgacauaaucggucaacgcaucgagaacaucaagaacgaacacaagucuaccuggcauuacgacgaggauaacccguacaagacgugggcguaccacggcagcuacgaggugaagcccucggguagcgcauccagcauggugaacggcguugugcgucuauuaaccaaacccugggacgugauccccaugguaacccagaucgccaugacggacacgaccccguucgggcagcaaaggguguucaaggagaagguggacaccagaacgccccgggccaaacgaggcacgacccaaaucauggaggugacggcuaaauggcucuggggcuuucugucccggaacaaaaagcccaggaucugcacacgcgaggaguucacgcgaaaggugcgcagcaacgcggcgaucggggcuguguucguggacgagaaccaguggaauagcgccaaggaggcgguggaagaugaacgcuucugggaccugguccaccgagagcgggagcuccacaagcagggaaaaugcgcgaccuguguauauaacaugauggggaagcgagagaagaagcuuggcgaguucgggaaggccaagggcucccgggcaaucugguacauguggcugggcgcccgcuuccucgaguucgaggcccuaggauucaugaacgaggaccacugguucagccgggagaauucccugucggggguagaaggggagggauuacacaaguugggguacaucuugcgcgacaucuccaagaucccuggaggcaacauguaugcggacgacacagccgggugggauacgcguaucacggaggacgaccuccagaaugaagccaagauaaccgagauaauggagccggagcacgcccugcuggcaaccagcaucuucaagcucaccuaucagaacaaggucguacgcgugcagcgccccgcgaaaaauggcacagucauggacgucaucucccguagggaccaacgggguuccggccaggugggcaccuacggccugaacaccuuuacgaacauggagguccagcucauuaggcagauggaguccgaggggaucuuccuccccagcgaacuugaaacaccgaaccuagccgagcgugugcuagacuggcuugagaaacacggggccgaacgccugaagcggauggccauuuccggcgacgauugcguggucaagccaaucgacgaccgguuugccaccgcgcucaccgcccuaaacgauauggggaaggugcggaaggacauaccccagugggagcccagcaagggcuggaaugauuggcagcaggucccguucugcucccaccacuuucaucagcugaucaugaaggacgggcgagagauuguugugccaugucggaaccaggacgagcucguggggcgcgcacgggucucucagggcgccggguggucccugcgggagaccgcuugccugggcaagagcuacgcgcagauguggcagcucauguacuuucaccggcgcgacuugcggcuagccgccaacgcaaucugcuccgccgugccaguggacuggguuccaaccagccgaacgaccuggagcauccacgcccaccaccaguggaugacuaccgaggauaugcucucuguauggaaucggguguggaucgaagagaacccguggauggaggacaagacgcacgucagcuccugggaggaggugccuuaucucggcaagcgcgaggaucaauggugcggcagccugauaggccucaccgcuagagccaccugggcgaccaacauccagguggcgauuaaccagguccggagacugaucgggaacgagaacuaccuggacuacaugacguccaugaagagguucaagaacgagagcgaccccgagggcgcccugugguga

SEQ ID NO: 23920 - RNA, 9879 nt, Artificial Sequence
  derived and/or modified CDS sequence (opt11) from DENV-1__KJ189337__SS-prME
agcgugaccaugcucuuaaugcucuuacccacggcucucgccuuccaccugacaacccgcggcggagagccccacaugaucgugagcaagcaagagcgcggcaagagccuucuguucaagacgagcgcuggggugaacaugugcacacuuaucgccauggaccugggcgaauuaugcgaagacacuaugaccuacaagugcccccagaucaccgaggccgagcccgacgacguggacuguuggugcaaugccaccgacaccugggugaccuacgggaccugcagucagaccggagagcaccgcagagauaagcgcucuguggcccuggccccccacgugggccuggggcucgagacccggaccgagaccuggaugagcuccgagggcgcauggaaacaaauccagcgcgucgaaaccugggcauuacggcacccuggguuuacggucaucgccuuauuccuggcucacgccaucggcaccagcaucacccagaaggggaucaucuuuauccugcugaugcucguuaccccgagcauggccaugcgcugcgucggcaucggcaaccgcgacuucguagagggccugagcggcgccaccuggguggaugucgugcuggagcaugggucuugcgugaccaccauggccaagaauaagcccaccuuggacaucgagcuucuaaagacggaggucaccaacccagcgauccuccgcaaguuaugcaucgaggcgaagaucagcaacaccaccacggacuccagaugcccgacacagggcgaggcuacucuggucgaggagcaggacgccaacuuugugugccgcaggaccuuuguggaucgcggcuggggcaacggcugcggccucuucggcaagggaucucugcuaacgugcgccaaauucaaaugcgugaccaagcucgaggguaagaucguacaguacgagaaucugaaguacuccgucaucguuaccgugcauacuggcgaccagcaccaagucgguaacgagacgaccgagcacggcaccaucgcgaccaucacgccccaagcccccacgagcgagauccagcugaccgauuacggcgcccuaacccuggacugcagcccccggacggggcuggacuucaacgagauggugcuccugacgaugaaagagaaauccuggcugguucacaagcagugguuccucgaccugccgcugcccuggacguccggggcaagcaccagccaggagaucuggaaucgccaggaccuccucgugaccuucaaaacggcccacgcgaagaagcaggagguggucguguugggcucccaggagggcgccaugcacacagccuugacgggggccaccgagauccagacgagcggcaccacgaccaucuuugccgggcaccucaagugccggcugaagauggacaagcucacgcugaagggcaccucauacgugaugugcaccgggagcuucaagcuggagaaagaagucgcggaaacccagcauggcacugugcugguccagguaaaguacgagggcaccgacgcgcccuguaagauccccuuuuccacccaggacgaaaaaggugugacccagaacggcaggcuaaucacggccaacccgaucgugaccgacaaggagaaaccugucaacaucgagaccgagccgcccuuuggcgagagcuacaucguggugggcgcaggggaaaaggcgcugaagcuaagcugguucaaaaagggaagcucgaucggcaagauguucgaggccacggcccgcggugcucgccggauggccauucugggcgacacggcgugggauuucggcagcauagguggcgucuucaccuccguggggaagcuggugcaccaggucuuuggcaccgccuacggggugcuauucaguggcgugucuuggacuaugaagaucgggauaggcauccuucuaacguggcugggucuuaacucacguuccaccagcuuguccaugaccuguaucgcagucgggauggugacucuguaccucggcgugauggugcaggcagacagcggcugugugaucaacuggaagggccgcgagcuaaagugcggguccggcaucuuugugacaaacgagguucauaccuggacugagcaguacaaguuccaggccgacucaccgaagcgucucucagcggccaucggaaaggccugggaggaaggggugugcggcauccgcuccgcgacccggcucgagaacaucauguggaagcagaucuccaacgaacugaaccacauccugcucgagaacgauaugaaauucaccguggucgucggggacgccaacggcauccuggcgcaagguaagaagaugauccgcccacagcccauggaacauaaguacuccuggaaguccuggggcaaagccaagaucaucggcgccgacauccagaacacgaccuucaucauugacgggcccgacaccccggagugucccgacaaccagagggccuggaacaucugggagguagaggacuacggcuucgggaucuucaccacaaauaucuggcuaaagcuccgcgacuccuauacccaaaugugcgaccaccggcugaugucggcggcaaucaaggauuccaaggccgugcacgccgacaugggcuacuggaucgagagcgagaaaaacgagacguggaagcuggcccgcgcguccuucaucgaagugaagaccugcacguggcccaagagccacacccucugguccaacggcgugcuggaaagcgagaugaucauccccaaaauauaugggggcccaaucucccagcacaacuaccggcccggguauuucacccagacggccgggcccuggcaccuggggaagcucgagcuggacuucgacuugugcgagggcacgacugucguaguggaugagcacuguggcaaccgcgguccgagccuccggacuacaacggucaccggcaaaaucauccaugaguggugcugccgcuccugcacccucccgccccugcgguuccgcggagaggacggcugcugguacgggauggagauccgccccgugaaggaaaaagaggaaaaccucguuagaucgauggugucagccggcagcggcgagguggacagcuucucccuggggauccucugugccagcaucaugaucgaggaagugaugcggagccgcuggagcagaaagaugcucaugaccggcacgcuugcggucuuccugcuccugauaauggggcaacugaccuggaacgaucucauccgccugugcaucauggugggcgcgaacgccuccgaccgcauggggauggguaccaccuaccuggcccucauggccacguucaaaaugcgaccgauguucgccguggggcugcuguucagacgacuuaccagcagggagguccuguuacuaacgaucgggcugagccugguggccaguguggagcuccccaacucccuggaggagcugggagaugggcuggccaugggcauaaugaugcugaagcugcuaaccgaguuccaaccccaccaguuguggacgacccugcucagccugaccuucauaaaaaccacgcuguccuuagacuacgcauggaagacuacugccauggcgcucucuaucgugucacuuuucccacucugccucagcacaacgucccaaaagacaaccuggcuuccgguccuccugggcagcuucggguguaaaccccugaccauguuccucaucaccgagaacaagauaugggguaggaagaguuggccgcugaacgaggggaucauggccaucgguaucgucagcauccugcucuccagccugcugaagaacgacgugccucucgccgguccgcucaucgccggcggcaugcugaucgcaugcuacgugauaucuggguccucugccgacuugucccuggaaaaggccgccgaaguaagcugggaacaggaggccgagcacuccggaacgagccacaacauccugguggagguccaggacgacgggacgaugaagaucaaggacgaggagcgagaugacaccuugacaauccuguuaaaggccacgcuccuagccgucucuggcgucuaccccaugucgauccccgccacccuuuucgucugguacuucuggcagaagcgaaagcagcgcuccggggucuugugggacacgcccagcccgcccgagguggaacgggcaguucuggacgacggaaucuaccgaauacugcagcggggccugcucgggcgcucccagguuggcgugggaguguuccaggacggggucuuccauaccauguggcacgugacgcgcggggccgugcugauguaucagggcaagcgccuggagcccagcugggcuucugucaagaaggaccucaucagcuauggcggugguuggcgguuucaaggguccuggaacaccggugaggagguccagguuauugcggucgagcccgggaagaacccgaaaaacguucagaccaccccgggcacguucaagaccccggagggagaggugggggcuaucgcccuggacuucaagcccggcacaagcggcucccccauagucaaccgcgagggaaaaauugugggccuguacgggaacggugugguaaccacgagcgguacuuacguaagcgccaucgcccaggcgaaggcgagccaggagggcccccuccccgagauugaagacgaaguguucaagaagcggaacuuaaccaucauggaccugcacccggggagcggcaagacccggcgguacuugcccgccaucgugcgggaggccaucaagcguaagcugcgcacgcuaauuuuagcgcccacacgcgugguggccuccgagauggcggaagccuugaaggguaugcccaucagauaccaaacaacagccgucaagagcgagcacacggggcgcgaaaucguggaccugaugugccacgcuaccuucaccaugcggcuccuguccccggugagaguccccaacuauaacaugaucaucauggacgaggcccacuucaccgacccugcaagcaucgccgcucgcggcuacaucuccacgcgcguggggaugggcgaggcggccgccaucuucaugaccgccacgccgcccgggagcguggaagccuucccccaauccaacgcgguaauccaagacgaggaacgggacaucccggagcgcagcuggaacaguggcuacgacuggauuaccgacuuccccggcaagacagucugguuugugccgucgaucaaguccggaaacgacaucgcuaacugccugcguaagaacggaaagcgcgucauccagcucagccggaagaccuuugacaccgaguaccagaagaccaagaacaacgacugggacuacguggugacgaccgacaucuccgagaugggggccaacuuccgcgccgaucgggucauugacccccgccggugccucaagcccgugauucugaaagacgggcccgagcgcgugauucuagcggguccaaugcccgucacaguggccagugccgcacagcggcgcggccggaucggccguaaccagaacaaagaaggagaucaguacguauacaugggccagccacucaacaaugaugaggaccaugcccacuggaccgaggcuaagaugcugcuggacaacaucaauacgcccgaggguaucauuccggcacuguucgagccagagcgcgagaaauccgccgcuaucgacggcgaguaccggcugcgaggggaggcccggaagaccuucgucgagcuaaugcgccguggcgaccugcccguguggcugagcuacaagguggcgagugaaggauuccaguacagcgacagacgguggugcuucgacggggagcgcaauaaccaggugcucgaggaaaacauggacguggagaucuggaccaaggagggcgagcgcaagaaguugcggccccgguggcuggaugcccgcacguacuccgacccgcucgcccugcgggaguucaaggaguucgcugccgggagacggucugucaguggcgaccugauccucgagaucggcaagcugccccagcaccugacccuccgcgcgcagaacgcccuggacaaucuggugauguuacacaacuccgagcagggcgggaaggccuaccggcaugccauggaggagcuccccgacacgaucgaaacgcugaugcuccuggcauuaaucgccgugcucaccgggggcgucacccuguucuuccuuagcgggaagggccucggcaaaacauccaucggccuguugugcgugaccgccagcagugcccuacuguggauggccucgguggagccucacuggaucgcggcuuccauuauccuggaguuuuuccucauggucuugcugaucccggagcccgauaggcaaagaacgccccaggacaaccagcuugcguacguggugaucggccugcuguucaugauccucaccgucgccgccaacgagauggggcuccuggagacgaccaagaaggaucucgggauagggcauguggccgccgagaaccaucagcacgccaccaugcuggacguggaccugcgcccggccagcgccuggacccucuacgccgucgccaccacggugauaaccccgaugaugcggcacacaaucgagaacacgaccgccaacaucuccuugaccgccaucgccaaccaggcggcgauccugaugggccuagacaagggcuggcccaucagcaagauggacaucggggugccccugcuggcccucggcugcuacucccaggucaacccgcugacccugacggcagcggugcucaugcugguggcucacuacgccaucauuggaccgggccugcaggccaaggccacccgcgaagcgcaaaagcgcaccgccgccgggaucaugaagaaucccaccgucgacggcaucguggccaucgaccuugaccccguagucuacgacgccaaguucgagaagcagcugggccagaucaugcugcugauacuguguacgucacaaauccugcucaugcggaccaccugggcgcugugcgagucgaucacgcuggccacugggccgcucacgaccuuaugggagggcagccccggaaaguucuggaacacuacgaucgccguguccauggccaacaucuuccgugggagcuaccuggccggagcagggcucgccuucucccugaugaagucccuaggcggcggcagacgcgggaccggcgcccagggcgaaacgcucggggagaaauggaagagacagcuaaaccagcuauccaagagcgaguucaacaccuacaaacgcagcggcaucauggaaguggaccgguccgaggccaaggagggacucaaacggggcgaaacgaccaagcacgccgucagccgggggaccgcuaagcugcgcugguuuguggagcgaaaccuggugaagcccgagggcaaggugaucgaccuaggcugcgggcggggagggugguccuacuacugcgcuggccucaaaaaggugaccgaaguuaagggguacaccaagggcggccccgggcaugaggagccgauccccauggccacguacggauggaaccuggucaagcugcacagcgggaaggacguguuuuuuaugccgccggagaaaugcgauaccuuacugugcgauaucggcgaguccagcccgaaccccaccaucgaagaggggaggacccugcgcguacucaagauggucgaacccuggcuacgcggcaaccaguucugcauaaagauacugaaccccuauaugccgucagugguggagacccucgagcagaugcagcgaaagcacgggggcaugcuugucagaaacccccugagcaggaacucaacccacgaaauguauugggugagcugcggcaccgggaacauaguguccgccgucaacaugaccagcaggaugcuccugaaccgcuucacgauggcgcaccgcaaaccuacauucgagcgggauguggaccugggcgcaggaacccgccacguggccgucgagcccgagguggccaauuuagauaucauugggcagcggaucgagaacguaaagaacgagcacaagucuaccuggcacuacgacgaggauaacccguacaagaccugggccuaccacggcagcuacgaggucaaacccuccgggagcgcgucuagcauggugaauggcguuguucgccugcugaccaagccaugggaugugauacccauggucacucagaucgccaugaccgacacgaccccguucgggcagcagcggguguucaaagagaagguggauacccgcacgccccgggcaaagcggggcacaacucagaucauggaggucacagcaaaguggcucuggggcuuccugucccggaacaagaagccacgcaucugcacccgggaggaauucacgcgcaagguccggagcaacgccgcgaucggugccguguucgucgacgaaaaccaguggaacagcgccaaggaggcagucgaggacgagcgcuucugggaccuggugcaccgggaacgcgaacuccacaaacaggguaagugcgcgaccugcgucuacaacaugauggggaagagagagaagaagcugggagaguucgggaaggccaagggcagucgcgccauuugguacauguggcugggcgcccgguuccucgaguuugaggcccugggguucaugaacgaggaccacugguucagccgcgagaacucccugagcggcguggagggggagggccuccacaagcugggguacauccugcgggacaucuccaaaauacccgguggcaacauguacgcugacgacaccgccgggugggacacacgaauuacagaggaugacuuacagaacgaggccaagaucaccgacaucauggagcccgagcacgcacuguuggccaccucaaucuucaagcucacguaucaaaacaaggugguccgcgugcaaaggcccgcgaaaaacgggacggugauggacgugaucucccgccgggaucagcgggggucaggccagguaggcaccuacgggcugaacacguucaccaacauggagguacagcuuauccggcagauggaguccgagggaaucuuccuucccagcgagcuggagacgccaaaccuggccgaacgcguccucgacuggcuggagaagcacggggccgagcggcugaagcguauggccaucuccggcgaugauugcguggugaaacccaucgacgaccgguuugcaaccgcgcucacagcccugaacgauaugggaaagguccgcaaagacaucccacagugggaacccagcaagggguggaacgacuggcagcaagucccguucuguucccaccacuuccaccagcugauaaugaaggacggccgggagaucgugguucccugccguaaccaagaugaauugguggggcgugccagagugagccagggcgccggcuggucccugcgagagaccgccugccugggcaagagcuaugcgcaaauguggcagcucauguacuuccaccgccgggaucugcgccuggccgccaacgccaucuguuccgcgguucccguggacugggugcccacgagccggacgaccuggagcauccacgcccaccaucaauggaugaccaccgaggacaugcucuccgucuggaaccgcguguggaucgaagagaacccguggauggaggacaagacgcacgugagcaguugggaggagguccccuaucuggggaagcgcgaggaccaguggugcggcagccugaucggcuugaccgcucgggccaccugggccaccaauauccagguggcgaucaaccagguccgccgguugauugggaacgagaacuaccuggacuacaugacauccaugaagcgcuucaagaacgagagcgaucccgagggcgcccucugguga

SEQ ID NO: 23921 - RNA, 9879 nt, Artificial Sequence
  derived and/or modified CDS sequence (opt11) from DENV-1__KJ189340__SS-prME
ucggugaccaugcugcucaugcugcugcccaccgcacuagccuuccaccucacaaccagaggcggugagccccacaugauagugucuaagcaggagcggggcaagagccugcucuucaagacgucugcgggagugaacaugugcacccugaucgccauggaccugggcgagcucugcgaggacaccaugacuuacaaguguccccagaucaccgaagccgagcccgacgacguggacugcuggugcaacgccaccgacaccugggucaccuacgggaccugcagccagaccggcgagcaucggcgggacaagcgcuccguggcccuggcgccccacgugggcuuggggcuagagacgcggaccgagaccuggaugagcuccgagggagcauggaagcagauacaacgagucgaaaccugggcccuccggcaccccggguucacggugaucgccuuauuccucgcgcacgccaucggaacgagcaucacucagaaggggaucaucuucauccugcugaugcuaguuacuccauccauggcgaugcggugugucggcauuggcaaucgggauuuuguggaggggcucagcggcgcuacguggguugacguugugcuggagcacggguccugcgugaccaccauggccaagaauaagcccacacucgacaucgaguugcuaaagacggagguuaccaaccccgcgauccuucgcaagcucugcaucgaagccaagaucagcaauaccaccacggacucccggugcccuacccaaggagaggcaacccuggucgaggagcaagacgccaacuucgugugccgccggacauuugucgaccgcggcugggggaacgggugcggccucuucggcaaggggagccugcugacuugcgcuaaguucaagugcgugaccaagcucgagggcaagaucgugcaguaugagaaccucaaguauuccgucauagugaccgugcacaccggcgaccagcaccaagucgggaaugagacuaccgaacacggcaccauugcaaccaucacgccccaggcgcccacgagcgagauccagcugaccgauuacggagcacucacccuugacuguagcccccggacgggauuagacuucaacgagauggugcuccugaccaugaaggagaagagcuggcugguccacaagcagugguuucucgaccugccgcugccauggaccucuggugccagcaccucucaagagacuuggaaccggcaggaccuccuggugaccuucaagaccgcccacgcgaaaaagcaggagguggucgugcuggggucgcaggaaggcgccaugcacacagcccugaccggggccacggagauccaaaccuccggcaccaccacgaucuucgccgggcaccugaagugccgacugaagauggauaagcugacccuuaagggcaccuccuacgugauguguacugggagcuucaagcuggagaaggaggucgcggagacgcagcacggcaccgugcuggugcagguuaaauacgaaggcaccgacgccccuugcaagauacccuuuuccacacaggaugaaaagggcgugacgcaaaacggccgccucaucaccgcuaauccuauugugaccgauaaggagaagcccgucaacaucgaaaccgagcccccuuucggggaaagcuauaucguugucggugcgggcgagaaagcgcugaagcuguccugguuuaagaaggggagcagcaucggcaagauguuugaagccacggcccgcggggcccgccggauggccauccuuggggacaccgcgugggacuucgggagcauuggaggcguguucacaagcgugggcaagcuggugcaucaggucuuugguaccgcguauggggugcuauucaguggcguguccuggacgaugaaaaucgggaucggcauccuccugacauggcugggccucaacagccgauccaccagccuguccaugaccugcauugccguaggcauggugacacuguaccucggcguaaugguccaggccgacagugggugcgugaucaacuggaagggucgcgaacugaaguguggcucuggcauauucgugaccaacgaaguccacaccuggaccgagcaguacaaguuucaggccgacagcccgaagcggcucagcgcagccaucggcaaggcaugggaggagggggucugcggcauaagauccgccacucggcucgagaauaucauguggaaacagauaagcaaugagcugaaccacauccugcucgaaaacgacaugaaguucacgguggucguaggggacgccaacggcauccuagcgcaggggaagaaaaugauccguccccagcccauggaacacaaguacucguggaaauccuggggcaaggccaagauuaucggugcagacauccaaaacaccacuuucaucaucgaugggcccgauacaccugaaugccccgacaaccagagggccuggaacaucugggaaguggaggacuacggcuucgggaucuucaccacaaacaucuggcugaagcuccgcgauuccuacacgcagaugugcgaucacaggcugaugucggcggccaucaaggauuccaaagccguccacgcggacaugggcuacuggaucgagucugagaagaacgagaccuggaagcuggcgcgugcguccuuuauagaggugaagacgugcaccuggcccaagagccacaccuuaugguccaacggcgugcuggaaagcgagaugaucauccccaagauuuacgggggcccgaucucccagcauaacuaucggccaggguacuucacgcagacggccgguccauggcaucuggggaagcucgagcuggauuucgaccuaugcgagggcacuacagucgugguggacgagcacugcggaaaccgcgggccgagccucaggaccacgaccguaaccggcaagauuauccaugaguggugcugccgcaguugcaccuuaccgccccugcgguucaggggggaggacggcugcugguacgguauggagauccggcccgugaaggagaaggaggagaaucucgugcgcucuaugguuucugccggcagcggugagguggacagcuucucccuggggauccugugugugucaauaaugaucgaggagguuaugcggucccgcuggagccggaagaugcucaugacgggcacucuagccguguuccugcuccuggugaugggucaauuaaccuggaaugaccucauccgccuguguaucauggucggagccaacgcgucagaccguaugggaauggggaccacguaccucgccuuaauggccaccuuuaagaugcggccaauguucgcugugggucuguuguuccgcagguuaacuucacgcgaagugcuccugcucaccaucgggcugucguuagucgccaguguggaauuacccaacucccuggaggagcugggcgacggacucgccaugggcaucaugaugcugaaguuacucacggaguuucagccccaccagcuguggacaacccugcugagccugacauuuaucaagacgacccucucccuugacuacgccuggaagacaacggccauggcccugucuaucgugucccuguuccccuuaugccugagcacgaccucccagaagaccaccuggcugccgguucucuuaggcagcuucgggugcaagccccugaccauguuccuuaucacggagaauaagauuugggggcggaaguccuggcccuugaacgaggggaucauggcgaucggcaucgugagcauucugcucuccagcuugcugaagaacgacgucccccucgccggcccgcuuaucgcaggaggcaugcugaucgccugcuacgugauuucuggguccagcgccgaccucucccuggagaaagcagccgaagugucgugggaacaggaggccgagcauuccggcaccagccauaauauccugguugagguccaggacgacgggaccaugaagaucaaggacgaggagcgcgaugacacccucaccauccuccugaaggccacccuccuugccguguccggcgucuaccccaugagcaucccagcgacccuguucguaugguacuucuggcagaaaaagaagcagcgaucggggguuuugugggauaccccgaguccaccugaggucgagcgcgcugugcuugacgauggcaucuaccggauccugcaacgcggucugcucgggcggucccagguaggcgucggggucuuccaggauggcguguuucauacgauguggcaugucacccgcggggcggugcugauguaccaggggaagcggcuugagccaagcugggccagugugaagaaggacuugaucagcuacggcggaggguggcgcuuucaaggaucauggaacaccggcgaggagguccaggugauagccguggaaccagggaagaacccuaagaacguacagaccacgcccggcaccuucaagacaccugagggcgaggugggggcgaucgcccuagauuuuaagcccggcaccuccggguccccgaucgucaaccgggagggaaagaucgucggccuguauggaaacggcgugguaacgacagggggcaccuacgucucggccauagcccaggccaaagccucccaagaggggccgcuucccgaaauagaggaugagguguucaagaaacgcaaccugaccauaauggaccugcacccggguagcggcaagacgcggcgcuaccuccccgccaucgugcgggaagccaucaagcgaaagcuucggacacugaucuuagcccccaccagagucguggcgagcgagauggccgaggcccugaaagggaugcccauccgcuaccagaccacggcggugaaguccgagcacaccggcagagagaucgucgaccucaugugccacgcaaccuucaccaugcgcuuacugucgccaguccgggugcccaacuacaacaugaucaucauggacgaagcgcacuucacggacccggcguccaucgcggcccgcggguacauaagcacccgugucggcaugggggaggccgcggccauauucaugaccgccacgccuccgggcaguguggaggccuucccccagagcaacgccgugauccaggacgaggagcgcgacauacccgagagaagcuggaacagcggcuaugacuggaucaccgauuuucccgguaaaaccguaugguucgugcccuccauaaagucuggcaacgacaucgcgaacugccugcgcaagaauggcaagcgggugauccagcucagccgcaagaccuucgacaccgaguaccagaagacgaaaaauaacgacugggacuacgucgugaccacugacaucagcgagaugggcgccaacuucagggcugaccgcgugaucgacccccggcgcugccuuaagcccgucauccuaaaggacgggcccgagcgugugauccucgccgguccgaugccagucacgguggccuccgccgcucaaagacgggggcggauugggcggaaucagaacaaggagggcgaccaguacguguacauggggcagccccugaacaacgacgaagaccacgcccauuggacggaggccaagaugcugcuagauaacauaaacacgccugaggguauuaucccggcgcuguucgaaccugagcgcgagaaguccgccgcaaucgacggagaguaucgccugcggggcgaggcccgcaagaccuucgucgagcuaaugcgccgcggcgaccugcccguguggcugucguauaaaguggccagcgaaggcuuucaguacuccgaucggcgauggugcuucgauggggagcgaaacaaccagguccuagaggagaauauggacguggagaucuggaccaaggaaggugagcgcaagaagcugcggccccguuggcuggaugcgagaacauacagcgacccgcucgcccuucgcgaguucaaggaguucgcugccggccggagguccgugagcggagaccugauucuggagaucgggaagcugccucagcaccugacauuacgggcccagaacgcgcuggacaaccuggucaugcuccacaacagcgagcagggcgggaaggccuaccgccacgccauggaagaacuccccgacaccaucgagaccuuaauguugcuggcccugaucgcggucuuaacuggcggggugacgcuguucuucuuguccggcaagggccucgggaagaccucaaucggccuucucugcgucaccgccuccagcgcacuccuguggauggccuccgucgaaccccacuggauugccgcuagcauuaucuuggaguuuuuucucauggugcugcugaucccggagcccgaccggcagcgcacgccccaggacaaucagcuugccuacgucgucaucgggcugcuguucaugauccucacgguggccgcgaacgaaaugggucugcuggagaccaccaagaaggaucucgggaucgggcacguagccgccgagaaccaucagcacgcuaccauguuggacguggaccuacggccagccuccgccuggacacuuuacgcgguugcaaccacggucaucacccccaugaugagacauacaaucgagaauaccacugcaaacaucagcuuaacugccaucgccaaucaggccgcuauccugaugggccucgacaagggguggcccaucuccaaaauggauauaggugugccccugcuggcacucggguguuacagccaggugaacccgcugacgcugaccgcugccguccucaugcugguggcucacuacgccaucauuggacccgggcugcaggccaaggccacgcgggaggcucagaaaagaaccgcggccgggauuaugaagaaucccacaguggacggcaucgucgcuauugaucucgauccagugguguacgacgccaaguucgaaaagcagcuggggcagaucaugcugcucauacugugcaccucucagauucugcucaugagaacuaccugggccuugugugaaagcauaacgcuagcgaccgguccucucacgacacuaugggaagggucccccgggaaguucuggaacacgaccaucgccguaagcauggccaacaucuuccggggguccuaccuggccggagccggccuagcguucagccucaugaagucccucgggggcggacgccgagggaccggagcccaaggggagacccuuggagagaaguggaagcgccaguugaaccaguuaagcaagagugaguuuaacacguacaaacggagcgggaucauggaaguggaccgcagcgaagcgaaggagggccucaagcgcggcgagaccaccaagcacgcuguuucccgcggaacagcuaaguugcggugguucgucgagcguaaccuggugaagcccgaagguaaggugaucgaucuggggugcggacgcgggggcuggagcuacuacugcgcugggcuaaaaaagguuaccgaagucaagggcuacacgaagggcggacccggccacgaggagccaauccccauggcaaccuacggcuggaaccuggugaagcugcauuccgggaaggaugucuuuuucaugccccccgagaagugcgacacgcuccugugcgacaucggugagaguucaccuaacccuacaauugaggagggcaggacgcugcgugugcuaaagaugguggagcccuggcugagaggaaaccaguucugcauuaagauccugaaccccuacaugccgagcgucguggaagcgcucgagcagaugcaacggaaacacgggggcaugcuggugcgcaacccccugucccggaacucuacccacgagauguacugggucuccuguggcacgggcaacaucgugagcgcugugaacaugaccagccgcaugcugcugaaccgguucacgauggcgcaccgcaagccgacguacgagcgcgacguagaccugggugccgguacgcggcacguggccguggaacccgaagucgccaaccuggacaucaucggccaacgcaucgagaacaucaagaacgagcacaagucgaccuggcacuacgacgaagauaacccguacaagacaugggcuuaccacggguccuacgaaguaaagcccagcgguagcgcgucguccauggugaacggggucgugcggcuguugaccaagccaugggacgucauccccauggugacccagauugcuaugaccgacaccaccccguuuggccagcaacgcguguucaaggagaaggucgauacccggacccccaaggcuaaacggggcacgacccagaucauggaggugacggccaaguggcucuggggguuccugagucgcaacaagaagccgcgcaucugcacccgggaggaguuuacgcgcaagguucgcagcaacgccgcgaucggcgccgucuucguggacgaaaaccaguggaacagcgccaaggaggccguggaggacgaacgcuucugggaucugguccaccgggaacgcgagcuccacaagcaggggaagugcgcuaccugcguguauaacaugaugggcaagagggaaaagaaacucggugaguucggcaaggccaagggcagccgcgcaauaugguacaugugguugggagcccgguucuuagaguucgaggcccucggcuucaugaacgaggaccacugguuuucccgcgagaacagccugagcgggguggagggggaagggcuacacaagcugggcuacauccugcgggauaucagcaagaucccgggcgguaacauguaugcggacgacaccgccggcugggacacaaggaucacggaggaugaccuccagaacgaggccaaaaucaccgagaucauggagccugagcacgcguugcuggccaccucuaucuucaagcucaccuaucaaaacaaaguagugcgggugcaacgccccgccaagaacggcaccgucauggaugugaucagccgccgggaccagcggggcuccggccagguggggacuuaugggcugaacacguucaccaacauggagguccagcugaucagacagauggaaagcgagggaaucuucuugcccuccgaacucgagacgccaaaccucgccgagcgcguccucgauuggcuggaaaagcacggcgcugaacggcugaagcgaauggccauuagcggagacgacuguguggucaagcccaucgacgaccgguuugccaccgcgcucaccgcucugaacgauaugggcaaagugcgcaaggacaucccccaaugggagcccuccaagggcuggaacgacuggcagcaggucccguucuguagccaucacuuccaccaguugaucaugaaggacgggcgcgaaaucguagugccgugucgcaaccaggaugagcucguuggccgggcccgcgucagucagggggccggguggagccugcgggagaccgccugccuggggaaguccuaugcacagauguggcagcucauguauuuccacagacgggaccugcgcuuggccgcaaacgccaucugcagcgcggugcccguagacuggguccccacaucccgaacgaccuggagcauccacgcccaccaccaguggaugaccaccgaggacaugcuaagcguguggaaccgcguguggauagaggagaauccguggauggaggacaagacucacgucucaagcugggaggagguacccuauuuggguaagcgggaagaccaguggugcggaucacugaucggacucaccgcccgcgccaccugggcaaccaacauccagguggcaaucaaccaggucaggcggcugaucggaaacgagaacuaucuggacuacaugacgagcaugaagagauucaagaacgaauccgaccccgagggggcccucugguga

SEQ ID NO: 23922 - RNA, 9879 nt, Artificial Sequence
  derived and/or modified CDS sequence (opt11) from DENV-1__KJ189341__SS-prME
uccguaaccaugcuacuaaugcugcuacccacggcccuagcuuuccaccucacuacucgcggaggggaaccccacaugaucguaucgaaacaggaacgaggaaaaagccuccucuucaaaacgagcgcaggcgugaacaugugcacccuaauagcuauggaccucggugaacugugugaagauaccaugacauacaaaugcccgcaaaucacagaagcggaaccugacgauguagauugcugguguaacgccacagacacaugggugaccuacggcacguguucgcaaacaggagggcaccgcagagaaaaacgaaguguagcccuugcgccccacguaggccucgggcuggaaacacggacagagacguggaugucgucagagggggcguggaaacaaauacaacggguugagaccugggcccuaaggcaccccgguuucacaguaauagccuuauuucuagcucacgcaaucgggacuagcaucacucagaaagguaucauuuuuauacuacuaaugcucgucacaccaaguauggccaugaggugcguaggaauaggcaaccgugacuucgucgagggcuuauccggagcaacguggguagaugucgugcucgaacacggaucaugcguaacaacaauggcuaaaaacaaaccaacgcucgacauagagcuacuaaaaacagaagugacaaacccagcaguccuaagaaaacuuuguauagaagccaaaauaagcaauacaacuaccgauucacgcuguccaacccagggagaggccacucuggucgaagaacaggacgcaaacuucguaugccgucggacauucgucgauagaggcuggggcaacgguugcggccuguucggcaagggaucgcugcucacuugugcgaaauucaagugcgucaccaaacuagaagggaaaauugugcaguacgaaaaccuaaaauacagcgucauaguaacaguacacaccggggaccaacaccagguagguaacgagacaaccgagcacgggacaauagccaccaucacgccacaagcaccuacgucagagauccaacucacggauuauggggcauugacucuggacugcucuccacgcacagggcuagacuucaaugagaugguucuccucacaaugaaggaaaaaucauggcucguccacaagcaaugguuccuggaccuuccgcugccauggaccaguggagcaaguacgucccaagagacauggaaccgacaagaucuccuaguaacuuucaaaacugcgcaugcgaagaagcaggagguagucguccucgggucacaagagggcgcaaugcacaccgcccucacaggcgcaaccgagauccaaaccagcggaacaaccacaaucuuugcuggacaccuaaaaugucgcuugaaaauggacaaauugacucuaaagggaacaucguauguaauguguacaggcccuuucaaguuagagaaggaagucgcagaaacgcagcaugggacuguccuuguccaagugaaauacgaaggaaccgacgcaccauguaaaauacccuucucgacacaggacgagaagggcgucacccaaaauggccgacucauaacggccaacccgauaguuacugacaaagagaagccggugaacauugagacggaaccaccuuucggggaaagcuacaucguagugggagcgggcgaaaaagcauuaaagcucucuugguucaagaaaggaucgucgauugguaaaauguucgaagccaccgccagaggagccagacggauggcaauacucggcgacaccgcaugggacuucgguagcauaggcggcguauucacgagcgugggaaaacugguccaucagguauuugggacggcuuacgguguccuauucaguggugugagcuggaccaugaagauuggcaucgggauacugcucacauggcucgggcuuaacucacggucgacuucucugagcaugacgugcauagucguaggcaucgucacguuauaucucggaguaaugguccaggccgacucugggugcgugauuaauuggaaaggacgagaguugaaauguggcucggggauauucgugaccaacgaaguacacaccuggacugaacaauacaaguuccaggcagauagccccaagcggcucagugcggccauagguaaggcuugggaagaaggagucugcggaauccgaagcgcaacccggcuagaaaauauaauguggaaacaaaucucaaacgaacucaaccacauauuacuagaaaacgacaugaaauucaccguugucguuggagacgcgaacggaauacucgcacaaggcaagaaaaugaucagaccacaaccgauggaacacaaguacuccuggaaguccugggggaaagcaaagauaaucggugcagacacccagaacaccacguucaucauagauggccccgacacuccugagugccccgacaaccaacgcgcguggaacauaugggagguagaagauuauggguucggcaucuucaccacgaacauauggcucaaauuacgagauagcuauacccagaugugcgaccaccgguugaugucagcagcaauuaaagacaguaaggcggugcacgccgacauggguuauuggauugagucggagaaaaacgagacauggaagcucgcccgcgccucauucaucgagguaaaaacaugcacauggccaaaaucccauacccucuggucgaacggugugcuggaguccgagaugauaauccccaaaauauacggaggccccauuucgcaacacaacuaccgacccggcuacuucacccagacugccggaccauggcaccugggcaaacucgaacuggauuucgaccucugugaagguaccacaguuguaguagacgaacauuguggcaaccgagguccaucccuaaggacaacgaccgugacaggaaaaaucauucacgaaugguguuguagaagcugcacccuaccgccccuucgauuccgaggggaggauggcugcugguaugguauggagauacgaccugugaaggagaaagaagaaaaccuaguccgaagcaugguaagcgcagguucuggagagguagacagcuuuucccuaggaauccuaugugcaaguauuaugauagaggagguaaugagaagcagauggucgaggaagaugcuaaugaccggcacacucgccgucuuucucuuacucaucauggggcagcuaaccuggaaagaucucauucggcuguguaucauggugggugcuaacgcaagugacaggaugggaaugggcacgaccuaccuggcacuaauggcgacauucaagaugcgacccauguucgccguagggcuccuauuuagaagacucacaagcagagaggugcuacuacugacaaucggucuauccuuggucgcgucaguagaacuacccaauucccuagaagaauugggagacggacucgcaaugggaauaaugauguuaaagcuccucacagaguuucagccacaucaacuuuggacaacacugcucagucucacguucauaaaaacaacgcuaagucucgacuaugccuggaagacaacagcaauggcuuuauccauaguaucacuguucccgcuaugccugagcacgacaagccagaaaacaacaugguuaccagugcugcuggggaguuucggaugcaagccaucaacaauguuucucauaacagaaaacaaaauauggggacgaaagagcuggccacuaaacgaaggcaucauggcaaucgggaucgugucaauacuccucagcagccuccucaaaaacgaugugccacuagccggcccauugaucgcaggcgguaugcuaaucgcauguuaugucauauccgggaguuccgcagaucuaucacuggaaaaagcagccgaggucucgugggaacaggaggccgaacacagcgggaccucgcacaauauacuggucgaaguacaagacgacggaacaaugaaaauaaaagacgaggagcgggacgacacccucaccauacugcucaaagccacacuccucgccguaagcgggguauauccaaugucaaucccugcaacucucuucguuugguacuucuggcagaagaaaaagcagcgcucagggguccuaugggauacuccaagcccaccggaagucgaaagagccguauuagacgacggaauuuaccgaauacugcagcggggguuacuaggccgaagccaggucggcguaggaguuuuucaagacggcgucuuucacaccauguggcacgucacucggggagcggugcuaauguaucagggaaagcgccucgaaccgaguugggcgagugucaagaaagacuugauaaguuacggcggcggauggcgguuccaaggcucuuggaauaccggggaagaagugcaaguaauagcaguagagcccggcaaaaaccccaaaaaugugcaaacaaccccggguaccuucaagaccccggagggcgagguuggggcaaucgcgcucgacuucaagccaggcacgucgggcucgcccauagucaaccgagaagggaagauugugggccucuacgggaacggugugguaacaacaagcggcacguacgugucagccauagcccaagccaaggccagccaggaggggccuuugcccgagaucgaggaugaaguauucaaaaagagaaaccucaccauuauggauuugcacccaggcaguggcaagacaagacgauaucugcccgcgauaguacgugaagcuaucaaacgaaagcuccguacacuaaucuuagcgcccacccgggucguugccucagaaauggcugaggcccugaaagggaugccgauuagauaccagacaacagcaguaaaaucagaacacacagggcgcgagaucguagacuuaaugugccacgccacuuuuaccaugagacuacugagcccggugcgcguuccaaauuacaacaugauuaucauggacgaagcccauuuuacugacccagcaagcauagccgcaagaggauacaucagcacuagaguggggaugggggaagcggcggccaucuucaugacagcaacgccacccggcagcgucgaagcauuuccgcaaagcaacgccguaauucaagacgaggaaagagacauuccggagcggucuuggaacagcgguuacgacuggauaaccgacuuccccgggaaaacggucugguucgugcccuccauaaagucagguaacgacauagcaaauugccuaaggaagaauggaaaaagagucauacaauuaucuagaaagaccuucgauacagaauaucagaagaccaaaaacaaugauugggauuacgucguaacgacugacauaucagaaaugggcgcgaacuuccgggcagaccgcguaauagauccaagaaggugccugaagcccguaauacucaaggacgggccggaacgggucauacuagccgggccgaugccggugaccguagcguccgcggcacagaggcgaggccgaaucgggcgaaaccaaaacaaagaaggugaccaauacgucuacauggggcaaccgcucaacaacgacgaagaccaugcccauuggacggaagcgaagaugcugcuagacaauauaaacacgcccgaagggaucauaccagccuuauucgagcccgaacgagagaaaagcgcagcaaucgacggcgaauaucggcucaggggagaagcgcgaaaaaccuucguagaacuaaugcggcgcggcgaucugccaguauggcucagcuacaaagucgcaucggaggguauacaauacagugaccggcguuggugcuucgacggagaacguaauaaccagguauuagaagaaaacauggacgucgaaauauggacaaaagagggggagaggaagaaacuccggccgcgauggcuggaugcacguacauacagcgacccacucgcgcugagggaguuuaaagaguucgccgcagggcggcgaucagugucaggcgaucuaauccucgagaucggaaaacugccacagcaccucacgcucagggcgcaaaaugcacuagauaaucuaguaaugcuacauaacucugaacaagggggcaaagcauaccggcacgcgauggaagaauugccggacaccauugaaacccuuaugcuccuugcuuuaaucgcuguucuaacgggagggguaacccuauuuuucuugagcggcaagggccuggguaagacaaguauaggacuguuaugcguaacggcguccagugcccuccucuggauggcgucagucgagcugcacuggauugccgcgagcauaauccucgaguucuuucuuaugguccuuuugaucccagaacccgacaggcaaaggaccccacaagauaaccaacucgcguacguggugauaggcuuacuguucaugauacugacgguugccgcaaacgaaauggggcuucuagaaaccaccaagaaagaucucggcauaggacaugucgccgccgaaaaccaccaacaugcgacgauguuagacguggauuugcguccggcgagcgcauggacccuuuacgcagucgccacaaccguuauuacccccaugaugcgccacaccaucgagaacacuacggcaaacaucucacuuacagcaaucgcuaaccaggccgcuauacugaugggccuggauaaaggcuggccaauaaguaaaauggauaucggaguaccguuacucgcacuaggguguuacucacaagucaauccguuaacgcucaccgcagccguacuuauguuagucgcacauuacgccauaaucggccccgggcuucaagcaaaagcaaccagagaagcccaaaagaggacggcugcuggaauaaugaaaaaccccacaguagacggaauagucgccauagaucuggauccggucguguacgacgcaaaauuugaaaaacaacuagggcagauaaugcuccucauacucugcacgucacaaauauugcucaugaggacaacaugggcucuaugcgaaagcauaacccucgccaccggaccgcugacgacccuaugggaaggcucuccaggaaaauuuuggaacacaacgauagcuguaagcauggcaaacauauucagggggucauaccuagccggggcgggauuagcauucagccucaugaagucacuaggcggagggcgacgggggacaggcgcccaaggggaaacgcucggcgagaaguggaagagacagcucaaccaacugaguaagagugaguucaacauauacaagcggucaggcauaauggaaguagaucgcuccgaagccaaagagggccucaaacgaggagaaaccacgaaacacgccgucucgcgugguacagcuaaacuccgcugguucguagagagaaauuuagucaaaccggaaggaaaagucauagaccuagguugcggcagaggcggauggagcuacuacugcgccgggcuuaagaagguaacagagguuaaaggguacacuaaagggggcccaggacacgaagaacccaucccgauggcgaccuacggcuggaaucugguuaaacuccauagcgggaaggaugucuucuuuaugcccccagaaaaaugcgacacacuccuaugcgauaucggggaguccagucccaacccaacgaucgaagaaggaaggacauuaagagugcuaaaaauggucgaaccuuggcugcgaggcaaccaauuuugcaucaaaauacuaaauccguauaugcccagcgucguggagacgcucgaacaaaugcaacgaaaacaugggggcaugcugguacguaauccacuaagccgcaacagcacacacgaaauguauugggucucgugcgguaccgguaauauaguuucggcaguaaauaugacuucaaggauguuauuaaaucgauuuacgauggcccauagaaaaccaacguacgaacgcgacgucgaccuaggagcagggacgaggcauguagccguggaaccggagguagccaaccucgacaucauuggacagagaaucgagaauaucaaaaacgaacacaagagcacauggcacuaugacgaggacaacccauacaagacaugggcguaccauggaagcuacgaaguaaaacccagcgggagcgccucgucaauggugaacggaguagugagacuccuuacaaagccgugggacguaaucccuaugguaacacaaaucgcaaugaccgacacuacgccguucggacagcagcgaguguucaaagagaaggucgauacccggaccccacgagcuaaaagagggacgacacaaauaauggagguaacugccaagugguuaugggguuuccugagccggaacaaaaagccaaggaucugcaccagagaggaguucacccgcaagguccguucaaacgcagcaaucggagcgguauucgucgacgaaaaucaauggaacagcgcaaaagaagcggucgaggacgaacgcuucugggaccuaguacacagagaacgagagcuacauaaacagggcaaaugcgcuacaugcguauacaauaugaugggaaaacgggaaaagaagcugggcgaauuuggcaaggcuaaagguucaagggcaauaugguauauguggcugggagcgcgcuuucuggaguuugaggcacuaggauucaugaaugaagaucacugguucucgcgcgagaacagccuuagcggcguagagggagagggccuccacaagcugggcuauauacuaagagauauaaguaagaucccgggaggaaacauguacgcugacgacacggcgggcugggacacuaggaucaccgaggacgacuuacagaacgaagcgaaaauuaccgacauaauggaaccugaacaugcguugcuagccaccucgaucuuuaaauuaacguaucagaacaaagugguuaggguccagcgcccagcgaaaaacgggacagugauggauguaauaagccgacgggaucagcgaggcuccggccaaguaggaaccuacggccuaaacacuuucaccaauauggaagugcagcugauacgacagauggaaagugaaggcaucuuccugccuuccgaacuggagacuccaaaucuagccgagcguguccuagacuggcucgagaagcacggcgccgagagacuuaagaggauggcgauaucaggggacgauugcgucguaaaaccaauagaugaccgauucgcaaccgcucuaacggcacuaaacgacauggguaaagucagaaaagacauaccacagugggagccaagcaaaggcuggaacgacuggcaacaaguacccuucugcucucaccacuuccaucaacucaucaugaaagacggacgcgaaaucgugguuccaugucgcaaccaagaugagcuaguaggucgcgccagagugucacaaggggccgggugguccuuaagggaaacagccugccucgggaaaagcuacgcucagauguggcaauuaauguacuuccacaggcgugaccucagacuggcggccaacgcgaucuguagcgcggugccaguggacuggguaccgacauccagaacaaccuggagcauacaugcccaccaccaauggaugaccaccgaagacaugcuuagcguguggaauagaguauggauugaggagaacccuuggauggaggacaagacacauguaagcagcugggaggaaguacccuaucuggggaagagagaggaccaauggugcggaagucucauaggacuaacugcccgagcuacuugggcgacaaauauacaagucgcaauaaaucagguaagaagacucauugggaacgagaauuaccuagacuacaugacuuccaugaaacgguucaaaaacgaaucagaucccgagggggcacucugguaa

SEQ ID NO: 23923 - RNA, 9879 nt, Artificial Sequence
  derived and/or modified CDS sequence (opt11) from DENV-1__KJ189343__SS-prME
agcgugaccaugcucuuaauguugcuccccaccgcccuggccuuucacuuaacgacccgggguggggaaccccacaugaucgugaguaagcaggagcggggcaagagcuuacucuuuaagacuagcgcgggggucaacaugugcacacugaucgcaauggaccugggggaguuaugcgaggacacgaugaccuacaaguguccccagaucaccgaagccgagcccgacgacguggacugcuggugcaacgccacugacacgugggucaccuauggaaccugcagccagacgggcgagcaccgccgggauaagcgcaguguggcccuggcgccccacgugggccuggggcucgagacacggaccgagaccuggaugagcucugagggggcguggaaacagauacagagggucgagaccugggcucugcggcaccccggguuuacugugacugccuuauuccucgcgcacgcgaucggcaccagcauuacccagaaagggaucaucuucauccuguugauguuggugacgcccuccauggcaaugaggugcgucggcaucggcaaccgggauuucguggaggggcugagcggcgcaacuuggguagaugucguccuggagcacgggagcugcgugaccaccauggcuaagaacaagcccacgcuggauaucgagcugcugaaaaccgaggucaccaaccccgcgauccuccgaaaacuuugcaucgaagcuaagaucagcaacaccacgaccgacucccggugccccacccaaggggaggccaccuuagucgaagaacaagacgccaacuucgucugcaggcggacguucgucgaccguggcugggggaacggcuguggccucuucggcaaagggagccuccugaccugcgccaaguucaagugcgugaccaaacucgagggcaagaucguucaguaugaaaaccuaaaauacagcgugauaguaaccgugcacacaggcgaccaacaccaggucgggaacgagaccaccgagcacgggaccaucgcgaccaucacuccccaggcccccaccagcgagauacagcugacggacuacggggcccucacgcuggacugcucgccccggacaggccuggacuucaacgagaugguccuccugaccaugaaagagaaguccuggcugguccacaagcagugguucuuggauuuaccgcugcccuggaccuccggagccagcacuagccaagagacguggaacagacaggacuuacuuguuaccuucaaaacugcccaugcgaaaaagcaggagguggucgugcugggaagccaggagggggccaugcacacggcacucacgggggccaccgagauacagaccuccggcacaacaacgaucuucgccgggcaccugaagugccggcugaagauggauaagcucacccugaagggcaccuccuacgugauguguacgggcagcuucaagcuggagaaggaggucgcagagacccagcacggcaccgugcuuguacaggucaaguaugagggcaccgacgcccccugcaaaauucccuucucaacgcaagacgagaagggagucacacagaacggccgccucaucacagccaacccgaucgucacugacaaggagaagcccgucaacauugagacggagccgcccuucggggagagcuacaucgucgugggcgcuggcgaaaaggcccugaagcuguccugguucaagaaggggagcagcaucggcaagauguucgaggccaccgcccguggggcccgcagaauggccauccucggcgacaccgcgugggauuucgggagcauugggggugucuuuaccuccgugggcaagcugguucaccaggucuucggcacggccuacggggugcuguucagcggaguguccuggacaaugaagaucgggaucggcaucuuacugacguggcugggacuaaacagcagguccaccagccugucgaugacgugcauugcugucgggauggugacccuguaccucggcgugauggugcaggccgauucagggugcgucgugaauuggaaagggcgcgagcugaagugcggguccggcauuuucgucaccaaugaagugcacaccuggaccgagcaguacaaguuccaagccgacagcccgaaacggcugucggcggccaucggcaaggcgugggaggagggagugugcggcauccgcagugcuacucgacucgaaaauaucauguggaagcaaaucagcaaugaacugaaucacauucuguuggagaacgauaugaaguucaccgucguggugggggacgccaacggcauccuggcgcaggggaagaagaugauccgcccccagccaauggagcacaaguacagcuggaaguccuggggcaaggccaagauuaucggcgcugacauccagaacaccaccuucaucaucgacgggcccgacacgccggaaugccccgacaaucagcgggccuggaacaucugggagguggaggauuauggcuucgggauauucacuacaaauaucuggcugaagcuccgcgacuccuacacccagaugugugaccaccggcugaugucugcggccauaaaggacuccaaagccgugcacgcggacaugggcuacuggaucgagucggaaaagaacgagacguggaaacuggcccgcgcguccuucauagaaguaaagaccuguaccuggccaaagucacacacgcucugguccaacggcgugcuggagagcgagaugaucauccccaagaucuacggagggccuaucucgcaacacaacuaccggcccggguacuucacacagaccgccgggcccuggcaccugggcaaguuagaacuggacuucgauuugugcgaaggcaccacggucguggucgacgagcacuguggcaaccgcgggcccagccugcgaacgaccacuguuacggggaagaucauccacgaguggugcugccgcuccugcacgcugccuccccuccgguuccgcggggaggauggcugcugguacggcauggagauccggcccgugaaggagaaagaggagaaccucguccgcucaaugguguccgccggcagcggcgagguagacuccuucucccuggggauccugugugccagcaucaugauugaagaagucaugcggucaagauggaguagaaagaugcucaugauaggcacccuggcaguguuccuacuccugaucauggggcagcugaccuggaaugaccucauccgcuugugcaucauggugggagcuaacgccuccgaccgaauggggauggguaccacguaccuggcacucauggcgaccuuuaaaaugcggccgauguucgccgucggccuacucuuccgucggcucaccagucgcgaggugcugcuuuuaacgauagguuuaucccugguggcguccgucgaguuacccaacuccuuagaggagcuaggcgacgggcuggccauggggauaaugaugcuaaaacugcuaacggaguuccaaccccaucagcuguggaccacccugcucagucugaccuucaucaagacgacccugucccucgauuaugcauggaagacuaccgccauggcguuaucuauagugucccucuuccccuuaugcuuaagcacgacuucccagaaaaccaccuggcugcccguauuacuugggagcuuugggugcaagccgcugacgauguuccucaucacggaaaacaagaucugggggcggaaguccuggccacugaacgaggggaucauggccaucggaauugucaguauccugcucuccuccuugcugaagaaugacgucccucucgccgggccgcugauagccggcgguaugcugauugcaugcuacgucaucagcggguccagcgcggaucucuccuuggagaagaccgccgaggugagcugggagcaagaggccgagcacuccggcaccagccacaauauccuaguggagguccaggaugacgggaccaugaagaucaaggaugaggaacgugacgacacgcucaccauccugcugaaagccacccugcuggccgucuccggcgucuaccccaugagcaucccggcgacccuguucgucugguacuuuuggcagaagaagaagcagcggagcgggguauuaugggacacgcccagcccgcccgagguggagcgcgccguacuggaugacggcauuuaccguauacugcagcgcggucuucuugggcggagccaagugggcgugggggucuuccaggauggcguguuccacaccauguggcacgugacuagaggagccguccuuauguaccagggcaagcggcuggagcccuccugggccuccgugaaaaaggaucucaucagcuacggcggaggguggcgcuuccagggguccuggaacaccggagaggaggugcagguuaucgcaguggagcccgggaaaaacccgaaaaacgugcagacgacccccggcaccuucaagaccccagagggcgaggucggggcgaucgcucuggauuuuaagcccggcacguccgggagcccaaucguaaaccgggagggcaaaauagugggccuguacgggaacggcgucgugaccaccucggggaccuacgucuccgccauugcacaggccaaggcaucacaggagggccccuugccugagaucgaggacgagguuuucaagaaacgcaaccugacgaucauggaccugcacccggggagcggcaagacccggcgcuaccuaccagccauagugcgggaagccaucaaacgcaagcugcggacccugaucuuggcgcccacgagagugguugcguccgagauggcagaggcgcugaagggcaugccuauccgcuaucaaacgaccgccgucaagagcgagcacaccgggcgggagauuguugaccugaugugccacgcaaccuucacgaugagacuccugucgccgguccgggucccuaacuacaacaugauuaucauggacgaggcgcauuucacggaccccgccucuaucgccgcccgcggcuacaucuccacccggguggggaugggcgaggccgcggcuaucuucaugacggccacacccccagggagcgucgaggccuucccacaguccaacgccguuauccaggacgaggagcgcgacauccccgagcggagcuggaauagcggguacgacuggaucaccgacuucccugggaagacagugugguucguccccucgaucaagaguggaaaugacaucgcgaacugcuuacgcaaaaauggcaagcgggugauccagcucucacgcaagaccuucgacacggaguaccagaagaccaagaacaacgauugggauuauguggucaccacugacaucucggagaugggugccaacuuucgggcagauagggugaucgacccccggcgcugccugaagcccgugaucuuaaaggacgguccugaacgggucauccucgccgggccuaugccagucacgguggcgucugccgcccagcgcaggggccgcauaggacggaaucagaauaaggaaggggaccaguacgucuauaugggucagccccugaauaacgaugaggaucacgcccacuggacggaagccaaaauguuacuggacaacaucaacacccccgaggggaucaucccggcgcuguucgagccagagcgcgagaaguccgccgccauagacggggaauaccgccuccgcggggaggcacgcaagaccuucguggaguugaugcggcgcggggaccugccggucuggcugagcuacaaaguggccuccgagggcuuccaauacagugaccggcgcuggugcuucgauggggaacgcaacaaccaggugcucgaggagaacauggacguggaaaucuggacaaaggaaggcgagcgcaagaagcugcggccucgcuggcuggaugcacggaccuacuccgacccgcucgcccugcgcgaguucaaagaguuugccgccgggcggagaagcgugaguggcgaucuaauccucgagauuggcaagcugccccagcaccugacccuucgggcccagaacgcucuggacaaccuggccaugcuccauaacagugagcagggcgggaaggccuaccgccacgccauggaggagcugcccgacacaauagagacccuuaugcuccuugcgcugaucgcagugcucacaggcggggucacccuguucuucuugagcgggaaggggcucggcaagaccuccauagggcugcucugugugacagccagcagcgcccuccucuggauggccagcgucgagccccacuggaucgcggcuuccauuaucuuggaguucuuccugaugguccugcugaucccggagccugaccggcaacgcaccccacaggacaaccagcucgcauacguggugaucggacugcuguucaugauccuaacgguugcugccaacgagaugggacugcuggaaacaacuaagaaagaccucggcauaggucacguggcggcugagaaccaucagcacgccacgaugcuggauguggaucuacggccggccagcgccuggacacuguacgcagucgccaccacugugauuacgcccaugaugcgccacacaaucgagaacaccaccgccaacaucaguuuaacggcuaucgcaaaccaggccgccaucuuaaugggccucgacaagggauggcccauuagcaaaauggacaucggggucccccuucuggccuuaggcugcuacucccaggugaacccgcugacccugacugccgcgguguugauguugguggcgcacuacgccauuauugggcccggauugcaagccaaggccacccgugaggcgcaaaagcgcacggcggccgggaucaugaagaaccccaccgucgauggcaucguggcuauagaucucgaccccguggucuacgacgcuaaguucgaaaagcagcuggggcagauaaugcugcuaaucuuaugcaccagccagaucuugcucaugcgcaccaccugggcacugugcgagagcaucacccuugccaccgggccgcucaccacucugugggagggcagccccgggaaguucuggaacaccaccaucgccguuuccauggcgaauaucuucaggggcucuuaccuggccggcgcggggcucgcguucucuuugaugaagucacuuggcgguggccgcagagggaccggggcccagggcgagacgcuaggggaaaaguggaagcgccagcugaaccaacugucgaaaagcgaguucaacaccuauaagagaucggggaucauggaaguagaccgcuccgaggccaaggaggggcucaagcggggcgagacuaccaaacacgcggucagcagagggaccgccaaacuaagaugguucguggagcgcaaccuggugaaacccgaaggcaaggucaucgacuugggcugcgggaggggcggcugguccuauuacugcgccggccucaagaagguaacggaagucaagggguacaccaagggcggccccggccacgaggagccgauacccauggccacuuacggcuggaaucuggucaagcugcauagcgggaaggacguguuuuucaugccaccugagaagugcgacacccuccugugcgauauaggcgaguccagcccgaaccccacgauagaggaggggcgcacgcugcggguacuuaaaauggucgaaccauggcugcgcgggaaccaguucugcaucaagauauuaaaccccuacaugcccagcguuguagagacccucgagcagaugcagcggaaacacggcgggaugcugguucgcaacccccuaagccggaacucaacacacgaaauguauuggguaucuugcggcacaggaaacaucgucuccgccgucaacaugacgucucgcaugcucuuaaaucgauucaccauggcccaccgcaaacccaccuuugagagggacguggaccuuggcgccggcacgcggcacgucgccgucgagcccgagguggccaaccucgacaucaucgggcaaagaaucgagaacauaaagaacgagcauaagucuacguggcacuaugaugaggacaauccguacaaaaccugggccuaccacggcucauacgaggugaagccuuccggaagcgcauccagcauggucaacggcguggugcggcugcugaccaagcccugggaugucaucccuauggugacacaaauugccaugaccgacacuacccccuucgggcagcagagagucuucaaagaaaagguagauacgagaacaccccgcgcgaagagggggacaacccagaucauggaagugacugccaaauggcucuggggcuuccugucucggaacaagaagccccggaucugcacccgcgaggaguucacccggaaaguccgcucaaacgccgccaucggcgcgguguuugucgacgagaaccaauggaacagcgccaaagaggcugucgaggacgagagauuuugggacuuggugcaccgcgagcgggagcuccacaagcagggcaagugcgcgaccugcguguauaauaugauggggaagagggaaaagaagcugggagaguucgggaaggccaagggcucccgggccaucugguacauguggcugggugcccgcuuccucgaguucgaggcccugggguuuaugaacgaggaccacugguuuagucgugagaacucccugagcggcguggagggggaaggucuccacaagcugggguauauccugcgcgauaucuccaagauuccgggcggaaacauguacgccgacgacacggccgguugggacacccggaucaccgaggacgaccuccagaacgaggccaagaucacggauaucauggagcccgagcacgcccugcuggccacgagcauuuucaaguuaaccuaucagaacaaggucguccgcguccagcgccccgcuaagaacggcaccgugauggaugugaucucccggcgcgaucagcgaggcagcggccaggucggcaccuacggacugaacacguucaccaacauggaggugcaacugauccgccagauggaguccgaaggaaucuuccuuccaucugagcuggagaccccgaaccuggccgaacgggugcucgacuggcuggaaaagcacggggccgagaggcugaagcguauggccaucuccggcgaugacugcguggucaagcccaucgacgaccgcuucgccaccgcgcucaccgccuuaaacgauauggggaaggugcggaaggacaucccacagugggagccaagcaagggcuggaacgacuggcagcaggucccguucugcucgcaccacuuccaccagcuaauuaugaaggacggccgggaaauuguggugcccuguagaaaucaggaugaacuugucgggcgcgcccgagugagccagggagcgggguggagucugcgcgagaccgccugccuggguaagagcuacgcgcaaauguggcagcucauguauuuccaccggagagaccugcgacuggccgccaacgccaucugcucggcggugcccguugacugggugcccacaagcaggacaaccuggaguauucacgcccaccaccaauggaugacaaccgaggauaugcucucuguguggaaucgggucuggaucgaggagaaccccuggauggaggacaagacccacgugagcaguugggaggaaguucccuaccuggggaagcgcgaggaccaguggugcggcagccugaucggcuuaacggcgcgcgccaccugggcgacuaauauccaggucgcgaucaaccaggugcgacgccugaucgggaaugagaacuaccuggacuacaugaccagcaugaagcgguucaagaacgaaagugaucccgagggugcccucugguga

SEQ ID NO: 23924 - RNA, 9879 nt, Artificial Sequence
  derived and/or modified CDS sequence (opt11) from DENV-1__KJ189344__SS-prME
agcgugacgaugcugcucaugcugcugcccaccgcccucgccuuucaccugacuacccggggcggggaaccccacaugaucgugagcaagcaagaacgcggcaagagccuccuguucaagacgagcgcggggguaaacaugugcaccuuaauagcuauggaccugggcgaacucugcgaggacacaaugacguacaagugcccccagaucacggaggccgaaccggacgacguugacugcuggugcaaugccaccgacaccuggguaacuuaugggacuugcagccagacaggcgagcaccggcgggacaaacgcucgguggcccuggccccgcacguggggcugggguuagagacgagaaccgaaaccuggaugagcuccgagggcgcauggaagcagauucaacgugucgagaccugggcccuacggcaucccggcuucacggugaccgcccuguucuuagcgcacgcuaucggcacgagcaucacccagaagggcaucaucuuuauccuucugaugcucgugacgcccucuauggcuaugcgcugcgucgggauaggcaaccgcgacuucguggaggggcugagcggcgcaacauggguggacgucgugcuggagcacggguccugugugaccaccauggccaagaacaagcccacucucgacaucgagcuuuuaaagaccgaggucaccaauccggcgauacugcgcaagcuguguaucgaggccaagaucagcaacaccacgaccgacagucggugcccaacccagggcgaggccacgcugguggaggagcaggacgcgaauuucgugugucgccggacguucgucgaccgcggcugggggaacggaugcggucucuuuggcaaagggagccugcugaccugcgccaaguuuaaaugcgugaccaaacucgagggcaagaucgugcaguacgagaaccugaaguacuccgucaucgugaccgugcacacaggcgaccagcaccaggucgggaacgagaccaccgagcacggcaccaucgccacgaucacaccccaggcucccaccagcgagauccagcugaccgacuacggggcccucacucuggacugcagcccccggacuggccuggacuuuaacgaaaugguauugcugaccaugaaggagaaauccuggcuggugcacaagcagugguuccucgaccugccucugcccuggaccuccggggccagcaccagccaggagacguggaaccggcaggaccuccuggugacuuuuaagaccgcgcacgcgaaaaagcaggagguggucgugcugggcucccaggagggggcaaugcacaccgccuuaacgggugccaccgagauccaaaccuccgguaccacgacuauuuuugccgggcaccugaagugccggcugaagauggacaagcucacccugaaagguaccuccuacgugaugugcacggggagcuucaaguuggagaaggaggucgcagagacccagcacggaaccguacuggugcaggucaaauacgagggcacggacgcccccuguaaaauccccuuuuccacgcaggacgagaagggggugacccagaacggccgccucaucaccgcaaacccgaucgugaccgauaaggagaagccagucaauaucgagacagaaccgcccuucggggagagcuacauuguugugggcgcgggcgagaaggcccugaagcugucuugguucaagaaagggagcuccaucggcaagauguuugaggccaccgcccgcggggcccgccggauggccauccucggcgacaccgcuugggacuucgguagcaucggaggcgucuucaccuccgugggcaaauuggugcaucaggucuucggcacggccuacgggguacuguucucugggguguccuggaccaugaagaucgggauaggcauauuacugaccuggcugggccucaacucgcgguccacgagccugagcaugacgugcaucgccgucggaauggugacucuguaccuaggcguaaugguccaggcagacaguggcugugugguuaacuggaaaggccgcgagcugaagugcggguccggcauauucguaaccaacgaggugcacaccuggaccgagcaguacaaguuccaggccgauagcccgaagcggcucagugcggccaucggcaaggccugggaggagggggugugcggcauucgcuccgcgacgcgacucgaaaauauaauguggaagcagaucagcaacgagcugaaccacauucugcuagagaacgauaugaaguuuaccgucgugguuggggacgccaauggcaucuuagcgcaggggaagaagaugauccgcccgcaaccaauggagcacaaguacuccuggaaguccuggggcaaggccaaaauuaucggcgccgacauccagaacaccacauucaucaucgacgggcccgauacgccggagugccccgacaaucagcgugcauggaacaucugggaggucgaagacuacggguucgggaucuucaccaccaauaucugguuaaagcuccgagacuccuacacccagaugugcgaucaccggcugaugagcgcggccaucaaggacucuaaggccguccacgccgacauggguuacuggaucgagagcgaaaagaaugagacguggaagcucgcccgagcguccuucaucgaagugaagaccugcaccuggccuaagagccacacccucugguccaacggcguccuggaauccgagaugaucauccccaagauauacggcggcccgauaucccaacacaacuaccggcccggguacuucacgcagaccgccggaccauggcaccuggggaagcucgaauuggacuucgaccugugcgagggcacuaccgugguggucgaugagcauugcggcaaccgcgguccaucgcuccggacuaccaccgugacaggcaagauuauccacgaaugguguugccgcuccugcacgcugccgccucugcgguuccgcggagaagacggcugcugguacgggauggagaucaggcccguaaaggaaaaagaggagaacuuggugcgcagcaugguguccgcuggcucuggcgagguggauagcuucagccuggggauccugugcguuucgaucaugauugaggaggugaugcgcucccgcuggagccggaagaugcucaugaccggcacgcuggccguguuccuucuucuuguaauggggcagcugacauggaacgaccucauacgucugugcaucaugguuggugcuaacgcguccgaccggauggggaugggcacgacguaccuggcccucauggccaccuucaagaugcgcccgauguucgccgugggccugcuguuccgccgguuaaccucacgugagguacugcuguuaacgauugggcuuuccuugguggcuuccgucgagcugccaaacuccuuagaggagcugggcgacggucucgcgaugggcaucaugaugcugaagcugcucacugaguuccagccccaccagcuguggaccacucugcuaagccugacguucauaaagacuacguugucccucgacuacgcuuggaagacgacugcgauggcgcuguccaucgugucccuguucccccucugccugucaaccaccucccagaagaccaccuggcugccggugcuacugggcagcuuugggugcaagccccugacgauguuccucaucaccgagaacaagaucuggggccggaaguccuggccccugaacgaggggaucauggcgaucggcauuguaagcauucugcucuccagucuauugaagaacgaugugccccucgccgggccgcugaucgccggcggcaugcugaucgccugcuacgugaucagcggcuccagcgccgaucucucccuggaaaaggcggccgagguuagcugggaacaggaggcugaacacuccggcaccagccacaacauccugguggaggugcaggacgacgggaccaugaagaucaaggacgaggaacgcgacgacacgcucacaauccugcugaaggccacccucuuggcggucuccggcguguaccccaugagcaucccggcgacucuguucgugugguacuucuggcaaaagaaaaagcagagaucggggguccucugggacacgcccagcccgcccgaagucgagcgcgccguucuggaugacggcaucuaccggauccugcaacgcggccugcuagggcggucccaaguagguguggggguguuccaggacggggucuuccacacgauguggcacgugacacgcggggccgugcugauguaccagggcaagcgguuggagccaagcugggccuccgucaaaaaggaucucaucagcuacggcgggggcuggcgcuuccaggguuccuggaacacaggcgaggagguccaggugauagccguugagcccgggaaaaacccgaagaacgugcagacgacccccggcaccuucaaaacccccgagggcgaggugggggcgaucgcccuggacuucaagcccggcacgucgggcaguccgaucgucaaccgggaggggaaaaucgugggccuguacgggaacgguguggucaccacuagcgggaccuacguguccgccaucgcccaggccaaggcgucgcaagagggcccccuccccgagaucgaggacgaaguguucaagaagcgcaacuugacaauuauggaccugcacccgggguccggaaagacccggcgcuaccuccccgccauaguccgcgaggccaucaagcgcaaguugcggacauugauccucgcccccacccgcguaguggcgagcgagauggccgaggcccugaagggcaugccgauucgguaccagacgaccgcagucaagagcgagcacaccgggcgggaaaucguagauuugaugugccacgcuacuuucacgaugcgacuccuguccccggugcggguccccaacuacaauaugauaauaauggacgaggcgcacuucaccgaccccgcaagcaucgccgcccgcggcuauaucucgacccggguggggaugggcgaggccgcggccaucuuuaugaccgcuacgccuccggggagcguggaagcguuuccccaguccaacgccgugauccaggacgaggaacgcgacauccccgaacggagcuggaacuccggcuacgacuggauaacggacuuccccgguaagaccguuugguucguuccgagcaucaaguccgggaacgacaucgcgaacugccugcgcaagaacggcaagagagucauccaacucagccggaaaacguucgacacugaguaucagaagaccaagaacaacgacugggacuacgugguuaccaccgacaucuccgagaugggggcgaacuucagagccgaccgcgucaucgacccacggcgcugccugaagcccgugauccucaaggacgggccggagcgggugauccucgccgggccuaugccugucaccguggcuagugccgcgcagagacggggccgcaucgggcggaaccagaauaaggagggggaccaguacgucuacaugggccagccccugaacaacgacgaggaccacgcccauuggaccgaggccaagaugcuccucgacaacaucaauacccccgaagggaucaucccagcacuguucgaacccgagcgcgagaaguccgccgccaucgauggcgaguaucgucugcgcggggaggcccgaaaaaccuucguggagcucaugcgccgcggcgaccuacccguguggcugagcuacaaggucgccucggagggcuuccaguauagcgaccgccgcuggugcuucgacggggagcggaacaaccaggugcucgaggaaaacauggauguggagauuuggaccaaggagggcgagcgcaagaaacuucggccaagguggcuagacgcgcggacguacuccgacccgcucgcucugagagaguuuaaagaguucgcugccgggcgccggucugucagcggcgaccucauacucgagaucggcaagcugccucagcaccuuacucuucgggcccaaaacgcgcuggauaaccucguaaugcuccacaacuccgaacaaggcgggaaggccuaccgccacgccauggaggagcugcccgacaccaucgagacccugaugcuccuggcucugaucgcgguguugaccggcgggguaacccuguucuuccugagcggaaaggguuuagggaagaccucaaucggccuacuguguguuaccgccucuuccgcccuccuguggauggcaagcguggagccccacuggaucgccgcgaguauaauccuggaguucuuccucaugguccugcugaucccggagccggaccgucagcgcacgccccaagacaaucagcucgccuacguugugaucggucuacucuucaugauccucaccgucgccgcuaacgagaugggguuacuggagaccaccaagaaggaccucggcaucgggcacguggccgcggagaaccaccagcacgccaccaugcuggauguagacuugcggccggccagcgcuuggacccucuacgcagucgcgaccaccgugauaacgcccaugaugcgccauacaaucgagaacaccaccgccaacaucucccugacggcgaucgccaaccaggccgcgaucuugaugggccucgacaaaggguggcccaucucaaagauggacaucggggugccccugcuggcccucgguugcuacucccaagucaacccacugacccuuacagcggccguucucaugcugguggcccacuacgccaucaucggcccaggucugcaggccaaggccacccgggaggcccagaagcgcacggcggcagggauaaugaagaaccccacugucgacggcaucguggcuauagauuuggaccccguggucuacgacgcaaaguucgagaagcagcugggccagaucaugcugcucauccugugcaccagccagauccugcucaugcgcacaacgugggcccuuugugaauccaucacgcuggcuaccgggccgcugaccacguugugggagggcagccccggcaaguucuggaacaccacaaucgccguguccauggccaacaucuucagaggcucauaccuggccggcgccgggcucgcguuuagccuaaugaagucccugggaggagggcgccgggggaccggcgcccagggcgagacgcucggggagaaguggaagcgccagcuuaaucagcugaguaagucugaguucaacaccuauaagcggucaggcaucauggagguggacagguccgaggccaaggagggccucaagcggggcgagacuaccaagcacgcggucagcaggggaaccgccaaacuacggugguucguggagcguaaccuggugaaacccgaggggaaggucaucgaucugggcugcgggcggggcgguuggaguuacuacugcgccggccucaaaaagguaacggaggugaagggauacaccaagggcggccccgggcacgaggagccgauacccauggccaccuacggcuggaaccuggucaaguuacacagcgggaaggacguguucuucaugccgcccgagaagugugacacccuccugugcgacaucggcgaguccagcccgaaccccacgaucgaggagggccgaacccugcgaguacucaagauggucgagccauggcuccgcggcaaccaauucugcaucaagauccugaaccccuacaugccguccgugguugaggcccucgagcaaaugcagcggaagcacggagggaugcuggugcgcaacccccugagucggaacagcacccacgagauguacuggguuagcuguggcaccgguaacaucgucucggccgugaacaugacaagccgcaugcuacuaaauagguuuacuauggcgcaccgcaagcccaccuacgagcgcgacguggauuugggcgcgggcacccggcacguagccguagaacccgagguggccaacuuggacaucaucgggcagcgcauagagaacaucaagaacgaacacaagucgacguggcacuaugacgaggacaaccccuauaagaccugggccuaccacgggagcuacgaggugaaacccuccgggagcgcguccagcauggucaacggcgugguccggcugcugaccaaacccugggacguuauacccaugguuacccagaucgcaaugacggacaccaccccguucgggcagcagcgcgucuucaaggagaagguggacacccggacgccacgcgccaagcgggguaccacacagaucauggaggucacagccaaguggcucuggggcuuccucucccgcaacaagaagccucggauauguacacgcgaggaguucacccggaagguccgcagcaacgccgcgaucggggccguguucguggacgagaaccaguggaacagcgcgaaagaggccgucgaggacgagagauucugggaucuggugcaccgcgagcgggagcuccacaagcaggguaagugcgcgaccugcgucuacaacaugauggggaagcgcgagaagaagcugggcgaguucgggaaggccaaggggucccgggccauaugguacauguggcugggcgcccgcuucuuagaguucgaggcccugggguuuaugaacgaggaccacugguucagccgggagaacucccugagcggcguugagggggagggccuucacaagcugggguacauccuacgcgacaucuccaagaucccgggcggcaacauguacgcggacgacaccgccggcugggacacacggaucaccgaggacgaccuccagaaugaggccaagauaaccgagaucauggagcccgagcaugcccugcuggcgaccucuauauucaagcugacguaccagaacaagguggugcgcguccagcgucccgcuaagaacgguacggugauggacguuaucucccgacgcgaccagcgggggagcggccaggucggcaccuacgggcugaacaccuucacaaacauggaggugcagcuuauccggcagauggaguccgagggcaucuuccuccccagcgagcuggagaccccgaaccuagccgagcggguccuugacuggcuugagaagcacggggccgagcgccugaagcggauggcgaucuccggcgacgacugcgucguuaagcccaucgacgaccgcuucgcuaccgcgcucacggcccugaacgacaugggcaaggugcggaaggacaucccacagugggaacccagcaagggcuggaacgacuggcagcaggucccguucugcucccaccacuuccaucagcugaucaugaaagacggcagggagaucguggugcccugucggaaccaggacgagcucgucgggcgcgcccgggugagccagggcgccggguggucccugcgcgagacagccugccuggguaagagcuacgcccaaauguggcagcucauguacuuccaccgacgggaccuucggcuggcagccaacgcuauaugcucggcggugcccgucgauugggugccaacgagccgcaccaccuggagcauccacgcgcaccaccaguggaugaccacggaggacaugcucuccguguggaaccgggucuggauagaggaaaacccguggauggaggacaagacccacgugagcuccugggaggaggugcccuaccuggggaagagagaggaccaguggugcggcagccugaucggcuuaacggcccgcgcuaccugggccacgaacauccaggucgcgaucaaccaggugcggcgccugaucgggaacgagaauuaccuggacuacaugaccuccaugaagcgguucaagaacgagagcgaccccgagggcgcccucugguag

SEQ ID NO: 23925 - RNA, 9879 nt, Artificial Sequence
  derived and/or modified CDS sequence (opt11) from DENV-1__KJ189346__SS-prME
ucggugaccaugcuccuuaugcugcugcccaccgcccuagccuuucaccugaccaccaggggcggcgagccccacaugauugugagcaaacaagagcgcggcaagagccuccucuucaaaaccuccgccgggguaaacauguguacucugaucgcgauggaccugggcgagcucugcgaggacaccaugacauacaaguguccucagauaaccgaggccgaacccgacgacguggacuguuggugcaacgccacagacaccugggugaccuacgggaccugcagccagaccggcgagcaccgccgggacaagcgcuccguggcacuggcgccgcacgugggccuggggcucgagacgcggaccgaaaccuggaugucuagugaaggcgcuuggaaacagauccagcgcgucgagaccugggcccuacgccaucccggguucacagugaucgcccuguuucucgcgcacgcgaucgguacgagcaucacccagaaggggaucaucuucauccugcugaugcucgucacccccuccauggccaugcgcugcgucggcaucggcaacagggacuuuguagaggggcugaguggcgccacuuggguggacgucguucuagagcacggauccuguguuaccaccauggccaagaacaagccgacccucgacaucgagcugcugaagacggaggucaccaaccccgccaucuuacguaagcugugcaucgaggcgaagaucagcaacaccaccacggauagucggugcccgacccagggugaagcaacgcuggucgaggagcaggacgccaacuucgugugccgacggaccuucgucgaccgcggcugggguaacggaugcggucucuucgggaaggguagccugcugacgugcgcuaaguucaagugugugaccaaguuggagggaaaaaucguccaauacgagaaccugaaguauuccgucaucguuaccguucauacuggcgaucagcaccaagugggaaacgagacaacggagcacggcacgaucgcgaccaucacgccccaggcgccaacaagcgagauccagcugaccgauuauggggcccucacacuggacugcagcccccggaccggucucgacuucaacgagaugguucuccuaaccaugaaagaaaagucgugguuggugcacaagcagugguuucucgaccugccguugcccuggaccuccggggccagcaccagccaggaaaccuggaaccgccaggacuugcuugugacguuuaagaccgcucacgcuaaaaagcaggagguggucgugcugggcucccaggaaggcgcgaugcacacugccuuaacgggggcuacggagauccagaugagcggcaccaccacgaucuucgccggacaucugaagugccggcugaaaauggauaagcucacccugaaggggaccuccuacgucauguguaccgggagcuuuaagcuggagaaggaggucgcagaaacccagcacgguacggugcuggugcaagucaaguacgagggcacugacgccccaugcaagauccccuucaguacccaggacgagaagggggucacacagaacggccgccucaucacagccaauccaaucgugaccgacaaagaaaagcccgucaauaucgagaccgagccgcccuuuggggaaagcuacaucgucgugggggccggcgagaaggcgcugaagcucucaugguuuaagaaggguagcuccaucgguaagauguucgaggccacagcccgaggugcgcgccggauggcgauccucggcgacacagcgugggacuucgggagcaucgguggcguauucaccuccguggggaagcuugugcaccaggucuucggcacugcuuaugggguacuguucagcgggguuuccuggacuaugaagauagguaucgggauccucuuaacguggcugggcuuaaacagcaggucuacgucgcucaguaugaccugcaucgccgucggaauggugacccuguaccucggcgugaugguccaggccgacucaggcugcgugaucaacuggaagggccgcgagcuaaagugcggaagcgguaucuuugugacgaacgagguccacaccuggaccgaacaauacaaguuccaggcugacagcccgaagcgauugagcgcggccauaggcaaggccugggaggagggcgugugcggcauccgcuccgccacccggcucgaaaacaucauguggaagcagaucucuaacgagcugaaccacauccugcucgaaaaugacaugaaguucaccguggucgugggugacgccaacggcauccuggcgcaggggaagaagaugauacgcccccagcccauggagcacaaauacucuuggaagucguggggcaaggccaagaucaucggcgccgauauccagaacacuaccuucauaaucgacgggcccgacaccccugagugccccgacaaccagagggcauggaacauaugggagguugaggacuacggcuucgggaucuucacaacgaauaucuggcuaaaguugcgcgacuccuacacccagaugugcgaccaucggcugaugagugcggccaucaaggauuccaaggccguccacgccgacauggguuauuggaucgagagcgagaagaacgaaaccuggaaacuggcccgcgcuaguuucaucgaggugaagaccuguaccuggcccaagagccacacccucugguccaauggcgugauggagagcgagaugaucauccccaagaucuacgggggcccgaucagccagcacaacuacaggcccggguauuucacccagacugccggccccuggcaccuggggaagcuggaguuggauuucgacuuaugcgagggcacgaccgucgugguggaugagcacugcggcaaccgcggaccaagucugcggaccacaaccgucacgggcaagaucauacacgagugguguugccgcuccugcacccugccgccccuacgguuucgaggggaggacgggugcugguacgggauggagauccggcccguaaaggagaaggaggaaaaccucgugaggucaauggucuccgccggaagcggcgagguggacagcuuuucccucgggauccucugcgccagcauuaugauagaggaaguuaugcggucucgauggagccgcaagaugcugaugaccggcacgcucgcuguguuccugcuacucgucaugggacagcugaccuggaacgaccugaucagauugugcauuauggugggcgcgaacgccuccgaccguauggggauggggacgaccuaccuggcgcugauggcaacguucaagaugaggccgauguuugccgucgggcuccuauuucgccggcugacgagccgcgaggugcuccugcugaccaucggacucucccugguggcgagugucgagcugccuaacagucuagaagaguugggggacgggcucgccaugggaaucaugaugcucaagcuacugaccgaguuccagccccaccaacucuggacgaccuuacugagccucaccuuuaucaagaccacgcugucccuggacuacgccuggaaaacaaccgccauggcccucucgaucgugucccuauucccccugugccucagcaccacaucccagaagacuacuuggcugccgguacugcucggcuccuuugggugcaagccccugaccauguuccugaucaccgagaacaagauauggggccgcaaauccuggccccucaacgaggggauuauggccaucgggaucgugagcauacugcuguccucacucuugaagaacgacgugccccuggccgggccacucaucgcuggaggcaugcugaucgcuugcuacgucauuagcggcuccuccgcggaccugagccucgagaaggccgccgagguuagcugggagcaggaggccgagcacagcggcaccucccacaacauccugguagagguccaggaugacgggaccaugaagauaaaggacgaggagcgcgacgacacucugaccauccuccugaaggccacgcuucucgccguguccggcguguacccuaugagcauaccugcaacccuguuccugugguacuucuggcagaagaagaaacagagaucagggguacucugggacacccccucgccgcccgaaguugaaagagccguguuagaugacgguaucuaucgcaucuuacagcgcggccugcucggucgcucucaggucggaguggggguguuccaagacggcgucuuccauaccauguggcacgugacccgcggggcaguguugauguaucagggcaagcggcuagagccaagcugggccuccgucaagaaggaccuuaucagcuacggugggggcuggagauuccaaggguccuggaauaccggcgaggaagugcaagugaucgcggucgagcccgggaaaaacccuaaaaacgugcagaccacgcccggcacguucaagacccccgagggugaggugggggccaucgcucuggacuucaagcccggcaccagcggguccccgaucgugaaccgggaggggaagaucguggggcuguaugggaacggggugguuaccacgagcgggaccuacguauccgccaucgcacaggcgaaggccagccaggaggggcccuuaccagagaucgaggacgaaguguucaagaagcgaaaccugaccaucauggaccugcacccagggagcggcaagacacgucgcuaccucccagccaucguccgggaggcaaucaagcgcaagcugcggacgcugauccucgcgcccacccgcgugguugccuccgagauggccgaggcccuuaaaggaaugccaauacgcuaccagaccaccgccgucaagagcgaacacacggggcgggaaaucguggaccugaugugccacgcgacguucacgaugcgccuucugaguccgguacgaguccccaacuacaauaugaucauaauggaugaggcacacuucacagaccccgccucgauugccgcccgcggcuacaucuccacacggguggggaugggugaggccgcugcgaucuucaugaccgccacgccuccuggcagcguggaggccuuuccccaguccaacgcggucauucaggacgaggagcgcgacauccccgagcggagcuggaacuccggcuacgauuggaucaccgacuuccccggcaagacgguaugguucgugcccucaaucaaguccgggaacgacaucgccaacugccugcgcaagaaugguaagagagucauccagcucucccguaagacauuugauaccgaguaccagaagacgaagaacaacgacugggacuacguggugacgaccgauaucuccgagaugggggcgaacuuucgggccgaccgcgucaucgacccccggcggugccugaagccugugauccugaaggacggccccgagcgggugauccucgcggggccgaugcccgucaccguugccagcgcggcccagagaaggggacgaauaggccggaaccagaacaaggagggggaccaguauguuuacaugggccagccccugaacaaugacgaggaucacgcucacuggaccgaggcgaagauguugcucgauaacauaaauacucccgaggguauuaucccugcgcuguucgagccugagcgcgagaagagcgccgcgaucgacggcgaguaccgccugcggggggaggcccgcaagaccuucgucgaacucaugcggcguggcgaccuaccaguguggcugagcuacaaggucgcguccgaggguuuucaguacucagaccggcgcugguguuucgacggggaacggaauaaucaggugcucgaggaaaauauggacguggagauauggaccaaggagggcgagcgcaagaagcugcggcccagauggcuggaugcccggacguacuccgacccgcucgcccugcgcgaguucaaggaauucgccgccgggcggcgcucggucagcggcgaucugauccucgagaucggcaagcucccccagcaccugaccuccagggcacagaacgcccucgacaaucugguuaugcugcacaauagcgagcagggggggaaggccuaccgccacgccauggaagagcucccagacacgaucgagacacugauguugcucgcgcuuauagccgugcugaccgggggggucacccuguucuuccugucggggaagggacuugguaagacgucaaucggauuacugugcgucaccgccuccagcgccuuauuguggauggccuccguggagccacacuggaucgccgcaaguaucauacuggaguuuuuccugauggucuugcugauuccggagcccgacagacagcguaccccccaggauaaucaacuggcguacguggugaucggccuccuguucaugauccugaccgucgcugccaacgaaauggggcuacuggagacgacuaagaaggaccuuggcaucgggcauguugcggccgagaaccaccagcaugccaccaugcuugacguggaucugcggccggccuccgccuggacgcuguacgcggucgccacgaccgugaucacccccaugaugcgccacacuaucgagaacacaaccgccaacauuagccucaccgcaauagccaaucaggcggccaucuuaaugggccuggauaagggcuggccaaucuccaagauggacaucggggucccacuccuggcccugggcuguuacagccaggugaacccacucacgcuaacggccgcgguacucaugcucgucgcccauuacgccauaauugggcccggauugcaagcaaaagccacccgggaggcgcagaaacgcaccgcggccgggaucaugaagaaccccaccgucgacggcaucguggccauagaccuggaccccguggucuacgaugccaaguucgagaagcagcucgggcagauuaugcugcugauucucuguaccucccagauccuguuaaugcguacuaccugggcgcucugugagagcaucacccuggccacggggccgcugaccacccucugggagggaagucccgggaaguucuggaacacgacgauugccgugucuauggccaacaucuuucggggcucguaccuggccggcgccggccuggcauuuagccugaugaagucccugggcggcggccgaagaggaaccggcgcccaaggcgagacgcugggcgaaaaguggaagcggcaacucaaccaguuaucuaagagcgaguucaacacauauaagcgauccggcaucauggagguggaccgcucggaggccaaggaagggcugaagcggggagaaacgaccaagcacgcgguuucaagggggacugccaagcuccgcugguucguagagcgcaaccuggugaagccagaaggcaaggucauagaccuuggcugugggcggggcgguuggagcuacuacugugcaggccuuaagaagguuaccgaggugaagggguauacaaagggcggcccuggccaugaggagccgauccccauggcgaccuacggcuggaaccuugccaaacugcacuccgggaaggacgucuucuucaugccacccgagaaaugugauacucugcucugcgacaucggcgaguccucaccgaauccuaccaucgaggaagggaggacccugcggguuuugaagaugguggagccgugguugcgaggcaaccaguucugcaucaaaauccugaacccauauaugccgagcgucguggagacucuggagcagaugcagcggaaacacggcgggauguuagugcgcaacccccugucccggaacaguacccacgagauguacuggguuucgugcggcacggggaacauugugagcgcagugaauaugaccucccgcaugcuucuaaacagguuuacuaccgcacacaggaagcccaccuacgagcgcgacgucgaccugggcgccgggacccgacacguagccguggagcccgaggucgccaauuuagacaucaucggccagagaaucgagaacaucaagaacgagcacaaaagcacuuggcacuacgaugaggauaauccauacaaaaccugggcguaccacggcuccuacgaggugaagcccucugggucggcgagcuccaugguaaacggaguggugcggcuccugaccaagcccugggacgugauccccauggucacccagaucgccaugacggacaccaccccguucggccagcagaggguguuuaaggagaagguugacacacggacgccgagggccaagcggggcacaacacagaucauggaagugaccgccaaguggcucuggggcuuccucagccgaaacaagaaacccaggaucugcacccgcgaggaguucacacggaaggugagaagcaacgcggccaucggugccguauucguggaugaaaaccaguggaacuccgcaaaggaggcgguggaggacgagcgguucugggaccugguccaccgggagcgggagcugcacaagcagggcaaaugcgcgaccugcguguacaacaugauggggaagcgcgagaagaagcuaggcgaguucgggaaagccaagggcagccgggccauaugguacauguggcucggagcccgcuucuuagaguucgaagcgcucggguuuaugaacgaagaccacugguuuucucgagagaacagucugucaggcguggagggggagggccuacauaagcucggguacauauugcgcgacauaagcaagaucccgggaggcaacauguacgcagacgacacggccgggugggacacgcgaauaaccgaggacgaucugcagaacgaagcaaaaaucaccgaaaucauggagccugaacacgcccuccuggcaacguccauuuucaagcugacauaccagaacaaagucgugcgcguacagagacccgcaaagaacggcaccguuauggaugugaucagucgucgcgaccagcggggguccggucaggugggcaccuacgggcucaacaccuucacuaacauggaaguccagcugauucgccagauggagagcgagggcaucuuucugcccuccgaauuagagacccccaacuuagccgagcgggugcuugacuggcucgagaagcacggggccgaacgcuuaaagaggauggccaucagcggcgacgacugcgugguuaagcccauugaugaccgauuugcgaccgcauugaccgcacucaacgacauggggaaggugcggaaggacaucuugcagugggagccgagcaagggcuggaacgacuggcagcagguccccuucugcagccaccacuuccaucagcuaaucaugaaggacggccgcgagaucgucgucccguguaggaaccaggaugagcucguaggaagagcccgggucucccagggggccggguggagccugagagaaacagcgugccugggcaaguccuacgcccaaauguggcagcucauguacuuccaccggagagaccugcggcuagccgcaaacgcgaucugcagcgccguucccguggacuggguccccaccucccgcacaaccugguccauacacgcacaccaccaguggaugaccaccgaggacauguuguccguguggaaccggguguggauugaagagaaucccuggauggaggacaagacgcacguguccagcugggaggaggucccguaccuggggaagcgugaagaucaauggugcggaagccucaucggccucacggcucgcgccacgugggcgacgaacauccaaguugccaucaaccagguccggcgccugaucgggaacgagaacuaccuggacuauaugaccagcaugaagcgguucaaaaacgaauccgacccagagggggccuuaugguga

SEQ ID NO: 23926 - RNA, 9879 nt, Artificial Sequence
  derived and/or modified CDS sequence (opt11) from DENV-1__KJ189347__SS-prME
agcgugaccaugcugcucaugcugcugcccaccgcccucgccuuucaccugaccacucggggcggggagccccacaugaucgugagcaagcaagagcggggcaagagccucuuguucaagaccucggccggagugaauaugugcacccugaucgccauggaccugggagagcucugugaggacacaaugaccuacaaguguccccagaucaccgaggccgagcccgacgacguggacugcuggugcaaugcuaccgacacguggguaaccuacggaaccugcagccagaccggcgaacaccggcgcgacaagcgcucuguggcccucgccccccacgucggccuggggcucgagacaagaaccgaaaccuggaugagcagcgagggcgccuggaagcaaauccagcgcguagaaaccugggcccugcggcaccccggguucacggugauagcccuguuccucgcucacgccaucggcaccagcauuacccaaaaggggaucaucuuuauccugcugaugcucguaacccccuccauggccaugcgcugugucgguaucggcaaccgggacuucguggaggggcugaguggcgccacguggguagacgucguguuagagcacggguccugcgugaccaccauggccaagaacaagcccacccucgacaucgagcuguugaagaccgaggucaccaaccccgcgauucucagaaaguuaugcauugaagccaagauaucaaacaccaccacggacucccggugcccgacccagggcgaggccacccucguggaggagcaggacgccaacuuugugugccgccggacauucgucgacaggggauggggaaacggcugcggucucuucggcaaggggagccuccugacgugcgcgaaguucaagugcgugaccaagcucgaggggaagauagugcaguacgagaaccugaaauacagugucaucgugacggugcacaccggcgaucagcaccaggucgggaacgaaacgaccgagcacgguaccaucgcuaccaucacgccccaggccccgacuagcgagauccagcucaccgacuacggggcccucacccuggacuguagcccccggaccggccuggacuucaacgaaaugguccuccugacgaugaaggagaaauccuggcugguucacaagcaaugguuccucgauuugccgcugccauggaccaguggggcuagcacaagccaggagaccuggaaccgccaagaccuccuggugacguuuaagaccgcucacgcuaagaagcaggaggugguggugcugggcucccaagaaggcgccaugcacacagcccucaccggcgccacugagauccagaccucuggcaccaccaccaucuucgcugggcaccugaagugcaggcugaagauggauaaacucacccucaagggcaccucuuacgucaugugcaccgggccguucaagcuagagaaggaggucgcggagacgcagcacggcaccgugcuggugcaggucaaguaugagggcaccgacgcccccugcaagauucccuuccucacucaggacgagaagggggugacgcagaacggccgguuaauuaccgccaaccccaucgugaccgacaaggagaagccuguuaacauagaaaccgagcccccguuuggugagagcuauaucgugguuggcgccggcgagaaggcgcugaagcuguccugguucaaaaaggggagcuccauaggcaagauguuugaagccacggcacgcggugcccgccggauggccauccugggcgacaccgccugggauuucggcagcaucggcggcgucuucaccucaguaggaaagcuggugcaccaggucuucggcaccgccuacggggugcuguucucgggcguguccuggacgaugaagaucgguaucggcauccugcugaccugguugggccugaacucacgauccaccagcuuguccaugaccugcaucgccgucgguaugguaacgcucuaccuggguguuaugguccaggccgacaguggcugcgugaucaauuggaagggccgggagcugaagugcggguccggcaucuucguaaccaacgagguccacaccuggaccgagcaguacaaguuccaggccgacagcccgaagcggcucagugcagccaucggcaaggccugggaggagggggugugcggcauccggagcgccacacggcuggagaacaucauguggaagcagaucagcaacgagcugaaccacauccuccuggagaacgacaugaaguucaccguggucgugggggacgcuaauggaauacucgcgcaggguaagaagaugauccgaccccagcccauggagcauaaguacuccuggaaauccuggggaaaggccaagauaaucggcgcagauauccagaauacaaccuucaucaucgaugggccggacaccccugagugcccagauaaccagcgagccuggaacaucugggagguggaggacuacggcuuugggaucuucacgaccaauauuuggcucaagcugcgugauucauacacccagaugugcgaccaccggcugaugagcgcggccauaaaggacuccaaggccguccaugccgacaugggcuacuggaucgagucagagaagaacgagaccuggaagcuggcccgcgcgaguuucaucgagguuaagacgugcaccuggcccaagagucacacccuaugguccaacggcguccuggaaagcgagaugaucauucccaagaucuaugggggucccaucucccagcacaacuaccggcccggguacuuuacccagaccgcgggcccauggcaccucgguaagcuggagcuggacuucgaccucugcgaaggaaccacugucguuguggacgagcacugcggcaaccgcgggccaucucugcgcaccaccacggucaccggcaaaaucauccacgaauggugcugccggaguugcacccugccgccucuccgguuucgcggagaggacggcugcugguacgggauggagauccggcccgugaaggagaaagaggagaaccuagugcgcagcauggucuccgccggcagcggcgagguggauucguuuagccuggggauucucugcgugagcaucaugaucgaggaggucaugcggucacgcuggagccggaagaugcugaugacgggcaccuuagccguguuccuccugcuggugauggggcaguugaccuggaacgaucugauccgacugugcauaauggucggcgcaaacgcgucagaccgcauggggaugggcacgacguaccucgcccugauggccaccuucaagaugcggccuauguucgccgugggucuccuauucagacggcugacgagccgugaggugcuucuccugaccaucgggcuguccuuaauggcgagcgucgagcugcccaacucccucgaggagcucggcgacgggcuggcgaugggcaucaugaugcuaaagcucuuaacugaguuccagccccaccagcuguggaccacccuucuuagccugacguuuaucaagacuacccucagucuggacuacgccuggaagaccaccgccauggcccugagcaucgugucccucuucccgcugugccuuagcaccaccucucagaagaccacauggcuccccguccugcuuggcucuuuugggugcaaaccccucacuauguuccuaaucacggagaacaagaucuggggacggaagucguggccccugaacgaagggaucauggcgauuggaaucguuucgauccuccuguccagccugcuaaagaacgacgugccgcuggccgggccacucaucgcgggcggcaugcucaucgcgugcuacguuaucuccgggagcuccgccgaucugucccuggagaaggcggccgaggugagcugggagcaggaggccgagcacuccggcaccagucauaacauccuaguggagguccaagacgacgggaccaugaagaucaaggaugaagagagagacgauacucugacgauccuguuaaaagcuacccugcuggcuguguccggcguauaccccaugagcauccccgcgacccucuucgucugguacuucuggcagaagaagaagcagcgguccggggugcugugggacacaccguccccgcccgagguugagcgcgccguccuugacgacggaaucuaccgcauccuacagcgcggccucuuagggcgcucacaggugggcgugggggucuuucaggacggcgucuuccacacgauguggcacgugacccgcggggccguccugauguaccagggcaagaggcucgagcccucaugggcuagugugaagaaggauuuaaucagcuacggagggggcuggcgcuuccaggguuccuggaacaccggcgaggaggugcaggucaucgccguggagcccggcaagaaccccaagaacguacagaccacgcccggcaccuucaagaccccugagggcgaggucggagcgaucgcccuggauuucaagccgggcacuagcgggagucccaucgugaaccgggagggcaagaucguuggauuauacgggaauggcgucgugaccaccagcgggacuuaugugagcgccauugcucaggcgaaggcgucucaggagggcccccugccagagaucgaggacgaggucuucaagaagcgcaaucugaccauaauggaucuccaccccggcuccgggaagacgcggcgcuaccuacccgcuaucguucgggaggcgaucaaacgcaagcugcggacccucauccuggcccccacucgcgugguugcuagcgagauggccgaggcccugaagggcaugccgauccgauaccagaccacugccgucaagagcgagcacacggggcgcgagaucguggaccucaugugccacgccaccuuuaccaugcgccugcugucccccguccggguucccaauuacaacaugauuaucauggacgaggcgcacuucacggaccccgcgagcaucgccgcccgcggcuacaucuccacccggguggggaugggcgaggccgcagccauauucaugaccgccaccccgcccgggagcgucgaggccuucccccagucaaacgcagugauacaggacgaggagcgcgacaucccugagcgcagcuggaacagcggcuaugauuggaucacggacuucccgggcaagacggugugguucguacccagcaucaaguccgggaacgacaucgcgaacugccuccgcaagaacggcaagcgggugauccagcugagccgcaagacuuuugacaccgaguaccaaaagacgaagaauaacgauugggacuacgugguuaccaccgacaucuccgagaugggggccaacuuucgagccgaccgggucauagacccccggcgaugccugaagccagugauccucaaggauggaccggagcgggugauccuggccggaccgaugcccgugaccgucgcgagcgccgcccaaagacgcggucgcaucgggcgcaaccagaauaaggagggggaccaguacgucuacaugggccaaccucugaacaacgaugaggaucaugcccacuggacggaggccaagaugcuccuggacaacaucaacaccccggaggggaucaucccugcgcuguuugagcccgagcgcgagaagucggccgccaucgacggcgaauaccgacuccgcggggaggcccgcaaaacuuucguugagcuaaugcggcgcggcgaccugcccgucugguuaucguacaaaguugccuccgagggcuuccaguacagcgaccgcagguggugcuucgacggggagcggaacaaccaggugcuggaggagaacauggacguugagaucuggaccaaagagggcgagcguaagaagcugcggccgcgcugguuggacgcucggaccuacucugauccccuggcccugcgggaguucaaggaguuugcagcggggcggagaucgguguccggcgaccucauccuggagaucggcaagcugccccagcaccucacgcugcgggcccagaacgcgcuggauaaccucgugaugcuacacaacagcgagcagggcgggaaggccuaucgccacgcaauggaggagcucccagacaccaucgagacccucaugcugcuggcccucaucgcgguccugaccgggggcgugacgcuguuuuuccucucggggaagggccucggcaagaccuccauuggacugcucugcguaacagccucauccgcccuccuguggauggccagcgucgagccgcacuggaucgccgcguccauuauucuggaguucuuccugaugguuuugcucauccccgagcccgaucggcagcgaaccccgcaggacaaccagcuagccuaugucgucaucgggcuccucuuuaugauccuaacgguggccgccaacgagaugggguugcucgagaccacaaagaaggauuuaggcaucgggcacguggccgcggaaaaccaccaacacgccacuaugcuggacguggaccuccggcccgcuagcgccuggacucuguacgccguggcgacaaccgugaucacccccaugaugcgucacacgaucgagaauaccaccgccaacaucagucugaccgccauugccaaccaggcugcgauccucaugggcuuggacaagggcuggcccauuagcaagauggacaucggcgucccauugcucgcccugggcugcuacucccaagugaacccccugacgcucacggccgcugugcugaugcugguugcgcacuacgcaaucauugggcccggccuccaagccaaggccacgcgggaggcccaaaagcguaccgcggccgggaucaugaagaacccuacgguagacggcaucguggccauugaccuggacccgguaguuuacgacgccaaguucgagaagcagcuggggcagaucaugcuccugauccugugcaccagccagauccuccugaugcgcaccacgugggcucugugcgaguccaucacccuugcgaccgggccgcugacaacccugugggaagguagccccgggaaguucuggaacacaaccaucgccguguccauggccaauaucuuccgcggcagcuaccucgcgggcgcaggguuggcguucucccuaaugaagagccucggcgggggccgucgagguaccggcgcccagggcgagacccugggggagaaguggaaacgccagcugaaccagcucagcaagagcgaguucaacacauacaagcggucaggcaucauggaaguggaccgcagcgaggccaaggagggacuuaagaggggcgagaccaccaagcacgccgugagccgcggcacugcgaagcugcggugguucguggagcgcaaccuggucaagccugagggcaagguaauagaccucggcugcgggcggggcggcugguccuacuacugcgccggccugaagaaaguuacggaggugaagggguacacgaaaggugggccggggcacgaggagcccauccccauggccaccuauggcuggaaucucgugaagcuccacagcgggaaggacguguucuucaugcccccggagaaaugcgauacccugcugugcgauaucggcgaguccagccccaaccccacuaucgaagaagggcgcacacuccgugugcugaaaaugguggagcccuggcuacgcgguaaccaguucugcauuaaaauucucaacccguacaugcccuccguggucgagacccuggagcaaaugcagcgaaagcacggcgguauguuagugcgcaacccuuugagccggaacuccacacacgagauguacuggguaagcugcggaaccgggaacaucgucucagccgugaacaugacaagccgcaugcuccugaaccgguuuacuauggcccaccgaaagcccaccuacgagcgugauguggaccucggcgcggggacacgacacgucgcagucgagccggagguugccaaccuggauaucaucggucagcgcaucgagaacaucaagaacgagcacaaguccacguggcacuacgacgaggacaaccccuauaagacgugggccuaucacggcagcuacgaggucagacccuccggaagcgccuccagcauggugaacggggugguccgacugcucaccaagcccugggacgugaucccgauggucacccagauugcgaugacggacacaacccccuucggacagcagaggguauucaaagagaagguggacacccgcacgccccgggcuaagaggggaacaacccagaucauggaggucaccgccaaauggcuguggggcuuucugucccggaacaagaagccgcgcauaugcacgcgggaagaguucacccgcaaggugcggagcaacgcagccaucggggccguguucgucgacgagaaccaguggaacuccgcaaaggaggccguggaagacgagcgguucugggaucucgugcaccgcgagcgcgagcugcacaagcaaggccggugcgcgaccugcguuuauaauaugaugggaaagcgcgaaaagaagcugggcgaguucgggaaggcuaaggggagccgggccaucugguacauguggcucggcgcucgcuuucucgaguucgaggcacugggguucaugaaugaggaccauugguuuagccgggagaacucccucagcggcguggaaggggagggacugcacaagcugggguacauccuccgcgacaucuccaagauucccggagggaacauguacgccgacgacaccgcgggaugggacacgcggauuaccgaggacgaccugcagaacgaggccaagaucaccgagaucauggaacccgaacacgcccugcucgccaccagcaucuucaagcugacguaccagaauaaggucguccgagugcagagacccgccaagaauggcaccgugauggacgucaucucccggcgcgaccagcgcgggagcggccaggugggcaccuacgggcugaacaccuucacgaacauggaagugcagcuuauccgccagauggaguccgagggcaucuuccugccgagcgaguuagagacccccaaccucgcggagcggguccuggacuggcuggagaagcacggggccgaacgccuuaagcguauggccaucuccggagacgacugcguggugaagcccaucgacgaccgcuucgcuaccgcacugaccgcacugaacgacauggggaaaguucggaaggacaucccucagugggagccgagcaagggcuggaacgauuggcagcagguccccuucugcucacaccacuuccaccaacucaucaugaaggacggucgcgaaauagucguccccugccggaaccaggacgagcucguggggcgcgcccgggugagccagggcgccgguuggucccuaagagagacggccugccucggcaaaagcuacgcccagauguggcaguuaauguacuuccaccggcgcgaccugagacucgcggccaacgccaucugcuccgcaguccccguggacugggugccgacgagccgcacaaccugguccauccacgcgcaccaccaguggaugaccacugaggacaugcugagcgucuggaaccgaguguggaucgaggagaacccuuggauggaggacaagacccacguuagcuccugggaggagguccccuaccuggggaagcgagaggaccaguggugcgggagcuugaucggccugaccgcccgggccacuugggcgaccaacauccagguggccauaaaccaggugcgccgccugaucgggaacgagaacuaccuggauuacaugacaucuaugaaacgguucaagaacgaguccgaccccgagggcgcgcugugguag

SEQ ID NO: 23927 - RNA, 9879 nt, Artificial Sequence
  derived and/or modified CDS sequence (opt11) from DENV-1__KJ189348__SS-prME
ucaguaacaaugcuauuaaugcucuuacccacggcucuagccuuccauuugaccacgagagggggagaaccccacaugauagugaguaaacaugaacgcgggaaaucccuucuguucaaaacaagcgcggggguaaauauguguacgcugauagccauggaccucggcgaacuuugcgaggacaccaugacauacaagugcccgaggauaacagaagcggaacccgacgacgucgacuguugguguaacgccacagauacuuggguaaccuaugggacgugcucgcaaaccggugagcaccgccgggacaagagauccguugcucuagcaccccacgucggacuaggacucgaaaccagaaccgaaaccuggaugagcagcgagggugcguggaaacaaauacaaagaguagagacuugggcacuuaggcaccccggauucacugucauagcucucuucuuggcacaugccauaggcacauccaucacccaaaagggaauaauauucauccugcucaugcugguaacaccaucuauggcgaugcgaugugucgguauaggcaaucgagauuuugucgaggggcuaucaggagcaaccuggguggacguaguacuugaacacgguuccuguguaacuacuauggccaagaacaagccaacccuagauaucgaacuacucaaaacagagguuacuaacccagcaguccuacggaaacugugcauugaggccaagauaagcaacacaaccacugauagucgcugccccacccagggcgaggcaaccuuaguugaagaacaagacgcaaauuucguaugccgacggaccuuugucgacagaggauggggaaacgggugcggacuuuucggcaaagguucgcuguuaaccugcgccaaguucaaauguguaacgaaacuggaggggaaaaucgugcaauacgaaaaccuaaaguacagugucauagucacgguacacaccggugaccagcaccagguaggcaacgagacgaccgaacacgggaccaucgccaccaucacaccacaagccccgacaucagaaauccagcuuacagacuacggggcacugacccuagauugcucaccaagaacaggcuuagacuucaacgaaauggugcuccucacaaugaaagagaaaagcuggcucguacauaaacaaugguuccuggaccucccccugcccuggacguccggcgcaagcaccucucaggaaacguggaacaggcaagaccucuuagucaccuucaagacugcacaugccaagaaacaggaagugguaguacugggaagccaagaaggugccaugcacacagcacuaacaggagcaacggagauccagacgucaggaacgaccacuauauucgcugggcaccuaaagugucggcugaagauggauaagcucacccugaaaggaaccaguuacguaauguguacaggcuccuuuaaacuugaaaaagaagucgcggagacccagcauggaaccgugcuaguccaagugaaauacgaaggcacggacgcuccgugcaagauucccuucagcacacaggaugaaaaaggcguaacacaaaacggacgauuaaucaccgcaaauccgaucguuacggauaaggaaaagccaguaaauaucgagacggagccgccauucggcgaaagcuacauaguaguaggcgcgggagaaaaggcacucaaacuauccugguuuaagaaaggauccagcauaggaaaaauguucgaagcaacggcgcgcggagccagacgcauggcaaucuugggggacacggcgugggauuucggaucaaucggagggguauucacuucaguaggcaaguuaguucaccaaguguuugguacagcauauggugugcuuuucuccggggugagcuggaccaugaaaauuggcaucgggauacuucuaacguggcucggccuaaacagucgcagcaccucauucagcaugaccugcauugccgucgggaugguaacccuguacuugggaguaaugguccaggcggauagcggaugcgucauaaacuggaaggguagagagcuaaaaugcggaagcggcaucuuuguuaccaacgaggugcacacuuggaccgagcaguacaaguuucaagccgacucaccaaaaagacucagcgcggccauuggcaaagcgugggaggagggaguuugcggaauccgcagcgcaaccagacuggaaaauauaauguggaagcaaauaucuaacgagcuaaaucacauacugcucgaaaaugacaugaaauucacaguagucguaggugacgcgaacgggaucuuagcccaaggcaagaaaaugauacgaccccaacccauggaacacaaauacucauggaaauccugggggaaagcgaaaaucauaggcgccgacauacaaaacacaacguucauaauugacggaccggauacaccggaauguccugacgaucagcgggcguggaauauaugggaggucgaggacuacggauucgguauuuucacaacaaacauauggcucaaacuacgggauaguuacacccagaugugcgaccacagacuaaugucagcagccaucaaagacucgaaggcgguccacgcggacauggguuacuggaucgagucagagaagaacgaaacuuggaagcuggcgagggccagcuucauagaagugaaaaccugcaccuggccaaagagccauacccuuuggaguaauggagugcuagaguccgaaaugauaauuccgaagaucuacggagggcccaucucacaacacaacuacaggcccgguuauuucacccaaacagcggggcccuggcaucucgguaagcuggaacuagauuucgaccuaugcgagggaaccacggugguuguggacgagcacugcggcaacagggggcccucgcuucggacgaccacagucacugggaaaauaauacaugaguggugcuguagaucaugcacccugcccccauuacgcuuccgaggggaagacggauguugguacgggauggaaaucaggcccgucaaagaaaaagaggaaaaccucgugagaagcauggugagcgcaggauccggcgaaguagacagcuucagucuagggauauuaugcgugagcauaaugaucgaagaggucaugagaucgagauggagccgcaaaaugcucaugaccggcacacucgccgucuuccuccuacuaauaaugggccaacucacauggaacgacuugaucagacuauguaucaugguaggagccaacgccucagaccgcaugggaaugggaacgacguaccuagcacugauggcaacauucaaaaugagacccauguucgccguaggcaucuuauucaggcgauuaacgucacgagaggucuuacuguuaacgauaggcuuaagccuagucgcaucuguggaacugccaaacucgcucgaggaauuaggggacggccuagcgaugggcaucaugauguuaaaacucuuaacugaguuccaaccgcaccagcucuggacaacccuccuaucucucacguucauaaaaacaacucuaagccuggacuacgccuggaaaacaacagccauggcgcugaguaucguaucgcucuuuccgcuaugccuuaguacaaccucccaaaagaccaccuggcuucccguacugcugggcaguuucggaugcaaaccucuaacaauguucuuaauaacagagaacaaaauauggggacguaagaguuggccuauaaacgagggaauaauggccaucggcauaguaagcauacuccuuucuagccuauuaaagaacgauguuccccuagcugggccacuuauagcaggagggaugcugaucgcgugcuaugugauaagcggcagcuccgcggaccuaagccuagagaaagcagcggaagucagcugggaacaggaggccgaacauucuggaaccagucacaacauacuuguagaagugcaggacgacggaacaaugcgcauuaaagacgaagagaaggacgauacacucacaauacugcugaaggcgacucugcucgcaguauccggcguguacccgauguccauccccgcaacacucuuuguaugguacuuuuggcaaaagaagaaacagcgcuccggcguccugugggacacgcccucgccacccgaaguagaaagagcaguucucgacgauggaauauauagaauauuacaacgcgggcuacuaggaaggucucaagugggaguaggaguguuccaggauggcguauuccacacuauguggcauguaacaaggggagcaguacugauguaucaagguaagaggcuggagcccucaugggccuccgucaagaaggaccuaaucagcuauggaggaggcuggagguuccaggguagcuggaauaccggggaggagguccaaguaaucgcuguggagccugggaaaaaccccaaaaauguacagaccaccccaggaaccuuuaaaacuccugaaggugaagucggagcaaucgcccuggacuucaaaccagggaccagugguucccccaucgucaaccgcgagggcaagaucguaggacuguauggaaacgggguugucacaacaucuggaaccuacgugucagccauagcccaagccaaagcgucccaagaaggaccccugccggaaauugaggaugaaguguuuaaaaagcgaaaucuaacgauaauggaccuccacccagggucaggcaaaacacgacgguaccuuccagcuaucguucgagaggcaaucaagcgaaaguugcgcacacuaauuuuggccccgacgcgaguuguagcuagugaaauggcagaggcccuuaagggaaugccgauaagauaccagacaacugcuguaaaaagugaacacaccggacgcgaaauaguggacuugaugugccacgccacauucacgaugcggcugcuaagucccguccguguacccaacuacaauaugauaaucauggacgaagcacacuucacagacccagcgagcaucgcggcacgaggcuauauaucaacacgaguaggaaugggugaagcagcagcaaucuucaugaccgcaaccccaccgggguccguggaggcauucccgcaauccaacgcugugauccaagacgaggagagggauaucccggagagaucguggaacaguggguacgacuggauaaccgacuucccugguaaaacgguaugguucguuccauccaucaaaagcggaaacgacauagcaaacugccucagaaagaauggcaaaagaguaauccagcugucgagaaaaacauucgacacugaguaucagaaaaccaaaaauaaugacugggauuacguagugaccacagauaucucggagaugggagccaacuuccgcgcagaucgugugauagaccccagacgcugccuaaaacccguuauccucaaagacggcccggaacgggugauucucgccggcccaaugccuguaaccguugccagugccgcccaaagacgaggucgcauuggcagaaaccagaauaaagaaggggaccaauauguauauaugggccagccacucaauaacgacgaagaccacgcacacuggaccgaggcaaagaugcuccuugauaacaucaacacucccgaaggcauaauucccgcccuguucgaaccggaacgggagaaguccgccgccauagacggcgaauaccgcuugcgcggcgaggcccggaaaacauucgucgaacucaugcguagaggagacuuacccgucuggcuauccuauaagguggcgucggaagguuuccaauacuccgacagacgcuggugcuucgacggcgaacgcaauaaccaggugcuagaagagaauauggacgucgaaaucuggaccaaagaaggggagcguaagaaacuacggccgcgauggcuagaugcaagaacuuacagugauccgcucgcacucagagaguucaaggaguucgccgcaggaaggaggucaguaaguggggaccugaucuuagagaucggcaaacuaccucaacaccucaccuuacgagcccagaaugcacuagauaaccucgucaugcuccacaacuccgagcaagggggaaaagcauaccgccacgcaauggaagaacugccagacacaaucgagacacuaaugcuauuagcgcuaaucgcgguacugaccggaggaguuacccuauuuuuccugagcggaaaaggccucggcaagacuuccauuggacuacucugcguaacugcaucaagcgcacuccucuggauggcaagcgucgaaccacacuggaucgcggcgagcauuauucuggaguucuucuugaugguacugcucaucccagagcccgacagacagcgcacaccccaggacaaccaacuggcauauguugucauaggccugcucuuuaugauacucacggucgcggcgaacgagaugggguuacucgagaccaccaagcgggaccuugggaucggccacguugccgcugaaaaucaccagcacgcgacgaugcuggacguagaccuacggccggcaagcgcguggacccuuuacgccguugcaaccacuguaaucacacccaugaugcgucacacgaucgagaacaccaccgccaacaucucgcuuacagcaauugcgaaucaggcagcaauccuaaugggucuggacaaggguuggccaaucucuaaaauggacauaggcgucccacuguuagcccuugggugcuauagucaaguaaacccacucacacucacugcugcagugcuaaugcuaguugcccacuaugccauaauugggcccggccuacaagcgaaggccacacgggaagcccaaaagaggaccgcggcggguauaaugaagaauccaacaguggauggaaucguggccaucgaucuggacccagugguauacgacgccaaguucgagaagcaacucggacagauaaugcugcugauacuauguacaucacagauacugcuuaugaggaccaccugggcguugugcgaaaguauuacacuugcgacgggucccuuaaccacgcucugggaaggaagcccgggaaaauucuggaacaccacaaucgccguuucaauggcgaacauauucaggggaaguuaccuugcgggggcgggccuggccuuuagucuaaugaaaucccuugggggaggccggagagggacaggagcccaaggagaaacucuaggggagaaauggaaaaggcaacugaaccaacuaaguaagcccgaguucaacacguacaagcgguccggaaucauggaaguggacaggucggaagcgaaagagggauugaaaaggggcgaaacaacaaaacacgcaguaaguaggggaacagcuaaacuacggugguucguagaacgcaaccucguaaagcccgaaggaaaagucaucgauuuaggcugcggucgaggaggauggucauacuacugcgcuggucucaagaaagucaccgaggugaaaggcuacacaaagggcggaccgggacacgaggagccgaucccgauggcaaccuacggcuggaaccucguaaaguugcacucaggaaaagacgucuucuucaugccaccagaaaaaugcgauacacuccucugcgacaucggggaaagcucaccaaaucccacgauagaagaaggucguacucuaagagugcucaaaaugguggaaccauggcuaagggggaaucaauucugcauuaaaauacugaacccauauaugccgaguguaguagagaccuuggaacaaaugcaaaggaaacauggaggaaugcuugugagaaauccccuaaguagaaauagcacgcacgagauguacugggucuccugugggacuggaaacauagucagcgccgucaauaugaccagcaggaugcucuugaaucgcuucaccauggcacauaggaaaccaaccuaugaaagagacgucgacuugggagcaggaaccagacacgucgcuguugagcccgaggucgcaaacuuagauauuauagggcaaaggauagaaaacaucaaaaacgagcacaagaguacauggcacuacgacgaagacaauccguacaagacgugggcuuaccacggguccuacgagguaaaaccgucuggcucggcaucgucgaugguaaauggagucgugcgacugcugacaaagcccugggacguaauuccaaugguaacucagauagcaaugaccgacacaacuccguucggccagcaaagaguauucaaagagaagguagacacgcggaccccaagagccaaaagaggcaccacacaaaucauggaaguaacggcaaaauggcucugggguuuucugagccgcaacaagaaaccucgaauaugcacacgggaggaguucacacggaaaguccgcagcaacgcggcgauaggcgcagucuucgucgaugaaaaucaguggaacagcgcaaaagaggcggucgaggacgaacguuucugggauuugguacauagagaacgggaguugcauaagcagggcaaaugcgcgacuugcguauacaacaugaugggaaagcgugaaaagaaacugggggaguuugggaaagccaaggggucgagggcgaucugguacauguggcuaggcgcacgcuuccuagaguuugaagcacuaggcuucaugaacgaagaccacugguucuccagggagaacucgcuaagcggcguagaaggcgaggggcuccacaagcucggauacauccuaagagacauuuccaaaauuccaggcgguaauauguaugcggacgauaccgcagggugggacacacgaauaaccgaagacgaccuccagaaugaggcuaaaauuacggauauaauggagccugagcacgcgcugcuagccacuucgauauucaagcucacauaccagaacaaggugguacggguucaacggcccgcaaagaauggaacaguaauggacgugauuagccgucgugaccaaagaggaucuggccaggugggcacauacggccugaacaccuucacaaacauggaaguacaacucauaaggcaaauggaaucugaaggcauuuuccuccccagcgaacuggaaaccccaaaccucgcggagcgcguacuaaacuggcucgaaaagcauggagcggaacggcucaaacgcauggccauuuccggagaugacugcguagucaagcccauagacgaucgcuucgcgacagcacucacggccuuaaacgauaugggaaaggucagaaaagacauaccccaaugggaaccgagcaaaggauggaacgauuggcagcaagugcccuuuugcagccaccacuuccaucagcuaauaaugaaagacggacgcgaaauagucguacccugccggaaccaagacgaauuaguagggcgcgcacgcgugucacagggagcgggauggaguuugagggaaacagcaugccuagguaaaucauaugcacaaauguggcagcuuauguauuuucaucgacgggaccuccgccucgcggccaacgcaaucuguucagcaguaccagucgacuggguacccaccagcagaacuacauggagcauacacgcucaccaccaauggaugacuaccgaggacaugcuauccguguggaaccggguguggauagaagagaacccauggauggaagacaaaacacacguuagcagcugggaggaagucccuuaucucggaaagagagaagaccaauggugcggcucccucaucggucucacugcccgcgccaccugggcaaccaacauacagguggccauaaaccaaguuaggcgauugaucggcaacgagaacuacuuagauuacaugacauccaugaagcgcuucaagaacgaguccgacccggagggcgcgcuaugguag

SEQ ID NO: 23928 - RNA, 9879 nt, Artificial Sequence
  derived and/or modified CDS sequence (opt11) from DENV-1__KJ189368__SS-prME
agcgugacuaugcugcucaugcugcugcccaccgcccucgccuuucauuugaccacuagaggaggggagccccacaugauagucuccaagcaggaacggggcaagagucuauuauucaagaccucugccggggugaacaugugcacccugauugcgauggaccugggcgagcucugcgaggacacuaugaccuauaaguguccccagauaaccgaggccgaaccugacgauguggacugcuggugcaacgcaaccgacacgugggucaccuacggaaccugcagccaaaacggcgagcaccgccgggacaagcgcagcguggcccuagcgccacacgugggccuggggcucgagacccggacggagacauggaugagcucggagggcgccuggaagcagauccagcgcgucgagaccugggccuugcggcaccccggguucaccgugaucgcccuguuccucgcucaugccaucgguacgagcaucacccagaagggaaucaucuucaucuugcuaauguuggucacgcccuccauggccaugcgcugcgucggcauaggcaacagagacuucguggagggccugagcggggcgaccugggucgacgucgugcuugagcacgguuccugugugaccaccauggcaaagaauaagcccacccucgauaucgagcugcugaagaccgaggucacgaaccccgcgaucuugcgcaaacuuuguaucgaggccaagaucucuaacaccaccaccgacucccggugcccgacccagggcgaggccacccugguggaggagcaggacgccaauuuugugugccgucggaccuucguugaccgcggcugggggaacggcuguggccucuucggaaagggcagccugcugacgugcgccaaguucaagugcgugacgaaguuagagggcaagaucgugcaguacgaaaaucugaaauacagugucaucguuaccgugcauaccggggaucagcaccagguuggcaaugagaccacggaacacggcaccaucgcgaccaucacgccccaagcacccaccagcgagauccaguugacggauuacggagcacucacccuugacuguagcccccggacaggccuggacuuuaacgagauggugcuccugaccaugaaagagaaguccuggcugguccacaagcagugguuccucgacuugccgcugcccuggacgaguggggccagcaccagccaggagaccuggaaccgccaggacuuacugguuaccuuuaagacggcgcacgcaaagaagcaggagguggucgugcugggcagccaggagggcgccaugcacacagcccucaccggggccacugagauccagaccagcgguaccaccacuauauucgcggggcaccugaagugccgguugaagauggacaagcucacgcugaagggcacauccuacgucaugugcaccgggccguuuaaguuagagaaagaggucgcggagacccagcacggaacggugcuagugcaagucaaauacgagggcaccgacgcccccugcaaaaucccguucagcacccaggacgaaaagggggugacccagaauggccgccucaucaccgccaacccaauugugaccgacaaggagaagcccgucaacaucgagacggagcccccauucggggagucauacaucguggugggcgccggcgagaaagcauugaaacuuagcugguucaagaagggguccucaaucggcaagauguucgaggccaccgcccgcggugcucgccggauggccauccuuggcgacacggcgugggacuucggguccaucggcggcgucuucaccaguguggggaagcuggugcaucagguuuucggcaccgccuauggggugcuguucucaggcgucagcuggaccaugaagaucgggaucggcauccuccuuacguggcugggccucaacucuaggagcaccuccuuaagcaugaccugcaucgccgucggaauggugacccuguaccucggcguaaugguccaggccgacucagggugcgugauuaacuggaagggacgcgagcuaaagugcgggagcggcaucuucgugacgaacgagguucacacauggaccgagcaauauaaguuccaggccgacucccccaagaggcuuucugcggccaucggcaaggccugggaggagggggugugcggcauccgcagugccacccgucucgagaacaucauguggaagcaaaucaguaacgagcugaaccauauccuccucgagaacgauaugaaguucaccgugguagugggcgacgccaacggcauucuggcgcaggguaagaaaaugauccgcccacaacccauggagcacaaguacagcuggaaauccuggggcaaagccaagaucaucggcgccgacauccagaacacgacuuucauuaucgacggcccggacacgccugaaugcccugacaaccagcgggcguggaacaucugggagguagaggauuauggcuucgggaucuucaccacuaacaucuggcugaagcucagggacagcuacacccagaugugugaccaccggcuaaugucugcggccauuaaggacagcaaggccguccacgccgacaugggcuacuggauagaguccgagaaaaacgagaccuggaagcucgcccgcgcaagcuucaucgaagugaagaccugcacuuggcccaagagccacacccucuggagcaacggcgugcucgaguccgagaugaucauaccgaagaucuauggaggccccaucagccagcacaacuaccggcccggguacuucacucaaaccgccggcccguggcaccugggcaagcucgagcuggacuucgaccugugugagggcacgaccgucgugguggaugagcacugcggcaaccgcgggcccucccuccggacuaccacaguuaccggcaagaucauccaugagugguguugccgcagcugcacccugcccccccugcgguuccgcggagaggacgguuguugguacggcauggagauucggccggugaaagagaaggaggaaaaccuugugcgcuccaugguaagcgccggcuccggggaaguggacagcuucucacuggggauccugugcguguccaucaugaucgaggaggucaugcguagcagguggucccggaagaugcucaugaccgguacgcucgccguauuccugcuccuggugauggggcagcugaccuggaacgaccucauccgccugugcauuauggucggcgccaacgcgagcgaucgcauggggaugggcaccaccuaucuggcccucauggccacguucaaaaugagaccuauguucgccguggggcugcuguuccgccggcucaccucccgagaaguucugcugcucaccauagggcugucccuagucgcguccguggagcuccccaacagccuggaggagcugggcgacggccucgcgaugggcaucaugauguuaaaacugcucaccgaguuccaaccccaccagcuguggacgacccugcucucccugaccuucaucaaaaccacgcugucccucgacuacgccuggaaaaccaccgccauggcccugucuaucgucucucuguucccgcucugccugagcacaacgagucagaagacgaccuggcugcccgugcuccugggcuccuuuggguguaagcccuugaccauguuccucaucaccgagaauaagaucuggggccggaagagcuggccccugaacgaagggaucauggcgauuggcaucgugaguauccuucuuagcucguuacugaagaacgacgucccgcucgccggaccccugaucgcgggcggcaugcugaucgccugcuacguuaucucagggagcucagccgaccucagccuagagaaggccgcggaggugucaugggagcaggaggccgagcacagcggcacgucccacaacauccuggucgaggugcaggacgacgggaccaugaagaucaaggacgaggagcgggaugacacccucaccauccuccugaaggccacacuucuggccgugagcggcgucuaccccauguccauccccgcaacccuguucgugugguacuuuuggcaaaaaaaaaaacagcggagcggugugcugugggacaccccgagcccgcccgaggucgaacgcgccguucuggacgacggcaucuaccggauauuacagcgcggccuguuggggcggucgcaggucggcguugggguauuucaggacggcguuuuucacaccauguggcacgucacgcgcggggccgugcucauguaccagggcaagcggcuggagccuuccugggccagcguuaagaaagaccugaucuccuacgggggaggcuggcgcuuccaagggagcuggaauacuggcgaggagguccaggugaucgccguggaaccggggaagaacccuaagaacguccagaccacucccggcacguucaagacacccgagggggaggugggggcgauagcccuggauuuuaagccgggcacuuccgggagcccaaucgugaaccgggagggcaaaaucgucggcuuauacgggaacgguguggugaccacguccggaaccuacgucagcgcgauugcucaggccaaggcgagccaagagggcccccucccggaaauugaggacgagguguucaagaagcggaaccugaccaucauggaccugcaccccgggagcggcaaaacccggcgcuaccuccccgcgaucgugagagaggcuauuaaacgcaagcugcggaccuuaauccucgcccccaccaggguuguggcgagcgaaauggccgaggcucugaagggcaugccgauccgcuaccagaccaccgccgugaaguccgagcacacggggcgggagaucgucgaccuaaugugccaugccaccuucaccaugagguuacugucaccaguccgagugccaaacuacaacaugaucaucauggacgaggcgcacuucaccgaccccgccuccaucgccgccagaggguacaucaguaccagagucgggaugggggaagccgcggcaaucuucaugacagccaccccccccggguccguggaggccuucccacagagcaacgccgugauccaggacgaggagcgcgacauccccgaacggucauggaacucgggcuacgacuggaucaccgacuuuccgggcaagacggucugguuugugccuaguauaaaaagcgggaacgacauagcgaacugccugcgcaagaacggcaagcgggugauucaacucucccgcaagaccuucgacacugaguaccaaaagacgaaaaauaacgacugggacuacgucguuacgaccgacauuagcgagaugggggccaacuuccgggccgaccgcgugauagacccccggcgcugccugaagcccgucauccugaaagacggcccggagcgggugauccucgcugggcccaugcccguuacugucgccuccgccgcccaacgcaggggccguauaggccggaaccagaacaaggagggugaccaguauguguacaugggccagccccugaacaacgacgaggaucacgcccauuggaccgaggccaagaugcugcucgacaauauaaacacuccggaggggaucaucccggcgcuguucgagcccgaacgcgaaaaguccgcggcaaucgauggcgaguauaggcugcgcggcgaggcccgcaaaaccuucgucgagcucaugcggcgcggcgaccuacccguguggcucuccuacaagguggccagcgagggcuuccaguauuccgaccggcgcuggugcuuugacggagagcggaacaaccaaguucucgaggagaacauggacguggagaucuggaccaaggagggcgagcgcaagaagcugcggccgagguggcuggacgcucgaaccuacuccgauccccucgccuugcgagaauucaaagaauucgccgccgggcggcgcuccaucucgggcgaccucauccucgagaucggcaagcugccccagcaccugacccuccgugcgcaaaacgcgcuggacaaucuugugaugcuccacaacagcgagcagggcgguaaggccuaccgccacgccauggaggagcugcccgacacaaucgagacccugaugcucuuggcccugaucgcgguccucaccgggggcgugacccuguucuuccuguccgggaagggccuuggcaagacgucuauugggcugcugugcgugaccgcuuccagcgcacuccucuggauggccuccguugagccgcacuggaucgcugcgagcaucaucuuggaguucuuccucaugguucuacugaucccagagcccgaccggcagcgcaccccgcaagauaaccagcuggccuacguggugaucggccugcuguucaugauccucaccguggccgcgaacgagaugggucugcuggagaccaccaagaaggaccucggcauugggcacguggccgcggagaaccaccagcacgccaccaugcuggacguagaccugcggcccgcuuccgccuggacccucuacgccguggcgacaacugugaucaccccgaugaugcgccauacaaucgagaacacgaccgccaacaucagccugacugccauugccaaccaagccgcgauccuuaugggccucgacaaggguuggccuaucuccaaaauggacaucggggucccgcugcuugcgcucggcugcuacucucaaguuaacccccuaacccuaacugccgccguucucaugcuggucgcgcacuacgccauaaucgggcccggccugcaagccaaggcaacccgggaggcccaaaagcgcacagcggccgggaucaugaagaaucccaccgucgacggcaucguugccaucgaccuugacccggucguguacgacgccaaguucgagaaacagcugggccagauaaugcugcugauccuauguacgucccagaucuugcucaugcgcacgaccugggcccugugcgagagcauuacauuagcaacgggaccccucaccacccugugggagggcuccccggggaaguucuggaacacgacgaucgccgugagcauggcaaauaucuuccgaggcuccuaccuggccggcgcggggcucgcguucagccugaugaaguccuuaggcgggggccgccgggggaccggugcccagggcgaaacucugggggagaaguggaaaaggcaacucaaccagcugagcaaguccgaguucaacaccuacaagcggagcggcaucauggaggucgaucgcagcgaggcaaaggaaggguuaaagcguggcgagacuaccaagcacgccguaucccgcgggaccgcuaagcugagaugguucguggagcgcaaccugguaaaacccgagggcaaggugaucgaccugggaugcgggaggggcggguggagcuacuacugcgcuggccucaaaaaggugacggaggucaagggauacacgaagggcggcccggggcacgaggagcccauccccauggccacguacggcuggaaccuugugaagcugcacuccgggaaggacguguucuucaugcccccggaaaagugcgauacccuuuuaugcgacaucggugagagcagucccaaccccaccaucgaggaggggcgcacacugcggguccucaagaugguggagcccuggcugcgcggcaaucaguucuguaucaagauccugaauccuuacaugccgagcgucguggagacgcuagagcagaugcagcgaaagcacgguggaaugcuggugcgcaacccucugucccggaacaguacccacgaaauguacuggguguccugcggaacuggcaacaucgucagcgccguuaacaugacaucccgcaugcugcugaaucgguucacgauggcucaccgcaagccuacauacgagcgcgacguagacuuaggcgcgggcacccggcacgucgccguggagccggagguggccaaccucgacaucaucgggcagcgaauagagaacaucaagaacgagcacaaaagcacuuggcacuacgacgaagacaacccuuacaagacgugggcguaccacggcuccuacgaggucaagcccagcggguccgccagcucaauggucaacggcgugguucgccuccuaacgaagccgugggacgugaucccaauggucacgcagaucgcgaugaccgacacgacaccguucgggcagcagcgcguguucaaggaaaagguggacaccagaacgccccgggccaagcggggcacgacccagaucauggaggucaccgccaaauggcucuggggcuuccugagccgaaacaagaagccgcggaucugcacucgcgaggaguuuacgagaaaaguccgcagcaacgccgccaucggcgcgguguucgucgaugagaaccaguggaauagcgcgaaggaggccguggaggacgagcgguucugggaccuggugcaccgcgagagagagcuccacaagcagggcaagugcgcgacgugcguuuacaacaugauggggaaacgcgagaagaagcugggcgaguucgggaaggcgaagggcagccgugccaucugguacauguggcuuggcgcccgguucuuggaguucgaggcccugggguucaugaacgaagaccacugguucucccgggagaacagccuguccggcgucgagggugaggggcuccacaagcugggauacauccugcgcgacaucagcaagauccccggcggcaacauguaugccgacgacaccgcggggugggacacccggaucacggaggacgaccuccagaacgaggccaagaucaccgaguucauggagccagaacacgcccugcuagcgaccucuaucuucaagcuuaccuaccagaacaaagugguacgcgugcagcgccccgccaaaaacggcacggugauggacgucaucagccggcgagaccagcgggguuccggccaggugggcaccuacgggcuaaacacauucaccaacauggaggugcagcugauccgccagauggaguccgaaggcaucuuccucccguccgaguuagagacgccaaaccuggcggagcggguguuugacuggcuugagaagcacggggccgagcgccuuaaacgaauggccaucagcggcgacgacugcguggugaagcccaucgacgaccgcuucgccaccgcguuaaccgcgcucaacgacauggggaaaguacggaaggacaucccgcagugggagccuuccaaggguuggaacgacuggcagcagguccccuuuuguucucaucacuuccaccagcugauuaugaaggacggacgcgagaucguggucccaugucggaaccaagacgagcugguggggcgcgcccggguuucccagggcgccggguggagcuuacgcgagaccgccugccugggcaaguccuacgcccagauguggcagcugauguacuuccaucggcgggaccuccggcuggcggccaacgcaaucugcagugccgucccaguggacugggucccgacuagucgcacgaccuggagcauccacgcucaccaccaguggaugaccaccgaggacaugcugagcgucuggaaccgggucuggaucgaggaaaaccccuggauggaggacaagacucauguguccagcugggaagagguccccuacuuagguaagcgcgaggaccaguggugcggcucacugaucggccugaccgcccgcgcaaccugggccaccaacauccaggucgccauaaaccaggugcgccgccucaucgggaacgagaacuaccuggacuacaugacgagcaugaagcguuucaagaaugaguccgauccagagggugcgcugugguga

SEQ ID NO: 23929 - RNA, 9879 nt, Artificial Sequence
  derived and/or modified CDS sequence (opt11) from DENV-1__KJ189369__SS-prME
agugugacaaugcuccucauguuacugcccaccgccuuagccuuccacuugaccacccggggcggggagccucauaugauugucucgaaacaggagcggggcaaaucccuccuguucaagacguccgcggggguaaacaugugcacccugauugccauggaccugggugaacucugcgaggacaccaugaccuacaaguguccccagaucacagaggccgaacccgacgacguagacugcuggugcaacgccacugauacuugggugacauaugggaccugcucucagacuggcgagcaucggcgggacaagcgcucuguggcccuagccccccaugugggacuaggauuggagacacguaccgaaacuuggaugucuuccgaaggugccuggaagcagauccagcgugucgagaccugggcccugaggcacccaggcuucacggugaucgcuuuguucuuggcgcacgcgauaggcaccagcauaacccagaaagggauaauauucauccugcugaugcucgugaccccguccauggcgaugcgcugcguggggaucgguaaccgggacuucgucgaggggcuuagcggcgccacguggguggacgucguuuuagagcacgggucaugcgucaccaccauggccaagaacaagcccacucuagauaucgagcucuuaaagacggaggucaccaaccccgcgauccuacgcaagcuuuguauugaagccaagaucagcaacaccaccaccgacucgcggugcccgacacagggagaagccacucugguugaggaacaggacgcaaacuucgugugucgucggaccuucguugaccgcggcugggggaacggcugcggcuuauucggcaaggggagccugcugacaugcgcuaaguuuaagugcguuacgaagcucgaagguaagauagugcaguacgagaaccuuaaauacuccgucaucgugaccgugcauaccggcgaccaacaccaggucgggaacgagacgaccgagcacggaacaauugcgacaaucacgccccaggccccgacgagcgagauccaguugacggacuauggcgcgcugacccucgauugcagcccccggaccgggcuggacuucaacgaaaugguguugcugaccaugaaggagaaguccugguuagugcauaagcagugguuccucgaccugccccugcccuggaccagcggggccucuaccagccaggagacuuggaaucgacaggaccuccuggugacguucaagacggcccacgcgaaaaagcaagagguggucguacugggcucccaggagggcgcgaugcacacagccuuaaccggggccaccgagauacagaccagcggcacaaccacgaucuucgccggucaucuuaaaugcaggcucaagauggauaagcugacacugaagggaaccucuuaugucaugugcaccggaaguuucaagcuggagaaggagguggcggaaacacaacauggcaccgugcuggugcaggucaaguaugaaggcaccgacgccccguguaagaucccguucuccacucaagacgagaaggggguaacgcagaacggucgccucaucacggccaaccccaucguaaccgauaaggagaagcccguaaauaucgaaacagaaccucccuucggggagucuuacauaguggucggcgcgggugagaaagcgcugaagcugaguugguuuaaaaagggcagcuccaucggcaaaauguucgaggccacggcacgcggggcgcgccggauggcgauccucggcgauacggccugggauuucggcagcaucggcggcgucuucacguccguagggaagcuaguucaccaggucuucggcaccgccuacggagugcuguucucggguguguccuggacgaugaaaauugggaucggcauccuccugaccugguugggccuaaacagccgguccaccagccuguccaugaccuguaucgccguugggauggugacgcuuuaccucggcgucaugguccaagcggauagcgguugcgugauaaacuggaagggccgcgagcugaaaugcggguccggcauauucgugacgaacgagguccacacuuggaccgaacaauacaaguuccaagcagacagcccgaaacggcuuuccgcugccaucgguaaggccugggaggagggggugugcggcaucagguccgccacccggcuugagaauaucauguggaagcagaucagcaacgagcugaaccauauacuccucgagaaugacaugaaauucaccguuguugugggggaugccaacggcauccuggcccagggcaagaagaugaucaggccccagcccauggagcauaaauacuccuggaaguccuggggcaaggcuaaaauuauuggggccgauauucaaaauacuacuuucauaaucgacggccccgacacgccggaaugcccugacaaccagcgcgccuggaacauaugggagguugaggauuacggguucggcauauucacgacuaacauuugguugaaacuccgggacaguuauacucagaugugcgaccaccgucugaugagcgcggcgaucaaggacucaaaagccguccaugccgacauggguuacuggauagaaagcgagaagaacgagacguggaaacuggcccgcgcgaguuucauugaggugaagacgugcaccuggcccaagagccacacccuaugguccaacggaguucuggagagcgagaugauaauccccaagauuuauggggggccgauaucccaacacaacuaucggcccgguuauuucacccagaccgccggacccuggcaccuugggaaauuagaacuggacuucgaccugugugaggguaccaccgucguuguggacgagcacugcggcaauagggggccgucucuccggacgacgacugucacgggcaagaucauacacgaauggugcugccgcucauguacccugcccccccugcgguuccguggggaggacggcugcugguacggaauggaaauucggccagugaaggaaaaggaggagaaccucguccgcucaaugguauccgccggcagcggggagguggacagcuuuagucuggggauccugugcgugagcaucaugaucgaggaagugaugcgaucccgcuggagccggaagaugcuuaugacgggcaccuuggccguauuccugcuauuggugaugggacagcugacguggaacgaucucauccgccuguguaucauggucggcgcgaacgccuccgaucgaauggggauggguacaacauaccuggccuuaauggccacuuuuaagaugaggccaauguuugccgugggucugcuguuccgccggcucaccagccgcgaggugcuguugcugacaaucgggcugucacucgucgcgagcguagagcucccuaacucccuugaagaacucggugaugggcucgcgaugggcauaaugaugcuuaagcugcugacggaguuccagccccaccagcuguggaccacccuacuaagucucacauuuauuaagacgacccugucccuggauuacgccuggaagacgacugccauggcucugagcauaguaucccuauucccccucugucuaagcacgaccucacaaaagaccaccuggcugccggugcugcuuggcucauucgggugcaaaccccuaaccauguuccucaucacggagaacaaaaucuggggacggaagucuuggccccucaacgagggaaucauggcgaucgggauagugaguauacuauuguccagccugcuaaagaacgacgucccacucgccgggccgcugaucgccgguggaaugcuaaucgccuguuaugugaucagcggguccuccgccgaccucucccuggagaaggcggcugaggugagcugggagcaagaggccgagcacuccgggaccagccauaacauacuggucgagguccaggacgauggcaccaugaagaucaaggacgaggaacgcgacgauacucucacgauuuugcuaaaggccacccugcuggcuguguccgggguguacccuaugucuauucccgcaacuuuauucgugugguacuucuggcagaagaaaaaacaacggucaggcgugcucugggauaccccuucaccgccagagguagagcgcgcaguacuggaugacggcaucuaccggauccugcaaagaggccugcucggucggucccaaguuggcgucgggguguuccaggacggcguguuccacacgauguggcacgucacucgcggggccguguuaauguaccaaggcaagcggcucgagccuaguugggcguccgucaagaaggaccucauuagcuacggagggggcuggcgcuuccaggggucguggaacacgggugaggaagugcaaguuauagccguggagcccggcaaaaacccuaagaacguucaaacgacaccaggcacuuucaagacccccgagggcgaagucggagcuaucgcuuuagacuucaagcccggcaccuccggguccccgaucgugaaucgugagggcaagaucguuggccucuacgggaacggcguggugacaaccagcgguacauacguaagcgccauagcccaagcaaaagcgagccaggagggcccgcuccccgagaucgaggacgagguguucaagaagagaaaccugacuaucauggauuugcacccuggcucagggaagacgcggcgauaccuccccgccauaguacgagaagccaucaagcguaaguugcguacucucauucucgccccuacacgcgugguggcuucggagauggccgaggcucugaagggcaugccuauccgcuaccagaccacggccgucaaaagcgaacacaccgggcgggagauuguggaccugaugugccacgccacuuucaccaugcgccuccugucuccgguacgaguucccaacuacaacaugauuaucauggacgaagcgcacuucacagaccccgccagcauugcggcucgaggcuauaucuccacccgggucggcaugggcgaggccgccgcuaucuucaugacugcaacgccccccgggagcguagaggccuucccccaauccaacgccguuauacaggaugaggaaagggauauacccgagcguucauggaacuccgguuacgauuggaucacugacuucccugggaagaccgucugguucgucccuagcauuaaguccgguaacgacaucgcgaacugccugcgaaagaacggcaaacgggucauccagcucucaaggaagaccuuugacaccgaguaucagaagacgaagaauaaugacugggacuacguugugaccacagacaucucugagaugggggccaacuuccgggccgaccgcgugaucgacccccggagaugccugaagcccgucauccugaaggacggcccugagcgagugauacucgccggaccgaugccggugaccgucgcaagcgcagcccagcgccggggucgcaucggucggaaccaaaauaaggagggggaucaauacguguacaugggucaaccgcugaacaaugacgaggaucacgcccacuggacagaggccaagauguugcucgacaacaucaacacccccgaggggauuaucccggcgcuguucgagcccgagagggagaagaacgcagccauagacggcgaguaccgucugcgcggggaagcccguaagacuuucgucgagcucaugcgccgcggggaccugcccguguggcugagcuacaagguggccucggagggcuuccaauacagugaccggcgguggugcuuugacggugagagaaauaaccaggugcucgaggaaaacauggacguggagaucuggaccaaggagggcgagcgaaagaagcuacgcccccgcugguuggacgcgcggacuuacucagauccgcucgcacuccgcgaguucaaagaguucgccgccgggcggagguccgugucgggcgacuuaaucuuggagaucggcaaacugccacagcaccuaacauuaagagcucagaacgcgcuggauaauuuggucauguugcacaacagcgagcagggagggaaggccuaccgccacgccauggaggaauuaccggacaccaucgagacccugaugcuccuugcgcugauagcgguacugaccgggggggugacacuuuucuuccuguccgggaagggccucggcaagaccagcauuggauuguugugcgucaccgccuccagcgcccuccuguggauggccuccguggagccccacuggaucgcugcuuccaucaucuuagaguucuuccucauggugcuguugaucccggagccagaccggcaaagaacgccccaagacaaucaacucgccuacgucguaaucggccugcuguuuaugauacucacgguggccgccaacgagauggggcugcucgagaccaccaagaaggaccucggcaucggacacguagccgcagagaaccaucagcaugcgacgaugcuggacguggauuugcgaccugccuccgccuggacguuguaugccguggcaaccacugugauaaccccuaugaugcgccauacgaucgaaaauacaaccgccaauaucagccugacugccauagcgaaucaagccgcgauucucauggggcuugacaagggcuggcccaucucgaagauggauauuggcgugccucugcuggccuuggguugcuacagccaggugaacccgcugacucugaccgccgccgugcucaugcucguggcccacuacgccauaauagggcccggcuuacaggcuaaggccacccgggaagcccagaagcgcaccgcugcuggaaucaugaagaaccccacgguggauggcauaguugcgaucgaccucgacccggugguguaugacgccaaguucgagaaacaacugggccagaucaugcugcucaucuugugcacgucccagauauuacucaugcgaaccacgugggcacugugcgagagcauaacgcuggcgacugggccacucaccacucugugggagggauccccagggaaguuuuggaacaccaccauagcugucaguauggcgaauaucuuucggggcuccuaccuggcgggcgcagggcucgcguucagccuaaugaaguccuugggugggggccgccgggggacuggcgcccagggcgagacauugggggaaaaguggaagcgccagcuuaaccaacugagcaaguccgaguuuaacacguacaagagaagcgggaucauggagguggaucgcagcgaagccaaggaggggcucaaacggggcgagacgaccaaacaugcuguuucacgcgggaccgcgaaguugcggugguucguugagcgcaaucuggugaagcccgagggcaaggugauugaccugggguguggacggggcggauggagcuacuauugcgcugggcucaagaaagucacggaggugaagggauacacaaagggcgggcccggccacgaggagccgauccccauggccaccuacgguuggaaccuggugaagcugcacuccgggaaagacgucuucuucaugcccccagagaagugcgacacccuccucugugauaucggcgagagcuccccaaacccgaccauugaagaggggcgcacacuucggguacucaagaugguggagccguggcuccggggcaaccaauuuugcauuaagauccuuaaccccuacaugccgagcgucguggagacacuggagcagaugcagagaaagcacggugggaugcugguacggaaccccuugucccggaauagcacccacgaaauguacuggguauccugcgggaccggaaacaucgugucagccgugaauaugacgucccgcauguuacucaaccgguuuaccauggcccaccgcaagcccaccuacgaacgggacguugaccuuggcgcuggcacccggcacguggccguggagcccgaggucgcgaaccuagacauaauaggucaacgcauagagaauauuaagaacgagcacaagagcacguggcacuacgacgaggauaauccguauaagaccugggccuaccacggcuccuaugaggugaagcccagcggauccgccucguccauggugaacggaguggugaggcugcugacaaagccgugggacgucaucccuauggugacccagauugcgaugacggacaccaccccguucgggcagcagcguguauucaaggaaaagguggauacuaggacgccccgugccaagcggggcacuacccagauuauggaggugaccgccaaguggcucuggggcuucuuaucucguaacaagaagccccggaucugcacgcgugaggaguucacccggaagguccgcuccaacgcggcaauuggagccgucuucguggacgagaaccaguggaacucugcuaaggaggcgguugaagacgaacgguuuugggaccugguccaucgcgagcgggagcuacacaaacagggcaagugcgcgacaugcguuuacaacaugauggggaagcgggagaagaagcugggcgaguucgguaaagcgaagggaaguagagccaucugguacauguggcugggcgcccgcuucuuagaguucgaggcccugggguucaugaacgaagaccacugguucagucgggaaaacagccugucgggcguagagggugagggccuccauaagcugggguacaucuuacgcgacauuagcaagauaccgggcgggaauauguacgccgacgacaccgcggggugggauacccgaaucacagaggacgaccuucaaaaugaggccaagaucaccgaaaucauggagcccgaacacgcacuucuagccacgagcaucuuuaaacucacguaccagaacaagguggugcgggugcagcgccccgcgaagaacggcacaguuauggacgugaucucgcgccgcgaccagcgagggucuggccagguuggcacguacggccugaacaccuucacgaacauggagguccagcuaauacgccagauggagucggaggguauauuucuccccuccgagcucgaaaccccgaaccuggcggaaagagugcucgacugguuagagaagcauggggccgagcgauugaagcggauggcgaucaguggcgacgacugcgugguuaagcccaucgaugaccgcuucgccacugcacucaccgcacugaacgacauggguaaggugcggaaagacaucccucaaugggagccaaguaaggguuggaacgacuggcaacaggugccauucuguagccaccacuuccaccagcugaucaugaaagacgguagagaaauagucgugccaugccggaaccaggaugagcucguggggcgggccagagugucccagggcgccggguggagcuuacgcgagacagccugucugggcaaguccuacgcccaaauguggcaauuaauguacuuccacagacgcgaccugagacuggcagccaacgcaauuugcagugccgugcccguggacuggguccccacaagccgcaccaccuggagcauccacgcacaccaccaguggaugaccacggaggauaugcucagcguguggaaccggguuuggaucgaggaaaacccguggauggaggacaagacccacguaaguagcugggaggaggugcccuaucuggggaaacgcgaagaccaauggugcggaucccuuaucggccucaccgcgcgcgcaaccugggcgacaaacauacaaguggcaauaaaccagguuaggcgccugauaggcaacgagaacuaccuagacuauaugacaagcaugaaacgguuuaagaacgaaucggaccccgaaggcgcgcucugguga

SEQ ID NO: 23930 - RNA, 9879 nt, Artificial Sequence
  derived and/or modified CDS sequence (opt11) from DENV-1__EU482615__SS-prME
ucuguaaccaugcugcucauguugcuacccaccgcccucgcauuucaccugacuacccggggaggagagccucacaugaucgugaguaagcaggagcggggcaagagccucuuguucaagaccuccgcaggagugaacaugugcacucugaucgcgauggaccugggggagcucugcgaggacacuaugaccuauaagugcccccagaucaccgaagcggagccugaugaugucgacugcuggugcaacgccacugacacgugggucacauacggcaccugcucgcaaaccggcgagcacagacgggacaagcggagcguggcccuggcuccccacgugggccuggggcucgaaacgcggaccgaaaccuggaugagcagugaaggggcauggaagcagauccagcgcgucgagaccugggccuuacggcaccccggguucacggugauagcacuuuuucucgcacacgccaucgguaccucuaucacccagaaaggcauuauuuucauacugcugaugcucgucacccccuccauggccaugcgcugcgucgguaucggcaaccgggacuucguggaggggcugagcggcgccacguggguggacgucgugcuugagcacgggucuugcguaaccaccauggccaagaacaaacccaccuuagauauugagcugcuuaaaacggagguuaccaaccccgcgauccuccgcaaacuuugcauagaggccaagaucaguaacaccaccacggacucccgauguccgacccaaggggaagcgacgcuaguugaggagcaagacgccaauuucguuugccgccggaccuuugucgaccgcggcugggggaauggcugcggucucuucggcaaggggagcuuauugacaugcgccaaguucaagugcguuaccaagcucgagggcaagaucgugcaguaugagaaccugaaguauuccgucauugugacagugcacaccggcgaucagcaccaggucggaaacgaaaccaccgaacacgggacaaucgcuaccaucacgccacaggccccgacgucugagauccagcuuaccgacuauggggcacucacccuggacugcagcccccggaccgggcuggauuucaacgagaugguucuccugacgaugaaagagaaauccuggcuggugcacaaacagugguuccucgacuugccucugcccuggacauccggggccagcacaucgcaggagacguggaaccgccaggaccuucuggugaccuucaagaccgcccacgcaaagaagcaggagguuguggugcuggggucccaggagggcgccaugcacaccgcccucaccggggccacggaaauccagaccagcgggaccacgacgaucuucgccgggcaccugaagugucgauugaagauggacaagcucacccuaaagggcacgucguacguaaugugcaccggaagcuucaaauuggagaaggaggucgcggagacgcagcaugggacggugcugguacaagucaaguaugaaggcaccgacgccccuugcaagauccccuucuccacccaggaugagaaagggguuacgcaaaauggccgccugaucaccgccaacccgauugugaccgauaaggagaagccgguaaacaucgagaccgagccgcccuucggggagagcuacaucgucgugggcgccggcgagaaggcgcucaagcuguccugguucaagaaggggucuuccaucggcaagauguucgaggccaccgcccgcggcgcacgccgaauggcaauccuaggggacaccgcgugggacuucggaagcaucggcggugucuuuaccagcguggggaagcuggugcaccaggucuuuggcaccgcauacggugugcuguucagcgggguuucguggacaaugaagauagggauaggcauacuucucaccuggcugggccucaacagccgcuccaccagccugucuaugaccugcaucgcuguggggaugguaacgcuguaccucggcgugaugguccaagcugacagcgggugcgugauaaacuggaagggccgugaguugaaaugcggguccggcaucuucgugaccaacgagguccacacguggaccgagcaauacaaguuccaggcugacagcccgaagcgguuaagcgcugccauagggaaggcuugggaagaaggggugugcggcauccgauccgcgaccaggcuggagaacaucauguggaagcagaucagcaacgagcugaaccacauccugcucgagaacgauaugaaguucacuguggucgugggggacgccaauggcauccuggcgcaggggaaaaagaugauccgcccacaacccauggagcauaaguacuccuggaaguccugggggaaggccaaaaucaucggcgcggacauccaaaacaccaccuuuauaaucgacgggcccgacaccccggagugccccgacaaccagcgugccuggaacaucugggagguugaagacuauggcuuugguaucuuuacgacaaacaucuggcuuaagcucagggacuccuauacccaaaugugcgaccaccggcucaugagcgcagccaucaaggacuccaaggccguccacgccgacaugggcuacuggauugaguccgaaaagaacgagacauggaagcuggcacgcgcaaguuucaucgaggugaagacguguacuuggcccaagucccacaccuuaugguccaacggcguguuggaguccgagaugaucaucccuaagaucuauggagggccgauaucccagcauaacuaccggccgggguacuuuacccagaccgccggacccuggcaccuggggaagcuagaguuagacuucgaucugugcgaggggaccaccguuguugucgaugagcauuguggcaacagagggccgagucuccggacaaccaccgucacaggaaagaucauccacgaguggugcugccgauccugcaccuuacccccccugagguuucgcggggaggacgguugcugguacgguauggagaucaggccugugaaggaaaaggaggagaaccugguucguagcauggucucggccggcagcggcgagguagacucauucucacuugggauccuaugugccagcaucaugauagaagaggugaugcguucccgcuggagccggaagaugcucaugacagguacacuggccguguuccugcugcugaucaugggccagcugaccuggaacgaccucauccgccugugcauaaugguaggagcgaacgcauccgaccgcauggguaugggcaccacauaucuggcccuaauggccaccuucaagaugcggccuauguuugccgucggucuacuguuccgccggcucaccagccgcgaggugcugcuccucacgaucggguugucccugguggcuagcguggagcuacccaacucccuggaggagcugggcgacggguuagcgaugggcauuaugaugcugaagcuccucacggaguuccaaccccaccaacuguggaccaccuugcuaucgcugaccuucaucaagacgacccugucccucgacuacgcguggaaaacuacggccauggcucugucaaucgucucccuguucccccucugccuuagcaccaccagucagaagacaaccuggcugccgguacuucugggcagcuucgggugcaagcccuugacgauguuccucaucacggagaacaagaucuggggccggaaguccuggccgcugaacgaggguaucauggccaucggaaucgucagcauccuccucuccucccugcugaagaaugacguuccccucgccgggccacuaaucgcaggggggaugcuuauugcaugcuacguuaucagcggguccagcgcggaucuaagucuggagaaggccgccgaggucaguugggaacaagaggcggaacauuccgguaccagccacaacauacuggucgaggugcaggacgacgggaccaugaagaucaaggacgaggagcgagacgacacguuaacgaucuuacuaaaggccacccuacuggcggucuccggcguguaucccaugucgauacccgcgacgcucuucgugugguauuucuggcagaagaaaaaacaacgguccgggguccucugggacacccccagcccucccgagguugagcgugccguccuugaugauggcaucuacagaauacuucaacgcggcuugcucgggcggucccagguuggcguggguguguuccaagacggcgucuuucacacgauguggcacgugacucgcggggcuguccugauguaucaggggaagcgacuggaacccagcugggccuccgugaagaaagaucuaaucagcuaugggggcggcuggcgcuuccaagggucuuggaauacuggagaggagguccagguaauagccgucgagccugguaaaaaccccaagaacgugcagaccacgcccggcacuuucaagaccccagaaggcgagguuggagcuaucgcacuggacuucaagcccggaaccagcgggaguccgaucgugaaccgugagggcaagauaguggggcuguacgggaaugguguggucacgaccagcgggacuuacguguccgccauugcccaagcgaaggccagccaagagggcccucuucccgagauugaggacgagguguucaagaagcguaaccugacuauuauggaccugcacccggggagcggcaagacuaggcgcuacuugccagccauuguucgggaagccaucaaacgcaagcugcggacucucaucuuggcgcccacucgcguaguugcgucggagauggcggaagcacugaagggcaugcccauucgcuaccagaccaccgcugucaagagcgagcauaccggucgugaaaucguggaccugaugugccacgcgacuuucaccaugaggcuacuguccccgguccguguucccaauuacaacaugaucauaauggacgaggcccacuuuaccgacccggcauccauagccgcucgugguuacaucagcacccgggugggaaugggcgaagcggccgccauuuuuaugaccgccacgccuccgggcagcgucgaggccuuuccacaguccaacgcggucauucaagacgaggagcgcgacaucccagaacggagcuggaacagcggcuacgauuggauaacggacuucccuggcaagaccgugugguucguccccagcaucaaguccgggaaugacaucgccaacugucugcgcaagaauggcaagcgcgucauacagcucagccgcaagaccuuugacaccgaguaccagaagacgaagaacaacgacugggacuacgucgugaccaccgacauaagcgaaaugggcgccaacuuucgcgccgacagggugaucgacccacggcgcugccugaagccugugauccugaaggauggccccgaacgugugauacucgcggggccgaugcccgucaccguugcuagcgccgcccagcggagaggccggaucggacggaaccaaaacaaggagggagaccaguacguguacaugggccaaccccugaacaacgacgaggaccacgcccacuggacggaggcgaagaugcugcucgauaacauuaacacucccgaagguauaaucccggcgcuguucgaaccagagcgcgagaaguccgcugccauagacggcgaguauagauugcggggagaggccagaaaaaccuuuguggaacucaugcgucgcggcgaccugcccguguggcugagcuacaaggucgcaucggagggcuuucaauauagcgaccggcguuggugcuucgacggggagaggaauaaccaggugcuagaggagaacauggacguggagaucuggaccaaggagggcgagcgcaagaagcugcggccccgcuggcuugaugcucggaccuacagugauccgcucgcccugcgcgaauucaaggaguucgccgcugggcgccgcuccgucagcggcgacuuaauacucgagaucggcaagcugccccagcaccugacgcuucgggcgcagaacgccuuagacaaucugguuaugcuccacaacucggagcagggcgguaaggcguaccgccacgccauggaggagcugcccgauaccauugagacgcugaugcuccuggcgcuaaucgccguguugacggggggcgucacgcuguuuuuccuuaguggcaagggccuagggaagaccuccauagggcugcuaugcgugaccgccagcuccgcucuccuguggauggccucgguggagccccacuggaucgcagcauccaucaucuuagaguuuuuucuaaugguccuacugaucccugagcccgaccggcaacgcacgccccaggacaaccagcuugccuaugucguuauagggcugcucuucaugauccucacgguagcagccaacgaaauggggcuacuggagacaaccaagaaagauuugggcauagggcauguagcggcagagaaccaucagcacgcaaccauguuagacguggaccuccggccggccagcgccuggacccuguacgcggucgccaccaccgugauaacucccaugaugagacacacgauagagaacaccaccgccaacauuucccugacagccaucgcaaaccaggccgccauccuuaugggccucgacaagggcuggcccaucagcaagauggacauaggggugccacugcuggcccuaggcugcuacucgcagguaaauccguugacgcugacagcagcgguguugaugcugguagcccauuacgccaucauaggcccgggccugcaggcgaaggccacgcgggaggcucaaaaacgcacagccgcugggaucaugaaaaacccgacggucgacggcaucguggccaucgaccucgacccgguggucuacgaugcuaaauucgaaaaacagcuaggccagaucaugcuguuaauccuguguaccagccaaauccugcugaugcgcaccaccugggcccugugcgagucuauuacacucgcgaccgggccguugacaacccugugggaggggagccccgggaaguucuggaacacuacaaucgccguauccauggcgaauauuuuccgggguagcuaccuggccggcgcggggcucgcuuucucccugaugaagucauuaggcgggggccgccgggguaccggcgcgcagggggagaccuuaggggaaaaguggaagcgccagcugaaccaguugucgaagagcgaauucaacacguacaagcggucaggcaucauggagguggaccgcuccgaggccaaggagggccucaagaggggcgaaaccaccaagcacgcugucucccgggguaccgccaagcugcggugguucguggaacgcaaccuggugaagccagaggguaagguaaucgacuugggcugcgggcgcggggguugguccuauuauugcgccggcuugaagaaagucaccgaggugaagggguacacgaagggcggaccagggcacgaagagccgauacccauggcaaccuacggcuggaaucuagucaagcuacauagcgguaaggacguuuuuuucaugccacccgaaaaaugugacacucuacugugcgacaucggcgaguccagcccgaauccaaccaucgaagaggggcgcacuuuaagaguguugaagauggucgaacccuggcugcgaggcaaccaauucuguauuaagauccugaaucccuacaugccuuccgugguggaaacccucgagcagaugcagcggaagcauggcgggauguuaguccguaacccccugagccggaacucgacccaugaaauguacuggguuagcugcgggacggggaauaucgucuccgccgucaauaugacgagccgaaugcuccugaaucgguucaccauggcgcaccgaaaacccaccuaugagcgcgacgucgaccugggagccggcacucggcacguggccgucgaaccggagguggcuaaccucgacaucauagggcagcgcauagagaacaucaagaacgagcacaaguccacguggcacuacgacgaggacaauccguacaagaccugggccuaccacggaucguacgaggugaagccaagcgggucggcuucuagcauggucaacggcgugguucggcugcugaccaagccgugggacgucauccccauggugacccagauugcuaugaccgacaccacgccguucgggcaacagcgagucuucaaagagaaaguggacacucggacgccccgcgccaagcggggcaccacccagaucauggaagucaccgccaaguggcucuggggguuccugucuagaaacaagaagccacggaucuguacucgcgaagaguucacccggaaaguccgcagcaacgccgcgauuggggcgguguucguggacgagaaccaguggaauagcgccaaagaggcugucgaggacgaacgguucugggaccuggugcaccgggagcgggagcuccacaagcagggcaagugcgcgaccugcguguacaauaugauggguaagcgagagaagaagcugggagaguucgggaaggccaaaggcucccgcgccaucugguacauguggcugggcgcgcgcuuccucgaguucgaagcucugggguuuaugaacgaagaccacugguuuagccgggagaacucccugucaggcgucgagggggaaggccuccacaagcugggguacaucuuacgcgacaucaguaagauccccggcggcaauauguacgcggaugacaccgcuggcugggauacgcggauuacagaggacgacuugcagaacgaggccaagaucaccgacauuauggagcccgagcaugcccuguuggcuaccagcauauucaaacucacguaucaaaauaaggugguucguguucagcgcccugcuaagaacggcaccgugauggacgugaucagccggcgcgaccaacggggaagcggucaggucggcaccuacgggcugaacaccuucacgaauauggagguucagcugauacgucagauggaauccgagggcaucuuccucccuagcgagcuagagacccccaaucucgccgagaggguacucgacuggcuggagaaacacggggccgagcgucugaagcggauggccaucuccggcgacgacugugucgugaagcccaucgaugaccgcuucgccaccgcgcucaccgcucuuaacgacaugggaaagguucguaaggauaucccccaaugggagccuagcaagggcuggaacgacuggcagcaggucccguucugcucccaccacuuccaucaauuaaucaugaaggacggacgcgagaucguggugccaugccggaaccaagacgagcuagucgggagagcuagaguuagccagggcgccggguggaguuuacgcgaaaccgccugccugggcaagucauacgcgcagauguggcagcuuauguacuuucaucggagagaccugcggcucgcagccaacgcuaucugcagcgcggugccagucgacugggugcccacgucacgcaccaccuggagcauacacgcccaccaccaauggaugaccacggaagacaugcucuccguauggaaccggguuuggaucgaggaaaacccauggauggaggacaagacccacgugucgucaugggaggagguaccauaucugggcaaacgcgaggaccaguggugugguagccugaucggcuuaaccgcucgcgccacuugggccacgaacauccaggucgcgauaaaccaggugcgucgccugaucgggaaugagaacuaccuggauuauaugacuucgaugaagcgguucaagucggaaucugaccccgaaggcgcccucugguga

SEQ ID NO: 23931 - RNA, 9879 nt, Artificial Sequence
  derived and/or modified CDS sequence (opt11) from DENV-1__EU482616__SS-prME
aguguuaccaugcuguuaauguuacugcccacugccuuggccuuccaucugacgaccagaggaggggagccucacaugaucgugaacaagcaggagaggggcaagagccuacuguuuaagaccagcgcggggguaaacauguguacccugauugccauggaucugggcgagcucugugaggacacgaugacuuauaagugcccucaaauuaccgaggccgagcccgaugauguggacugcuggugcaacgcgaccgacaccugggucaccuacgggaccugcucgcagaccggugagcaccggcgggacaagcgaaguguagcacuggcgccccacgugggcuugggccucgaaacccgcaccgagacguggaugaguagcgaaggcgccuggaagcagauacaacgggucgaaacgugggcccugaggcacccaggguuuacgguaauagcccuguuucuagcgcacgccaucggcaccuccaucacccagaaggggauaauauucauucugcugaugcucgucaccccgagcauggccaugcgcugcgucgggauugggaaccgagacuucguagaggggcuguccggcgccacguggguggaugucgugcuggagcacgggagcugcgugaccaccauggccaagaacaagcccacucucgacaucgaacuacugaagacggaggucacgaauccggcgauccuccgaaaguuaugcaucgaggccaagauuuccaacaccaccacagacucucggugcccgacccagggugaggccacgcucguggaggagcaagaugccaacuucgugugccgucggaccuucgucgaccgggggugggguaacgggugcgggcucuuuggaaagggguccuuacugaccugugcgaaguucaagugcguaaccaagcucgagggcaaaaucguccaguaugaaaaccugaaguacagugugaucgugacugugcacaccggcgaccagcaccaggucggcaacgagacaaccgagcacgguaccauagcgaccaucacaccccaggcccccaccuccgagauucagcugaccgacuacggggcucucacccuggauugcucuccccggaccggcuuggacuucaacgagauggugcuucugacaaugaaggagaaaaguuggcugguacacaagcagugguuccucgaccuaccucugcccuggaccuccggggccuccacgucacaagagaccuggaacagacaggaccuccuggugacguucaagaccgcccacgcgaagaagcaggagguggucguccugggcagccaagagggcgccaugcacacagcccugaccggggcgacggagauccagaccuccggcacuaccacgaucuucgccgggcaccugaagugccggcugaagauggacaaguugacccugaagggcaccagcuacgucaugugcaccgggaguuucaagcuggaaaaggagguugcggagacgcagcacgguacaguucuggugcaagucaaguacgaagggacugacgcccccuguaagaucccguucucgacacaggacgagaaaggagugacacagaacggaagguuaaucacugcgaacccgaucgugaccgauaaagagaagcccgucaacauagaaaccgagccgcccuucggggaaagcuauauaguggucggugccggcgagaaggcguuaaaacugagcugguucaaaaagggguccagcaucggaaagauguucgaggccaccgcucggggagcccgucggauggccauacucggcgauaccgcgugggacuucggcaguaucggcggagucuucaccagcguggggaaacuuguucaccaggucuucgggaccgcauacgggguucuguucuccggugugagcuggaccaugaagauaggcaucggcaucuugcucacuuggcugggccucaauagucgcaguaccucccugucgaugaccugcaucgcagucgggaugguuacgcuguaccucggcguuaugguccaggcggacuccgggugcguaaucaauuggaagggccgcgagcugaaguguggcucgggcauuuuugugaccaaugagguccacaccuggacggagcaguacaaguuccaggccgacuccccaaagcgccugagugccgccaucggcaaagccugggaggagggcguaugcggcaucagaagcgccacacggcucgagaauauaauguggaaacagaucuccaacgagcugaaccacaucuuacucgagaacgacaugaaauucacgguggucgugggagacgcgaacggcauccuggcgcaggggaagaaaaugauccgcccucagcccauggagcauaaguacucuuggaaguccuggggaaaggccaagauuaucggcgcggauauccagaauacaaccuucauaaucgacgggcccgauacaccggaguguccagacgaccagcgggcuuggaacauaugggaaguggaggacuauggauucgguaucuuuacgaccaauaucugguugaaacuucgcgacagcuacacccagaugugugaccaccggcugauguccgcggccaucaaggacagcaaagccguccacgccgauaugggcuacuggauagaguccgaaaagaacgagaccuggaagcuggcacgcgcgagcuucaucgaggugaaaacuugcacauggcccaaaucccacacccucuggucaaacggcgugcuggaguccgagaugauuaucccgaagauauacgggggcccaaucagccagcacaacuacagacccggguacuucacccagacggcaggccccuggcaucuggggaaguuggaacuggacuucgaccucugcgagggcacaaccgucgugguggacgaacacugcggcaaccgagggccguccuuaagaaccacgaccgucaccgguaagauaauccacgaguggugcugccgcagcugcacccugccgccccugcgguuccgcggggaagacggcuguugguaugggauggagauccgacccguaaaagagaaggaagagaacuuagugcgcuccauggucagcgccgguuccggagagguggauagcuuuagccuggggauucugugcgcaucgauuaugaucgaggaggugaugagaagucguuggagucgaaagaugcuuaugacaggcacucuggccgucuucuuguuacucaucauggggcagcuaaccuggaacgaucucauccgacugugcauuauggugggcgcgaacgccagcgaccgcauggggaugggcaccacuuaccuggcccucauggcaaccuucaaaaugcggcccauguucgccgugggacuacucuuccgccggcuaaccagucgcgagguccuguuguuaaccaucggccugucccugguugccaguguagagcuccccaauagcuuagaggagcuaggcgacggccucgccaugggcauuaugaugcugaaacugcuuacggaguuccagccacaccaacuguggaccacacugcuuucucugaccuuuaucaagaccaccuugagccucgacuacgccuggaaaaccacugccauggcgcuguccaucgucucucuguucccgcuuugccuguccacaacgucacagaagacuaccuggcuaccggugcuccugggauccuucggaugcaagccccugaccauguuccucaucacggagaauaagaucuggggccgaaagagcuggccccugaaugaggggaucauggccaucggcaucgucuccauccugcucagcucccuucucaagaacgacgugccccuggccggcccgcugaucgcugggggaaugcugaucgccugcuacgugaucagcgggagcuccgccgaccucucccuggagaaagccgccgagguguccugggaacaggaggccgagcacagcggcaccucccacaacaucuuaguugaggugcaggaugacgggaccaugaaaaucaaggacgaggagaaggacgacacccucacgauacugcugaaggccacccuccuggcaguaagcggcguguacccaauguccauucccgccacccuuuuugucugguacuucuggcaaaagaagaagcagcgcucuggggucuugugggauacccccuccccgcccgaagucgagcgggccguguuggacgacggcauuuauagaauccugcagcggggccugcuugggagaagccagguagggguugggguauuccaggacggcgucuuccauacgauguggcacgugacacguggggcugugcugauguaccaggguaagcgccuggagccauccugggccagcguaaagaaggaccucaucucguacggcgggggcuggcguuuccaggggagcuggaauacuggggaggaggugcagguuaucgcgguagagcccgggaagaacccgaaaaacgugcagaccacgcccgggaccuuuaagacccccgaaggcgagguuggcgccaucgcccuggacuucaagcccggcacuucgggaagcccgauagucaaccgugaaggcaagaucguaggccuguacgggaacggcguggucaccaccuccgggaccuacguaagcgcaauugcccaggcgaaagccucccaggagggcccccucccugagaucgaggacgagguauucaagaagcggaacuuaaccaucauggacuuacauccggggagcggaaagacgcgccgguaccuccccgcaaucguccgcgaggcgaucaagcggaagcugagaacccugauccucgcgccaacucgggugguggccagcgaaauggccgaagcccugaagggcaugccgauucgcuaccagaccacggcugucaaaagugagcacaccggacgcgagaucguggaccuuaugugccacgcgaccuucacaaugcggcugcugucaccggugcgcguccccaacuacaacaugaucauaauggacgaggcucacuucaccgacccagcauccaucgccgcccgugguuacauaucgacccggguggggaugggcgaagcggccgccaucuucaugaccgccacgccgccuggcagcgucgaggccuucccccaaagcaaugcgguuauccaagacgaggagcgggauauaccugagagguccuggaacagcggguacgacuggaucacggacuuccccggcaaaaccgugugguucgugcccuccauuaagagcgggaacgacaucgcgaacugccuccggaagaacggcaaacgugugauccagcucagccggaaaaccuucgacacagaguaccaaaagaccaagaacaacgauugggacuacgucgugaccacagacaucucggaaaugggugccaauuuccgcgccgaucgggucaucgacccccgucggugccugaagcccgugauccuuaaggacggccccgagcgggugauccucgcggggccgaugcccgucaccguggccuccgccgcccagcggcguggacggauaggccgcaaucagaacaaggagggggaccaguacguuuauaugggccaaccccugaacaacgaugaggaccacgcccauuggacggaggcgaagaugcuucucgacaacauaaauaccccugaggggaucaucccggcccuguuugagccggagcgggaaaaaucggccgccaucgacggggaauaccgguuacgcggggaggcccgcaagaccuucgucgaguugaugcgccggggcgaccuacccguguggcucucguacaaggucgccagcgagggcuuccaguacucagacagacguuggugcuuugacggggaacgcaacaaccaagucuuagaggaaaauauggacguugagaucuggaccaaggagggcgagaggaagaaguuacguccccgguggcuugacgcccgcaccuauagcgacccccucgcccugcgggaguuuaaggaguucgccgcugggcgccgauccgucucaggggacuuaaucuuagagauuggaaaacugccccagcacuugacgcuucgcgcgcagaacgcgcucgacaaccugguaaugcuucacaauagugaacagggcggaaaggcguaccggcacgcgauggaggaguugccugacaccaucgaaacacugaugcuuuuggcgcugauagcggugcucaccgggggcgucacacuauucuucuuguccgggaaaggucucgggaaaaccagcaucgggcugcugugcgugaccgccaguucggcccuguuguggauggccuccguggagccgcacuggaucgcggccagcaucauacuggaguucuuccucaugguccugcugaucccggagcccgaccgccaacgcacgccccaggacaaccagcucgccuacguugugaucggccuauuauucaugaucuuaacggucgccgcgaacgagauggggcugcuggagacgacgaagaaagaccuugguauuggccauguagcugccgagaaccaucagcaugccaccaugcuggacguggaccuccgcccugcauccgcuuggacgcuuuacgcggucgcuacgaccgugaucacacccaugaugagacacacgaucgagaauaccaccgccaacaucagccugacggcuaucgccaaccaggcggccauacugaugggcuuggacaagggcuggcccaucuccaagauggacauuggggugccgcuguuagcauuaggcugcuacucucaggucaacccccugacacuaacagccgcaguguuaauguuaguagcgcauuacgccaucauugggccgggcuuacaggccaaggccaccagagaggcucagaaacggacagcagccgggaucaugaagaaccccacggucgacggaaucgucgcuaucgacuuggauccgguagucuacgacgccaaguucgagaaacaauugggucagaucaugcugcuaauccugugcaccagccagauccugcuuaugcgcacaacgugggcgcugugcgagucuaucacccuagccaccgggccguugaccacgcugugggaaggcagccccgggaaguucuggaacacgaccauagcugugagcauggccaacauuuucagaggcuccuacuuggcuggagcgggucuggccuucagccugaugaagucccugggcggagggcggcgcggcaccggcgcccagggcgagacccucggggagaaguggaagcggcagcucaaccaacuuucuaaaucugaguucaauacguacaaacgcucagggaucauggagguggaccgaagcgaggcgaaggagggacucaagcgcggcgaaaccaccaaacacgcgguuagccggggaaccgccaaacuuaggugguucgucgagagaaaccuggugaagccggaaggcaagguaauugaccuggggugcgggcgcggaggguggagcuacuacugcgccggccucaagaaggugaccgaagugaagggauacacgaagggcggccccgggcacgaggagcccauccccauggcaaccuacgguuggaacuuggucaaguugcacucagggaaagacgucuucuucaugccgccggaaaagugcgauacacuacuaugcgacauuggcgagagcucgccaaacccgaccaucgaggagggccggacacugcgcgugcucaagauggucgagccuuggcugcggggcaaccaguuuugcaucaagauccugaaccccuacaugccgucggugguggagacccucgagcagaugcaaaggaagcacggaggcaugcugguccggaauccucugucaagaaacagcacccacgagauguacuggguauccugcgggaccgggaacauugugagcgcugucaauaugaccucccggaugcuccuuaacagguuuaccauggcacaucggaaacccacuuacgagcgagauguugacuuaggcgccggcacaaggcauguagcaguagagcccgagguggcaaaccucgacaucaucgggcagcgcaucgagaacaucaagaaugagcacaagagcacguggcacuacgacgaagacaacccguacaaaaccugggcauaccacggcuccuacgaggugaagcccagcggguccgcgagcuccaugguuaacggaguggugaggcugcucaccaaacccugggacgugauccccauggugacccagaucgccaugacggacacgacgccguucgggcagcagagggucuucaaggagaagguggacacccgcacaccccgugccaagcgcggcaccacccaaauaauggaggugacggcaaaauggcucuggggauuuuuaagccggaauaagaagcccaggaucuguacgcgugaggaguucacucgcaagguacguuccaacgccgcuaucggcgccguauucguggacgagaaccaguggaacagcgccaaagaggccgucgaggacgagcgcuucugggaccuagugcaucgagagcgcgaacuacauaagcagggaaaaugcgcgaccuguguuuacaacaugaugggaaagcgggagaagaaacuuggcgaguucgggaaggccaagggcagccgcgcaaucugguacauguggcugggggcccgguucuuggaguucgaggcccuaggguuuaugaacgaggaucacugguucucccgcgagaacagccuguccggcgucgagggggagggccuccacaagcugggauauauccuucgggauaucaguaagauaccgggcggcaauauguacgcggacgacaccgcggggugggacacgcgcaucaccgaggacgaccuccaaaacgaggccaagaucacugacaucauggagccggagcacgcccugcuugccaccuccaucuucaagcuaaccuaucagaacaagguggugcgcgugcaacgcccggcgaagaauggcaccgugauggacgugaucagccgccgggaccagcgcgggucagggcaagucggcaccuaugggcugaacacguucaccaauauggaggugcagcugauaaggcagauggaauccgaaggcauauuccuuccaucggagcuggagaccccgaaccuagccaagagaguacucgacuggcuggagaagcauggggcugagaggcuuaagcgaauggccaucagcggagacgacugcgucguaaagcccaucgacgaccgguucgccacagcgcuaaccgccuuaaacgacauggggaaggugcgcaaggacauaccacagugggaaccgucaaagggcuggaaugacuggcagcaggucccuuucugcagccaucauuuccaccagcuuaucaugaaggacggccgugagauuguggugcccugccgaaaccaggaugagcucgucgggcgggccagggugucacaaggcgcugguuggagccugcgcgaaacugccuguuuaggcaaauccuacgcgcagauguggcaacucauguacuuccaucgccgggaucugcgguuagccgcaaacgccaucugcagcgcggucccggucgauugggugcccaccagucgcaccacauggagcauccaugcucaccaucaguggaugaccacggaggacaugcucagcguguggaaccgcguauggaucgaagagaauccguggauggaggacaagacucacgucuccucaugggaggaggugcccuaccugggaaaacgggaagaucaguggugcggcucccugaucggccucaccgcccgcgccaccugggcgaccaacauccagguugcgaucaaccaggugcgccgccugaucgggaacgagaacuaccuggacuacaugacguccaugaaacgauucaagaacgaguccgacccagagggcgcacucugguga

SEQ ID NO: 23932 - RNA, 9879 nt, Artificial Sequence
  derived and/or modified CDS sequence (opt11) from DENV-1__EU482618__SS-prME
agcgugaccaugcugcucaugcugcugcccaccgcgcucgccuuccaccugacuacccgaggcggggaaccccacaugaucgugagcaagcaggagagaggcaaaagccuacuauucaagaccagcgcggggguaaacauguguacccugauagccauggaccugggcgagcugugcgaggacacgaugaccuauaagugcccccagauuaccgaagcagaacccgacgacguggacugcuggugcaacgccaccgacacgugggucaccuaugggaccugcagccagacuggagagcaccgccgagauaaacgcuccguugcacuggcgccccacgugggccugggacucgagacucggacugagaccuggaugagcucugaaggcgccuggaaacagauucagcgcgucgagaccugggcccugcggcaccccggguucacggugaucgcccuguuccucgcgcacgcgaucggcacaagcaucacgcagaaggggaucauauuuauccugcugaugcuugugaccccuuccauggcgaugcgcugcgucggcaucggcaaccgggacuuuguggagggacugagcggcgccacguggguggacguugugcuggaacacggguccuguguuaccacaauggccaagaauaagcccacccuggacaucgagcugcuuaagacagaggucacaaacccagcgauccuccgcaagcugugcaucgaggcaaaaaucagcaacaccaccacggacucacgaugcccuacccagggcgaggccacccuaguggaggagcaagacgccaacuucguuugccgcaggaccuucgucgaccgcggcugggggaauggcugcggacucuucggcaaagggagccugcuaacgugcgccaaguucaagugcgucacgaagcuagagggcaagaucgugcaguaugagaaccugaaguacucaguaaucgugaccgugcacaccggcgaccaacaccagguggguaacgagacgaccgagcacggaaccaucgcgacaauaacgccccaggcaccgacgagcgagauccagcuaaccgacuacggggcacucacacuggacugcucaccacggacgggccuggacuucaaugagauggugcuccugacgaugaaggagaaguccuggcugguccacaagcaaugguuccucgaccugccgcugcccuggacuuccggugccagcaccagucaggagaccuggaaccgacaggaucuccuggugacguuuaaaaccgcccaugcgaaaaagcaggaagucgucgugcuuggcucccaggagggcgcaaugcacacugcccuuaccggggcuacggagauccaaaccagcggcaccaccacgaucuuugcaggacaccucaagugccggcugaagauggacaagcucacccuuaagggcaccuccuacguuaugugcaccgggagcuucaagcuggagaaggaggucgcagagacacagcacggaacagugcugguacaggugaaguacgagggcacagacgccccgugcaagauccccuuuaguacccaggacgagaagggugugacgcaaaacggcaggcuaauaaccgcgaacccgaucgugacugacaaggagaagccggucaacauagagaccgagccacccuucggggaaagcuauaucguggucggcgccggugagaaggcgcuaaagcucuccugguuuaagaaagggagcuccauuggcaagauguucgaggcgacggcacguggggcccgccggauggccauucucggcgacaccgcgugggacuucgguagcaucggcggcgucuucaccuccguggggaagcuggugcaccaaguguucggcaccgccuacggggugcuguucucagguguuuccuggacgaugaagaucggcaucggcauacuccugaccuggcuaggccucaacucacgcuccacgucucuguccaugacauguauagccgucgggaugguuacgcuguaccucggggucaugguccaagccgacucugggugcgugauaaacuggaagggccgcgaguuaaagugcggguccgguaucuucgugaccaaugagguccacaccuggaccgagcaguacaaauuccaggccgacagcccgaaacggcugagcgcggcuaucggcaaggccugggaggagggggugugcggcauccgcuccgccacccgacucgagaacaucauguggaagcaaaucagcaacgagcugaaccacauccugcucgagaacgacaugaaguucacgguggucguuggggacgccaacggcauccuggcgcaggggaagaagaugauacgcccccagcccauggagcacaaguacuccuggaagucuuggggcaaggccaagaucaucggcgccgacauccagaacacuaccuucauuaucgacgggcccgacaccccggagugccccgauaaccagcgggccuggaauaucugggagguggaggauuacggguuugggaucuucacgaccaauaucuggcugaagcuccgcgacaguuacacacagaugugugaccaccggcugaugagcgcggcuaucaaggacuccaaggccguucacgccgacaugggcuacuggaucgagucagagaagaacgagacuuggaagcuggccagggcgagcuucaucgaggugaagacaugcaccuggccgaaaucacacacccucugguccaacggcguguuggagagcgagaugaucauaccuaagauuuacgggggccccaucucccaacacaacuaucggcccggguacuucacccaaacggccggccccuggcaccuggggaagcucgaguuagacuucgaccugugcgagggcaccaccgugguaguggacgagcacugcggcaaccgggggccgagucuccggaccacgaccguaacgggcaaaauaauccacgaguggugcugucgcuccugcacacuuccgccgcuccgguuccgcggggaggacggcugcugguacgggauggaaauccggcccgucaaagagaaggaagagaaccucguccgcaguauggucuccgccggcagcggggagguugauuccuucuccuuagggauccugugcgccagcaucaugauugaggaggugaugcggucccgcuggucucguaaaaugcucaugacgggcacccuggccguuuuccugcuccugaucauggggcagcuuaccuggaacgaucuuaucagacugugcaucauggugggcgcuaaugccuccgaccgcauggggaugggcaccacguaccuugcccucauggccaccuucaagaugcggccgauguucgccguggggcugcuguuucgcagacucaccagccgcgaaguccugcugcugacgauugggcugucccugguggcgagcguggaacuacccaacucacuggaggagcugggcgacgggcuugcuaugggcauuaugaugcugaagcugcucacggaguuccagccccaccagcuguggacgacccugcugagccugacuuucaucaagaccacgcuuucccucgacuacgcguggaagaccaccgccauggcccugagcaucgucucccuguucccccucugucugucaacgaccucccagaagaccacuuggcugccggugcuucugggcagcuucgggugcaagccccugaccauguucuugaucacggagaauaaaaucuggggccggaaauccuggccccuaaacgaagggaucauggccaucgggaucgugucuauccugcucuccagccuguugaagaacgacguuccccucgccgggccauugaucgccgggggcauguugauugcguguuacgugaucagcgggagcagcgcggaccugucccuggagaaggcagccgaggucagcugggaacaggaagccgagcacagcggcaccagccacaacauccugguggaggugcaggacgacggcaccaugaaaaucaaggacgaggaacgcgacgacacccucacgauccuucugaaggccacccuccuggcggucucugggguguauccuaugagcauccccgccacacuguucgugugguauuucuggcaaaagaagaagcagcgcuccgggguccucugggacacccccagcccucccgagguggagcgcgccgugcuggacgaugggauuuaccggauccugcagcgcggcuuacucggccggagucaggucggcguggggguguuccaggauggcgucuuccacacgauguggcacguaacccgcggggccguucugauguaccaagggaagcggcuggagcccagcugggccuccguuaagaaggaccucaucagcuacggcgggggcuggcgcuuccagggguccuggaacaccggcgaagaaguccaggugaucgcgguggagccagggaagaaccccaagaacgugcagaccacgccgggcacguuuaagacccccgaaggcgaggugggggcaaucgcccuggacuuuaagcccggcaccagugguuccccgaucgucaaccgggagggcaagaucgugggccuguacgggaacggcguggugacgaccagcgggacuuacgugucagccaucgcccaggcgaaagccagccaagagggcccccucccagagaucgaggacgagguguucaagaagcgcaaccugaccauaauggaccugcacccggggagcggcaagacgcggcgcuaccugcccgcuauuguccgggaggcaaucaaacggaagcugcggaccuuaauacuugcgcccacccgcgugguggccuccgagauggccgaggcacugaagggcaugcccauacgcuaccagacuacggccguuaagagcgagcauacugggcgggagaucguagaccuuaugugccaugcgaccuucaccaugcggcuccuguccccggugcggguccccaacuauaacaugaucauaauggacgaggcgcauuucacagaucccgcgagcauagccgcucgcggcuacaucuccacccggguagguaugggagaggcggccgcgauuuuuaugacugccacaccgcccgggucuguggaggccuucccccaauccaacgcggucauccaagacgaggagcgcgacauccccgagcggagcuggaauucuggauacgacuggaucacggacuuccccggcaagaccgugugguucgugcccagcaucaaguccgggaacgacaucgccaacugccuacgcaagaacggcaagcgggucauucagcucagccgcaagaccuuugacaccgaguaucaaaaaacgaagaacaacgacugggacuacguggugaccaccgacaucucggagaugggggccaacuuccgagccgaccgcgucaucgacccccggcgcugccugaagccggugauccugaaagauggccccgagcggguaauccucgccgggccgaugcccgucacgguggcaucggccgcccagcgacggggccguaucggccggaaucagaacaaggagggagaccaguacguguacaugggccaaccccugaacaaugaugaagaucacgcucauuggacggaagcgaagaugcugcucgacaacauaaacacccccgaggggaucaucccggccuuguucgagcccgagagggagaagagcgccgccaucgacggcgaguacagacuccgcggggaggcccgcaaaaccuuuguagagcucaugcgacgcggcgaucugcccgugugguugagcuacaaggucgcguccgagggcuuccaguauagcgaccggcgcugguguuucgacggggagcggaacaaccagguucucgaggagaacauggacguggagaucuggacgaaggagggcgagcgcaaaaagcugaggccccgcuggcuggacgcccggaccuacuccgauccgcucgcccugcgcgaguucaaggaguucgcggccggucggcgaagcgucucaggcgaccugauccucgagauuggcaagcugccgcaacaccugacgcuccgggcgcagaacgcucuggacaaccuaguaaugcuccacaauuccgagcagggugggaaagccuaccgccacgccauggaggagcugcccgacacgaucgagacccugaugcucuuagcgcugaucgccgugcucaccggcggcgucacgcuguucuuccuguccgguaagggccucggcaagaccuccaucgggcuguugugugugaccgccucuuccgcauugcuguggauggccagcguagaaccccauuggaucgcggccuccaucauccuggaauuuuuccucaugguccugcugaucccggagcccgaccggcaacgcacgccccaggacaaucagcucgccuacgucguaaucggccuguuauucaugauccucacugucgccgccaaugagauggggcugcuggagacgaccaagaaggaccugggcaucgggcacguggcggccgagaaccaccagcacgccacgaugcuggacguggaucugcggccggccagcgcguggacccucuacgcggucgcgaccaccgugaucacgcccaugaugaggcacacgaucgagaacaccacugccaacaucucccuuaccgcuaucgcuaaucaggcugccauacugaugggccuggauaagggcuggcccaucaguaaaauggauauuggagugccccugcuggcccucggcugcuacucccaggugaauccgcugacucuaacggccgcggugcucaugcugguggcucauuacgccaucaucggucccggauuacaggcuaaggccacucgggaggcgcaaaagcgcaccgccgccggaaucaugaaaaaccccacggucgacggcaucguagccauagaccucgacccaguggucuacgacgccaaguucgagaagcagcugggccagaucaugcugcucauccugugcaccagccagauccugcucaugcgcaccaccugggcgcugugcgaguccaucacgcuagcaaccgggccccucaccacacucugggagggcagccccgggaaauucuggaacacgaccaucgcggugucaauggccaacaucuuucgggguagcuaccuggccggagcgggacucgccuucucccugaugaagucccugggcgggggccgccgggggaccggagcccagggcgagacccucggggagaaauggaaacgccagcugaaccaguuauccaaaagugaguuuaauacguacaagcggaguggcaucauggagguggaccgcuccgaggccaaggaggggcucaagcgcggcgagacaacaaagcacgcggucagcagagguacugcuaagcugcggugguucguggaacgcaacuuggugaagcccgagggcaaggucaucgaccugggcugcgggcggggcggcugguccuacuacugcgccggacucaagaaggugaccgagguaaaggguuacacuaagggcggucccgggcacgaggagcccauccccauggccaccuacggguggaaucuugugaaacugcacucggggaaggacguguucuuuaugccgcccgagaagugcgauacccuccugugcgauaucggcgaguccagcccgaacccuaccauagaggaggggcgcacgcugcggguacucaagauggucgagcccuggcugcgcggcaaccaguucugcaucaagauccugaaccccuacaugccguccgugguggagacccucgagcagaugcagcggaagcacgguggcaugcuaguccgcaacccccugagccggaacuccacccacgagauguacuggguguccugcggaacggggaacauaguguccgccgucaacaugacgagccgcaugcuccugaaccguuucaccauggcgcaccgcaagcccaccuacgagcgcgacguggaccugggagccggcacccggcacguugccguugaacccgagguggcgaaccucgacaucaucggccaacgcaucgagaacauaaaaaaugaacacaaaucuacuuggcacuacgacgaggacaacccguacaagacgugggccuaccacggaucguacgaggugaagccauccgggagcgcguccucgauggucaauggcguggugcggcugcugaccaagccaugggaugucaucccaauggugacccagaucgcgaugacugacacaacgccguuugggcaacagcgcgucuucaaggaaaaaguggacacccguacaccucgggccaagcggggcacuacccagaucauggaggugaccgccaagugguuguggggcuuccuuucccgcaauaaaaagccccggaucugcacgcgcgaggaguucacccggaaaguccgcagcaacgccgccaucggugccguguucguggacgagaaucaauggaacagcgccaaggaggccgucgaggacgagcgguucugggaucuggugcaccgcgagcgggagcuccauaagcaaggcaagugugccaccugcguuuauaacaugauggggaagcgcgagaagaagcugggcgaguucgggaaggccaagggaucacgagccauaugguauauguggcugggcgcccgcuucuuggaguuugaggcgcugggguucaugaacgaggaccacugguucagccgggagaacaguuuaagcggcgucgagggggagggccuccacaagcugggguacauccugcgcgacauauccaagauuccaggcggcaauauguacgcagaugacaccgcuggaugggauacgcgaaucacugaggacgaccuucagaaugaggccaagaucacggacaucauggaacccgaacaugcguuacuggcuaccagcaucuucaagcucacuuaccagaacaagguggugcgcguccagcgccccgcgaagaacggcaccgugauggacgugaucucccggcgcgaccagcggggaagcggccaggucggcacguacggacugaacaccuuuaccaauauggaggugcagcugaucaggcagauggaguccgaggggaucuuccuacccagcgaguuggagacgccgaaccuggcagagcgggugcucgauuggcuggagaagcauggggcagaacgccucaagcggauggccaucagcggggacgacugcguaguuaagcccaucgaugaccgcuucgccacagcgcucaccgcgcuuaacgacauggggaaggugcggaaggauaucccccagugggagcccagcaagggcuggaaugacuggcagcaggucccuuuuugcucacaccacuuccaucagcugaucaugaaggacggccgcgagauugugguacccugcaggaaccaggacgagcuagucgggcgcgcccgggugucucagggcgccggauggucccuucgcgaaaccgcuugccugggcaagagcuacgcgcagauguggcagcucauguacuuucaccgccgcgacuugcggcuggccgccaacgcuaucugcuccgcggugcccgucgacugggugcccaccagucgcacaaccuggucuauccaugcccaccaccaguggaugaccacggaggacaugcucuccguguggaaccgggucuggauugaagagaacccguggauggaggacaagacccacgugagcucgugggaggaggugcccuaccugggaaagcgcgaagaccaguggugcggcagccuaaucggccuaaccgccagagcuacgugggccacgaauauucaagucgcgaucaaccaggugcggcgccugauugggaacgagaacuaccuggacuacaugacauccaugaaacgguucaagaacgaguccgaccccgagggcgcguuaugguag

SEQ ID NO: 23933 - RNA, 9879 nt, Artificial Sequence
  derived and/or modified CDS sequence (opt11) from DENV-1__EU482619__SS-prME
agcgugacaaugcugcugaugcugcugcccaccgcccucgcuuuccaccugacgacacggggcggggagccccacaugaucgugaguaaacaggagcggggcaagucucucuuauucaagaccagcgcgggggucaauaugugcacccugaucgccauggaccucggcgagcucugugaggacaccaugaccuauaagugcccccagauaacugaagcggagcccgacgacguggacugcuggugcaaugccacagacaccugggucaccuaugggaccugcagccagaccggcgagcaccggcgggacaaacgcucaguggcgcuggcuccccacgugggucuggggcucgagacgcggacggagaccuggaugagcagugagggcgccuggaagcagauccagcgcguagagaccugggcccugcggcacccaggguucacagugaucgcccuguuccucgcgcacgccaucggcaccagcauuacccagaaagggauuaucuucaucuugcugaugcucguuacucccuccauggccaugcggugugucggcaucggcaaccgggacuucguggaagggcuaagcggcgccacguggguagacguugugcuggagcacggguccugcguaacuaccauggccaagaacaagcccacccucgacaucgagcuacugaagacggaggucacuaaccccgcgauccuccgcaagcuguguaucgaggccaagauaagcaacaccacgacggacucccggugcccuacccagggagaggccacccugguggaggagcaggacgccaacuucgugugucgccggacguucgucgacagagggugggguaauggcugcggccucuucgguaaggggagccugcugacgugugcgaaguucaaaugcgugaccaagcucgaaggcaagaucgugcaguacgagaaccuaaaguacagugucaucgugaccgugcacaccggcgaccagcaccaggucgggaaugagacaaccgagcauggcacuaucgcuaccaucacgccccaggcccccacgagcgagauucaguugaccgacuacggggcccucacccuggacugcagcccccgcaccggccuagauuucaacgagauggugcuccugacaaugaaggaaaaguccuggcugguccacaagcaaugguucuuggaccugccgcugcccuggaccuccggagcaagcacaagccaggagaccuggaacagacaggaccuccucgugaccuuuaagaccgcacacgcgaagaagcaggaggugguagugcugggcagccaggaaggcgccaugcacacggcccuuaccggugccacggagauccagaccagcggcaccaccaccauuuucgccgggcaccugaagugccguuuaaagauggauaagcucacccugaagggcaccuccuacgugaugugcaccgggagcuucaagcuggagaaggaggucgcggagacucagcacggcaccgugcuugugcaggugaaguacgaggggaccgacgcccccugcaagaucccuuucuccacacaagacgagaaaggggugacacaaaacggccgccucaucaccgccaaccccaucgugacugacaaggagaagcccgucaacaucgagaccgagccgcccuucggggagucuuacaucguggugggagccggcgaaaaggcgcugaagcuguccugguucaagaaagggagcuccauuggcaagauguucgaggccacggcccgcggggcgcgccguauggcuauccucggcgacacagcgugggauuucgggagcaucgggggcgucuucaccuccguggggaagcuggugcaccaggucuucggcaccgccuacgggguccuauucagcggcguguccuggacgaugaagaucgggaucggcauacuccuaaccuggcugggacugaacucccgcuccaccagccuguccaugaccugcaucgccgucgguaugguaacgcuguaccucggcgugauggugcaggcggauagcgggugcgugaucaacuggaagggccgcgagcucaagugcggguccggcauuuucgugaccaacgagguccauaccuggaccgagcaguacaaguuccaagcggacucuccgaagcggcugagcgcggccaucggcaaggccugggaggagggggugugcgguauaagauccgcaacacggcucgagaacaucauguggaagcagauaagcaacgaacuaaaccacauccugcucgagaacgacaugaaguucacgguggucgugggggacgccaacggcauccuggcacaagggaagaagaugauccguccccagccaauggaacacaaguacuccuggaaguccuggggcaaggccaagaucaucggcgccgacauccaaaacaccacguucauaauugacggacccgacacaccggaaugccccgacaaccagcgggccuggaacaucugggagguggaggacuacggcuucgggaucuucaccaccaacauauggcugaaacuccgcgacuccuacacccagaugugcgaccaccggcugaugagcgcggccaucaaagacuccaaggcuguccacgcagauaugggcuacuggaucgagagcgagaagaaugagaccuggaagcuagcccgagcgagcuucaucgaggugaagacgugcaccuggcccaagagccacacccucugguccaacggagugcuggaaagcgaaaugaucauccccaagaucuacgggggaccgaucucccagcacaacuaccggccuggguacuuuacccaaacggccggccccuggcacuuggggaagcucgagcuggacuucgaucugugcgagggcaccaccgucguuguggaugagcacugcggaaaccgagggcccagccuccggacuacgaccgugaccggcaagaucauccacgaguggugcugccguuccugcacccugccgccccugcgguuccgcggggaggacggaugcugguacgggauggaaauccggccggugaaggagaaggaggagaaucucguuaggagcauggucagugcuggguccggugagguggauucguucucacuuggaauccugugcgccucgaucaugaucgaggaagugaugcgaagucgcuggagccggaagaugcucaugacgggaaccuuagccgucuuccugcuccucauaauggggcaguugaccuggaacgaucucauccgccuguguauuaugguuggugcaaacgccuccgaccggauggggaugggcacaacguaccuagcacucauggccacauuuaagaugcgaccgauguuugccguggggcugcuguuccgccggcucacuagccgcgagguccugcuauuaaccaucggguuaucccugguagcuagcguugagcucccgaacucccuggaggaguugggcgacgggcucgccauggguaucaugaugcuaaaacugcucacggaauuccagccucaccagcuguggaccacccuguugagucugaccuucaucaagacgacccuuuccuuagacuacgcguggaagaccaccgcuauggcucugucgaucgucucccuguuuccccuuugucuguccacgaccucacagaagacaaccuggcugccgguucuccugggcagcuucgggugcaaaccccugaccauguuccucaucacggagaacaagaucuggggccggaaguccuggcccuuaaaugaggggaucauggccaucggcaucgucagcauccugcuaucaagccuacucaagaaugacgugccccucgccgggccgcugauagccggcgggaugcucaucgccugcuauguuaucagcggguccagcgcggaucucucccuggagaaggccgccgaggucagcugggagcaggaggccgagcacuccggcaccagccacaacauacugguggaaguucaggacgacggaacgaugaagauuaaggaugaggagcgcgacgacacccugacgauccugcugaaggccacgcuccuggcggucuccggcguguacccaaugagcauccccgccacccuguucguaugguacuucuggcagaagaagaaacagcgcuccgggguccucugggauacacccagcccgcccgaaguggagcgcgccgugcuggaugacggcaucuaucggauccugcagcgcggacuacuggggcggucccaggucggaguggggguguuccaggauggcgucuuccacacgauguggcacguuacccgcggggcggugcugauguaccagggcaagcgacuggaaccgagcugggccuccgugaagaaggaccucaucagcuacggugggggcuggcgcuuccagggguccuggaacaccggcgaggagguccaggugaucgcggucgagcccgguaaaaacccgaagaacgugcagacuacgcccggaaccuuuaagacccccgagggcgaggugggggcgaucgcccuggauuucaagcccgggaccucuggguccccgaucgucaaucgggagggcaagauugugggucuguacgguaauggcguggugacaaccagcggaaccuauguguccgccaucgcccaggccaaagccagccaggaaggaccgcuccccgagaucgaggacgagguauucaaaaagcgcaaccugacuaucauggaccugcacccggggucaggcaagacccggcgcuaccucccggccauagugcgggaggcaaucaagcgcaagcugcggaccuuaauccucgcgcccacccgcgugguggccuccgagauggccgaggcccugaaggggaugcccaucagguaccagaccacggccgucaaguccgagcacaccgggcgggagaucguagacuuaaugugccacgcaaccuucaccaugcgccuccugagcccggugcggguccccaacuacaacaugaucaucauggaugaagcccacuucacggauccagccagcaucgccgcccggggcuauaucuccacccggguagggaugggcgaggcagccgccaucuucaugaccgcaacaccgcccgggucagucgaggccuucccccaguccaacgcagucauccaggacgaggagcgcgacauccccgaacguagcuggaacuccggcuaugacuggaucacggacuuucccggcaaaacugugugguucgugcccagcaucaaguccggaaacgacaucgccaacugccugcgcaagaacggcaagcgggucauccagcucagccgcaaaaccuuugacaccgaauaccagaagacgaagaauaacgauugggacuauguggugaccaccgacaucuccgagaugggugccaacuuccgcgccgaccgcgucaucgacccccggaggugccuuaagcccgucauccugaaggauggccccgagcgggugauccucgcggggccuaugcccgucaccguggccagcgcggcccagcgccguggcagaaucggacggaaccagaacaaggagggggaucaguacguauacaugggacagccccucaacaaugacgaggaccaugcccacuggacggaggcgaagaugcuacucgauaacaucaacacccccgaagggauuaucccggccuuauuugagcccgaacgcgagaaguccgccgccauagacggcgaguaccgccugcgcggugaggcccgcaaaaccuuugucgagcucaugcggcggggcgaccugccgguauggcugagcuacaaggucgcguccgagggcuuccaguacagcgaccggagauggugcuucgacggggagcguaacaaccaggugcucgaggagaauauggacgucgagauauggaccaaggagggcgaacgcaagaaguuacgaccccgguggcuggacgccaggaccuauuccgacccgcucgcccugcgcgaguucaaggaguucgcggccgggcggcgcagcgucuccggcgaccugauccuggagaucggcaagcugccccaacauuugacguuacgggcucagaacgcccucgauaaccuggucaugcuccacaacuccgagcagggcgggaaggccuaccgucacgccauggaggaguuaccugacaccaucgaaacccugaugcuccuagcgcugaucgcugugcucaccgggggcguuacgcuguucuuccuuagcgggaagggcuuggggaagacauccaucgggcugcugugcgugaccgcguccuccgcgcucuuauggauggcgagcguagaaccccacuggauagcggccuccaucauccuggaguucuuccuaaugguccugcugaucccagagcccgaucggcagcgcacgccccaagacaaccagcucgccuacguugugaucggccuguuauuuaugauccucacggucgccgccaacgagaugggacugcuggagaccacaaagaaggaucucgggauagggcacguggcggcagagaaccaccagcacgcgaccaugcuggacgucgaccugcggccggccagugccuggacgcucuacgcggucgccacuaccgugaucacccccaugaugaggcacaccauagagaauaccaccgcgaacaucucacugaccgccaucgccaaccaggcggccauccuuaugggccucgacaagggcuggcccaucagcaaaauggacauaggcguuccucugcuggcucucggcugcuacagccaggucaacccgcugacgcugaccgccgcgguguuaaugcugguggcccacuacgccaucaucgggcccgggcugcaggccaaggccaccagggaggcucagaagcgcaccgccgccgggauaaugaagaaccccacggucgacggcaucguggccaucgaccucgaccccguggucuacgaugccaaguucgagaaacagcuaggccagaucaugcugcucauccugugcaccagccaaauccugcucaugcgcaccaccugggcgcugugcgaguccaucacgcuagcuacugggccgcucaccacucugugggaaggcucgcccgggaaguuuuggaauacgaccaucgccguguccauggcaaacaucuuucggggcucguacuuagccggcgcggggcuggccuucucccuuaugaagucccuuggcgggggcagacgggggacaggcgcgcagggagagacccuuggugagaaguggaagagacaacugaaccaguuguccaagagcgaauuuaacacguacaagcggucgggaaucauggaaguggaccgauccgaggcaaaggagggccucaagcggggcgagaccaccaaacacgcgguaagccgcgggaccgccaagcuacggugguucguggagcgcaacuuagugaaacccgagggcaaggucaucgaucucggcugcggccggggcgggugguccuacuacugcgccggccucaagaagguaaccgaggugaagggauacacaaaggggggccccggucacgaagagccgauucccauggcaaccuacggcuggaacuuagucaagcuacacagcgggaaggacgucuucuucaugccgcccgagaagugcgacacccuccuuugcgacaucggugaauccucuccgaacccuaccaucgaggaggggcgcacgcugcggguccucaagauggucgagccguggcugcgcggcaaccaguucuguauaaagauacuaaaccccuacaugccguccguaguggagacccucgagcagaugcagcggaagcacggcgggaugcuugugcgcaacccgcugucucggaacuccacccaugagauguacugggugagcugcggcaccgggaauauuguuucugcuguaaacaugacgucacgcaugcuccugaaccgguucaccauggcgcacagaaagccuaccuacgagcgcgacguagacuugggagcagguacccggcauguggccgucgagcccgagguugcgaaccuagacaucaucgggcagcgcaucgagaacauuaagaacgaacauaaauccacguggcauuacgaugaagacaacccguacaagaccugggccuaccacggcagcuacgaggugaagccuuccgggagcgcaucuagcauggucaacggcguggugcgguuauuaaccaaacccugggacgucauccccauggucacccagaucgccaugaccgacaccaccccuuucgggcagcagcgcgucuucaaggagaagguagacacgagaacaccccgcgccaagcggggcaccacccagaucauggaggugaccgcgaaguggcucuggggcuuccugucccgcaacaagaagccgcggaucugcacgcgugaggaguucaccagaaagguccgcaguaacgcggcgauuggggccguguucaucgacgagaaucaguggaacagcgccaaggaagccguggaggacgaacgguucugggaccuaguccacagagagcgggagcuccacaagcagggcaaaugcgcuaccuguguguauaacaugaugggaaaacgcgaaaagaagcucggcgaguucgggaaagcuaagggcucccgggccaucugguauauguggcugggcgcacgcuuccucgaguuugaggcccuagguuucaugaacgaggaucacugguucagccgggagaacucccugaguggcguagagggggagggccuccauaagcuuggguacauccugcgcgacauauccaagaucccgggcggcaacauguacgcggacgacaccgccgggugggacacgcguguaaccgaggacgaccuacagaacgaggccaagaucaccgacaucauggagccagagcacgcccugcuggccaccagcaucuucaaacuaacauaccagaacaagguggugaggguccaacgcccugcgaagaacgggaccgucauggacguaaucucucgacgcgaccagcgggggagcggccagguugggaccuaugggcugaauacauuuacgaacauggaggugcagcugauccgccaaauggaguccgagggcaucuuccucccuuccgaguuggagaccccgaaccuggccgagagagugcucgacuggcuggagaagcacggggccgagcggcugcggcgaauggccaucuccggcgaugacugcguugugaagcccaucgacgaccgguucgccaccgcucucaccgcccuuaacgacauggggaaggugaggaaggauaucccccagugggagcccagcaagggcuggaacgacuggcagcaagucccguucugcucccaccacuuccaccagcugaucaugaaggacggcagagaaaucguggugcccuguaggaaccaggacgagcucgucgggcgggcacgaguuagccagggagccggguggucccuccgagagaccgcaugcuuaggcaagagcuacgcgcagauguggcagcugauguacuuccaccgucgugaccugcgccuggccgccaaugccaucugcuccgcggugccagucgacugggugcccacgucacggacgaccuggucaauccacgcccaucaccaguggaugaccaccgaggauaugcuguccguguggaaccgcgucuggauagaggagaacccguggauggaggacaagacacacgugagcuccugggaggaggugccguacuuagggaagcgcgaggaccaauggugcggcagccugauuggccucaccgcccgggccacgugggccacgaacauccaagucgcgaucaaccagguccgccggcugaucgggaacgagaacuaccuggauuacaugaccuccaugaagcgcuucaagaacgagucagaucccgagggcgcucucugguga

SEQ ID NO: 23934 - RNA, 9879 nt, Artificial Sequence
  derived and/or modified CDS sequence (opt11) from DENV-1__FJ898433__SS-prME
agcgugacgaugcugcucauguugcuucccaccgcuuuggcuuuccaccugacgacccggggcggggagccccacaugaucgugagcaagcaggaacggggcaagagccuccucuucaagacgucugccggggugaacauguguacccugauagccauggaucugggcgagcucugcgaggacaccaugacuuacaaaugcccucaaaucacggaggcagagcccgacgacguggacugcuggugcaacgccaccgauacgugggucacauacgggaccugcagccagacgggugagcaccgucgggagaagcgaucaguggcccuggcgccccacgugggccuggggcucgaaacgagaacugagaccuggaugaguucugagggcgcguggaagcagauccagcgggucgagaccugggcacugcggcaccccggcuucacgguuaccgcucuguuccucgcgcaugccaucggcaccucaaucacccaaaaggggaucaucuucauccugcugaugcucguuacucccagcauggcuaugcgcuguguagggaucggcaaucgggacuucguugaaggccucagcggcgccaccuggguggaugucguacuggaacacggguccugcgugacuaccauggcaaaaaacaagcccacccucgacaucgagcugcugaagaccgaggucaccaaccccgcgauccuccgcaagcugugcauagaggccaagaucagcaacacaacuacggacucccggugccccacccagggcgaggccacucuggucgaggagcaagacgcgaacuuugugugucgacguacguucgucgaucgcggcuggggcaacggcugcggccucuucggcaaagggagccuccugacaugugccaaguucaaaugcgugaccaagcucgagggcaaaaucgugcaauaugagaaccugaaguacuccgucauugugacggugcacacgggcgaccaacaccaggucggcaacgagaccaccgagcauggcaccaucgcgaccaucacgccacaggcccccaccagcgagauccaacugaccgacuacggggcccucacccuagacugcucaccgaggacggguuuagacuucaacgagauggugcuccucacaaugaaggaaaaguccugguuaguccacaagcagugguuccucgacuuaccacugcccuggaccagcggggccagcaccagccaagagacguggaaucgacaggaccuccuuguuaccuucaagaccgcccacgcgaagaagcaggaggugguagugcugggcucccaagagggcgccaugcauaccgcccucacgggugccaccgagauccagaccagcgguaccacaaccaucuucgcuggacaccugaaaugccggcugaagauggauaagcucacccugaagggcaccuccuacgugaugugcacuggguccuucaagcuggagaaggagguagcggagacccagcauggcacagugcuggugcaggugaaguacgagggcaccgacgcgcccugcaagauccccuucuccacccaagaugagaagggggugacgcagaauggccgacucauuacggccaacccgaucgugaccgacaaagagaaacccgugaacaucgagacggagccacccuucggggagagcuacaucguggugggcgccggcgagaaggcucugaagcugucuugguucaagaaagggucauccaucggcaagauguucgaggccaccgcccgcggggcgcgacguauggcgauacugggggacaccgcuugggacuucggauccaucggaggcgucuucaccuccgugggaaagcugguucaccaggucuucggcacggcuuacggggugcuguucagcggcgugaguuggaccaugaaaaucgggaucgguauccucuugaccuggcugggccucaacucacgcuccacaucacuguccaugacgugcauagccgucgggauggugacccuguaccucggcgugauggugcaggccgacagcgggugcgucaucaacuggaagggccgugaauuaaaguguggguccggaauuuucgugaccaacgagguacauaccuggaccgagcaguacaaguuucaggccgacagcccgaagcggcuuagcgcggcuaucggaaaggcgugggaggagggcgucugcggcaucagguccgccacgcggcuggagaacaucauguggaagcagaucagcaacgagcugaaccauauucugcucgagaacgacaugaaguucaccguggucgucggggacgccaacggcauccuggcgcaggggaagaagaugauucguccccaacccauggagcacaaguauuccuggaaguccugggguaaggccaagaucaucggagcggacauucagaacaccaccuucaucaucgacggaccugacaccccggaaugccccgacaaccagcgggccuggaacaucugggaaguggaggacuacggguuuggcaucuucacaaccaacaucuggcugaagcuacgggacuccuacacucaaaugugcgaccaucggcugaugagcgcagcaauuaaagacuccaaggccguccacgccgacaugggcuacuggaucgagucagaaaaaaacgaaacuuggaaguuagcccgcgcgaguuuuaucgaggugaagaccugcaccuggcccaagagccauacgcucugguccaacggcguauuagaaagcgagaugaucaucccgaagaucuacggggggccgaucucacagcacaauuaucggccgggcuacuucacucagaccgccggccccuggcaccuggggaagcucgagcuggacuucgacuccugcgagggcaccacgguggucguggaugagcacuguggcaacagagggccgucguuaagaacgaccacugucaccggcaaaaucauccaugaauggugcuguaggagcugcacgcugccgccacuucgguuccgcggggaggacggcuguugguacgggauggagaucaggccggugaaagagaaggaagagaaccuggugcggagcauggucagcgcuggcagcggugaaguggacuccuucagucucggaauccugugcguguccaucaugaucgaagaggugaugcggagccgcuggucccgcaagaugcugaugacugguaccuuagccguuuuucuucuguuaauuauggggcagcugaccuggaaggacuugauccgccucugcaucauggugggcgccaacgcgucggaccgcauggggauggguacgaccuaccuggcgcugauggccaccuuuaagaugcggccgauguucgccguaggccuccuguuuaggcggcugacaucccgcgaagugcuccugcugacgaucgggcucagccugguggccuccgucgagcuaccuaacagccucgaagaacugggcgauggccuggcgaugggaaucaugaugcucaagcugcugacagaguuccacccucaucagcucuggaccacgcuguugucccuaacguucauaaagaccacccucucgcuggacuaugcauggaagaccacggcaauggcauugucaaucgugagccuguucccacucugcuuaucgacaacgucgcagaagaccaccuggcugccgguccugcucggguccuucggguguaagccacugacgauguuucucaucaccgagaacaagaucuggggccgcaaaagcuggccccucaacgagggcaucauggcgaucggcaucguguccaucuuacugagcagccuccugaagaaugaugugccccuggcaggaccucucaucgccggcggaaugcugaucgcgugcuacguaaucuccgguucguccgcugaccugagcuuggagaaggcggccgagguguccugggagcaggaggcugagcauagcgguacuucccacaacauccugguggagguacaggacgacgggacaaugaagauaaaggacgaggagcgcgacgacacguuaaccauacuccucaaggcuacccugcuagcagugagcggcguauaccccaugucgauccccgcgacacucuucgucugguacuucuggcagaagaagaagcagcguagcgggguccugugggacacacccucaccacccgaaguugagcgcgccguguuggacgacggcaucuaccguauccugcaacguggccugcugggccggagccaagugggcgucgggguuuuccaggacggaguuuuccauaccauguggcacgugacccgcggggccguccucauguaccagggcaagcggcuggagccguccugggccagcgugaaaaaggaccugaucuccuacggcgggggcuggcguuuccaggggagcuggaacaccggagaagaggugcagguaaucgccguggagcccgggaagaauccgaaaaaugugcagacaacccccggcaccuucaagacacccgagggugaagucggggcgaucgcccucgauuucaagcccggcacguccgguucaccgaucgugaaccgggagggaaaaaucguuggccuguacgguaacggcguagugaccaccuccgggacguacgucagcgcgaucgcccaggcaaaagcgagccaggagggcccccugcccgaaauugaggacgaggucuucaagaagcgcaaccuaacgaucauggaccuucacccgggguccggcaaaaccagaagguaccugcccgccaucgugcgugaggccaucaagcgcaaguugaggaccuugauccuggcacccacccgcguggucgcgagcgagauggccgaggcccuaaaaggcaugcccauccgguaccagacgaccgccgugaaguccgagcacaccgggcgagagaucguggaccugaugugccaugccaccuucacgaugcgccuucugagcccgguacgcgugccaaacuacaacaugaucauaauggacgaggcacacuucacagaccccgcuucuauagccgcccggggcuauaucagcacccggguggggaugggcgaggccgcggccauuuucaugacggccacgcccccaggcucagucgaagccuucccccagagcaacgccgugauccaggaugaggaaagggacauccccgagaggagcuggaacagcggcuacgacuggaucaccgacuuucccggcaagacugugugguucguacccuccauuaaaagcggaaaugacauugcuaacugucugcgcaagaacggcaagagagugauccagcucagccggaaaaccuucgacacggaguaccagaagaccaagaacaacgauugggauuaugugguaaccaccgauaucagcgaaaugggggccaacuuccgggccgaccgcgugaucgacccccggagaugccucaagcccgugauucuuaaggacggacccgagagggucauccuggccgggccuaugcccgugacgguggcgagugccgcccagcgucggggccgcaucggccggaaccagaacaaggagggugaccaguacguauacaugggccagccccucaacaacgaugaggaccacgcccacuggaccgaggccaagaugcugcuggacaacauuaacacccccgaggggaucauuccggcccucuucgagcccgagcgcgagaagagcgccgccaucgauggcgaguaccgccugcgcggggaagcaaggaagaccuuuguggaauuaaugcggcgcggcgaccuccccguaugguuauccuacaagguugccucugagggcuuccaguacagugaucggcgcuggugcuucgacggggaacguaacaaccaaguucuggaggagaacauggacguagagaucuggaccaaggagggcgaacgcaaaaagcuaaggccccgguggcuggacgcgcggacuuacagugacccgcuggcccuucgcgaguucaaggaguucgccgcugggcggcgcagcgugaguggggaccugauccuggaaaucggaaaacucccccagcauuugacucugcgggcccagaacgcgcucgacaaucuggugaugcugcacaauagcgagcagggcgggaaggccuaccgccacgcgauggaggagcuucccgacaccaucgagacccugaugcuacucgcucugaucgcgguccugaccggaggggugacccuguucuuccuguccggaaaagggcugggcaaaaccagcauugggcuccugugcgugaccgcguccucugcccugcuguggauggccagugucgagccccacuggauagccgcuagcauuauccuggaguucuuccugauggugcuccugauaccagagcccgaccggcagcgcacgccccaagacaaccagcuggccuacguggucaucggccuccuuuucaugauccugaccguugccgcuaaugagauggggcuacuggagaccaccaagaaggaucugggaaucggucacguggcugcagagaaccaccagcacgccacgaugcucgacgucgaucugcggccggccuccgccuggacacuguacgcgguggcgacuaccgugauuacgcccaugaugcgccacacaaucgaaaauaccaccgccaacauuagccucacggccaucgcuaaccaggccgcgauacugaugggacucgauaaggguuggcccaucucuaagauggacauagguguuccccuccuugcccugggcugcuacagccaggugaacccguugacgcugacagccgccgugcugaugcucgucgcgcacuacgccaucauuggacccggccugcaggcuaaggccaccagggaagcccagaagcguacggcggccgggauuaugaagaacccuacgguggacggcaucguggccaucgaccuagaucccgucguguacgaugccaaguuugagaagcaguugggccaaauuaugcugcugauucuaugcaccucccagauacugcugaugaggacuacuugggcccucugcgagagcauuacccuggcgacgggaccgcucaccacgcucugggaaggcucaccagggaaguucuggaacaccaccaucgccgugagcauggccaacauauuccgcggaaguuacuuggcgggcgccggguuagcguucagccucaugaagucccuggguggggggagacgggguacgggagcacagggcgagacgcucggggagaaauggaagcgucaacucaaucagcugagcaagagcgaauucaacaccuacaagcggucuggcaucauggagguugacagaagugaggccaaggaggggcuuaaacggggcgagacuaccaagcacgccgugucccgcgggacggcaaagcugcgaugguucguggagcgcaaccuagucaagcccgagggcaaagugaucgaccugggcugcggccggggaggguggucauauuauugcgccggcuuaaagaaagugacugagguuaagggguacaccaaagggggcccagggcacgaagagccgauccccauggccacauaugguuggaaccuggugaagcuucacuccgggaaggacguguucuucaugccucccgaaaagugcgacacccugcucugugauaucggcgaaagcuccccuaauccuacgaucgaagaagggcggacccugcgcguccuaaaaaugguggagccguggcuccgcggcaaccaguucugcauaaagauucugaauccuuacaugccuagcguggucgagacccuggagcaaaugcagcggaagcacggcgggaugcucgugcgcaacccccugucccguaauuccacccaugagauguacugggugagcuguggcacaggaaacaucgucagcgcaguuaacaugaccucccgcaugcugcucaaccgcuuuaccauggcgcaccgcaagcccaccuacgagaaagacguggaccugggcgcggguacgagacacgucgccguggagccagagguggccaaccucgacauaauagggcagcggaucgagaauaucaagaacgagcacaagagcaccuggcauuacgacgaggacaacccguauaagaccugggcguaccacggcuccuacgaggugaagcccagcggguccgccucuuccauggugaacggcgugguccgacucuuaacaaagcccugggacgugauaccgauggucacgcagaucgcgaugaccgacacaaccccguucgggcaacagcggguguuuaaggagaagguggacacacguacaccccgggccaagcgcggcaccacccagaucauggaggucaccgcgaaauggcuguggggcuuccucucgcgaaacaagaaaccccgaauaugcacccgggaagaguucacacgcaagguuagaucgaacgcugccaucggggcgguguucgucgaugagaaccaguggaacuccgccaaagaggcaguggaggacgagcgcuucugggaccuggugcaccgggagcgcgagcugcacaaacaaggcaagugcgccaccugugucuacaacaugauggggaagcgggagaagaagcuuggcgaguuugggaaagcgaagggcagccgugcaauaugguacauguggcugggcgcccgguuucuagaguucgaggcccuaggguucaugaacgaggaccauugguucucucgcgagaauagccuauccggcguggagggggagggccuucacaagcucggcuacauucugcgggacaucagcaagauuccgggcggcaacauguacgccgacgacacggcugggugggacacccgcaucaccgaggaugacuuacagaaugaggccaagauaaccgacaucauggagcccgagcacgcucuucuggccacgucuaucuuuaagcugacuuaccagaacaagguggucagggugcaacgccccgccaagaacgggaccgucauggacgucaucuccagaagagaccagagggggucgggccaggugggcacauacggccucaauacguucaccaacauggaggugcagcucauccggcagauggagagcgagggaaucuucuuacccuccgagcucgaaaccccgaaccucgcggaacgcguccuugauuggcucgggaagcacggagccgagcggcugaagcgcauggcuauaagcggggacgacugcguggugaagcccaucgacgaccgauuugccaccgcacugaccgcgcugaacgacaugggcaagguccgcaaggacaucccccagugggagccauccaaaggcuggaacgacuggcagcaaguacccuucugcagccaccacuuccaccaauuaaucaugaaagaugggagggagaucgugguccccugcaggaaucaagaugaacuggugggccgggcccgcgugucgcagggggccggcuggucccugaaggaaacggccugccuggggaagagcuacgcccagauguggcagcugauguacuuccaccggcgugaccuccggcuggcggcaaacgccaucugcagugcugucccuguggacugggugccuaccagccgcaccaccuggucuauacacgcgcaccaccaguggaugacgaccgaggacaugcugagcgucuggaauagaguguggaucgaggagaacccguggauggaggacaagacccauguguccucgugggaagagguccccuaccucgggaagcgcgaggaccaguggugcggcucccugaucgggcugaccgcccgggccacgugggccaccaacauucagguggccaucaaucagguacgccgacucaucggcaaugagaacuaccuggacuacaugacaaguaugaaacgguucaagaacgaguccgaccccgagggcgcguugugguga

SEQ ID NO: 23935 - RNA, 9879 nt, Artificial Sequence
  derived and/or modified CDS sequence (opt11) from DENV-1__FJ547088__SS-prME
agcgucaccaugcugcucauguuacuuccgaccgcacucgcuuuccaccugacuacccggggcggcgagccccauaugaucgugagcaagcaggagcggggcaagucgcuacucuucaagaccagcgccggggucaacaugugcacccugaucgcaauggaccugggagagcuuugugaggauacuaugacguacaagugcccacagaucaccgaagccgagccagaugauguggacugcuggugcaacgccacagacacuugggucaccuacgggacgugcucacagaccggggagcaccggcgggauaagcgcuccguggcccucgcgccccacgugggccuggggcucgagacgaggacagagaccuggaugagcuccgagggcgccuggaagcagauccagcgcgucgagacuugggcccugcggcaccccggguucacggugaucgcccuauuccucgcgcacgccaucgggaccagcauuacccagaaggguaucauauucauccugcugaugcucgugacacccuccauggccaugcgcugcguaggcaucgguaacagggauuucguggaggggcugucuggcgccaccugggucgacgucgugcuggagcauggaucgugcgucaccaccauggccaagaauaagcccacccucgacaucgaguuacugaaaacggagguaaccaaucccgcaauacugcguaagcuguguaucgaggcuaagaucagcaacaccaccacggacucucggugcccgacccagggggaggccacccuuguggaggagcaggacgccaacuucgugugccgccggacguucgucgaccgcggcugggggaacggcugcggcuuauuuggcaagggaagccuguuaacgugcgcaaaguucaagugcgugaccaaacucgagggcaagaucguucaauacgagaacuugaaauacuccgucaucgugaccgugcacacaggcgaccagcaccagguugguaacgaaacgaccgaacacgguaccaucgcgaccaucacgccccaggcaccgacgagcgagauccagcugaccgauuacggggcccucacgcuggacugcagcccccggaccggccuugauuucaacgagauggugcuccugaccaugaaggaaaaguccuggcucguccacaagcaaugguuccucgaccugccucugcccuggaccuccggggccagcaccagccaagagaccuggaaccgacaggaccucuuggugacguucaagaccgcccacgccaagaagcaggagguaguaguauugggcucccaggagggugcaaugcacaccgcccucaccggggcaacggagauacagacaagcgguaccaccacgaucuucgccgggcaucugaagugccggcugaaaauggacaaguugacccugaaggguacuuccuaugucaugugcaccggguccuucaagcuggagaaggaggucgcggagacgcagcacggcaccgugcuggugcaggugaaguaugaaggcacagacgcccccugcaagauccccuucucuacccaggacgagaagggggugacucaaaauggccgccugaucaccgccaacccgaucguaaccgacaaggaaaagcccgugaacaucgagaccgagccgcccuucggcgagucguacaucgucgugggcgccggcgagaaggcacugaaguuaagcugguucaaaaaggggagcuccaucggcaagauguucgaggccacggcccgcggggcccgccggauggcgauccucggggauaccgcgugggacuucgggagcaucgggggcgucuucaccuccgugggaaagcuggugcaccaggucuucggcaccgccuauggggugcuguucagcggcguauccuggaccaugaagaucgggaucggcauccuccuuacuuggcuaggacuaaauagccguucgacgagccuuuccaugacgugcaucgcugucgggauggugacucuguaccucggagugaugguccaggccgauagcgggugcgugaucaacuggaagggcagagagcuuaagugcggguccgguaucuuugugaccaacgagguccacacuuggaccgagcaguacaaguuccaggccgacagcccgaagcggcugagcgcggccaucggcaaggccugggaagaggggguguguggcauccgcuccgccacacggcucgaaaacaucauguggaaacagaucagcaacgaacugaaccacauccugcuugagaaugacaugaaguucacaguggucgugggggacgcaaacggcauccuggcgcaggggaagaagaugauucgcccccagcccauggagcacaaguacuccuggaaguccuggggcaaggccaagauuaucggcgccgacauccagaacaccaccuuuaucaucgacggacccgauaccccggaaugccccgauaaccagcgggccuggaacaucugggagguggaagacuacggcuuugguauuuucacgacuaacauauggcugaagcucagagacuccuacacccaaaugugcgaccaucgacugaugagcgcugccaucaaggauucgaaggccguccacgccgacauggguuacuggaucgagagugagaagaacgagaccuggaagcuggcacgcgcuuccuucaucgagguuaagacgugcacguggccuaagucucacaccuuguggucuaacggaguccuggagagcgaaaugaucauccccaagaucuacgggggcccgauaucccagcacaacuaccggcccggguacuucacccagacggcugggcccuggcaccugggaaagcucgagcuugauuucgaccucugcgagggcaccaccgucguggucgacgagcacugcggcaauagagggcccagcuugcggaccacuaccgucacaggcaagauaauucacgaguggugcugccgcaguugcacccugccgccccuucgcuuucggggggaggacggcugcugguaugguauggagauccggccggugaaagagaaggaagagaaccucgugcgcagcauggucuccgccggcagcggcgaggucgacagcuucuccuuggggauccugugcgccucuaucaugauugaggaggugaugcggucccgcuggagccggaagaugcucaugacgggaacccuggccgucuuccuguuacugaucaugggccaacucaccuggaacgaccucauaagacugugcaucauggugggggcgaaugcauccgauaggaugggaaugggcacaaccuaccuggcccucauggccacguuuaaaaugcgcccgauguucgcggugggccugcuguuucgccgacucaccucgcgcgaaguccuucugcucacaauugggcuguccuugguagccagcguugaacugcccaacucccucgaggaguugggcgaugggcucgcuaugggcaucaugauguuaaagcugcucacggaguuccagccccaccagcuguggaccaccuugcucagccuuaccuucaucaagaccacccuuagccucgacuacgccuggaaaaccaccgccauggcgcucagcaucgugucucuguucccgcucugucuaagcacgaccucgcagaaaaccacuuggcugccggugcuccugggcagcuucgguugcaagccacugacaauguucuugaucacagagaacaagaucuggggucggaaauccuggccauugaacgaggggaucauggcgaucgggaucgucagcauucugcuguccagccugcugaagaacgaugugccucucgcagguccgcugaucgcgggcggcaugcugaucgccugcuacgugaucagugggucaagcgcggaccucucccuggagaaggcugccgaaguuagcugggagcaggaggccgagcacucuggcacaagccacaacauccuuguggaggugcaggacgaugggaccaugaagaucaaggacgaggagcgcgacgacacccucacgauacugcuuaaggccacccuucuggcaguauccggcguuuauccuaugagcaucccggccaccuuguucgugugguauuucuggcagaagaagaaacaacgguccgggguacuuugggacacccccagcccacccgagguggagcgcgccguccucgacgacggaaucuaccggauucugcaacgcggccugcucgggcgaucacagguaggaguggggguguuccaggacggugucuuccacaccauguggcacgucacucgcggcgccgugcugauguaccagggcaagcggcuggagccgagcugggcguccgucaagaaggaccucaucagcuacggcggagguuggcgcuuccagggauccuggaacaccggcgaggagguccagguaauagcggucgagcccggcaagaacccgaagaacguacagacgacgcccgguaccuucaaaaccccggagggcgagguaggggcuaucgccuuggacuucaagccuggcaccuccggguccccaauugucaaccgggaagggaagauugugggccuguacgguaauggaguugucacaaccagcgggaccuauguuucugccaucgcccaggcgaaggccagccaggaaggcccccuccccgagaucgaggacgaggucuucaagaagcgcaaccucaccaucauggaccugcacccggggagcggaaagacgcggcgcuaccuccccgccauugugcgggaggccaucaagcgcaagcugcggacccugaucuuggcgcccacgcgagugguggcuuccgaaauggccgaagcucugaaagguaugcccauccgauaucagaccacggccgucaagagcgagcauaccggacgcgagaucguggaccuaaugugccacgcgaccuucaccaugcgccuucugucaccugugcggguaccgaauuacaacaugaucauuauggacgaggcccacuucacggaccccgcguccaucgccgcccgcggcuacaucuccacgcggguggggaugggcgaggcugccgcgaucuuuaugacugccacgccucccgggucaguggaggccuucccccaguccaaugcggucauccaggacgaagagcgcgacauucccgagcgaucguggaacuccggcuacgacuggaucacagacuuccccggcaaaaccguaugguucgugcccagcaucaaguccgggaacgacaucgcaaacugccuaagaaaaaauggcaagcgugucauccagcucucacgcaagaccuuugacaccgaguaccagaaaacgaagaauaacgacugggacuacguggugacaacggacaucuccgaaaugggggccaacuuccgggccgaccgcgucaucgaccccaggcgcugccugaagcccgugauccugaaggauggccccgagagggugauccucgcggggcccaugcccgucaccguggccagcgccgcccagcgacggggacgcauuggccguaaccagaacaaggagggggaucaguacguguacaugggccagccacugaacaacgacgaggaccaugcccacuggacggaggcgaagaugcugcucgacaauaucaauaccccggaaggcaucauaccggcgcuguucgagcccgagcgugagaaauccgcugccaucgacggcgaguacaggcugcgcggggaggcacgcaagacuuucguggaguuaaugcgccguggcgacuugccaguguggcugagcuacaaagucgcgucggagggcuuccaguacucugaccgacgcuggugcuucgacggagagcggaacaaccaggugcuggaagagaacauggauguggagauuuggaccaaggaaggugagagaaagaagcugcguccacgcuggcuggacgcccguaccuacuccgacccgcucgcgcugcgcgaguucaaggaguucgccgcuggccggcgcagcgucagcggcgaucugauucucgagaucggcaaacugccccagcaccugacgcuccgcgcucagaaugcucuggacaaccuggugaugcuacacaacuccgagcaaggggguaaagccuaccgccacgccauggaggagcugcccgacaccaucgagacgcugaugcuacuggcguugaucgccgugcucaccggcggcgucacacuguuuuucuuaagcgggaagggccucggcaagacuagcaucgggcuccugugcgugaccgcuagcagcgcccuccuuuggauggccagcgucgagccgcacuggauugcggccuccaucauccuggaguucuuccucaugguccuucuaauccccgagcccgaccgccagcgcacgccacaagacaaccagcucgcuuaugugguaaucggcuugcuguucaugauccucacggucgccgccaacgagauggggcugcuugagaccaccaagaaggaccucggaaucggacacguggcggccgaaaaccaccaacaugccaccaugcuggacguggacuuacggccggcgagcgccuggacgcuauacgccgucgccacaacaguuaucacccccaugaugcgccacacgaucgagaacaccacagccaacaucucccugaccgccaucgcuaaccaagcggccauccugaugggccuggacaaaggcuggcccaucucgaagauggacauuggagugccccugcuugcucucgggugcuacagucaaguaaacccguugacgcugacugcggcggugcucaugcugguagcucacuacgccaucaucggccccggcuuacaggccaaggcgacccgggaggcccagaagcgcaccgccgcagggaucaugaaaaaccccacggucgacgggauaguggcuaucgaccuggaccccgucguguacgacaccaaauuugagaaacaguuaggccagaucauguugcucauacuuugcacgagccagaucuuacucaugcgcaccacgugggcccucugcgaguccaucacccuggcgacggggccccuaaccacgcuaugggagggcagccccgggaaguucuggaacaccaccaucgccguguccauggcgaacaucuuccguggcucguaucuggccggcgcagggcucgcguucucccugaugaagucccugggcggaggccggcgcgggacuggcgcgcagggugaaacacuaggagagaaauggaaacggcaacugaaccaacugagcaagucagaguucaacauauauaagcgguccggcauaauggagguugaccgcuccgaggccaaggaggggcucaaacgaggcgaaaccaccaaacacgccgucagccgcgguaccgcaaagcugcggugguucguggagcgcaaccuggucaagccagagggaaaggugaucgaccugggcugcgggcggggcgguugguccuacuacugugcuggccuaaagaaggugacugaggugaagggguacacuaagggcggucccgggcaugaggagccaauccccauggccaccuacggauggaaccugguuaagcuccacagcgguaaagacguuuucuucaugccgcccgaaaagugugauacccuccucugugauaucggcgaguccagcccgaaccccaccaucgaggaggggcggacgcugcgggugcucaagauggucgagccauggcuacgcgguaaucaauucugcaucaaaauccucaaccccuacaugccguccgugguggaaacccucgagcagaugcagcggaaguacggcgggaugcucguccgcaacccccugagccggaacuccacccaugagauguauugggugaguugcggcacgggcaacaucguguccgccgucaacaugaccucgcgcauguuacugaaccgcuucaccauggcucaccgcaagcccaccuacgagcgcgacguggaccugggcgcgggcacccggcacguagcuguagagccugagguggccaaccuugacaucauagggcagcgcaucgagaacauuaagaacgagcacaaguccaccuggcacuacgaugaggauaacccguacaagaccugggccuaccacgggagcuacgaggugaagccuuccgggucugccuccaguauggucaacggcgucgugagacugcugaccaagcccugggacgucauucccaugguaacccagauugcgaugacggacaccacuccauucgggcagcagcgcgucuucaaggaaaaggucgacacccggacgccccgcgccaagcggggcaccacccagaucauggagguuaccgccaaguggcucuggggcuucuuaucccgcaauaagaaaccccggauaugcacgcgcgaggaguucacccggaagguucgcagcaacgccgcgaucggggcggucuucguggacgaaaaccaguggaacagcgccaaggaggccgucgaagacgagcgguuuugggaccuggugcaucgugagcgggaacuucacaagcaagggaagugugcgacuugcguguacaacaugauggggaagcgagagaagaagcugggugaguucgggaaagccaaggguucgcgggcuaucugguauauguggcucggcgcucgcuuucuagaguucgaggcccugggguuuaugaaugaggaccauugguucagccgggagaacucccugagcggcguagagggggagggccuccauaagcugggguauauucugcgcgauauauccaagaucccgggcggcaacauguacgccgacgacaccgcugggugggacacgcggaucacggaggacgaccuccagaacgaggccaagaucaccgacaucauggagcccgaacacgcccugcucgcaaccucuauuuucaagcugacguaccagaacaagguggugcgcguccaacgaccggccaaaaacggaacugugauggacguaaucuccagacgcgaccagcggggcuccggccaggugggcacuuacgggcuaaauaccuucacgaacauggaagugcagcuuauccgucagauggaguccgagggcaucuuccugcccucagagcuggaaacaccgaaucuggcugggcggguguuggacuggcuggagaagcacggggccgagcgacuuaaacggauggccaucucuggagaugacugcguugugaagccuaucgacgacagauucgccaccgcccucacugcucugaacgacaugggcaagguccggaaagacaucccgcagugggagcccucgaagggcuggaacgacuggcagcaggucccguucugcucccaccauuuccaccaguuaaucaugaaggacgggcgcgagaucguggugcccugccggaaccaggaugagcuaguuggccgugcccgugugucucagggggccggcuggagccugcgcgagacagccugccugggcaaaagcuacgcccagauguggcagcucauguacuuccaccgccgcgaccugcgguuagcggccaacgccauaugcucagccgugcccguggacuggguacccacgagccgcaccaccuggagcauccacgcgcaccaccaguggaugaccacggaggacauguugaguguguggaaccgggucuggauugaagagaaccccuggauggaggacaagacccacgucagcuccugggaggaagugccguaccucggcaaaagggaggaccaguggugcggcagccugauaggcuuaacagcccgcgccaccugggccacgaacauccagguugccaucaaccaggugcggagguugaucggcaaugagaacuaccuggacuacaugacaagcaugaagcgcuucaagaacgagagcgacccagagggcgcguuaugguga

SEQ ID NO: 23936 - RNA, 9879 nt, Artificial Sequence
  derived and/or modified CDS sequence (opt11) from DENV-1__FJ810419__SS-prME
agcgugaccaugcuguugaugcugcugccuaccgcccuagccuuccauuuaaccacccgaggcggggagccccauaugauugugagcaagcaagagcggggcaagagccuccuuuucaagacgagcgcgggggugaauaugugcacccugaucgccauggauuuaggcgagcucugcgaggacacgaugaccuauaaaugcccccagaucaccgaggcggaacccgacgacguggacugcuggugcaaugcaaccgacaccugggucaccuacgggaccugcucccaaaccggcgagcaccggcgggacaagcgguccguggcccuggcuccucacgugggacuuggacucgagacgcggacugagacguggauguccuccgagggcgccuggaagcagauccagcgcgucgagacuugggcacugcgccacccgggcuucacggugaucgcccuuuuccucgcgcacgccaucgguaccagcauaacccagaagggcauuauauucauucugcugaugcucgugacccccagcauggccaugcggugcgucgggauagguaaccgggacuucguggagggauugaguggugccacgugggucgacguugugcuggagcauggguccugcgugaccaccauggcuaagaacaaacccacccuggacaucgagcuccuaaagacggaggucaccaaccccgcgauccuccggaaacuguguauagaggccaagaucucaaacaccaccacggacucccggugcccgacccagggcgaggccacccugguggaggagcaagacgccaacuucgucugccgccguaccuucguagaccgcggcugggggaacggcugcgggcucuucggcaaggggagccugcuaacuugugcuaaguucaagugcgugaccaagcucgagggcaaaaucgugcaguacgagaaccugaaauacuccgucaucgugaccguacacacgggcgaccagcaccaagucgggaacgaaacaaccgagcacggcacuauagcgaccaucacgccacaggcccccacgagcgagauccagcugaccgacuacggggcucucacccucgacugcagcccccggacuggccuggauuucaacgagauggugcuccugacaaugaaggagaaguccuggcugguucacaagcagugguuccucgaccucccccugccuuggacguccggggccagcaccagccaagagacauggaaccgccaagaccuccuggugacguucaagaccgcccacgcuaagaagcaggaggugguggugcuggggucccaggaaggggccaugcacaccgcccucaccggcgccacggaaauccagacuagcgggaccacaacgaucuuugccgggcaccuaaagugccggcugaagauggauaagcucacccuaaagggaaccuccuacgugaugugcaccgguagcuucaagcuggagaaggagguugcugagacgcagcaugggacuguguuggugcaggucaaguacgaagggaccgacgcccccuguaaaaucccguuuuccacccaggacgaaaagggcgugacgcagaacgggcgacucaucaccgccaauccgaucgugaccgacaaggagaaaccugucaacaucgaaaccgagccgcccuuuggggaaagcuacauuguggugggggcaggagagaaggcgcuaaaguuguccugguuuaagaaagggaguuccauuggcaagauguucgaggccacggcucgcggugcccggaggauggccauccucggcgacaccgcgugggacuuugggagcaucggcggagucuucaccuccguggguaagcuggugcaccagguguuuggcacggcguacggugugcuguucagcgggguguccuggacaaugaagaucggcauaggcauucuccugaccuggcugggccucaacagccgauccacaucacucuccaugaccugcaucgcagucgggaugguaacgcuuuaccucggcgugaugguccaggccgacagcgggugcgugaucaacuggaagggccgcgaacuuaagugcgggucagggaucuucgugaccaacgagguacauacuuggaccgaacaauacaaguuccaagccgauucaccgaagcggcugucggcggccaucggcaaggccugggaagagggggugugcgggauucgcuccgccacccggcuugagaacaucauguggaagcagaucucaaacgagcugaaccacauccugcucgagaacgacaugaaguuuacuguggucgugggggaugccaacgguaucuuagcgcaggggaaaaaaaugauucgcccccagcccauggagcacaaauacuccuggaaguccugggggaaggcgaagaucauaggcgccgacauccaaaacaccaccuuuauaauagacgggcccgacaccccggagugccccgacaaccagcgagccuggaacauuugggagguggaggacuacggcuucgggaucuucacaaccaacauauggcuaaagcuccgcgacuccuacacccagaugugugaccacagacugaugagcgcggccaucaaggacuccaaggccguccacgccgacaugggauacuggauugagagcgagaagaacgagaccuggaaguuagcccgagcaaguuucaucgaggugaaaacgugcaccuggccuaaaucccacacccucugguccaaugggguacuggagagugaaaugaucauucccaaaaucuacgggggcccgaucucccagcauaacuaccgccccggguacuucacccagacggcaggccccuggcaccuggggaagcucgagcuggacuucgaccuaugugagggcacaaccguugugguggacgagcacugcgggaaccgcgggccgagccuccggaccacgacagucaccggcaagaucauacacgaauggugcugccgcuccugcacccuaccgccccugcgguuuagaggggaagacgggugcugguacggcauggagauccggcccgugaaagagaaggaggagaaccucgugcgcagcauggucucugcaggcagcggcgaaguggacagcuucucccugggaauccucugugcuagcaucaugaucgaggaggugaugcggucccguuggagucggaagaugcucaugaccggcacccuggccgucuucuugcuccuuaucaugggacagcucaccuggaaugaccuuauccgccugugcaucauggugggugcgaacgccuccgaucgaaugggaaugggcacgacguauuuggcccucauggccaccuucaaaaugcggccgauguuugccgugggacugcuguuccgccgguuaacgucgcgcgagguccugcugcuuaccaucggccugucccugguggcguccguagagcugcccaacuccuuagaggaacuaggcgacgggcucgcaaugggcaucaugaugcugaagcugcucacggaauuccagccccaccagcucuggaccacccugcugagccugaccuucauuaagacgacccugagcuuggacuacgccuggaagacuaccgccauggcgcugagcaucguuucccuuuucccccucugucugagcacgaccucccagaagacaacuuggcugcccguccuccugggcagcuucggguguaaaccccugaccauguuccuuauaacggagaacaagauauggggccggaaguccuggccccugaacgaggguaucauggcgaucggcauugucagcauccugcucuccagccuuuugaagaacgacguuccucucgcggggccgcucaucgccggcggcaugcuaaucgccuguuacgugaucagcggguccagcgcagaccucagccuggagaaggccgccgaggugagcugggaacaggaggcggagcauuccggcaccucgcacaauauccugguagaggugcaggaugauggaaccaugaagaucaaggacgaagagcgcgacgauacccucaccauccugcugaaggcaacccuccuggcggucaguggcguguacccuaugagcauccccgcaaccuuauucgugugguacuucuggcaaaagaagaagcaacgcuccgggguacucugggauacaccgagcccgccggagguggagagagccgugcuggaugacggcaucuaccggauccugcagcgaggguuacucgggcggucccaggucgguguggggguguuccaggacggugucuuccacacgauguggcacgugacccgcggggccgugcugauguaccagggcaagcggcuggagccuagcugggcgucggucaagaaggacuugaucagcuacggcgggggcuggcguuuucaaggguccuggaacaccggcgaggagguccagguuaucgcggucgagcccggaaagaauccaaagaacgugcaaaccacucccggcaccuucaaaaccagcgagggcgaggugggagccauagcacuggacuucaagccgggcacaucugggagccccaucgucaaucgggaggguaagaucgugggucuguacggcaacgguguggucacgacaaguggaaccuacgugagcgccauugcccaagcgaaggccucccaggagggcccgcugcccgaaaucgaggaugaaguguucaagaagcgcaaccugaccaucauggaccugcaccccggguccggcaagacacgccgcuaucuuccggccaucguccgggaggccaucaagcgcaagcuccggaccuugauccuggcgccuacgagaguuguggccagcgagauggccgaggcccuuaagggcaugcccauccgcuaccaaacaacggccguuaaauccgagcacacagggcgugagaucguggaccuaaugugccacgcgaccuucacaaugcgccuccuuagccccgugcgggugccgaacuacaacaugaucaucauggacgaggcgcacuuuacggaccccgcuuccaucgccgcgcgcggcuauaucagcacgcggguugggaugggagaggcagccgcuaucuucaugaccgcaacgccgcccgguuccguggaggcuuuuccgcagagcaaugccguuauacaggacgaggagcgcgacauccccgagaggaguuggaacagcggcuacgacuggauuacggacuuccccggaaagacggugugguucgugcccuccaucaagagcgguaacgauaucgcgaacugccugcgcaagaacggcaagcggguuauccaguugucgcgcaagaccuuugacaccgaguaccagaaaacgaagaacaacgacugggacuacguugucacgacggacaucagcgagaugggggcuaacuuccgggccgaccgcgucauagacccacggcgcugccugaaacccgucauucugaaggacggccccgagcgggugaucuuggcggggcccaugccggucaccguagccagugccgcccaacgccggggccgaauuggccggaaucagaacaaagagggcgaccaguacguguacaugggccagccgcucaacaaugacgaggaccacgcacacuggacggaagcgaaaaugcugcucgacaauaucaacacccccgagggcaucaucccugcucuguucgagccugagcgcgagaaguccgcugcuauagacggcgaguaccgccugcgcggcgaggcgagaaagaccuuugucgagcucaugcggcgcggcgaucugcccguuuggcuguccuacaaggucgcgagcgagggcuuccaauauuccgaucggcgcuggugcuucgauggggagcggaauaaccaggugcucgaggaaaacauggacgucgaaaucuggaccaaggagggcgagcgcaagaaguuacgaccuagauggcuggacgccaggaccuauagcgacccgcucgccuuacgcgaauucaaagaguucgccgccgggcggcggagcgugucaggagacuugauacucgagauuggcaagcugccgcagcaccugacgcuacgggcgcagaacgcucuggacaaccucgucaugcuccacaacagugagcagggugggaaggcuuaccgccacgccauggaggaguuaccggacaccaucgagaccuugauguugcuggcgcugaucgcugugcucaccgggggcguaacgcuguucuuucuauccgggaagggccucggcaagacgucaaucgggcugcugugcgugacggccuccucagcacuacuguggauggccuccguggagccgcacuggauagcggccucuauaauccuggaguucuuccucaugguucuguuaauaccagagccggaccggcagcgcacgccccaggacaaccagcucgcauacguggugaucggccugcuguucaugaucuugacggucgccgcuaaugagauggggcuucuggagaccacgaagaaggaccucggcauugggcacguggcggccgaaaaccaucagcacgccaccaugcuggacguggaccugagacccgcuucggccuggacgcucuaugccgucgccaccaccgugaucacacccaugaugaggcacacgaucgagaacaccaccgccaauauuucucugaccgccauugcaaaucaggcggccaucuuaaugggccucgacaagggguggcccauauccaagauggacauuggggugccccuacuggcccucggauguuacagccaggucaacccccugacguuaaccgccgcgguucucaugcugguagcccacuacgcaaucaucgggccgggccugcaggccaaggccacucgggaggcgcagaagcgcacggccgccgggauuaugaagaaccccacggucgacggcaucguagcgauugaccuugaccccguggucuacgacgcaaaguucgaaaagcagcuggggcagaucaugcugcucaucuuguguaccucccagauccuucuuaugcgcaccacgugggcccugugugaaagcauaacacucgccaccgggccccucaccacacugugggagggcuccccggggaaguuuuggaacacgaccaucgccguaagcauggccaacaucuuccggggcuccuaccuggcaggcgcgggguuggcauuuagcuugaugaaguccuugggcgggggccgaagggggaccggcgcccagggggagacccucggcgagaaguggaagcgccagcugaaccaacugaguaagucggaauucaauaccuacaagcgguccgguaucauggaggucgaccggagcgaggccaaagagggcuuaaagcguggcgagaccaccaaacacgcggucucccgugggaccgcaaaacuaagaugguucguggagcgcaaccugguaaagccagagggcaaggugaucgaucucggcugcggucggggcggguggagcuacuacugcgcaggacucaagaaggugaccgaagugaaaggguacacgaagggaggccccgggcaugaggagccuauucccauggcgacuuacggcuggaaucuaguuaagcuguacaguggaaaagacguguucuuuaugccgcccgagaagugugacacccuccuuugcgacauaggcgagagcucuccgaaccccacuauugaggaggggaggacgcugcgagugcucaagauggucgagccguggcuucgcggcaaccaguucugcauuaagauccugaaccccuacaugcccagcgugguggagaccuuagagcaaaugcaacggaagcacggcgggauguugguccgcaacccguuaucccggaacagcacccacgagauguacuggguguccugcgggaccgggaacaucgugagcgccgucaacaugacgucgcgcaugcuccugaaccgguucaccauggcccaccgcaagcccaccuacgaacgcgacgucgacuugggggccgggacccgacacguggccguugagcccgagguggccaaccucgacaucaucgggcagcgcaucgaaaacauuaagaacgagcacaaaagcacauggcacuacgacgaggacaaccccuacaagaccugggccuaucacggcagcuaugaggugaagccgaguggguccgcgucguccauggucaacggaguagugcggcugcugaccaagcccugggacgucauacccauggugacccagaucgccaugacggacaccacacccuucgggcagcaacgcgucuucaaggagaagguggauacccggacgccgcgcgccaagcgggggaccacccagauaauggagguaaccgccaagugguuguggggcuuccugagccggaacaagaagccccggaucuguacgcgcgaggaguucacccggaagguccgcagcaacgccgcgaucggggccguguucguggacgagaaccaguggaacucggccaaggaggcggucgaagaugagcgguucugggaccuggugcaccgcgaacgggagcuccacaagcagggcaagugcgcgacgugcguguauaacaugauggggaaaagagagaagaagcuaggcgaauucgggaaagcuaaggggagccgggccaucugguauauguggcugggugcccgguuccuggaguucgaggccuuaggguucaugaacgaggaccacugguucucccgcgagaauagccuuuccggcgucgaaggggagggccuccauaaacugggguacauacugcgcgacaucagcaagauccccgggggcaacauguaugcggacgacaccgccggcugggacacacggauaaccgaagacgaucuacagaacgaggccaagaucaccgacaucauggagccagagcacgcgcugcuggccaccuccaucuucaagcucacauaccagaacaagguuguucgcguccagcgccccgcgaagaauggcaccgugauggauguuaucagccgucgcgaccagcgggggucuggacaggucggcacguacggucuuaacaccuuuacgaacauggagguacaacugauccgccagauggagucugagggaaucuuccucccaucagagcuggagacccccaacuuggcagagcgggugcuagacuggcuggagaagcacggggcugagaggcuuaagagaauggccaucagcggggacgauuguguggugaagccgaucgacgaccgcuucgccaccgcucuaaccgcccugaacgacauggggaaggugcggaaggacaucccccagugggaacccuccaagggcuggaacgacuggcagcagguccccuucugcagccaucacuuccaccaacuaaucaugaaggacggccgcgagauugucgugccgugccggaaucaggacgagcucguuggucgcgcccgagugucccagggcgccggguggucccugcgggagacagccugccuaggcaaauccuacgcgcagauguggcagcucauguacuuucaccggcgcgaccuucggcuggccgccaacgcgauuugcucggccgugccagucgauuggguacccaccagccgcaccacgugguccauucacgcccaccaccaguggaugaccacggaggacaugcuaucuguauggaaucgcgucuggaucgaggagaaccccuggauggaggacaagacccacguguccagcugggaggaggugccguaccuggggaagcgcgaggaccaauggugcggcucccugauaggccucaccgccagagccacgugggccacgaacauccaggucgcgauuaaucaggugcggcgccugaucgggaacgagaacuaucuagacuauaugaccaguaugaagcgcuucaaaaacgaaagugaucccgaaggugcccucugguga

SEQ ID NO: 23937 - RNA, 9879 nt, Artificial Sequence
  derived and/or modified CDS sequence (opt11) from DENV-1__FJ547068__SS-prME
agcgugaccaugcugcucaugcugcugcccaccgcccucgccuuccaccugaccacccgggguggggagccccacaugauagucagcaagcaggagcggggcaagagccucuuguucaagaccagcgcgggggugaacaugugcacccugauagccauggaccugggcgaacucugcgaagacacuaugaccuacaaauguccgcagauuaccgaggccgagcccgacgacguggacugcuggugcaacgccaccgacaccugggugaccuacgggaccugcagccagaccggcgagcaucggcgggauaagcggucugucgcccuugcgccccacgugggacuggggcucgagacgcggacugagaccuggaugagcuccgagggcgccuggaagcaaauccagcgcgucgagaccugggcccugcggcaucccgguuucacgguuaucgcccuguuucucgcucaugccauaggcacuucuaucacccagaaggggaucaucuucaucuuacugaugcucgucacccccucuauggcuaugcgcugcgugggcaucggcaaucgugauuucguggagggucugagcggcgccacguggguggacgucguacuggaacacggguccugcgugaccaccauggcgaagaacaagcccacccucgauauagaacuccugaagacggaagucaccaaccccgcuauccuccgcaaguuaugcaucgaggccaaaaucagcaacaccacaacggacucaagaugcccgacccagggcgaggcaacccuggucgaggagcaggacgccaacuucgugugucggcggaccuucgucgaucgaggaugggggaacggcugcggccucuuuggcaaggggagccugcugacgugcgcaaaauucaagugcguuaccaagcucgagggcaagaucguacaguacgaaaaccugaaguacagcgucaucgugaccguccacaccggcgaccagcaccaagucgggaacgagacaaccgagcacggcaccaucgcgaccaucacgccucaagcgccgacgagcgagauccaacugacggacuacggggcccucacccuggacugcagcccccguacgggccuggacuucaacgagaugguacucuuaacgaugaaggagaaauccuggcuugugcacaagcaaugguuccucgaccugccacugcccuggaccuccggggccagcaccagccaggagaccuggaaccgccaagaucucuuaguaacguucaagacugcccacgcgaagaagcaggagguggucguacucggcucgcaggagggcgccaugcacaccgcccucaccggugcaacggagauccagaccuccggcacaaccacgaucuucgccggacaccugaagugccggcugaagauggacaagcucacccugaaggguacauccuacgugaugugcaccgggagcuuuaagcuggaaaaagaggucgcggagacucagcacggcaccguccugguucaagucaaguacgagggcaccgacgcccccugcaagauccccuucuccacccaggacgagaagggagugacgcagaauggccgccucaucacggccaacccgauugugacagacaaggaaaagccagucaacaucgaaaccgagccgccauucggggagagcuacauuguggugggugccggugaaaaggcacuaaagcuauccugguucaagaaggggagcuccaucggcaaaauguucgaggcaacggcgcgcggugcccgccggauggccauccucggcgacacggcgugggacuucgggagcaucggcggcguuuucaccucggugggcaagcuggugcaccaggucuucggcaccgccuacggggugcuguucagcggcguguccuggacgaugaaaaucgggauugggauccugcugaccuggcugggucucaauucacgcuccacaagccuaagcaugaccugcaucgccgucggcauggugacgcuguaccucggagugaugguccaggccgacagcgggugcguaaucaacuggaagggccgugagcugaagugcggauccgguaucuuugugaccaacgagguccauaccuggacggagcaguacaaguuccaggccgacucuccgaagcggcugucugcggcaauaggcaaggccugggaggagggggugugcggcauucguuccgccacccggcuugagaacaucauguggaagcagauuaguaacgagcugaaccacauccuguuggaaaacgacaugaaguucacggugguugucggugacgccaacggcauacuggcccaggggaagaagaugauccgcccccagcccauggagcacaaguacuccuggaagaguuggggcaaggccaagauaauuggcgccgacauccagaauaccaccuucaucaucgacgggccggacaccccggagugccccgauaaccagagggccuggaacaucugggagguugaggauuauggcuuugggaucuucacgacaaacaucuggcugaagcuccgcgacucauacacccagaugugcgaccaccggcugaugagcgcggccaucaaggacuccaaggccguccaugcggacaugggcuacuggaucgaaagcgagaaaaacgagaccuggaaguuagcccgugcguccuuuaucgaggugaaaacaugcaccuggcccaagagccacacccugugguccaacggggugcuggagagcgagaugaucauaccgaagaucuaugggggcccaaucucccagcauaauuaccggcccggguacuucacccaaacagcgggcccuuggcaucugggcaagcucgagcuggacuucgaccugugcgagggcaccaccgucgugguggacgagcauugcgguaaccgcgggccgagccucaggacaacgaccgugacgggcaagauuauccacgagugguguugucgcucauguacacugccgccucugcgguuccgcggggaggacggcugcugguacgggauggagauccgccccgugaaggaaaaggaggagaaccucguacgaucaauggucuccgccggaucuggcgagguggacucauucucccuugggauccugugcgccagcaucaugaucgaggaggucaugcggucccgcuggagccggaagaugcucaugacgggcacccuugccgucuuccugcuccuaaucauggggcagcugacuuggaaugaccucauccgccuaugcaucauggugggugcgaaugcaagugaccgcauggggaugggcaccaccuacuuagcccugauggccaccuucaagaugagaccgauguucgccguagggcugcuguuccgccggcucacgagccgggagguccuguuacucaccauagggcugucacuggcugccagcguggagcuacccaauagccuggaggagcugggcgacgggcucgccaugggcaucaugaugcugaagcugcucacggaguuccagccccaccaacuguggaccacccugcuuagccugaccuucaucaagaccacgcuguccuuggacuacgccuggaagaccacggcgauggcccugagcaucgugucgcuguuucccuuaugccugagcacgaccucccagaagaccaccugguuaccgguccuccuuggaagcuucgggugcaaaccccuuacuauguuccucaucacggaaaacaagaucuggggccggaaauccuggccccucaacgaggggaucauggccaucggaaucgugagcauacugcucagcagccugcugaagaaugacgucccccuugccgggccauugaucgccggcgggaugcuuaucgcguguuacguuauaagcgggucuagcgccgaccucucccuggagaaggccgccgaggugagcugggagcaagaggccgagcacucugguaccucacacaacauacuggucgaggugcaagacgacgggaccaugaagaucaaggacgaggagcgcgacgauacguugacgauccugcugaaggcuacccugcuggccguauccggcgucuacccaaugagcauccccgccacccuguuugugugguacuucuggcagaagaaaaagcagcgguccggcgugcucugggacacccccagcccgccggaggucgagcgcgccguguuggacgacggcaucuaucggauccugcagcggggcuugcucgggcggucccaggugggcgugggggucuuccaggacggcguguuccacacgauguggcacguaaccaggggggccgugcuuauguaccagggcaagagguuggagcccagcugggcguccgugaaaaaagaccucaucuccuacggcgggggcuggcgcuuccagggguccuggaacaccggcgaggagguccaggugauagccguggaaccggggaagaacccgaaaaacguccagaccacgccaggcaccuucaagacccccgagggcgaggucggggccaucgcccuggauuucaagcccggcaccagcggcucaccgaucgugaaccgagagggcaaaaucgucggccuguacgggaacggcguggugacgaccagcgggaccuacgucuccgccauagcgcaggcuaaggccucucaagaaggcccccuccccgagauagaggacgaaguguucaagaagcgcaaucugaccaucauggacuugcacccugggagcggcaagacucgacgcuaccucccggcuaucgugcgggaggccaucaagagaaagcugcggacgcugauucucgccccaacccgggucguggcuucagagauggccgaagcccugaaaggaaugcccauccgcuaccagacuacggccgucaagagugagcacaccggucgggagauugucgaccugaugugccacgcuacuuucaccaugcgcuugcuguccccugugcgggugcccaacuacaauaugauaaucauggacgaagcccauuucaccgaccccgcgagcauagcagcgcgcggcuacaucuccacacgggucgggaugggugaggcugccgcuaucuucaugaccgccaccccgcccgggagcguggaggcguuuccacaauccaacgccgugauccaagacgaggagcgcgacauuccugagagaagcuggaacuccggauacgacuggauuacugauuuccccggcaagaccgucugguucgugccuagcaucaaguccgggaacgacauagcuaacugucugcgcaagaacggcaagcgggugauccagcucagccgcaagaccuucgacacugaguaucagaagacgaagaacaacgacugggacuacgucgugaccaccgacaucuccgagaugggggccaacuuccgggcggaucgcgugaucgacccccggagaugucugaagcccgucauccugaaggacggccccgagcgggugauccucgccgguccgaugcccguaaccgucgccagcgccgcccagcgccggggccgcaucggccggaaccagaacaaagagggggaucaguacguuuacauggggcaaccccugaacaacgacgaggaccacgcgcacuggaccgaggccaagaugcugcucgauaacaucaacaccccagaagggaucaucccggcccuguucgaaccugagcgggagaagucagcagccaucgacggggaguaccgccuccgcggagaagcgcgcaagaccuucguggagcucaugcggcgcggcgaccugccuguauggcugagcuacaaaguugcauccgagggcuuucaguauagcgaccggcgcugguguuucgacggagagagaaacaaccagguccucgaggagaacauggacguggagaucuggaccaaggagggcgagcgcaaaaaguuacggccccgcuggcuggacgcccggacuuacuccgacccguuggcgcugagggaauucaaggaguucgccgcggggcggaggagcgugagcggcgaccugaucuuggagaucgguaagcugccacagcaccugacguugagggcccaaaacgcccuggacaaucuggucaugcuccacaacagugagcagggcgggaaggccuaccgccacgcgauggaggagcugccggacaccaucgagacucugaugcuccuggcccugaucgcgguccucacggguggcgugacgcuguucuuccugucagggaagggccucggcaagaccagcaucgggcugcugugugugaccgccagcuccgcccuccuguggauggcgagcguggagccucacuggaucgcugccagcaucauucuggaguucuuucucauggugcuauugaucccggagcccgaccggcagcgcacgccccaggacaaccagcucgcuuacgucgugaucggccuguuguucaugauccucaccguggccgcgaacgagauggggcuguuggaaaccaccaagaaggaucucggcauagggcacgucgcagccgaaaaccaucaacacgccaccaugcuggacguggaccugagaccugccagugcguggacgcucuacgccguggcaaccaccgucaucaccccuaugaugcgccacacgaucgaaaacaccacagccaacaucucccugacggccaucgcgaaccaggcggcgauccugaugggucucgauaaaggcuggcccaucagcaaaauggacaucggggugccccuguuggcacucggcugcuacucccaggugaacccacugacgcugaccgccgccguccucaugcugguggcccacuacgccaucauaggccccgggcugcaggcuaaggcgacccgggaggcucagaagcggaccgccgccgguaucaugaagaaccccacgguggauggcaucgucgcuauagacuuagaccccguuguguacgacgcaaaguucgagaagcagcuaggccagaucaugcugcugauccuaugcaccucucagauccugcucaugcggaccaccugggcccugugcgaguccaucacguuggcuaccgggccucucaccaccuugugggaggggucucccggaaaguucuggaacaccaccaucgcggucuccauggccaacaucuuucggggcagcuacuuagcaggcgccgggcucgccuucucccugaugaaaucccucggggggggccgccgggggaccggcgcccagggggagacccucggggagaaauggaaacgccaacuuaaucagcugaguaagagcgaauucaauacguacaagcggagcggcaucauggagguggaucgcuccgaggccaaggaagggcucaagcgcggagaaaccaccaaacacgcagugagccgcgggaccgccaagcugcguugguucgucgaacggaaucuggugaagcccgaggggaaagugauagacuugggcugcgggcggggcgggugguccuacuacugcgccggccucaagaaggugaccgaagugaagggguacacgaaggggggucccgggcaugaggagccgauucccauggccaccuacggcuggaaccuggugaagcugcacagcgggaaggacguauuuuuuaugccgcccgagaagugugacacccuccugugcgacauuggcgaguccagcccgaacccaaccaucgaggaggggcgcacgcugcgggugcucaagauggucgagccguggcugcgaggcaaccaguucuguaucaagauccugaaccccuacaugccguccgucguugagacacucgaacagaugcagcggaagcacggcgggaugcuggugcgcaacccccugagccggaacuccacucaugagauguauugggucucaugcggcacagggaacauugugagcgcggugaacaugacaucucgcaugcuccugaaccgguucaccauggcccacagaaagcccaccuacgagcgcgacgucgaccucggugcuggaacccggcacgucgcuguggagcccgaggucgccaaccucgauaucaucggucagagaaucgagaacaucaagaacgagcacaaguccacauggcacuacgacgaggacaacccguauaagacaugggcguaccacggcucuuacgaggugaagcccuccgggagcgccucaucaauggugaacggcgucgugcggcugcugacaaagcccugggacgugauccccauggugacccagauugccaugacggacaccaccccguucgggcagcagcgcguguucaaggagaaggucgacacccggacaccccgcgcaaaacggggcacaacccagaucauggaggugaccgccaaguggcucuggggauuccugucccgcaacaagaagcccaggaucugcacgcgcgaggaguucacccggaaggugcgcagcaacgccgcgaucggggccgucuucguugacgaaaaccaauggaacagcgccaaagaggcgguggaggacgagcguuucugggaccugguacaccgcgagcgggagcuccauaagcagggcaagugcgcgaccugcguauacaacaugaugggaaagcgcgagaaaaagcugggcgaauucgggaaggccaaaggcagccgggccaucugguacauguggcugggggcccgcuuccucgaguucgaagcacugggguucaugaacgaggaccacugguucagcagagagaauucccugucaggcguggagggggagggccuccacaagcugggguacauucugagagacauuucgaaaaucccuggcggcaacauguacgccgacgauaccgccgggugggacacucggaucaccgaagaugaccuccagaaugaagccaagaucaccgacaucauggagcccgagcaugcccugcuggcgaccucaaucuuuaagcuaaccuaucagaacaaggucgugagggugcaacgcccugcuaagaacggcacagucauggacguaaucucccggcgcgaccagcgcggaagcggucagguggguaccuacgggcucaauacauucacgaacauggagguccagcugauccgccagauggaguccgagggcauuuuccucccaagcgagcucgagaccccgaaccuggccgagcgggugcucgacuggcuagaaaagcacggagccgagcgccugaaacggauggcgaucuccggcgaugacugugugguaaagccuauugacgaccgcuucgcgaccgcccucaccgcccucaacgacauggggaaggugaggaaggacauuccccagugggagccaaguaaagguuggaacgacuggcagcaggucccguucugcucccaccauuuccaccaacugauaaugaaggauggccgagaaaucguugugcccugccggaaccaagacgagcucgugggucgagcucgugucagccagggcgcgggcuggucccugcgcgagaccgcgugccugggcaagagcuacgcucagauguggcaacucauguacuuccaucggcgcgaucugcggcucgccgccaacgcgaucugcuccgcuguacccguagacugggucccgacuagccgcaccacguggagcauccacgcgcaccaccaguggaugaccacggaggacaugcucagcguguggaaccgaguguggauagaggagaacccguggauggaagacaagacccacgucagcuccugggaggaaguucccuaccuggggaagcgcgaagaucaauggugcggcagccugauaggccucacggcgcgugcgacaugggcuacgaacauccagguggccaucaaccagguccgacgccugaucgggaacgagaacuacuuagacuacaugaccuccaugaaacgguucaagaacgaguccgacccggagggcgcccucugguga

SEQ ID NO: 23938 - RNA, 9879 nt, Artificial Sequence
  derived and/or modified CDS sequence (opt11) from DENV-1__FJ562104__SS-prME
agcgucaccaugcuccucaugcugcugcccaccgcguuagccuuccaccucacuacccgggggggggagccccacaugaucguuagcaagcaggaacgcggcaagagccuccuguuuaagacuagcgccggggugaacauguguacccugaucgcuauggauuugggcgagcucugcgaagacacaaugacguacaaguguccucagaucaccgaggccgagcccgaugacguggacuguuggugcaacgccacagacaccugggucacuuacgggacuuguagccagaccggggagcaccggagggacaagcgcuccguggcucuggcaccccauguuggccuggggcucgagacgcggaccgagaccuggaugagcuccgagggagccuggaagcagauccagcgcgucgagacaugggcccugcggcaccccggguucacggugauagcccuguuccucgcgcacgccaucggcaccuccaucacgcagaaagggauaaucuucauccugcugaugcucgugacgcccuccauggccaugcgcugcgucgguaucggcaaccgggacuucgucgaggggcuguccggcgccacgugggucgacguagugcuggagcacggguccugcgugaccaccauggcuaagaacaagcccacgcucgacaucgagcugcugaagacggaggucacuaacccagcgauccuccgcaagcugugcaucgaggcaaagaucucuaacaccaccacggacucccggugcccuacccagggcgaggccacacugguggaggagcaggacgccaacuucgucugucgccggaccuucguagaucgcggcugggggaacggaugcggccucuucggcaaaggaagccugcugacuugcgccaaguucaaaugcguuacgaagcucgagggcaagaucgugcaguacgagaaccuuaaguacuccgucauuguuaccguucacaccggcgaccagcaucagguagggaacgagaccaccgagcacggaacgaucgcgaccauaacgccccaggcccccacuagcgagauccaauuaaccgacuacggggcccucaccuuggacugcagcccccggaccgggcuggacuucaaugagaugguguugcugacgaugaaagaaaaguccuggcugguccauaagcagugguuccuggaccugccgcuucccuggacuuccggggccagcacaagccaggagaccuggaaccgccaggaccuccuggugacguucaagaccgcucacgcuaagaagcaagaaguagucgugcugggcucccaggagggcgccaugcacaccgcucuaacgggggccacagagauccagaccagcgguaccaccaccaucuucgccgggcauuuaaagugccgcuugaaaauggacaagcucacacugaaaggcacuucauacgugauguguaccgggagcuucaaacuugagaaggaggucgcggagacgcagcacggaaccgugcugguacaggucaaauacgaaggcaccgacgcccccugcaagaucccuuucucuacccaagaugagaaaggggucacucagaacggccgacuaaucaccgcgaacccgaucgugaccgacaaggagaaaccuguaaacaucgaaaccgagccgcccuucggugagucauacaucguggugggcgccggcgaaaaggcguugaagcuguccugguucaaaaaggguaguuccaucggcaagauguucgaggcgacggcaaggggggcgagacggauggccauacucggcgacaccgcgugggacuucggaagcaucggcggcgucuucaccuccgucgggaagcugguccaccaggucuucggaaccgccuacggggugcucuucucuggcguguccuggacgaugaagauugggaucggcauccuccugaccuggcugggccucaacagccguuccaccucccugucuaugaccugcauagcugucgggaugguuacgcucuaccuaggcguaaugguucaggccgacagcggguguguuaucaacuggaagggccgagaguuaaaaugcggguccgggaucuucgugaccaacgagguccacaccuggacugagcaguauaaauuccaggcggacagcccaaagcggcugagcgcggccaucggcaaggcgugggaggaggggguguguggcauacgauccgccacacgccucgagaauauaauguggaagcagauaagcaacgaacugaaccauauccuguuagaaaacgacaugaaauucacgguggucgucggggacgccaacggaauucucgcgcaggggaagaaaaugaucagaccccagcccauggaacacaaguacuccuggaaguccuggggaaaggccaagaucaucggagccgacauccagaacacaaccuuuaucaucgauggccccgacaccccggaguguccggacaaccaacgggccuggaacaucugggagguggaggacuacggcuucgguauuuucacgaccaacaucuggcugaaacuccgcgauaguuacacccagaugugcgaccaccggcucaugagcgcggccaucaaggacucaaaagccgugcacgcggacaugggcuacuggauugagucggagaagaaugagacauggaagcuggccagagcuuccuucaucgaggugaagacaugcacauggccaaaaagccacacucucugguccaacggcgugcuggaaagcgagaugaucaucccuaagauauacgggggcccgaucucucagcacaacuaccgccccggguacuucacccaaacggccggccccuggcaccugggaaagcucgagcuggacuucgaccucugcgagggcaccaccguagugguggaugagcacugcggcaaucgcgggccgagccuccguacgacgaccgucaccggcaagaucauccacgaguggugcugucgcuccugcaccuugccgcccuugagauuucgcggggaggacggcugcugguacgggauggagauccgacccgugaaggagaaggaggagaaccucgugcgcagcaugguauccgcaggaucaggcgagguggacagcuucagucugggcauccugugcgccuccaucaugaucgaggaggugaugcggagccgcuggucuagaaagaugcucaugacgggcacgcuggcugucuuccugcuccugaucauggggcaacuuaccuggaacgaucuaauccgacugugcaucauggugggcgcgaaugccuccgaccgcauggggaugggcaccacguaccuggcccugauggccacuuucaagaugcggcccauguucgccguggggcugcuguuccgccggcucaccagccgcgaaguccugcuguuaaccaucggguuaucucugguggcgagcguggagcucccaaacucccuggaggaacuuggcgauggccucgccaugggcaucaugauguuaaaacugcucacggaguuccagccucaccagcuguggaccacucuguuaagccugaccuucaucaaaacgacccugucccucgacuacgcguggaagaccacggccauggcgcugagcaucgucucccuauucccguuaugccugucuacgaccucccagaagaccaccuggcugcccgugcuccugggcagcuucgggugcaaacccuugaccauguuccucauaacggagaauaaaaucuggggucggaaguccuggccccugaacgagggcaucauggccaucggcauagucagcauccugcucucaagcuugcuuaagaacgaugugcccuuagccgggccgcugaucgcuggcgguaugcugaucgccugcuacguaaucagcggcuccucugcggaccucucccuggagaaggccgccgaggucagcugggaacaggaggccgagcauucgggcacuucccacaacauccugguggagguacaggaugacgggaccaugaaaaucaaagaugaggagcgcgacgacacucuaacgauucugcugaaagcgacccucuuagcggucuccggaguauaccccaugagcaucccugccacccuguucgugugguauuucuggcagaagaagaagcagcgguccgggguccucugggacacccccagcccgccugaaguggaacgcgccguccuggaugacgggaucuaccggauccugcaacgcggccugcucgggaggucccagguagggguggggguguuccaggauggcguuuuccacacgauguggcacgucacucgcggcgccguucugauguaccagggcaagcgguuggagccaagcugggcaagcgucaagaaagaccucaucagcuacggggggggcuggagguuccagggguccuggaacaccggcgaggagguccaggugauugcggucgagcccgggaaaaaccccaagaacgugcagacuacaccuggcacguucaagacucccgagggcgagguaggcgccaucgcguuagauuuuaaacccgggaccagcggauccccgauaguaaaccgggagggcaaaaucgugggccuguacgggaauggcguugucacgaccucugggacauacgugagugcgaucgcccaggcgaaggcuucccaggagggcccccuccccgagauugaggacgaaguguucaagaaacgcaaccuuacaauuauggaccuccacccagggucuggcaagacgcggcgcuacuugcccgcuaucguccgugaggccaucaagcgcaagcugcggacccucauucucgcgcccacgcgcgugguggcguccgagauggccgaagcucuaaaaggcaugcccauccgcuaccagacuaccgccgucaagagcgaacacacagggcgagagaucguggaccugaugugccacgcgaccuucaccaugcgccuccugucaccggugcggguccccaacuacaacaugauuaucauggacgaggcucacuucacagaccccgccagcaucgccgcgcgcggguacaucuccacccggguuggcaugggcgaggcggcggccaucuuuaugaccgccacgccgcccgggagcguggaggccuucccacaauccaacgcagucauacaggacgaggaacgcgacauuccagagcguagcuggaauuccggcuaugacuggaucaccgacuuucccggaaagaccgugugguucgugcccuccaucaagagugggaacgacaucgccaacugcuuacgcaaaaacggcaagcgagucauucagcucagccgcaagaccuucgacaccgaguaccagaagacgaaaaacaacgauugggauuacguuguuaccacagacaucuccgagaugggggccaacuuccgagcagaccgcgucaucgauccccggcgcugccugaagccggugauacugaaggacggcccggagcgggugauucucgcuggucccaugccggucaccguggccagcgcagcgcagaggcgcggccgcaucggccggaaccagaacaaggagggcgaccaguacguauacaugggccaacccuuaaacaacgacgaggaccacgcccauuggacugaggcgaagaugcugcucgacaacaucaauaccccugaggggauaaucccggcacuguucgagcccgaacgcgaaaagucagccgccaucgacggcgaguaccgcuuaagaggggaggcccgcaagaccuucgucgagcucaugcgucggggcgaccugcccgucuggcugagcuacaagguagcguccgagggcuuccaguauagcgaccggcgcuggugcuucgacggcgagcggaauaaccaggugcucgaggagaacauggacguagagaucuggaccaaggagggcgaacgcaagaagcugcggccccgauggcuggacgcccggaccuacuccgauccguuggcccugcgcgaguuuaaggaguuugccgccgggagaagaagcgucagcggcgaccugauucucgagaucggcaaauugccccagcaucugacguugcgggcgcagaacgcccuggacaaucuugugaugcuccacaauagcgagcaagggggcaaggccuaccgccacgccauggaggagcuacccgacacaaucgagaccuugaugcuccuggcgcugauagcagugcucacggggggcgucacguuauucuuccugucagggaagggccugggcaagaccuccauagggcugcugugcgugacagccuccuccgcccucuuguggauggccaguguagagccccauuggaucgcggcuuccaucauucuggaguucuuccucaugguguuauugauuccugaacccgaccggcagcgcacuccucaggacaaccaguuggccuacguugugaucggccugcuguucaugauccuaacgguggccgcuaacgagauggggcugcuggagaccaccaaaaaagaccucggcaucgggcacguggcggcagagaaccaccaacacgcgacuaugcuggacguggaccugcggccggcuuccgcguggacgcuauacgcggucgccacuaccgugaucacccccaugaugcgccacacaaucgagaacacuacagccaacauuucccuaaccgccaucgccaaucaagcggccauucugaugggccuagacaagggcuggccgaucuccaagauggacaucgggguacccuugcuggcccucggcugcuacucccaggucaacccgcuuacgcugaccgccgcggugcucauguugguggcccauuacgcgaucaucggcccaggccugcaggccaaagcaacccgggaggcgcagaagaggaccgcugccgggaucaugaagaacccaacgguugacggcauugucgccaucgaccucgaccccgucgucuacgauaccaaguucgagaagcagcugggccagaucaugcuguugauccucugcacgucacagauccugcucaugcggaccacgugggcccugugcgaguccaucacgcucgcgaccggaccgcucaccacauugugggagggcagccccggaaaguucuggaacacuaccaucgcaguguccauggccaacaucuuucggggcagcuaccuugccggcgcugggcucgcauucucccugaugaaguccuuaggcgggggccgccgagggacaggugcccagggcgagacgcuaggggaaaaguggaaacgccaacugaaccaguuguccaagagcgaguucaacauuuacaagcguagcgguauaauggaagucgaucgcuccgaggccaaggagggacucaaacggggagagaccacaaagcaugcggucucgcgcggcacggcuaaacugcggugguucguagagcgcaaccuagugaagcccgaaggcaaggucauugaccugggcugugggcggggcgggugguccuacuauugugccggccuuaagaaggugaccgaggucaagggauacacuaagggcggcccggggcaugaagagccgauccccauggccaccuacggcuggaacuuaguuaagcuacacagcgggaaggacguuuucuucaugccgcccgagaagugugauacccuccucugcgacaucggcgaguccagcccgaaccccaccauugaagagggacgcacacugcgggugcucaagauggucgagcccugguuacgcggcaaccaguucugcaucaagauucugaaccccuacaugccguccguuguggagacccucgagcagaugcagcggaaauacggcgggauguuaguccgcaacccccugucgcggaauaguacccacgagauguacugggugucgugcggcaccgggaacaucgugucagccgugaacaugacgagccgcaugcuccugaaccgguucaccauggcccaucgcaagcccaccuacgagcgcgacguggaccugggcgcaggcacgcggcacguggcaguugaacccgagguggccaaccucgauaucauagggcagcguaucgaaaacaucaagaacgagcauaaguccacguggcacuaugacgaggacaaccccuacaaaaccugggccuaccacggcagcuacgaggugaagcccagcggaagcgccuccagcauggugaacggaguggugcggcugcugaccaagccuugggacgucaucccaauggugacccagauagcgaugacggacacgacgccguucgggcagcagagagucuucaaggagaagguggacacccggacaccccgcgccaaacggggcaccacccagaucauggaggugaccgccaaguggcucuggggcuuccugucccgcaacaagaagccccggauaugcacgagagaggaguucacccgaaagguaagguccaacgccgcgaucggggcgguguucgucgacgagaaccaguggaacagcgccaaagaggccguagaggacgagcgguucugggaccuggugcaucgcgaacgggagcuccacaagcaaggaaagugcgcgaccugcguauauaauaugauggguaaacgcgagaagaaauuaggugaauucgguaaggcgaagggcagccgggcuaucugguauaugugguugggcgcccgcuuccucgaguucgaggcccugggcuuuaugaacgaggaccacugguucagccgggagaacucucugagcggagucgagggggagggccuccauaagcugggguacaucuugcgcgacaucuccaagaucccgggugguaacauguacgccgaugauaccgcggggugggauacacgaaucacugaggacgaccuccagaacgaggccaagaucaccgauaucauggagccugagcacgcuuugcuggccacaucgaucuucaagcugacguaccagaacaaaguggugcgaguccagcgccccgcaaagaacggcaccgugauggacgugauaucccggcgcgaccagcgggggagcggccaggucggaaccuaugggcugaauaccuucacgaauauggaaguacagcugauccgccagauggaauccgaggguaucuuucuacccucagaacuagagaccccgaaucuggcggagcggguauuagauuggcuggagaagcacggggccgaacgucugaagcggauggccauauccggugacgacugcguugugaaaccuaucgacgaccgcuucgccaccgcucucaccgcgcugaacgacaugggaaagguccggaaagacauaccccagugggagcccagcaagggcuggaacgacuggcagcaggucccguucuguagucaccacuuucaccagcugaucaugaaagacggccgggagaucguggugcccugccggaaccaagacgaacucgucgggcgcgcccgggugagccagggcgccggcuggucccugcgcgagaccgccugcuugggcaaaagcuaugcccaaauguggcagcuaauguacuuccaccggcgcgaccugcggcuagccgcuaacgccaucugcucggccgucccggucgacugggugcccaccucccgcaccaccuggagcauccacgcacaccaccaguggaugacuaccgaagacaugcucuccguguggaaccggguuuggaucgaggagaacccguggauggaagacaagacccaugugagcucaugggaggagguccccuaccuggggaagcgcgaagaccaauggugcggcucccugauuggccuaaccgcucgcgccaccugggcgacuaacauccagguugcgauaaaccaggugcgccgccuuauagggaacgaaaauuaccuggacuauaugaccagcaugaagcgguucaagaacgagagcgaccccgagggggcgcucugguga

SEQ ID NO: 23939 - RNA, 9879 nt, Artificial Sequence
  derived and/or modified CDS sequence (opt11) from DENV-1__GQ199857__SS-prME
uccguaacuaugcugcugaugcuguuaccgacggcgcucgccuuucauuugaccacccgagggggugaaccgcacaugauugugaguaagcaagaacggggcaagucgcuccuguucaagacaagcgccggggugaacaugugcacccugaucgccauggacuuaggugaacuuugcgaagacaccaugacguauaagugcccccagaucaccgaagccgagcccgacgacguggacuguuggugcaacgccacggacaccugggugaccuacgggaccugcucucaaacuggcgagcauaggcgggacaagcgcucuguugccuuggcgccucacgugggucugggccucgagacucggacagaaaccuggauguccuccgagggcgcguggaagcagauccaacgcgucgaaaccugggcccugcgacaucccggguucacggugaucgcccuauuccucgcgcacgccauaggcaccucaaucacucaaaaggggaucaucuucauccugcuuaugcucgugacccccuccauggccaugcgcugugucgggauuggcaaccgggauuucgucgaggggcugagcggggccacguggguggacgucgucuuagagcacggguccugcgugaccaccauggcuaagaacaagccaacccucgacauagagcuccugaagacggaagucaccaaccccgcgauccuccggaagcugugcaucgaggccaagauuagcaacaccacuacugacucaagguguccgacccagggcgaggccacccugguggaggagcaggacgccaacuucgugugucgccggaccuucgucgaccgcgguugggguaauggcugcggacucuuugggaaggggagccugcugacgugcgccaaguucaagugcgucaccaagcucgagggcaagaucguucaguacgagaaccuaaaguacuccgugaucgugacagugcacaccggggaucagcaccaggucgguaacgagacgacugagcacggcaccauugcgaccaucacgccacaggcccccacaagcgagauccaacugaccgacuacggggcacucacccuggacugcagccccaggaccggccuggacuucaaugagauggugcucuuaacgaugaaggaaaagucuuggcugguccauaagcaaugguuccucgaccugccgcugcccuggaccuccggggccagcaccucacaagagacuuggaaccgccaggaucugcuggugacauucaagacggcccacgcaaagaagcaggaggucgucguguuaggcucccaggaaggcgcaaugcacaccgcgcucaccggugccacagagauccagaccagcggcaccaccacgaucuuugcggggcaccugaagugucggcugaagauggacaagcuaacguuaaaggggaccuccuacguuaugugcaccggcagcuucaaacuugagaaggaaguugcggagacgcagcacggcaccgugcugguccaggucaaguacgagggaaccgacgcgccuuguaaaauccccuucuccacccaagacgagaaggggguaacgcagaauggccgccugaucaccgcgaauccaauuguaacagacaaggagaagcccgucaacaucgagacggagccgccauucggcgagucguacaucguggugggcgcuggcgaaaaggcgcugaaacuuucgugguucaagaaggggucgaguaucggaaagauguucgaggcuacggcccgcggggcccgccggauggccauccucggcgacaccgcuugggacuucgguagcaucggaggcgucuuuaccagugugggaaaacuugugcaccagguuuuuggcacggcuuacgggguguuauucagcggcguauccuggacgaugaaaauagggaucggcauccuacugacguggcugggccucaacagccgcuccaccagccuaucgaugaccugcauugccgucgggauggugacucuguaccucggcgucaugguacaggccgacagcgggugugugaucaacuggaaggggagagagcuaaaaugcggguccggcaucuucguuaccaacgagguacacaccuggaccgagcaauacaaguuccaggccgacucuccgaagcggcuuagcgcggcuaucggcaaagccugggaggagggugugugcggcauucgauccgccacccgacucgaaaacaucauguggaagcagaucagcaacgagcugaaccacauccugcucgagaaugauaugaaguucaccguugucgugggagaugccaacggaauccuggcucaagggaagaagaugauccgcccccaaccgauggagcacaaguacuccuggaaguccuggggcaaggccaagauuaucggcgccgacauacaaaauacgaccuucauuauagacggccccgauacccccgagugucccgacaaccaaagagccuggaauauaugggagguggaggacuacggcuucgggaucuuuaccaccaacauauggcugaagcuacgcgacuccuacacccagaugugcgaccaccggcugaugagcgccgccaucaaggacuccaaggccguccaugcggauaugggauacuggaucgagagcgagaagaacgagacuuggaaacucgccagggccuccuucaucgagguuaagacaugcaccuggcccaaaagccacacacucugguccaacggcgugcuggaaagcgagaugaucaucccgaagauauacggagggccgauuagucagcacaauuaucgccccggguacuucacccagacggcgggccccuggcaccuggggaagcucgagcuggacuucgaccugugcgagggcacuaccgucgugguggacgagcacugcggcaaccgcgguccgagccuucggacgacgacggucaccggcaagaucauucacgaguggugcugccgcucaugcacacugccgccccuccgguuucgcggggaggacggcugcugguacgggauggagauucggccagugaaggaaaaggaagagaaccuugugcgcagcauggucuccgccggcagcggcgagguggauucuuucucccuagggauccugugugccucaaucaugaucgaagaggugaugcgcucccgcuggagccgaaagaugcucaugacagguacucuggccgucuuccugcuccugaucaugggccagcugacauggaacgaccucauucgccuuugcaucauggugggcgccaaugccuccgaccgcaugggaauggggaccacguauuuagcucucauggccacuuuuaagaugcguccgauguucgccguggggcuacucuuccggcgguugaccagccgcgagguccugcuucucacuaucgggcuguccuuaguggcgagcguagaguuacccaacucccuggaggagcugggagacgggcucgccaugggcaucaugaugcugaaacugcucacagaguuccagccccaccagcuguggaccacccuucucagccugaccuucauuaagaccacucugucccuggacuacgcuuggaagaccaccgcgauggcgcuguccauaaucucgcuguucccccucugccuguccacgaccucccaaaagacuaccuggcugccuguccuccugggcucuuuugggugcaagccccugaccauguuucucaucacggagaacaagaucuggggcagaaaauccuggccgcugaacgaaggaaucauggcgaucggaaucgucagcauccuccucuccagucuucuaaagaacgacguuccccucgccgggccgcugaucgcgggcggcaugcugaucgcguguuacgugaucagugggucuagcgcugacuugucccuggagaaagccgccgagguuagcugggagcaggaagccgaacacucagggaccagccauaacauccuggucgaagugcaagacgacgggaccaugaagaucaaggacgaggaaagggacgacacccuaaccauccugcucaaagcgacccuccucgcgguauccggcgucuaccccauguccauccccgccacucuguucguaugguacuucuggcagaagaagaagcagcgguccgguguccucugggauacccccagcccacccgaggucgagcgcgccguccuggacgacggaaucuacagaauccugcaacgcgggcuacucgggcguucccaagugggcguaggcguguuccaggacggcguguuucacacgauguggcacgucacacgcggggccguguuaauguaucaggguaagcggcuggagccuagcugggcgagcgucaagaaggaccuuaucagcuacggcgguggcuggcgguuccagggguccuggaacaccggcgaagagguccaggugaucgcgguagagcccgggaagaacccgaagaacguccagaccacgcccgguaccuuuaagacccccgagggcgagguaggggccaucgcacuggacuucaagcccggcaccagcgguuccccgaucgugaacagggagggcaaaaucgucggucuguacggcaaugggguugugacgacaagcggcaccuaugucagcgccaucgcgcaggccaaggcuagucaggagggcccccuucccgagauagaggacgagguguucaagaagcguaacuuaacaaucauggaccuccacccuggaagcggcaaaacacggcgcuaccuccccgccauugugcgagaagcaaucaagcgcaaacugcggacccugauccucgcgcccacccgcgucguggcuuccgagauggccgaagcccuaaaaggcaugcccaucagguaccagaccacggccguuaagagcgagcacacuggucgggagauaguugaccugaugugccacgccacauucacgaugagacucuugucccccgugcgcguucccaacuacaacaugaucaucauggacgaggcucacuucacggaccccgccagcaucgccgcccguggcuacauauccacgcgggucgggaugggggaggcggcugccaucuucaugaccgccacgccgcccgguagcguggaagccuucccccaguccaacgcggugauccaggacgaggagcgcgacauccccgaacggucauggaacagugguuaugauuggaucacggacuucccgggcaagaccgucugguucgugcccuccauuaaguccgggaaugacaucgcaaacugcuuacguaagaacgggaagcgggugauccagcucagucgcaagacauucgacacagaguaccaaaagacgaagaacaacgacugggacuaugucgugaccacugacaucagugagaugggggccaauuuccgggccgaucgcgucaucgacccccggcgcugccugaagcccgugauccucaaggacggcccggaacgagugauccuagcggggccgaugcccgugaccgucgccuccgccgcucaacgccggggccgcaucggccguaaucagaacaaggaaggggaucaguauguauacauggggcagccacuuaauaacgacgaagaccacgcccauuggacggaggcuaagaugcugcucgacaacaucaacaccccagaggggaucaucccggcccucuuugagccagagcgcgagaaaagugccgccauugauggcgaguaucgucugaggggcgaagcccgcaaaaccuucguggagcucaugcgccgcggcgaccugcccgucuggcuaagcuauaaggucgcguccgaaggcuuccaauacagcgaccggcggugguguuuugacggagagcggaacaaucagguccucgaggagaacauggauguugaaaucuggaccaaggagggcgagagaaagaagcugcggccccgauggcuugaugcucggaccuacuccgacccgcucgccuugcgcgaguucaaggaguucgccgccgggcggcgcagcgugucuggcgaccuaauccucgagauagguaaauuaccucaacacuugacgcuacgcgcgcagaacgcccuagacaaccugguaauguugcauaauagugagcagggcgggaaagccuacaggcacgccauggaggagcugcccgacaccaucgaaacccugaugcuccucgcgcugauugccgugcucacagggggcgugacgcuuuucuuccugagcgggaaaggccuaggcaagaccuccauugggcugcuguguguuaccgcaagcuccgcacuccuguggauggccagcguggagccccacuggauugcugcuucaaucauccuggaguucuuccucauggugcuguuaaucccggagcccgaucggcagcguacgccccaggacaaucagcucgcuuacgucguuaucggccugcuguucaugauccuaaccguggccgccaacgagauggggcuccuggaaaccaccaagaaggaccucgguaucgggcacgucgcggcggagaaccaccaacacgccacgaugcuugauguugaccugcggccggccagcgccuggacgcucuacgcgguagccaccacgguaaucacaccuaugaugcgccauacgaucgagaacaccaccgcaaacaucuccuugaccgccauugccaaccaggcggccauucugaugggccuagacaagggcuggcccauaaguaagauggauaucgggguuccccuucuggcccuaggcuguuacucccaggugaacccacugacccugaccgccgcgguccucaugcuggucgcccacuacgccauaaucggcccggggcuacaggccaaggcgacacgggaggcgcagaagcgcaccgcggccgggaucaugaagaaccccacaguggacggcaucgucgccaucgaccuagaccccguggucuacgacaccaaguuugaaaagcagcuuggacaaaucaugcugcucaucuugugcaccucccagauccugcucaugcgcacuacuugggcacugugcgaguccaucacccuagcuaccgggccgcuuaccacauugugggagggaagccccgggaaauucuggaacaccaccaucgccgucuccauggccaacauauuccgcgguucauaucuggccggugccgggcucgcuuucucuuugaugaagucccugggcgggggccgacgggggaccggggcacagggcgaaacgcugggggagaaguggaaacgacagcugaaccagcuguccaaguccgaguucaacaucuacaagcggagcggcauuauggaaguagaccgcagcgaggccaaggaggguuuaaagcggggugagacgacgaaacacgccgugagccgcgggacggcgaagcugcgaugguuugucgagcgcaaccugguuaagcccgagggcaaggugaucgaucugggcugcgguagaggcgggugguccuauuacugcgccggccucaaaaaggucacagaggugaagggauacacgaagggcggccccggccaugaagaaccgaucccgauggccacauacggcuggaaccuuguuaagcugcacagcgguaaggacguauucuucaugccgccggagaagugcgacaccuuacugugcgauaucggugaauccagcccuaaccccaccaucgaggaagggcggacguugcggguucucaagaugguggagccaugguuacguggcaaucaguuuuguaucaaaauccugaaucccuacaugccguccgucguggagacccucgagcagaugcagcguaaguacggugggaugcuugugcgcaacccccucagccgcaauuccacccacgagauguacugggucucguguggcacagggaacaucgugagcgcugugaacaugaccucacgcaugcuccugaaucgguucacuauggcccacagaaagcccaccuacgagcgcgacgucgaucucggggcugggacccgacauguagccguggagcccgaagucgccaaccucgacauaaucggucaaagaauagagaauauuaagaaugaacacaaguccacguggcauuacgacgaggacaacccguacaagaccugggcauaccacggcucauacgaggugaagccuucgggaagcgccuccagcauggugaacggcgucgugcggcugcugaccaaaccaugggacgugauacccauggucacccagaucgcgaugacggauacgaccccguucgggcagcagcgcguguuuaaggagaaggucgauacgagaacgccgcgcgccaaaagaggaaccacccaaaucauggaggucacagccaagugguuauggggcuuccugucccguaacaagaagccacggaucuguacgcgggaagaguucaccaggaagguucgcagcaacgccgccauaggugcuguauucaucgacgagaaccaguggaacagcgccaaagaagccguggaggacgagcgguucugggaccuggugcaccgcgagagggagcuccacaagcaaggcaaaugcgcgaccugcgucuacaacaugauggggaagcgcgagaagaagcugggcgaguucgggaaggcgaagggcagccgggcuauaugguacauguggcugggcgcucgcuucuuagaguucgaggcccugggguucaugaaugaggaccacugguucucacgagagaacucccuuagcggaguggagggggagggguuacacaaacuggguuacauacuacgagacaucucaaagaucccgggcggcaacauguacgccgacgacaccgccgggugggacacgcggaucaccgaggaugaccuccagaaugaggcgaagaucacagauaucauggagcccgagcaugcccuccuggcgacuagcauauucaaacuuacguaccaaaacaaagugguucguguucagcgacccgccaagaacggcacaguuauggacguaauaucgcgucgugaccaacgugggagcggccaagugggcacguacggauugaauaccuucacgaacauggagguccagcugauccgccagauggaaucugaggggaucuuucuucccagcgagcuggagaccccgaaccuggcggagcgggucuuagacuggcuggagaagcacggggccgagcguuuaaagcggauggccaucuccggcgacgacugcguggugaagcccaucgacgaccgauuugcgaccgcccucaccgcucugaacgacauggggaagguucggaaggauaucccacagugggagcccagcaagggcuggaacgacuggcagcaagucccguucugcucccaucacuuccaucagcugaucaugaaggacggccgcgagauuguugugcccugccggaaucaggacgagcugguggggagagcccgggugagccagggcgcaggguggucccuccgggaaacagcgugcuuagguaagagcuacgcccagauguggcaguugauguauuuccacaggcgcgaccugcgacuggcggccaacgcaaucuguucagcaguccccguggacugggugccuacgagccgcaccaccuggucgauccacgcccaccaucaguggaugacuacagaggauaugcucaguguguggaaccguguguggauugaggagaacccguggauggaagacaaaacccacgugagcaguugggaagaaguccccuaccuggggaagcgggaggaccaguggugcggcaguuuaaucggccucaccgcccgcgcgaccugggccacgaacauucagguagcaaucaaccaagugcgacgccugaucgggaacgagaacuaucuggauuacaugaccaguaugaaacgguuuaagaaugagagcgaccccgaaggugcucucugguga

SEQ ID NO: 23940 - RNA, 9879 nt, Artificial Sequence
  derived and/or modified CDS sequence (opt11) from DENV-1__GQ199858__SS-prME
ucggugacaaugcugcucaugcugcugccaaccgcacucgccuuucaccugacuaccagaggaggggaaccccacaugauagugaguaaacaagagcggggcaaaagccucuuauucaaaaccagugcuggugugaauaugugcacccugauugcgauggaccugggcgaguugugcgaggacacuaugacuuacaagugcccccagaucaccgaggccgaaccugacgacguagacuguuggugcaacgccacggauaccugggugaccuacgggaccugcagucagaccggggagcaccggcgcgauaaaagaucaguggcccuggcgccccacguaggucugggccuggagacgaggacggagacuuggaugucguccgaaggcgcguggaagcagauacagcgggucgagacuugggcccuccggcaccccggguuuacggugauagcccuguuccucgcacacgccaucgguaccagcaucacccagaaggggauaaucuucauccugcucaugcuugugacccccuccauggcgaugcgcugcgucgggaucgguaaucgggacuucguagaggggcuaagcggcgccacgugggucgacgucgugcuugaacacgguucgugcgugaccacaauggccaagaacaaacccacucucgauaucgagcugcugaagacggaaguaaccaacccggcgauucuccgcaagcucugcauugaggcaaagauaucuaacaccacuacggacucccgauguccgacccagggggaggcuacccucguagaggaacaggacgccaauuucgugugcaggcggacguuuguugaccgcggcugggggaacggcugcggccuuuucggcaaggggagccugcugacuugcgcuaaguuuaagugcgugaccaaacucgagggcaagauagugcaauacgagaacuugaaguacuccgucauagugacggugcacaccggugaucagcaccagguugguaacgagacaaccgagcacgggaccaucgcuaccauuacaccccaggcccccacaagcgagauacagcugacugacuauggggcguuaacccuugacugcagcccucgaacugggcuggacuucaacgagauggugcuccugacgaugaaggagaaaagcuggcuggugcacaagcagugguuccucgaccugccccugcccuggaccuccggggccagcaccucacaggaaaccuggaaccgacaggaucuccucgugacguuuaagaccgcccaugcgaagaagcaggaggugguugugcuggggucccaggagggugccaugcauacggcacucaccggggccacagagauccagacguccggcaccaccacuauauucgccggccaccugaagugcaggcugaaaauggacaaauugacacugaagggcaccuccuacgugaugugcaccgggagcuucaagcuggagaaggaggucgcggagacgcagcacggcaccguguuggugcaggucaaauacgaaggcacggacgcucccugcaagaucccauucuccacacaagaugagaagggggugacgcagaacggccggcucauuaccgccaauccgaucgugacggauaaggagaaacccgucaauaucgagaccgagccacccuucggggaguccuauaucguggugggcgccggcgagaaggcauugaaacuguccugguuuaagaagggaagcuccaucggcaagauguuugaggcaacggcccgcggugcccgacggauggccauacucggggacacggcgugggacuuugggagcaucggaggcgucuucaccuccgugggcaagcugguccaccagguguucggcaccgccuacggcgugcuguucagcggcguguccuggacgaugaaaaucggcaucgguauccuccugaccuggcugggccucaacagcaggucuaccucccuguccaugaccuguaucgcugucgggauggugacauuauaccuaggcgugaugguccaagcugauagcgggugcgucaucaacuggaagggccgagagcucaaaugcgggucugggaucuuugugacgaacgagguccacaccuggaccgaacaguacaaauuccaggccgacucuccgaagagacugagcgcagcaaucggcaaagcgugggaagagggggugugcgguauaagguccgcgacccggcuagagaacaucauguggaagcagaucagcaaugagcucaaccacaucuuacucgagaacgacaugaaguucacgguaguagugggugacgccaacggcauacuggcgcaagggaagaagaugauccgcccccagcccauggaacacaaauacuccuggaaauccuggggaaaggcuaagaucaucggagccgauauccagaacaccaccuucaucaucgacgggcccgacaccccggagugccccgacaaccagcgggccuggaacaucugggagguugaggauuacggcuucgggaucuucacgaccaauauuuggcugaaguugcgcgacuccuacacccagaugugugaccaucggcucaugucugcggccaucaaggacuccaaggccgugcacgcugacauggguuauuggaucgagagcgagaagaacgaaaccuggaagcuggcgcgagcguccuucaucgaagugaagacaugcaccuggcccaagagccacacccuaugguccaacggcgugcuggaaagcgagaugaucaucccgaagaucuacgguggccccaucucucaacacaacuaccgcccaggguacuucacccagacugcgggaccauggcaccucgguaagcucgaacuggacuucgaccugugugagggaacaacugucgugguggacgagcacugcggcaaccgcgggccgagccuacggaccacgaccguaaccggcaagaucauccacgaguggugcugccguuccugcacccugccuccccugcguuuccgcggggaggacggcuguugguauggaauggagauccggcccgugaaggagaaagaggagaacuuagugcgcuccaugguguccgcagguaguggagaaguggacucuuucucccuggggauccugugcgccagcauuaugaucgaagaggugaugcgguccagguggucuaggaagaugcucaugaccggcacccuggccgucuuccuguugcuuaucauggggcaguuaaccuggaacgaccucauucgccugugcauuauggucggugcgaacgcguccgaucgcauggguaugggcaccacguaccucgcccucauggccaccuucaagaugcggcccauguucgccgugggccugcuuuucaggcggcugaccagccgcgagguccuacuccucacgaucgggcuaucccugguggccagcguggagcucccgaacucccuggaggagcugggugacgggcuagccaugggcaucaugaugcugaaguugcucacggaguuucaaccccaccagcuguggaccaccuugcugucucugaccuucaucaaaaccacccugucccucgauuacgcguggaagaccaccgccauggcgcugagcaucauuucccuguuuccucucugcuugagcacgaccucccagaagaccaccuggcugccgguccuccuuggcucuuuugggugcaagccccuaaccauguuccucaucaccgagaauaaaaucugggggcgcaaguccuggccccuaaacgaggggauuauggccaucggcaucgucagcauccugcucucgucccugcugaagaacgacgucccccucgccgggcccuuaaucgcgggcggcaugcugauugcaugcuacgugaucagcggguccagcgcggaccucucccuggaaaaggccgcggagguuagcugggagcaggaggccgagcacuccgguaccagccacaauauucugguugaagugcaggacgacgggaccaugaaaaucaaggacgaggagcgagacgacacucucacaauccuguugaaagccacccuccucgcuguguccggcgucuauccuaugucuauccccgccacacuuuucgugugguauuucuggcagaagaagaagcagcgguccgggguucuuugggacacccccucacccccugagguagagagagccgugcuggacgauggcaucuaccggauccugcagcgcggccuacucgggagaucccaggugggagucgggguguuccaggacggcguauuucacacgauguggcaugucacuagaggggccguccuaauguaccaaggcaagcggcuggagccuagcugggcauccguaaagaaggaccucaucagcuacggcggugguuggagauuccagggguccuggaacaccggcgaggagguucagguaaucgcgguggagcccggcaaaaauccgaagaacguccagacaacgcccggcacuuuuaagacccccgaaggugaggugggcgccauagcgcucgacuucaagccaggcacuagcggaucccccaucgugaacagagagggcaagaucguaggccuuuacgggaacggcgugguaacgaccagcggcaccuacguauccgccaucgcccaggcgaaagccagccaggagggcccccucccggagaucgaggacgagguguuuaagaaacgcaaccugaccaucauggaccugcacccagggucaggcaagacucggagauaccuccccgccaucguucgggaggccaucaaacguaaguugcggacccugauccucgcaccaacgcgcgucguagcuuccgagauggcagaggcgcucaagggaaugccgauucgcuaccagaccacggccgucaagagugaacauaccgggcgggagauagucgaucugaugugucacgcgaccuucacgaugcgccuccugucgccggugcgggugcccaacuauaacaugaucauaauggacgaggcccacuucacggacccagccagcaucgccgcccgcggcuauaucuccacccgggucgggaugggcgaggcagcugccaucuucaugacagccacuccgccugggucaguggaagccuucccccagucgaaugcgguuauccaggacgaggaacgugacauccccgagcggucguggaacuccggcuaugacuggaucacggauuuucccggcaaaaccgucugguucguaccgagcaucaaguccgggaacgacaucgcgaacuguuugcgcaagaauggcaagcggguaauccagcucagccguaaaaccuucgacaccgaguaccagaagacuaagaacaacgacugggacuacgucguaaccaccgacaucagcgagaugggagcaaauuuucgggcggaccgugucaucgacccgcggcgcugccugaagcccgucauccugaaagaugguccggagcgggugauuuuagcagguccuaugcccgugacaguggccagugccgcccagcgcaggggccgcauuggccgcaaccagaacaaggagggggaccaguacguauacauggggcagccccugaacaacgacgaggaccaugcacacuggacggaggcgaagaugcugcucgacaacaucaauacccccgaggggauuauuccggcuuuauucgagcccgagcgcgagaaguccgccgccaucgauggcgaauaccgcuuacgcggggaggcccgcaaaaccuucguggagcucaugcggcgcggcgaccugcccguuuggcugaguuacaagguggcguccgagggcuuucaguacucagacagacgcuggugcuucgauggagaacgcaacaaccaggugcucgaggaaaacauggacguggagaucuggaccaaagagggcgagcgcaagaagcugcgacccagauggcucgacgcccgaaccuacuccgacccgcucgcacuacgcgaguucaaggaguucgcggccgggcgccgcucugugagcggcgaccugauccucgagaucggcaaacuuccccagcaccugacccuucgggcucagaacgcuuuagacaaccuggucaugcuccacaacuccgaacagggcgguaaggccuaccgucacgcgauggaggaacugccagacaccauugagacccuaaugcuccuggcacugaucgcaguucucacugggggcgugacguuauuuuuccugagcgggaagggacugggaaagaccuccaucgggcuguugugcgucaccgccagcuccgcccuccuuuggauggccagcguggagccccauuggauagcggccuccaucauccuggaguucuuccucauggugcugcucaucccggagccugaccggcagcgcacgccccaagacaaucaguuggcuuacgucgugaucggucugcuguucaugauccucacuguggcugccaacgagauggggcucuuggaaaccacaaagaaggaucucgggaucgggcacguugcggcggagaaccaccagcacgcuacgaugcuagacguggaucuucguccggccucggccuggacccucuacgcgguggcuaccacgguuaucacaccaaugaugcgccauacgaucgaaaacacuaccgccaacaucuccuuaacggcuauugcuaaccaggccgccaucuugaugggccuagacaagggcuggccgaucagcaagauggauaucggggugccccuguuagccuuaggcugcuauucccagguaaauccgcugacucugaccgcggcgguccucaugcugguggcucauuacgccauaauaggucccggucugcaggcgaaggccacccgggaggcgcaaaagagaaccgccgccggcaucaugaagaaccccacaguggacggcauaguagccaucgaccucgaccccguaguguacgacacuaaauucgaaaaacagcugggacagaucaugcuucuaauccugugcaccucgcagauucugcucaugcgcacaacuugggcccugugugaaaguaucacccuggcgacgggaccccucacgacgcugugggagggcagccccgggaaguucuggaacacaaccaucgccgucuccauggccaacaucuuuagggggagcuaccuggccggagccgggcucgcguuuucacuaaugaagucccucggcgggggccgccgggggaccggagcccagggcgagacccucggggagaaguggaagcgccaacugaaucagcugucgaagagugaguuuaacaucuacaagcggagcggcaucauggaggucgaccgcagcgaggccaaggaggggcucaagcggggcgagaccacaaagcacgccguaagucgcggcacagcgaaacuucguugguucguagagcgaaaccuggugaaacccgaaggcaaagugauagauuuagggugcgggagaggagggugguccuauuacugcgccggauuaaagaaggucaccgaggucaagggguacacgaagggcggacuggggcacgaggagcccaucccgauggcgaccuacggauggaaccuggugaaacuacacagcggcaaagacgucuucuucaugccaccagagaaaugugauacccugcuaugugacaucggcgaauccagccccaauccgaccaucgaggaggggcggacgcuccgggugcugaaaaugguggaacccuggcugcgcggcaaccaguucugcaucaagauccucaaccccuacaugccguccgucguggagacgcuggagcagaugcagcguaaguacggagggaugcugguccggaacccgcucucaagaaauuccacgcacgagauguacugggucucuugcggcacgggaaacaucguguccgccguaaacaugaccagccgcaugcugcugaaucgguucacaauggcccaucgcaagcccacauacgaacgcgaugucgaccugggcgcgggcacccgucacguggccguggagcccgagguggccaaccuggacaucaucgggcaaagaaucgagaauauuaagaacgagcauaagucaacguggcauuacgacgaggacaaccccuacaagacuugggccuaccacgguagcuacgaggugaagccgucaggcucugccuccagcauggucaacggcguggugcggcuguuaaccaagccaugggacgugauccccauggucacccagaucgcgaugacggauaccaccccuuucggucagcagcguguguucaaggaaaagguggacacccguacuccgcgcgccaagcggggcaccacccagauuauggaggugaccgccaagugguuguggggauuucugucgcgcaauaaaaagccuaggaucugcacgcgcgaagaguucacccggaaggugcgcucaaacgccgcaaucggggcggucuucguggacgagaaccaauggaacucggccaaggaggcaguugaggacgaacgguuuugggaccucguucacagggagcgggagcugcacaaacagggaaaaugugcgaccugcgucuacaacaugauggggaagcgcgagaagaaacugggcgaguuugggaaggcgaagggcucccgggccaucugguacauguggcucggcgcccgguuccuugaguuugaggcccugggguuuaugaaugaggaccacugguuuagcagagagaacucccucagcggcguggagggcgagggccugcacaagcugggguacauccuucgcgacaucuccaaaauacccggcgguaacauguacgcagacgacacagcggggugggacacccggaucacugaggacgaccugcagaaugaggccaaaauaaccgauaucauggagccggagcaugcccugcucgcuaccuccaucuucaagcugacguaucagaacaaagucgugcgagugcagagacccgcaaagaauggcaccguuauggacguaaucucacggcgcgaccaacgggggagcggccaggugggcaccuacggauuaaauacauucacgaauauggagguccagcucaucaggcagauggagucggagggcaucuuccugccuucggagcuggaaaccccgaaucuugcagagcgggugcuggacuggcuggaaaagcacggagcugagcgauuaaagcguauggccaucuccggcgaugauugcgucgucaagccgauugacgaccguuucgccaccgccuuaacugcucugaacgacauggggaagguucggaaagacaucccgcagugggagcccagcaagggcuggaacgauuggcaacagguccccuucugcucucaccacuuccaccagcugaucaugaaggacggccgcgagaucgucgugccgugccggaaccaggacgagcugguuggucgcgcccgcgugucacagggagccgguuggucacugcgcgagacugccugccucggcaagucuuacgcccagauguggcaguugauguacuuucaucgucgcgacuugcgguuagcggccaacgccaucugcucugccgugcccgucgacuggguccccacgagccguaccaccuggagcauccaugcgcaccaccaguggaugacuacggaggacauguuguccguguggaaccggguguggaucgaggagaaccccuggauggaggacaagacccacgugucuucgugggaagaggugcccuaccuggggaagcgcgaggaccaguggugugggagcuugauuggccucaccgcacgcgccaccugggcgaccaacauacagguggcaaucaaccagguucggcgccuaaucgggaacgagaacuaccucgacuacaugaccuccaugaaacgcuucaagaaugaguccgaccccgagggcgcucugugguga

SEQ ID NO: 23941 - RNA, 9879 nt, Artificial Sequence
  derived and/or modified CDS sequence (opt11) from DENV-1__GQ199859__SS-prME
agcgugaccauguuacugauguuacugcccaccgcucuugccuuucaccucacaacucgcggcggggagccccacaugauugugucuaagcacgaacgggggaagagccuccuauucaagacgucaaccggggugaacaugugcacgcugaucgccauggaccugggcgagcucugugaggacaccaugaccuacaagugcccccguauuacagaggcggagcccgacgacguggacugcuggugcaacgcaacggacaccugggugaccuacgggaccugcagccagacgggcgagcaccggcgcgauaagcguuccguggcccuggcuccccacgugggccugggguuagagacccgcaccgagaccuggaugagcuccgaaggcgccuggaagcagauccagcggguggagacgugggcccuacgccacccgggguuuaccgugaucgcccuguuccuggcccacgcgauaggcaccagcaucacccagaaggggaucaucuucauccugcugaugcucgucacgcccaguauggccaugcggugcgucggcauaggcaaccgugacuucguggaggggcugucgggcgccaccuggguggaugucguguuggaacauggguccugcgugacaaccauggccaagaacaagcccacgcucgacauagaacugcugaaaaccgaggugaccaaccccgccgugcugcggaagcuuugcaucgaggcgaagaucagcaacaccacgaccgacagucgaugccccacgcagggcgaggccacccugguggaggagcaggacgccaacuuuguaugccggagaacgcucguggaucgggguugggggaacggcuguggacuguucggcaagggaagccugcugacgugcgccaaguuuaagugcguuacaaagcuggagggcaagaucguccaguaugagaaccugaaauacucugugaucguaacuguccacacuggcgaccagcaccagguggggaacgagaccaccgagcacggcaccaucgccacgaucacgccucaagcgcccaccagcgagauccaguuaaccgacuauggcgcccugacucuggacuguagcccccggacgggucucgauuucaaugagaugguucugcugaccaugaaagagaaguccuggcucgugcacaaacagugguuccuggaccugccgcuuccauggaccuccggagccagcacaagccaggagacguggaaccggcaggacuuacuggucaccuucaagaccgcccacgccaagaagcaggaagucgucgugcucggcucccaggagggcgcgaugcacaccgcccugaccggggcuaccgagauucagacuuccggcacaacgaccaucuucgcagggcaucucaagugccgcuugaagauggauaagcugacccugaaaggcaccagcuacguuaugugcacggggucguucaagcuggagaaggagguugccgagacccagcacggcaccgugcucguccaagugaaguacgagggaaccgaugcgcccugcaagauccccuucagcacgcaggacgagaagggggugacacagaacggcaggcugauuaccgccaacccgaucgugaccgacaaggagaagcccgugaacauagagacugagccgcccuucggggagagcuacaucguggucggcgccggcgagaaggcgcuuaaauuaucaugguucaaaaaggggagcaguaucggcaagauguuugaggcgaccgcccgcggcgcccggcgcauggccauccugggcgauaccgccugggacuucggcagcaucggcggaguguucaccagcguggggaagcugguccaccagguguucggcacggcguacgguguccucuucagcggcguauccuggaccaugaagaucgggaucggcauccuacugaccuggcuaggacugaacagccgcagcaccagccugaguaugacgugcauugccguggggauggucacucucuaccuuggcgucaugguucaggccgacucaggaugcgugaucaacuggaagggacgggagcuaaagugcgggucaggcaucuuugucacuaacgaagugcauaccuggaccgagcaguacaaguuccaggccgacagcccgaagcgacucagcgccgcaaucggcaaggcaugggaggagggggucugcggcauccggagcgccacgcgccuggaaaacauuauguggaagcagauuaguaaugaacugaaccacaucuuguuagagaacgacaugaaguucaccgucguggugggcgacgccaacggaaucuuggcccaggggaagaagaugaucagaccccagccuauggagcacaaguacuccuggaaaucuuggggcaaggcaaagauaaucggcgcugacauccagaauaccaccuucaucaucgacgggcccgacacgccggagugccccgacgaccagcgcgcuuggaacaucugggaggucgaggacuacggauucgggaucuuuaccacaaacaucuggcucaaacugcgggacuccuacacgcagaugugcgaccacagauugaugagcgccgcgaucaaggacuccaaggcugugcaugcggacaugggcuauuggauagaaagcgagaagaacgagacguggaagcucgcccgggccuccuucauugaggugaagacuuguaccuggcccaagagccacacccugugguccaacggcguccuggagagcgagaugauuauucccaagaucuacggaggcccgaucucccagcacaacuaucgccccggguacuucacgcaaaccgcgggccccuggcaccucgguaagcuggagcuggacuucgaccucugcgaggggaccaccguaguggucgacgaacauugcggcaaucgggggccgagccugcgcacgaccaccgugaccggcaagaucauccacgaguggugcugucgguccugcacucugccgcccuuacgauuccgcggggaggacggcugcugguacgggauggagauccgcccugugaaggagaaggaagagaaccugguccggagcaugguguccgccggcagcggcgaaguugacagcuucucccuggggauccucugcgucucaaucaugaucgaggaggugaugcgcucaagauggagccgaaagaugcugaugaccggcacccuggccguauuccuccugcugaucauggggcagcucaccuggaacgaccugauccgucugugcaucaugguuggcgccaaugccuccgaccguauggggaugggcacaaccuaccucgcucugauggcuaccuucaagaugcgcccgauguucgccgugggcauccuguuuagacgccucacaagucgggaggugcugcugcucacgaucggacuguccuuggucgccaguguggagcuccccaacuccuuggaggagcugggcgacggguuggccaugggcaucaugaugcugaagcugcucacugaguuccagccacaccagcuauggacgaccuugcugagccugacguucauaaagaccacccugucccucgacuacgcauggaagacaacggccauggccuuaaguaucguaagccuguucccucucugccugucaaccaccucccaaaagaccaccugguugccggugcuccucggcagcuucgguugcaagccacugacgauguaccucaucaccgagaacaagauuuggggucgcaaguccuggcccaucaacgaggggaucauggccaucggcaucgugagcauccuucuaucaagccuccugaagaaugacgugccccuggccgggccgcucaucgccggagggaugcugaucgccugcuacgugauuagcgggucgagcgccgacuuaucguuagaaaaggccgcggaggugagcugggagcaggaggccgagcacuccggcacaucccacaacauccuugucgaggugcaagacgacgggaccaugaggaucaaggacgaggagaaggacgacacgcugacaauauuacugaaagccacacuucucgccguguccggugucuacccaaugagcauccccgccacucuguuugugugguacuucuggcagaagaagaagcagcgcuccgggguguugugggacaccccuuccccgcccgaggucgagcgggcagugcucgacgauggcaucuaccgcauccugcagcggggcuuacuggggcgcucucaggugggagucgggguguuccaggacggcguguuccacaccauguggcacguuacacgcggggcagugcugauguaccagggcaagcgccuggaacccagcugggccuccgugaagaaggaccugaucagcuacggcggcggguggcgguuccaggggucuuggaauaccggcgaggagguucaggugaucgcaguggaacccgggaaaaacccgaagaacguacaaacaaccccuggcacguucaagacacccgaaggcgaggucggggcaauagcacucgauuucaagccgggcacuagcgggucgccgaucgugaaccgagagggcaagaucgucggccuguaugggaacggcgugguuaccaccagcgggaccuacgucagcgccauugcccaggccaaggccagccaggagggcccccugcccgagaucgaggacgagguguucaaaaaacggaacuugacgaucauggaccuucacccggguagcggcaaaacccgccgguaccugcccgccaucgugcgagaagccaucaagcgaaaguugcguacgcugauccuggcccccacccgcguaguggccuccgagauggcggaggcccucaaaggcaugcccauccguuaccagacaaccgccguaaagagcgagcacaccgggcgcgagaucgucgacuuaaugugccacgccaccuucacgaugcgacugcucucaccaguucgcgugcccaacuauaacaugaucaucauggacgaggcccauuucaccgacccggcgagcaucgccgccagaggcuacaucuccacccgcgucgggaugggcgaagccgcagcgaucuuuaugaccgccacgccccccggcagcgucgaggccuuuccccaauccaacgccgucauccaggacgaggagcgggauauccccgagcgcagcuggaacuccggcuacgacuggaucaccgacuuccccggcaagaccgucugguuugugccgagcaucaaauccggcaacgacaucgccaauugccugcggaagaacgguaagcgcgugauacagcugagccguaaaaccuucgacacggaauaccagaagacaaagaacaacgacugggacuacguagugaccaccgacaucagugagaugggggcuaacuuccgcgccgaccgggucaucgacccccgccggugccucaagcccgucauacugaaggauggccccgagcgcgugauccuggccggaccgaugcccgugacugucgccagcgccgcccaacggcgcggccggaucggccgcaaccagaacaaggagggggaccaguacguguacaugggccagccccuaaacaacgacgaggaccacgcccacuggaccgaggcaaagaugcugcuagacaacauaaacacccccgaggggaucaucccggcccuuuucgagcccgagagagagaaguccgcggccaucgauggcgaguaccggcugcgcggggaggcucggaagaccuucgucgagcugaugcgccggggagaccuaccuguauggcucagcuacaagguugccuccgagggcuuccaauacagcgaccgccgauggugcuucgacggcgaacgcaacaaucagguccuggaggaaaacauggacguggaaaucuggaccaaggaaggcgagcggaagaagcuccgcccucgguggcuugacgcccgaacguacuccgacccccuggcgcuccgggaguuuaaggaguuugccgccgggcgccggagcgugagcggcgaccugauccuggagaucggcaagcucccccagcaccugacccugcgugcccagaaugcgcucgacaaccuggucaugcugcacaacuccgagcagggcggaaaggcguaccgacacgccauggaagagcuccccgacaccaucgagacccuuaugcugcucgcccugaucgccgugcuuaccgggggcgugacccucuucuuccugagcgguaagggccugggcaaaaccuccauugggcugcugugcgucaccgcgucauccgcccugcucuggauggccagcguggagccccacuggaucgccgccuccaucauccuggaguucuuccugauggugcuccugaucccugaacccgaucgccagcggacgccccaggacaaccaacuggcguaugucgugaucggccugcuuuucaugauccugaccgucgcagccaacgagauggggcuccuagagaccaccaaaagggaccugggcauaggacacguagccgcggagaaccaccagcacgcgacgaugcucgacguugaccugcggccggcuagcgccuggacccuguacgccguggccaccaccgucaucacgcccaugaugcgccacaccaucgagaauaccaccgcgaacaucucccucacggccaucgcaaaccaggccgccauccugaugggccucgacaagggauggcccaucuccaagauggauauagggguuccccuccuggcgcuggggugcuauucccaagugaacccgcucacccucacagccgccgucuuaaugcucguggcccacuacgcaaucaucgggcccggccugcaggccaaggcuacccgcgaggcccagaagcggacggccgcggggaucaugaaaaaccccaccgucgacgggaucgucgccaucgauuuagaccccgugguguacgacgccaaauucgagaaacaguuaggccaaauaaugcugcugaucuugugcaccagccagauucugcugaugaggaccacgugggcccuuugugaguccaucacgcuggcaaccgggccgcugacaacgcucugggaggguagccccgguaaguuuuggaacaccaccaucgcagucucgauggccaacaucuuccggggcagcuaccuggcaggcgcagggcuggcuuucucccucaugaagucuuuaggcgggggccgccgggggaccggcgcgcagggggagacacugggggagaaguggaaacgucagcuaaaccagcuauccaagcccgaauuuaacaccuacaagcggucaggcaucauggagguggaccgcucagaggcaaaggaagggcugaagcggggcgagaccaccaagcacgccgugagucgcggaaccgccaagcuacggugguucgucgagcgcaaucugguaaagcccgagggcaaggugaucgacuuggggugcgggcggggcggauggagcuauuacugcgcgggccugaagaaggucacggaggugaagggguauaccaaaggaggcccgggccacgaggagccuauccccauggccacuuacggcuggaacuuagugaagcugcacuccgggaaggacgucuuuuucaugcccccggaaaagugugacacccugcucugcgacaucggcgagagcucccccaaccccacgauagaggaggggaggacccuacgggugcugaagaugguggagcccuggcuccgcggcaaccaguucugcauaaagauccugaacccguacaugcccagcgucguggagacccuggagcagaugcagcggaagcacggggggaugcucgugcgcaacccccucucccggaacagcacccacgagauguacugggucuccugcggcacggggaacaucgugagcgcggugaacaugaccucccgcauguugcucaaccgcuucaccauggcacaccggaagcccaccuacgagagggacgucgaccugggcgccggcacacgccaugucgcaguggagccggaggucgccaaccuagacaucaucgggcaacggaucgagaacauaaagaacgagcacaagagcaccuggcacuaugacgaagacaaccccuauaagacgugggccuaccacggauccuacgaggugaagcccucgggguccgcgagcuccaugguuaacgguguagugcggcuccugaccaagcccugggacgucaucccgauggugacucagaucgccaugaccgacacaacccccuuugggcagcagcgugucuucaaggagaaggucgacacucggacaccucgggcuaagcgggguaccacacaaaucauggaagucacagccaaguggcuguggggcuucuuaagccgcaacaagaagccgcggaucuguacccgcgaggaguucacccgcaagguacgcuccaacgccgcaaucggggccgucuuugucgaugaaaaccaguggaacagcgcgaaggaggccguugaggacgagcguuucugggaccuggugcaccgcgagcgggagcugcacaagcagggcaaaugcgcgaccugcguguacaauaugauggggaagcgagagaagaagcucggagaguucggaaaggccaagggcucacgggcaaucugguauauguggcugggcgcccgguuccuggaguucgaggcccucggguucaugaacgaggaccacugguucucccgggagaacagccugagcggaguggagggggagggcuuacacaagcucggguacauccugcgcgacaucagcaagaucccaggugguaacauguacgccgacgacacggccgggugggacacccgcaucaccgaggacgaccuacagaacgaggcgaagaucacagacaucauggagcccgagcacgccuuacuggcuacaucgauauuuaaguuaaccuaccagaacaagguagugcggguucagcgccccgcgaagaacggaaccgucauggacguaaucucccggcgcgaccagcggggauccggacaggugggaacguacggucucaacacguucacgaacauggaaguccagcuuauccgccagauggagagugagggcaucuuccuucccuccgaacucgagaccccgaaccuggccgaacgggugcuggacuggcuggagaagcacggcgcggagagacugaaacggauggcgaucucaggcgacgacugcguggucaagccaaucgacgacagauucgcuaccgcccugaccgcccucaacgacauggggaaggugcggaaggacauuccccagugggagccguccaaagguuggaacgacuggcagcaggucccauucugcagccaccacuuucaccagcugaucaugaaggacggccgcgagaucguuguacccugccggaaccaggacgagcugguagggcgggcgcgggucucgcagggcgcuggguggucccuccgcgagacggccugucugggcaaguccuacgcucaaauguggcagcugauguacuuccaucggcgcgaccuccggcuggcugcgaaugccaucuguucagcggugccgguggacugggucccgaccucccgcacgaccuggagcauccaugcgcaccaccaauggaugaccacagaggacaugcugagcgucuggaaucgcguguggauugaggagaaccccuggauggaggacaagacccacgucuccagcugggaggagguccccuaccuaggaaagcgggaagaccaguggugcggcagccuaaucggcuuaacugcgcgcgcaacgugggccaccaacauccagguagcaaucaaccagguacggcgccucaucgguaacgaaaacuacuuagacuacaugaccagcaugaagcgguuuaagaacgaguccgaccccgagggcgcccugugguga

SEQ ID NO: 23942 - RNA, 9879 nt, Artificial Sequence
  derived and/or modified CDS sequence (opt11) from DENV-1__JF937645__SS-prME
agcguaacgauguuacucaugcuauuacccaccgcacuagcuuuucaccucaccacacgcggaggagaaccgcacaugauaguguccaaacaagaacgaggaaaaucacugcuauucaaaacgucggcaggagucaacaugugcacgcucauagcgauggaucucggggaacuaugcgaagacaccaugacguacaaaugcccgcaaaucacggaagcggaaccagacgacguagacugcuggugcaacgcgacagacacauggguaacauacggaaccugcucacaaaccggcgaacauagaagggacaaacgaagcguggcccucgcuccacaugucggucucggacucgaaacccgaaccgaaacauggaugucgucagaaggggcuuggaaacagauccaacgcguagaaacaugggcauuaagacacccgggguucacaguuauagcccuguucuuagcgcacgccauaggcacuucaaucacucagaaagguauaauauucauccuacuaaugcuagucacacccagcauggccaugagguguguggggauugggaaccgggacuucgucgaaggcuuaagcggggccaccugggucgacgugguccucgaacacggaaguugcgucaccaccauggccaaaaauaaacccacacuagacauugaacuauuaaaaaccgaagucacaaacccugcgauacugcgaaagcuaugcauagaggcaaaaaucuccaacacgacaaccgacagcagaugcccaacgcaaggcgaggccacccucgucgaggagcaagacgcaaacuuuguaugccgccggacacucgucgacaggggcugggggaauggcugugguuuauucggcaaaggaagccuacugacaugcgccaaauuuaagugcgugacuaaacuggaaggcaaaaucguacaauacgaaaaccugaaauacagugugaucgugacuguccauacaggcgaccaacaccaggucggaaaugagacaaccgagcacggaacaauagccacuaucaccccacaggcccccacgagcgaaauccaauugacagacuacggugcacucacacuugacugcucaccccggacuggccucgacuucaaugagaugguauuacucacgaugaaagagaaaucaugguuaguccauaaacaaugguuucuagaccugccauuacccuggaccagcggggcauccaccagccaggagacauggaacaggcaagaucuccuagucacguucaaaaccgcucacgccaagaaacaggagguagugguacugggcagccaggagggggcgaugcacacggcccuaacaggagccacugaaauucagacgagugggaccacgacgaucuucgcagggcaccuaaagugccgacugaagauggauaagcuaacccucaaaggaaccucauauguaauguguaccgguucuuucaaguuagagaaagaagucgcggaaacgcagcauggaacagugcucgugcaggucaaauacgaggggacagaugcgccauguaaaauccccuucagcacacaggacgaaaaggggguaacgcagaacggccggcugaucacggcaaaccccauuguaacugacaaggagaaaccagucaacauagaaaccgaaccacccuucggcgaaucguacaucgugguaggagcgggggaaaaagcacuaaaauuaagcugguucaagaagggaagcagcaucggaaaaauguucgaagcaacagcucgaggggcacggcggauggcgauacuaggagauacagccugggauuucggcagcauaggcggagucuuuacaucgguagggaagcuaguacaucaggucuuuggaacagcguacggaguacuauucagugggguaagcuggacaaugaaaauaggaaucgggauucuucuaaccugguuaggauuaaacagccgaagcacaagucuaucuaugacaugcaucgccguaggcauggugacacucuaccuuggcgugaugguccaagccgauagcggauguguuaucaauuggaaaggacgggaacugaagugugguucagggaucuucgugacgaaugaaguacacacuuggacugaacaguauaaauuucaagcggacagcccaaagagacucagcgccgccaucgguaaagcgugggaagagggcguaugcgggauccgcagcgcaacaagacuagagaauauaauguggaaacaaaucuccaaugagcuuaaccacauccugcuagaaaacgacaugaaauucaccgucguggucggagaugcuaacggaauccucgcucaaggcaagaagaugauacgcccacaaccgauggagcacaaauacucauggaaaagcuggggcaaagcaaaaauuauaggagcggauauccagaacacgaccuucauaauagacgguccagauacaccggagugccccgacaaccaacgcgcauggaauaucugggagguagaagacuauggcuucggaaucuuuacaacaaacaucuggcucaagcuccgagacagcuauacccagaugugugaccaccgucucaugucggcagccaucaaagauagcaaggcagugcacgcagacaugggcuauuggauagagagugagaaaaacgagacuuggaaguuagcccgcgcguccuucaucgagguuaagaccuguacauggccaaaaagccacacacuuuggucaaacggaguccucgagucggagaugauaaucccgaaaauauacggaggaccuauaagccaacacaacuaccgcccuggcuacuucacgcaaacggcuggcccauggcaucuggguaagcuagagcucgacuucgaccugugcgaagggaccacaguaguaguggacgagcacugcggcaaccgggggccuucgcuacgcacaaccaccgucaccggaaaaauaauacaugaaugguguugccgauccugcacgcugcccccacuucgguuucgaggcgaggacggaugcugguacggaauggagauacgaccagugaaagagaaagaggaaaaccuaguucgcuccauggucucagcaggaucgggcgagguagauucuuucucacuaggcauucuuugcgcaaguauaaugaucgaggaagugaugcggagccgcuggagcaggaaaaugcucaugacgggaacgcucgcaguauuucuucuucuaauaaugggacaacuaacguggaacgaccuaauacgguuauguauaaugguuggggcgaaugccagcgaccggaugggcauggguaccacguaccucgcguuaauggccacguucaaaaugagacccauguucgcagucggacuacuauuccgaagacuaacaagucgagaaguacuacugcuaacaauuggguuaucccuaguagcaagcgucgaacuaccgaauagccucgaagaacugggagacggccucgcuauggggauuaugauguugaagcugcugacggaguuccagccgcaccagcucuggacaacccuccugucacucacauucaucaagacaacgcugagccuugacuaugccuggaaaacgacggcgauggcccucuccauagugagccuuuucccccucugccuaagcaccaccagucagaaaacgacuuggcugccgguacuacuaggaucguucggaugcaagccucucaccauguuccuaauaacagaaaauaaaaucuggggccggaagucuuggccucucaaugaagggauuauggcaauagggauaguauccauacuacucagcagccuucucaaaaaugacgucccacuggcggggccccucaucgccggcgggaugcuuauagcgugcuacgucaucagcggaucguccgcggaccucucccuugaaaaggcagcggaaguguccugggagcaagaagcggagcauucagggacgagccauaauauauuagucgagguccaggacgacgguacaaugaagauuaaagaugaagaacgagaugacacacugacgauacuucucaaagcuacccuccuagcuguaucgggggucuaccccaugucaaucccggcgacacuauucgucugguauuucuggcagaagaagaaacaaagaagcgggguucuuugggacacuccaucuccuccggaaguugaaagggcaguccuagacgauggcauauaccgcauacuacagaggggacuacuggggcggucgcaagugggugugggaguguuucaagacggagucuuucauacuauguggcacgugacccgcggugcgguguuaauguaccagggcaaacgacuagagccgagcugggcaagcgucaagaaagacuuaauaagcuacgggggcggcuggcguuuccaaggaaguuggaauaccggagaagagguucaagucauagcggucgagcccgguaagaacccgaaaaacgugcaaacaaccccggggaccuucaaaacccccgaaggggaagucggagccaucgcacuagacuuuaagccgggaacaaguggaucgcccaucguuaaccgggaaggaaaaauagucggacucuauggaaauggcguggucaccacgagcggaacauauguuucugccauagcacaggcaaaggcgucucaggaaggccccuugccagaaauagaagacgaaguuuucaagaagcggaacuuaacgaucauggacuuacaccccggcucgggaaagacgaggcgguaccugcccgcaaucguaagagaggccaucaagaggaaacuuagaacccuaauccuggcaccgacacguguuguugcaucagaaauggccgaagccuugaagggcaugcccauccgcuaccagaccacagcaguuaagucggaacauaccggucgagaaauagucgaccucaugugucacgccaccuucaccaugcgacuuuuaagcccugucagagugccaaacuauaacaugaucauaauggacgaagcacauuuuacagacccggcaagcauagccgcacgcggauacaucucaacgcggguagguaugggcgaagcggccgccaucuuuaugaccgccaccccgcccggcagcguagaagcauucccacaaagcaaugccgucauacaagacgaagaacgcgacaucccagaacgcagcuggaacucagguuacgacuggaucaccgauuucccuggaaaaacagugugguucgugccaagcauuaaauccggaaaugacauagccaauugccuaaggaaaaacggcaagcggguaauacaauuaagccgcaaaaccuucgacaccgaguaccagaaaacgaaaaacaacgauugggacuaugucgugacaacagacauaagcgaaaugggugcgaacuuccgggcugaccgcgugauagauccacgcagaugccugaaaccggugauucucaaggacggacccgagaggguaauccuagcuggucccaugcccguuacagucgccucggccgcccaacggagaggacgaauugguaggaaucagaauaaggaaggggaccaguauguauacaugggacaaccacucaacaacgaugaagaccacgcgcacuggaccgaagcaaaaaugcuacucgacaauaucaacacgcccgaaggaauuauaccggcguuguucgagccggagcgagagaaaagugcagcuauagacggggaauaccgucugcggggagaggcaaggaaaacauucguagagcucaugcgacgaggcgaccucccggucuggcuaucauacaaagucgcauccgagggcuuccaguauucugaccgccgcuggugcuucgauggggaacgaaacaaccaagugcucgaggaaaauauggacguagagaucuggaccaaagagggcgagaggaagaaacuaaggccacgcuggcuugacgcaagaacauacagcgacccccucgcacuucgggaguucaaggaguucgccgccgggcggcgcagugucucaggggaccugauauuagaaauuggaaaguugccccaacacuugacacuacgggcacaaaacgcucucgacaaucuugugaugcugcacaacagcgaacagggugggaaagccuacaggcacgccauggaagaacuccccgacacaaucgagacguugaugcuucuagcccuaauugcgguccuaacagguggggucacgcuguuuuuccuuucaggcaaaggccucggcaaaaccucgauaggacugcugugcguaacagcuucaagcgcucuacucuggauggccuccgucgaaccccauuggauugcagcuagcauaauccucgaguucuuccuaaugguacuacugauaccagaacccgaccgacaacggaccccucaagacaaccagcuagcguacgugguaaucggacuccuguuuaugauacuuacuguugccgcgaacgaaaugggccucuuggaaacgacuaagaaagaccuggggaucggccauguagcagcugaaaaccaccaacacgcaacuaugcuagacgucgauuuacgacccgcgucagcauggacccuguacgcaguagccacgacugucauaacgccaaugaugcgacacaccauugagaauaccacggccaacaucagcuugacugcaaucgcaaaccaagcggcaauccugaugggauuagacaaaggguggccuauaucaaaaauggacaucggaguaccacuacucgcacuaggauguuacagccaggucaauccacuuacauuaaccgccgccguccuuaugcuaguagcgcauuacgccauaauaggcccaggacugcaagccaaggcuacccgcgaggcgcaaaaacggacagcggccggaauaaugaaaaaccccaccguggauggaauugucgcgauagaccuggaccccguaguuuaugacgcgaaguucgaaaaacaacuaggccagaucauguuacuaauucucugcacaucccagauacuguuaaugcgaacaacaugggcccuaugcgaguccauaacccucgcaacagggccccucaccacccugugggaagguaguccagggaaauucuggaacacaaccaucgcaguaucgauggcaaacauauucagaggaagcuacuuggccggugcugggcucgcguucagcuuaaugaaaucgcuagggggcggccgaagaggcacaggugcucaaggagaaacacuaggugaaaaguggaaaaggcaacucaaccaacuaagcaaaagugaauuuaacaccuauaaacggucaggaauaauggaaguagacagauccgaggcgaaggaaggcuugaagagaggcgaaacaacuaaacaugcggucuccagaggcacagcgaaacucaggugguucguggaaaggaaccuggugaaacccgaagggaaagugauagaccuaggauguggaagagguggaugguccuauuauugcgcagguuugaaaaaggucaccgaagugaaaggcuacacgaaaggaggcccgggccacgaagaacccaucccaauggccacguacgguuggaaccuaguaaaacuacacuccggaaaagauguauucuuuaugccgccugagaagugcgacacacuuuugugugauauuggcgaaucaagcccaaacccaacaaucgaggaagggcguacccuaagaguccucaagaugguggaaccguggcugcgaggcaaccaauucugcauaaaaauacugaauccguacaugccguccguuguagaaacguuagagcagaugcaaagaaagcacggagggauguuggugaggaauccccugucccggaacagcacacacgagauguacugggucucuugcggaacaggcaacaucgucuccgccguuaacaugacaagcaggaugcuacucaaucgcuucacaauggcccacagaaaacccaccuaugaacgagacguugaccuaggagccggaacccgacacguggcaguagaacccgagguggccaauuuagauauaauugggcagaggauagaaaauaucaagaaugagcauaaaucaacguggcauuaugacgaggacaacccauacaaaacaugggcauaccauggaaguuaugaagugaaaccgagcggcagugcguccucaaugguuaacgggguggugagacugcucacgaaacccugggacguaauaccgaugguaacacagaucgccaugaccgauacaacgcccuucgggcaacaaagggucuucaaggaaaaaguagacacaagaacaccccgugccaagcgcggcacaacacaaaucauggagguaaccgcgaaauggcucuggggcuuccugagucgcaauaagaaaccaaggauuuguacaagggaggaguucacgcgaaaaguccggaguaaugccgcaaucggagccguauucgucgacgagaaccaguggaacuccgcgaaggaagcagucgaggaugaacgcuucugggaucuaguacaccgugaacgggaacuacauaaacaaggcaaaugcgcgacaugcguauauaacaugaugggaaaacgggagaagaaacuaggugaauuuggaaaagccaaagggagucgcgccaucugguacaugugguuaggcgcgagguuucucgaguucgaagcucucggcuucaugaacgaagaucacugguucucacgcgagaacagccuaucaggaguggagggagagggccugcacaaacuaggauacauucugcgagacaucucaaagaucccaggaggcaacauguacgccgacgacacggcaggcugggacacacgaaucacggaagacgaccuacaaaaugaagccaagaucacugacauaauggaaccugagcacgcguuauuagcaacaagcaucuucaaauuaaccuaucaaaacaaagugguccgaguccaacgacccgcaaagaacggcaccguaauggaugugaucucacgacgggaccaacggggcagcgggcaagucggcacauacggucucaacacguucaccaacauggaagugcaguugauccgccagauggagagugaaggcauauuucuaccgagcgaacucgagacaccgaaccuagcagaacggguucucgacuggcuugagaagcauggcgcggaacgccuaaagcguauggcaauaagcggugacgacugugucguuaaacccauagaugaccgcuucgcaacggcacugacggcacuuaacgacaugggaaagguaaggaaggauauaccgcagugggagccaagcaaggguuggaacgacuggcaacaagucccguucugcagccaccacuuccaccagcuuauaaugaaagacggcagagagauuguggugccauguagaaaccaggacgaacugguagggcgcgcccgagugagucaaggcgcagguuggagucucagagaaacggccugccugggcaagucauacgcccagauguggcagcugauguauuuccaucggagggaccuacgccucgcugcaaaugcaauaugcagugcagucccagucgacugggucccaacgucccgaacgaccuggagcauccacgcccaucaccaguggaugacuacagaagacaugcuuagcguauggaaccgaguauggaucgaagaaaacccauggauggaggacaaaacccacgugucgucaugggaagaagucccauaccucgggaagcgggaggaccaguggugcggcucacugauaggacuaacagcgcgcgcuacaugggccacaaacauccagguagccaucaaccaggucagacggcuaauaggaaacgaaaacuacuuagacuacaugaccucuaugaaacgguuuaagaaugagagcgacccagaaggagcccuaugguga

SEQ ID NO: 23943 - RNA, 9879 nt, Artificial Sequence
  derived and/or modified CDS sequence (opt11) from DENV-1__FJ850114__SS-prME
aguguuaccauguuacucaugcuccuacccaccgcccucgccuuccaccugacaacgcguggaggggaaccccauaugauaguuuccaaacaagaacguggaaagucccuccuguucaaaaccucggccggcguaaacaugugcacccucauagcgauggaccuuggagaacucugcgaagacaccaugacuuauaaaugcccucaaauuacugaagccgagccagaugacgucgacugcuggugcaaugccacagauaccuggguaaccuacggcacaugcagccagaccggagaacaucgacgggauaagcggagcgucgcccuggcaccccauguggggcucggacuggaaaccaggacagaaaccuggaugucgucagagggggccuggaaacaaauacagaggguggagaccugggcccuuaggcacccggguuuuacggugauagcgcuauuccuagcccacgcgaucgggaccucgauaacccagaagggaaucaucuucauuuugcuuaugcuggugacucccuccauggcaaugagauguguaggcaucgguaacagggauuucguggagggccuauccggugcgaccuggguagacgugguacucgagcacggaagcugcgucacaacaauggccaaaaacaaacccacccucgauauagagcuauuaaagaccgaagucacuuccccagcgaucuuaaggaaguuaugcauagaagcgaagaucucgaacacuacaacagacuccagaugcccuacacaaggagaggcaacccucguggaagaacaagacgcaaacuucguaugccggcggaccuucguagaccggggaugggguaacgguugcggauuguuugggaaggguucccuacugaccugcgcaaaauucaagugcgucacaaagcucgagggcaaaaucguucaguacgagaaccuuaaauacagcguaaucgugacaguccauacgggugaucaacaucaaguaggcaacgaaacuacggagcacggcacgaucgccacaauaacgccucaagccccaacguccgagauccaguuaacagacuacggcgcacucacgcucgacugcucuccacgaacuggccuggauuuuaacgaaaugguacuacuaacuaugaaggagaaaagcuggcucgugcacaaacaaugguuccuagaucucccacugccguggacaagcggggcaucuacuagccaagagacguggaaucgacaggaucuccuaguaaccuuuaaaacagcgcaugcaaagaaacaagaggucguugugcugggcagucaagagggcgccaugcacacggcccuaacgggugcgacggagauacaaacgucgggcacaacgacgaucuucgcgggacacuuaaagugucgccuaaagauggauaaguugacacucaagggcaccucguacgugaugugcacaggauccuucaaauuagagaaagaagucgcagaaacccaacacgguacuguccucguccaagucaaguacgaaggaaccgacgcucccugcaagauccccuucagcacgcaagacgaaaagggggucacgcaaaacggacgacucaucacagcaaaccccauugucaccgacaaagaaaagccaguuaacauugaaacggagccacccuucggagaaucguauauuguaguaggcgccggcgaaaaggcccugaaauuaagcugguucaagaaaggcuccagcaucggcaaaauguucgaggccaccgcucgcggagccaggaggauggcgauacucggcgacacagccugggacuucggaagcaucggaggcguuuuuaccagcgucggaaaguuaguccaccaaguauucggaacggccuacggcguacuuuucuccggagucucguggacaaugaaaauuggaauuggcauccuucugacuuggcuuggucuaaauucacgaaguaccucucucucaaugacgugcaucgcugugggcauggucacacucuaucugggcguuaugguacaagcagacagcggcugcgucauaaacuggaagggccgggaacugaagugcggaagcggcauauucguaacaaaugaaguccacaccuggacagagcaauauaaauuucaggcagacagcccaaaaagacucucagccgccauaggaaaggccugggaagaaggggugugcggaaucagaagugcaacccgccuugaaaacauuauguggaagcaaauuucaaacgaacucaaucacauccuacucgaaaacgacaugaaauucacgguaguagucggagacgcgaacggaauacuagcgcaggguaagaagaugauccgcccucaaccuauggaacauaaauacuccuggaaguccuggggcaaggcaaaaaucauaggcgccgacauccagaauacaacauucaucauagacggcccagacacgcccgaaugcccagacaaccagcgagcauggaauauaugggaaguggaagacuacggauucggaaucuucaccaccaauauuuggcucaagcuaagagacucauacacccaaaugugcgaccacaggcucaugucagccgcaaucaaagauucgaaggcaguacacgcugauaugggauacuggaucgaaagcgagaaaaacgaaacuuggaaacuugcgcgcgcaucuuucaucgaggugaagacaugcaccuggcccaaaucacacacucuguggucaaaugguguccuugaguccgaaaugauaauuccaaagacuuacggcggcccaaucucgcaacacaacuacagaccaggguacuuuacacagaccgccggaccuuggcauuuaggcaagcucgaacuugacuucgaccuaugcgaagggacuaccguagucgucgacgagcauugugguaaccgaggcccaagucuaagaaccacuacagucacaggaaaaauaauacacgagugguguuguaggagcugcaccuugcccccucuacgauuccggggcgaagacgggugcugguacggcauggaaaucagaccugugaaggagaaagaagagaacuugguacggaguauggugagugcggguucaggggaggucgacuccuuuucccugggaauacuaugcgcgucgauaaugaucgaagaaguaaugaggucaagauggucaagaaaaaugcuaaugacgggcacacuggcuguguuccuccuacuaaucaugggccagcuuacauggaaugaccugauucgucuguguaucauggucggagccaacgccuccgaccggauggggaugggcacaaccuaccuagcccucauggcgacauucaaaaugcggccgauguucgcgguuggacugcuguucagaaggcuaacaucacgggaaguacuacuacuuaccaucggacucagccucguggcaucugucgagcuacccaacagccucgaagaauuaggcgacgggcuggcgauggggauuaugaugcucaagcuccuaacagaguuccaaccccaccagcuauggacuacccuacucagccugaccuucauaaaaacgacccugucuuuagacuacgccuggaaaaccacggcaauggcauuaaguauagugagucuauucccccugugucucucgacaacuucucagaaaacuaccuggcugccgguucuucuagggagcuuuggaugcaagccgcuaacuauguuccuaaucacagaaaacaagauuuggggccgaaagucguggcccuugaaugaggguaucauggccauaggcaucguaagcauccuacucagcucgcucuugaaaaaugacgugccccuugccgguccacugauagccggcgggaugcuuauagcgugcuacgugaucucgggcagcucagcugaccuaucacuggagaaagcagcagaagucucaugggaacaagaagcagaacacagcggaaccucccacaauauacuuguagaaguacaggacgacggcacaaugaaaaucaaagacgaagaacgagaugauacgcuaaccauauuacucaaggccacccuucucgcgguaaguggagucuacccaaugucaaucccagcgacccucuucgucugguacuucuggcaaaagaagaaacaaagaucuggcguacuuugggacacaccuagcccuccggaagucgaacgcgccguguuagaugacggcauauaccgcauccuacaacgaggguuacugggcagaucacaagugggaguagggguuuuccaagacgggguauuccacacgauguggcacgucacccgcggcgccgugcucauguaccagggcaaaagacucgagcccagcugggccucagucaagaaagaccuaaucagcuacggugggggcuggagauuccaaggaagcuggaauacgggggaagagguucagguuauagcagucgaaccuggaaagaaucccaaaaacguucaaacaaccccaggaacauucaagacgccggagggcgaaguaggggccaucgcgcuagacuucaaaccuggcaccucgggauccccgauagugaacagagaaggaaaaaucguaggcuuauacgggaacgggguagugacuacaucaggaaccuacgucuccgccaucgcacaggccaaggccagucaagagggccccuuaccggaaauagaggacgaaguuuucaagaaacgaaaccucacgaucauggaccuacacccagggaguggcaaaacgcgucgguacuuaccggcaaucgugagagaagcgauaaagaggaaacuccgcacgcuaauucucgccccaacgagaguagucgccucagagauggcggaagcacugaaggggaugccgauccgauaucaaaccacagccgucaaaagcgagcacaccggaagagagaucguagaccuaaugugccaugcgacauucaccaugcgccuacucuccccgguacggguacccaacuacaacaugaucauaauggacgaagcgcacuucacugaccccgcaagcauugccgcgcgaggauacauauccacgcgcgucggaaugggugaagcagcggcaauauucaugaccgcgacaccgccagggagcguggaagcauuuccccaaagcaacgcggugauucaagacgaagaaagggacaucccagaacgaucuuggaacaguggcuacgacuggaucaccgacuuccccgguaagacaguaugguucguccccagcauaaaaaguggaaacgacaucgcaaauugccuacggaagaacggcaagcgcgucauacaacucagccgcaaaacauucgacaccgaauaccagaagacuaagaacaacgauugggauuaugucguaacaaccgacaucucagagaugggcgccaacuucagagcagaucgcgucaucgacccacgccgaugcuuaaaaccugugauacuuaaggacggacccgagcgcgugauccuggcugguccgaugccagugacgguugcaagcgccgcacaacgccgaggacggaucggucgaaaucaaaauaaagaaggugaccaauacgucuacaugggccaaccgcuaaacaacgacgaggaccacgcccacuggaccgaagcaaaaaugcuacuagauaacauaaacaccccagaagguaucauucccgcgcucuuugaaccggaaagagagaagucggcagcaauugacggcgaguaccgacuccgaggugaggccagaaaaacauucguggaacugaugcggcgaggagaccucccagucuggcuaagcuacaaaguggcaagcgaaggauuccaguacucagaccgccgcuggugcuuugacggagaacgcaacaaccaggugcuagaagagaacauggacguagagaucuggacuaaggagggagaacguaagaaacuuagaccccgguggcucgaugcaagaacauauagcgauccguuagcacugcgcgaguuuaaagaguucgcugcagguagaaggaguguauccggcgaccucauacuggaaaucggcaaacuuccacaacaccugacguugcgagcacaaaacgcccuagacaaccuugucaugcuucacaauuccgaacaaggagggaaagcguacaggcacgccauggaagaacuaccggauacgauugagacacuaaugcuccucgcccugauagcugugcuaacaggagguguaacacuuuucuucuuaagcggaaaaggacugggaaaaacaagcauaggccucuugugugucacagcgagcucagcacuacuguggauggcaucggucgaaccacacuggauagcggcguccauuauacucgaauuuuuccucauggugcuacucaucccagagccagaccgacagcgaacaccccaagacaaccaacucgcauacgucguaauuggucuccuauuuaugauacuaacggucgcugcgaacgagaugggauuguuggagacgacgaaaaaggaccuaggaauagggcacguagccgcagaaaaccaucaacacgcaacaaugcucgauguagauuuacguccagcaagugccuggacacuauaugcagucgcaacaacgguaauaacuccgaugaugagacacacaaucgaaaacacaacagcaaacauuucccuaaccgcgauagcaaaccaggcagcgauccucaugggacuugacaaaggguggccaauaaguaaaauggacaucggagucccgcuacuagcgcugggguguuauucacaagucaacccccuuacgcucacagcugcgguauuaaugcuggucgcccacuacgcaaucaucggaccuggacuacaagcgaaagcaacccgcgaggcacagaaacgaacagcggcuggcauaaugaaaaacccgaccgucgaugggauagucgcgaucgaccuggacccgguuguguaugacgcgaaauucgaaaaacaacuagggcagauaaugcugcugauccuaugcaccucccaaauccuccucaugagaacaaccugggcguuaugcgaaucuaucacgcucgcaacaggaccgcuuacgacacugugggaggggucgccagguaaauuuuggaacacaaccauagcgguaucuauggcgaacaucuuccgcggcuccuacuuggccggugcaggccuagcauucucacuaaugaagucucucggggguggacgcagagggacaggggcgcaaggagaaaccuuaggugaaaaauggaaaagacaacuaaaccaguuaagcaaaucagaguuuaacacauacaaacgcucgggcauuauggaaguagauagauccgaggcaaaggaaggucuaaagcggggagagacaacaaagcacgcagugucgcgagggacagccaagcucagaugguuugucgaaagaaauuuggugaaaccugaagggaaaguaaucgaccugggaugcgggcgaggagguuggagcuacuauugcgcgggccucaaaaaggucaccgaagucaaaggcuauacaaaaggaggcccgggacacgaagaacccaucccaauggcaacguacggauggaaccuaguuaagcuacacuccgggaaggacguauucuuuaugccucccgaaaagugcgacacacuccucugcgacaucggugaaucgucaccgaacccgacaaucgaagaaggccgaacccuacgaguccucaagaugguagaaccgugguuaaggggcaaccaguucuguaucaaaauacuaaacccuuacaugccauccguaguagagauccuugaacaaaugcaaaggaaacacggaggaaugcucgugcgcaauccccuaagccgcaauucuacgcaugaaauguacuggguauccuguggaaccgguaauauuguauccgcaguaaacaugacgagccggauguuacuaaauagguucacaauggcgcacaggaagccgacguacgaacgugacgucgaccucggagcaggaacacgacacguggccguagaacccgagguggccaaccucgauauaauaggacaaagaaucgagaacaucaagaaugagcacaagucaacguggcacuacgacgaagacaaccccuacaagacaugggcguaccauggcuccuaugaagucaaaccgagcggguccgcgagcaguauggucaacggggucguccgccuacucaccaaaccuugggacgucauaccaauggucacacaaaucgccaugaccgauacgaccccuuucgggcaacaacgcgucuucaaggaaaaaguagacacacggacgccccgcgcuaaaagaggaacuacccaaauaauggaaguaacagccaaauggcuguggggcuuccucucacgaaacaagaagccacgaauaugcacgcgugaagaguucacgagaaaggucagaaguaacgccgcaauaggggccguguucgucgacgagaaccaauggaacucggcaaaagaggccgucgaggacgaacgguucugggaucuugugcaccgcgaacgggaacugcacaagcaaggcaagugcgcuaccugugucuacaacaugauggguaaacgggagaagaaauuaggggaguucggcaaagcuaaagggucgcgagcuaucugguacauguggcucggcgcgagguuccuagaguucgaggcacucgguuucaugaaugaagaccacugguucuccagagaaaauucacucagugguguugagggagaagggcuacauaaacugggguauauccucagagacauuagcaaaauuccaggaggaaacauguaugcagacgacaccgcgggcugggauacacguaucacagaagaugaucugcagaacgaggcgaaaauaaccgacaucauggagccggagcacgcgcuacucgcgaccagcauauucaagcugacuuaccagaacaaagugguacguguacaacgcccggcuaaaaacggcaccgucauggacguaauuucuagaagagaccagaggggauccggccagguagguacguauggacugaacacauuuacaaauauggaaguccaauuaauucggcagauggaaagugaggggaucuuccuccccagcgaacucgagacaccgaaccuggccgagcgaguccuagacuggcucgaaaagcauggagcggaaagguugaaaagaauggccauaagcggugacgacugugucgucaagccgaucgacgaucgguucgcaacggcacugaccgcgcucaacgacaugggcaaaguuagaaaagacaucccccaaugggagccgagcaaaggcuggaaugacuggcagcaagucccauuuuguagucaccacuuccaccaguuaauaaugaaagacgggcgcgaaauugugguuccuugccggaaccaagaugaacuuguaggucgugcgagggucucacaaggcgcaggcuggucacugcgagagacagccugccuggggaaaucguacgcacaaauguggcaacucauguacuuccacaggcgggaccuccgccucgcagcuaacgccauaugcagcgccgugccggucgacuggguacccacauccaggacaacauggagcauccaugcgcaccaccaguggaugaccaccgaggacaugcucagcgucuggaaccgaguguggaucgaagagaacccuuggauggaggauaaaacgcauguaucaucaugggaggagguacccuaucuaggaaaacgcgaggaccaauggugcggcagccuaauaggccugacagcccgggcuacaugggcaacgaacauacaaguugcuauuaaucaaguucgacguuuaauaggaaacgagaacuaccucgauuacaugauaucuaugaagcgguuuaaaaacgaaagugauccagaaggagcauuaugguga

SEQ ID NO: 23944 - RNA, 9879 nt, Artificial Sequence
  derived and/or modified CDS sequence (opt11) from DENV-1__JN819402__SS-prME
agcgugacgauguugcucauguuacugcccaccgcucuugcauuccaccugacuacccgcggcggggagccccauaugaucgugagcaaacaagagcgggggaaaagccuccuguucaagaccagcgccggcgucaacaugugcacccugauugcgauggaccugggcgaacuaugcgaggacaccaugaccuacaagugcccccagaucaccgaggccgagcccgacgaugucgacugcuggugcaaugccaccgacaccuggguaaccuacggaaccugcagccagacgggcgagcaccgcagggacaagcgguccguggcccuggccccccacgugggucuggggcucgaaacacguacagagacauggaugucauccgaaggcgccuggaagcagauccagcgcgucgagaccugggcgcugcggcauccgggguucacuguaauugcccuguuccucgcacacgccauaggcacuagcauaacacagaaggguaucaucuucaucuugcugaugcucgugacccccucaauggccaugcgcugcgucggcaucgguaaucgggacuucguggaagggcugagcggcgcuacguggguggacguugugcuggagcacgguuccugcguuaccacaauggccaagaacaagcccacguuagacaucgagcuguugaagacggaagucaccaaccccgcuauccuuagaaagcuguguaucgaggccaagaucagcaauacaaccacggacucccggugcccgacacagggagaggccacccuagucgaggagcaggacgcuaacuucgucugccgccggaccuuugucgaucgcggcugggggaacggcugcggccucuucggcaaggggucauuacugacgugcgcgaaguucaagugcgugaccaaacucgagggcaagaucgugcaguacgagaaucugaaguacuccguuaucgugaccgugcauaccggcgaucagcaucagguaggaaacgaaacgaccgagcacggcacuaucgcgaccaucacgccccaggccccaacaucagagauccagcugaccgacuauggggcucuaacccuggacugcuccccccgcaccggccuggacuucaacgaaauggugcuccugacaaugaaggagaaguccuggcugguccacaagcaaugguuucuagaccugccgcugccuuggacuucaggggccucuaccagccaggagaccuggaaccgccaggaccuucuggugacguucaagacugcgcacgcgaaaaagcaggaggucguagugcugggcucccaggagggggccaugcacaccgcccucacaggggccacggaaauccagaccagcggcaccaccacgauauucgccgggcaccugaagugcagguuaaaaauggauaaguugacucuaaaggggacauccuaugugauguguaccgguagcuucaaacuggagaaggaggucgcggaaacgcagcauggcacggugcuggugcaggugaaguacgagggcaccgaugcccccugcaagauccccuucagcacccaggacgagaagggggugacgcagaacggucgccucaucaccgccaacccaaucgugacggacaaggagaaacccgucaacauagagaccgagcccccauucggggagucguacauugucgugggcgccggcgagaaggcgcugaagcucuccugguucaagaaagggagcuccaucggcaagauguucgaagccacggcccgcggggcacgccggauggcgauccucggugacaccgccugggacuuugggagcaucggcggcguauucaccagcguggggaagcugguccaucaggucuucggcaccgcuuacggggugcucuucagcggagugagcuggacgaugaagaucgggaucgggauccuccugaccuggcuaggcuugaacagccgcuccaccagccuaagcaugaccugcaucgccgucggcauggugacucuguaccucggcguaaugguccaggcagacucugggugcgugaucaacuggaagggccgcgagcuuaagugcggguccggaaucuucgucaccaacgaaguccacacauggacggagcaguauaaguuccaggccgacagcccgaagcggcugucugcggccaucggcaaggccugggaagagggggugugcggcauccgcagugccacccggcucgagaauauaauguggaagcagaucuccaacgagcugaaccacauccuucucgagaacgacaugaaauucacgguggucgugggggacgcaaacggcauccuggcgcaggggaagaagaugaucaggccccagcccauggagcacaaguacuccuggaagagcuggggcaaggccaagauuauuggagccgacauccagaacaccacauuuaucaucgaugggccugacacaccggaaugccccgacaaucagcgggccuggaacaucugggagguggaggacuacggcuuugggauuuucacaaccaauaucuggcugaagcuccgugacuccuacacccagaugugcgaccaccggcugaugagcgcggccaucaaggacaguaaagccguccacgccgacaugggcuacuggaucgagagcgagaagaaugagacauggaagcuggccagggccuccuucaucgaggugaagacauguaccuggccuaagagccacacacucugguccaacggcgugcuggagagcgagaugaucaucccgaagaucuacgggggcccaaucucccagcacaacuaccggcccggauacuucacccagacggcgggccccuggcaccuggguaagcucgagcuggacuucgaccuuugugagggcacgaccguagugguggacgagcacugcggcaaccgcgggccgucguuacggaccacgaccgucaccggaaagaucauacaugaguggugcugccgcuccugcacccugccgccccugcgguuuagaggagaggacggcugcugguacgggauggagauccgccccgucaaggagaaggaggagaaccuugugcgcagcaugguuucugccggcagcggcgagguggacagcuucucccugggcauccugugcgccagcaucaugaucgaggaggugaugcggucccgcuggagccggaaaaugcucaugaccggcacccuggccguguuccuacuccugaucauggggcagcugacuuggaacgaucucaucagacugugcaucauggucggcgcgaacgccagcgaccgcauggguauggggaccacguaccucgccuuaauggccaccuucaagaugcggccgauguucgccgugggucugcuguuccgccggcuuacuagccgcgagguucugcugcucacuaucggguugucacugguggcgagcgucgagcucccuaacucccuggaggaacugggcgacggguuagccaugggcaucaugaugcugaagcugcucacggaguuccagccccaccaguuguggaccacccugcucucacuaaccuuuaucaaaacgacccugucccuagacuacgcuuggaagaccacagcaauggcguuguccaucgucagucucuucccgcucugccuaagcacgacaagucaaaagaccaccuggcugccugugcugcuggggagcuucgggugcaagccccugaccauguuccucaucacggagaauaagaucuggggccggaagucuuggccgcugaacgaggggauuauggccaucgggaucgucucaauccugcucuccagccugcuaaagaacgacgucccccucgccgggccgcugaucgccggcggcaugcuaauagccugcuaugugaucagcggauccagcgcagaccucucgcuugaaaaagccgccgaggucagcugggagcaggaggccgagcauuccggaaccagccacaauauccugguggagguacaggacgaugggaccaugaaaaucaaggacgaggagcgugacgacacccucacuauccugcuaaaggccacccuccuggcggucuccggcguguaccccaugagcauccccgccacccuguucguaugguacuucuggcagaagaagaagcagcgcuccgggguccucugggacaccccguccccaccggaaguggagagggcgguuuuggacgacggcauauacagaauccuccagcgcggccuccuaggacguucccaggucggcgugggaguguuccaggacggcgucuuccacacgauguggcacgugacccgcggggccguuuuaauguaccagggcaagagauuagagcccagcugggccuccgugaagaaagaucucaucagcuauggcggaggguggagguuccagggguccuggaacacuggugaagagguccaggugaucgcuguagaacccgggaagaacccgaagaaugugcagacaacgccgggcaccuucaaaacccccgagggugaggugggggccaucgcucuggacuucaaaccuggcaccagcggguccccgaucgucaaccgggagggcaagaucguggggcuguacgggaacggcguggucacgaccagcgggacuuacgucuccgcuaucgcacaggcgaaggccagccaggagggaccacuccccgagaucgaggacgaagucuucaagaagcgcaaucugacaaucauggacuuacauccugggucuggcaagacgcgccgcuaccuccccgccaucguccgggaggcuaucaaacgcaagcugcggacacucaucuuggcucccaccagggucguggcauccgagauggcugaggcacugaagggcaugcccauccgcuaccagaccacggcggucaagagcgagcacaccgggcgcgagaucguggaccugaugugccacgcaaccuucacgaugcgccuccuguccccggugcggguucccaacuacaacaugaucaucauggacgaggcccacuucacggaccccgccagcaucgcagcccgcggauauaucuccacccggguggggaugggggaggcggccgccaucuuuaugaccgccacgccucccggcagcguggaggccuuuccccaguccaacgcggucauccaggacgaggaacgcgacauccccgagcggagcuggaacuccggcuacgacuggaucacggacuuccccggcaagaccgugugguucgugccaagcaucaaguccgggaacgauaucgccaacugucugcgcaagaacggcaagagggucauccagcucagccguaaaaccuucgacaccgaauaccagaagacgaagaacaacgacugggauuacgucgugaccaccgacauuuccgagaugggggcuaacuuccgggccgaucgcgucaucgacccccggcgcugccugaagcccgucauucugaaggacggccccgagcgcgugauccucgcggggccgaugcccgucaccguggccuccgccgcacagagacgagggcgcaucggccggaaucagaacaaagaaggcgaccaguacguguacauggggcagccccugaauaacgacgaggaccaugcccauuggacggaggcgaagaugcugcucgacaauaucaacaccccugaggggaucaucccggcacuuuucgagcccgaacgcgaaaagagcgccgccaucgacggcgaguaccgucugcgcggggaggcccgaaagaccuucgucgagcuaaugcgccgcggcgaccugcccguguggcugagcuacaaaguagcuuccgagggcuuucaguacagcgaccggagguggugcuuugacggggagcguaacaaccagguccuugaagagaacauggacguugagauauggaccaaggagggcgagcgcaagaaguuacggccgcgcuggcuggaugcccggacauacuccgacccgcuagcccugcgcgaguuuaaggaguucgccgccgggcggagaagcguaucuggcgaccugauccucgagauaggcaagcugccucagcaccugacgcucagggcgcagaacgcccuugacaaucugguuauguuacacaauagugaacagggcggcaaggccuaccgccacgccauggaggagcugccggacaccaucgagacacucaugcuccuggcccugaucgccguguuaacggggggcgucacgcuguucuuccugagcgggaagggccucggcaagaccuccaucggucugcugugugugaccgccagcagcgcccuccuguggauggccagcguagagccgcacuggaucgcggccuccaucauccuggaauucuucuuaaugguccugcugaucccagagcccgaccggcagagaacgccccaggacaaccaacuagccuacguggugaucggccuguuguucaugauccuaacgguugcggcuaacgagauggggcugcuugaaaccaccaagaaagaucucggcaucgggcacguggccgccgagaaccaccaacacgccaccaugcuggacguggauuuacggccggccagcgccuggacgcucuaugcggucgcuaccaccgugaucacccccaugaugcgccacacgaucgagaacaccaccgcgaauauaagccugaccgccaucgccaaccaagcggccauacucaugggccucgacaaaggcuggcccaucagcaagauggacaucggggugccccuacuggcacucggcugcuacagucaggucaacccacugacgcuaaccgccgccguccucaugcucgucgcccauuacgccaucaucgggcccggccugcaggccaaggcgacgcgggaggcgcagaagcgcaccgcugccggaauuaugaaaaaccccacgguagacggcauaguggccaucgaccucgaccccgugguguacgacgcuaaguucgagaagcagcugggccaaaucaugcugcugauccugugcacgagccaaauccugcucaugcgcacuaccugggcgcugugcgaguccaucacgcuagccaccgguccgcucaccacccugugggagggcagccccggcaaguuuuggaacacgaccaucgccguuuccaugacuaacaucuuccggggcagcuaccuggccggugccggguuggcguucuccuuaaugaagucccugggcggggggcgccgggggaccggcgcccagggcgagacgcucggcgagaaguggaagcgccagcugaaccagcuguccaaaagcgaguuuaacaccuauaagcggagcggcaucauggaggucgaccgcuccgaggcgaaggaggggcucaagcggggcgaaaccaccaagcacgcugucucacgcgggacggcgaaacuccggugguucguggagaggaaccuggugaagcccgaggggaaagucauugaccuuggcugcggacggggcggguggucauacuauugcgccgggcucaagaaggugacggaagugaagggguacaccaaaggcggcccugggcacgaggagccgaucccaauggccaccuacggcuggaaccuggucaagcugcacagcgggaaagacguauucuucaugccccccgagaagugcgacacucuccugugugacaucggcgaaucaagcccgaaccccacgauugaggaagggaggacccuccggguucucaagauggucgagcccugguugcggggcaaccaguucugcauuaaaauuuugaaucccuauaugccguccgucguggaaacccucgagcagaugcaacggaagcacggugggaugcugguccggaauccccugucgcggaacuccacccacgagauguacugggugagcugcggaacggggaacaucguguccgccgucaacaugaccagccggaugcuucugaaccgguucaccauggcccacaggaagcccaccuacgagcgcgacguggacuugggcgcgggcacgcgacauguagccgucgagccagagguggccaaccucgacaucaucgggcagcgcauagagaacaucaagaacgagcacaaguccaccuggcacuacgacgaggacaacccauacaaaacuugggccuaccacggcuccuacgagguaaagcccuccgggagcgccucgucaauggucaacggaguggugcgucuacugaccaagccuugggacgucauucccauggugacacagaucgcaaugaccgacaccaccccguucgggcagcagcgcgucuucaaggaaaagguggauacgagaacgccccgggccaaacggggcaccacccagauaauggaggugacggccaaguggcucuggggguuccucucccggaacaagaagccccggaucugcacccgcgaagaguucacccggaagguccgcagcaacgccgccaucggggcgguguuuguugacgagaaccaguggaacagcgccaaggaggccguagaggacgagcgcuucugggaccuggugcacagggagagggagcuccacaagcagggcaagugcgccaccugcguguacaacaugauggggaagcgcgagaagaagcugggggaguucgggaaggcgaagggcucccgggccaucugguacauguggcugggcgcccgguucuuggaguucgaggcccugggguucaugaacgaggaccacugguucucucgggagaacuccuuaaguggcgucgagggggagggacuccacaagcugggcuacauccugcgcgacaucuccaagaucccggggggcaacauguacgccgacgacacggcggguugggacacgcguaucacagaagacgaccuccaaaacgaggccaaaaucaccgacauaauggagcccgagcacgcacugcucgccacgucgauauucaagcucaccuaccagaacaaaguggugcgcguacagaggccugccaagaacggcaccgugauggacgugaucuccaggcgcgaccagcggggaucuggccaggucggcaccuaugggcugaacacguucaccaacauggaggugcagcugauccgucucauggagucagagggcaucuuccugcccagcgaacuggagacaccgaaucucgcggagcggguacuggacuggcuggagaagcacggugccgaaagacucaagcguauggccaucuccggcgaugacugcgucgucaagcccaucgacgaucgcuucgcgaccgcccucacugcgcugaacgacauggggaaggugcggaaggacaucccccagugggaacccagcaagggauggaacgacuggcagcagguaccguucugcucccaccauuuccaccagcucaucaugaaggacggccgcgagaucguggugcccugucggaaccaggacgaacugguugggcgggcgcgggugagucagggcgccggguggagccugcgagagacggccugccucgggaagagcuaugcccagauguggcagcugauguauuuccaccggcgggaccuucggcucgcggccaacgcuaucugcuccgccgugcccguugacugggugccgacgucacgcaccaccuggagcauccacgcgcaccaucaguggaugacgacagaggacaugcuguccguguggaaccggguuuggaucgaggagaacccguggauggaggacaagacccacgugagcuccugggaggaggugcccuaccugggcaagcgcgaggaccaguggugcggcagccucaucggccugaccgcccgcgccaccugggccaccaacauccaggucgccaucaaucaggugcggcgccucauagguaacgagaauuaccucgacuauaugaccuccaugaaaagauucaagagcgaauccgaccccgagggcgcgcuuugguga

SEQ ID NO: 23945 - RNA, 9879 nt, Artificial Sequence
  derived and/or modified CDS sequence (opt11) from DENV-1__FJ850113__SS-prME
agugugaccauguuacucauguuacugcccaccgcucucgccuuccaccuaaccacacggggcggagagccacauaugaucgugagcaagcaggaacgggggaagucccuacuguucaagaccagcgccggggugaacauguguacccugauugcaauggacuugggagagcucugcgaggauacaaugaccuacaaguguccucagauuaccgaggcggagcccgacgacguggacugcuggugcaacgccaccgacaccugggugaccuacgggacauguagccagacuggagagcaucggagagacaaacgauccguggcucuggcgccacacgugggcuuggggcucgagacgcggacggagaccuggaugagcucugagggcgccuggaagcagauacaacgcgucgaaacgugggcucugcggcaccccggcuucacggugaucgcccuuuuucucgcccaugccaucgggacuagcaucacacaaaaggggaucauauucaucuugcugaugcucguuacuccauccauggccaugcgcugcgucggcaucggcaauagggacuucguggaggggcugucuggggcgacguggguggaugucguacucgagcacggguccugcguuacaaccauggcaaagaacaagcccacucucgacauugaacuguugaagacugaggucaccaaucccgcaaucuugcgcaagcuguguaucgaagccaagaucagcaacaccacgacugauucccgguguccgacgcaaggagaggcuacgcucguggaggagcaggacgcaaacuuugugugccgccggacguuugucgaccgcggcuggggaaacggcugcggucuguuugguaaggggagucuucugacgugcgccaaguucaagugugugacuaagcuggagggcaagauugugcaguacgagaaccugaaguauuccguuaucguaacaguccacaccggcgaccaacaccaggucgggaacgaaacuacugagcaugguacaaucgcgacuaucacgccccaagcccccacgagcgagauacagcugaccgacuauggggcauuaacguuagacugcagcccucggacgggucuggacuucaacgagauggugcuacucacuaugaaggagaaauccuggcugguccacaagcagugguucuuggaucuuccccugcccuggacaucuggcgcuucgacgucacaggagacauggaaucgccaagaccucuuagugaccuucaagaccgcccaugcgaagaaacaagagguggucguucugggcucacaagagggcgcaaugcacaccgcccuaaccggggccacggaaauacagaccagcgguaccacuacgauauucgccgggcaccugaagugucgucugaaaauggacaagcugacccugaagggcacgaguuacgugaugugcacugggagcuucaagcucgagaaggaagucgcggagacgcagcacggcaccgugcuggugcaggucaaguaugagggcaccgacgccccuugcaagaucccauuuuccacacaggacgagaaaggaguuacgcagaacggcaggcuuauuaccgccaacccaaucgugaccgauaaggagaaaccugucaauaucgagacagagccgcccuucggggaaagcuacaucguggugggggcaggggagaaggcgcugaaguuauccugguucaagaaagggagcucaaucgggaagauguucgaggccaccgcccgcggggcacgcaggauggcgauccucggcgacaccgccugggacuucgguagcaucgguggcguguucaccuccgugggaaaguuggugcaucagguguucggcaccgccuacgggguccuguucucgggcguaucauggacgaugaagauuggaaucgggauccuccugaccugguugggccucaauagccgcuccaccucgcuguccaugaccugcaucgcgguugggaugguaacgcuguacuuaggcgugauggugcaggccgacucgggguguguaauuaacuggaagggacgcgagcuaaaaugcggcucgggcauauucgugaccaacgagguccauacauggaccgaacaauacaaguuucaggcugacagcccgaaacggcuguccgccgccauuggcaaggcuugggaggagggcguuugcgggauucgcuccgccacccggcucgagaacaucauguggaagcagauaucgaacgagcugaaccacauacugcuggagaaugacaugaaguuuacggugguugugggcgaugccaauggcauccuugcgcaagggaaaaagaugauccgcccccagcccauggagcauaaguacuccuggaaguccuggggcaaggccaagaucaucggugcugauauacaaaacacuaccuucaucaucgacggacccgacaccccggagugccccgacaaccagcgggccuggaacaucugggaagucgaggacuacggguucgguaucuucacuacgaacauuuggcucaagcuacgcgacuccuauacccagaugugcgaccacagacugaugagcgcggcaauaaaggauuccaaagccguccacgccgacaugggcuacuggaucgagucugaaaagaacgagaccuggaaacuugcccgcgcguccuucauagaggugaagacgugcaccuggccuaaaagucauacccuuuggucaaacggcguguuagagagcgaaaugaucauccccaagauuuauggggguccgauaucccagcauaacuaccggcccggguacuucacccagacugccgggccguggcaccugggcaagcuagagcuggacuucgaccugugcgagggcaccacggucgugguugacgaacacugcggaaaccgugggccgucguuacggaccacgacagucaccggcaagauuauccacgaguggugcugucgcaguugcacccugccgcccuuacgguuccgcggggaagacggaugcugguacgguauggagauucgucccgucaaggagaaggaagaaaaccucgugcgcucaauggucagugccgguaguggagaaguggacagcuuuucgcucggaauauugugcgccuccauuaugaucgaggaggugaugaggucccgcuggucacggaagaugcucaugacggggacucuggccguuuuccuucuccuuauaauggggcagcugaccuggaacgaucucaucagauugugcauaaugguaggcgcaaaugccuccgaccgaauggggauggggaccacauaccuggcccuuauggcuaccuucaagaugcggccgauguuugccguggggcuccuguuucgcagacugaccagcagagagguacugcuccuuaccaucggucuuucccugguggcuagcguggaguuacccaacucccucgaggagcugggcgacgggcucgccauggguauuaugauguugaagcugcucacagaguuccaaccccaccagcuguggaccacccuacucucgcugaccuucaucaaaacgaccuuaucgcuugauuaugccuggaaaaccaccgcgaugguacugucuauagugucccuguucccccucugcuugagcaccaccucccagaagaccaccuggcuuccgguccuccugggcucauucggcugcaaaccccugaccauguuccucaucacggaaaacaagauauggggccggaaguccuggccacugaacgaagggaucauggcgauugguaucgucucuauccugcucuccuccuugcuaaaaaacgaugugccccucgccgggccgcuuauagccggcggcauguuaaucgcaugcuacgucauaagcgguuccagcgcugaccucucccuggaaaaggcggcugaggugagcugggagcaagaggccgagcacuccgguacuucgcauaacauucugguggagguucaagacgacgguaccaugaagaucaaggaugaggagcgcgaugacacucucacuaucuugcugaaggccacucuccuggccgugaguggcguguacccuauguccaucccggcgacccuguuugucugguacuucuggcaaaagaaaaaacagcggagcgggguccucugggacacccccagcccgcccgagguggagcgggcgguccuagacgauggcaucuaccgcauccugcaaagaggccuccugggccgaucccaggugggcgugggggucuuccaagacggcguguuccacacgauguggcacgugacgcguggggccguucugauguaccaggggaagcgucuagagcccagcugggcuagcguuaagaaagaccucaucucguaugguggaggguggcgcuuccagggauccuggaauacgggcgaggaaguacaggucaucgcuguggagcccgggaagaauccuaagaacguacagaccacccccggaaccuuuaagacgcccgagggggagguuggggcaaucgcgcuugauuucaaacccgggacaagcggguccccgaucgugaaccgcgagggcaagaucgugggccuguacggaaauggcguagugacgacaagcgguaccuacguauccgccaucgcucaggccaaggcgucgcaagagggcccccuaccagagaucgaagacgaggucuucaagaaaaggaaucugaccaucauggaccugcacccgggaagcggcaagacuaggcguuaccugcccgcuauugugcgagaggccaucaagcgcaagcugcgaacacugaucuuggcccccacccgcguagucgcauccgagauggcagaggcacuaaaagguaugcccauccgcuaccagaccacggccgucaagagcgagcacaccgggcgugagaucguggaccugaugugucacgccacguuuacgaugagauugcugucuccgguccggguucccaacuacaacaugauuauuauggacgaggcgcacuucaccgaccccgccagcauagcugcucguggcuauaucucuacccgggugggcaugggggaggccgcggcgaucuucaugacugcuacgccgcccggaucagucgaagccuucccccaguccaacgcuguuauccaggaugaagagcgcgacauccccgaacgguccuggaauucuggauacgacuggaucacagauuuucccgguaagaccgugugguucguaccuagcaucaaguccgggaacgacaucgcgaacugcuuacgcaagaacggcaagcgggugauccagcucagcagaaagaccuucgacaccgaguaccaaaaaacaaagaacaacgacugggacuacguggucaccacugacaucuccgagaugggggccaauuuccgggcugaccgcgugaucgaccccagacgcugccugaaaccugugauccugaaggauggccccgaaagggucauccucgccggcccgaugccuguuaccgucgccagcgcugcgcagcgucgcggccgaauaggcagaaaucaaaauaaagagggggaccaguaugucuauaugggccaaccccugaacaacgacgaagaccacgcccacuggacggaagcuaagaugcuucuagacaauauaaauaccccugaagggaucaucccggcgcuguucgagccggagcgcgaaaaguccgccgccauagacggcgaauaccgccugcgaggggaggcccguaagaccuucguggaguuaaugcggcgcggcgaccugccggucuggcugagcuacaagguggccagugaaggcuuccaauauagcgaccgacgcuggugcuucgacggcgagcgaaacaaccaggucuuggaagagaacauggacgucgagaucuggaccaaggaaggcgaacgcaaaaaacugcggccccgcuggcuagaugcucguacguacuccgacccacucgcccuucgcgaguucaaagaauucgccgcggggcgacgcagcgugagcggcgaccuuaucuuagagaucggcaaguuaccccaacaucugacccuccgggcacagaacgcgcucgauaaccuggugaugcuccacaacuccgaacagggcggaaaagccuacagacacgccauggaggagcuucccgacaccauagagacccugaugcuccucgcgcucaucgcgguccucacagggggggugacgcuguucuuccugucuggcaaaggccucggcaagacuuccauaggguuacucugcguaaccgccagcucggccuuacuguggauggcuagcgucgagccccacuggauagccgccuccaucauccuggaguuuuucuugauggugcugcugaucccugagccggaccggcaaagaacgccccaggacaaucagcucgcguacgugguuauaggguugcuguuuaugauccucaccguggcugccaacgagauggggcuucuggaaaccacgaagaaggaccucggcaucggccacguggcugccgagaaccaccagcacgccaccaugcuggacgucgacuuacggcccgccagcgccuggacgcucuaugcuguagcgacgaccgugaucacccccaugaugaggcacacgaucgagaacaccacagcgaacauaucucugaccgccaucgccaaucaggcggcgauacugaugggccuagauaagggcuggcccaucagcaagauggacaucggugucccccugcuagcucucggcuguuacucccaggugaacccauugacgcugaccgccgccguucuuaugcuggucgcgcacuaugcaaucaucggucccggccuucaggccaaagccaccagggaggcccaaaaacgcacggcggcggggaucaugaagaacccaacggucgacggcaucguggcuauagaccucgauccggucguguacgacgcuaaauucgagaaacagcucggccagaucaugcuccugauacugugcaccagucaaauccugcucaugcggacuaccugggcccugugcgaguccauaacacuagcgacaggcccgcucaccacccuuugggagggcagccccgggaaguucuggaauaccaccaucgccguguccauggccaauaucuuccgaggaagcuaccuggccggcgccgggcucgcguucucccugaugaagucccugggcgguggacgcagagggaccggcgcccagggugagacccucggcgagaaauggaaacgccagcugaaccagcugaguaagagcgaguucaacacguacaagcgcagcggcaucauggaagucgauaggucggaggcaaaggagggacuuaagcggggcgaaaccacuaagcacgccgugucaagagguaccgcaaaacugcggugguucguagaacguaaccuuguaaagccagagggcaagguuauagaccuggggugcgggcggggcgggugguccuacuacugcgcuggccugaaaaaagucacagaggugaagggguacacgaagggcggccccgggcacgaggagccgauacccauggcaaccuacggcuggaaucuggugaagcuucauagcggaaaggauguguucuucaugccgcccgaaaaaugugauacucuucugugcgacaucggggaauccucgccgaaucccacgaucgaagaagggagaacgcugcggguccucaaaauggucgaaccaugguugcgcggaaaccaguucugcaucaagauccugaaccccuacaugccguccgugguagagacguuagaacagaugcagcggaaacacgguggaaugcuggugcguaacccacugagccggaauuccacccaugagauguacuggguuagcugugguaccgguaacaucguuuccgccgugaacaugacgagccgcaugcuccugaaucguuucaccauggcgcaucggaagccgacauacgagcgcgacguggaccugggagcagggaccaggcacguugccguggagcccgagguggccaacuuggacaucauugggcagcgcauugagaacaucaagaacgaacacaagagcacguggcauuacgacgaggacaacccguacaagaccugggccuaucacggcucuuacgaagucaagcccuccggcuccgccuccagcauggucaacggggugguucgacugcugaccaagcccugggacguaauucccauggucacgcagauagcaaugacggacaccacaccuuucgggcagcagcgcguguuuaaggagaagguggacaccagaacgccccgggccaagcggggaaccacucagauaauggaggucacagcuaaguggcucuggggcuucuuaagucgcaacaaaaagccacggauuugcacgcgggaggaauucacccggaaagugcgcucuaacgcugccaucggggcgguuuucgucgacgagaaccaguggaacucugccaaggaggccgucgaggacgagcgguucugggacuuagugcaucgcgagcgggagcugcacaagcaagguaaaugugcaaccugcgucuacaacaugauggguaagcgcgagaagaagcugggcgaguucggcaaggcgaagggaucucgugcaauuugguacauguggcuaggcgcacgcuucuuagaguucgaggcuuuaggguucaugaaugaagaccacugguucucuagagagaacuccuuaagcggcgucgagggggaaggacuacauaaacucggauauauacugcgagacauuucgaagaucccgggcggcaacauguacgccgacgauaccgcagguugggacacgcggaucaccgaggacgaccuccagaaugaggccaaaaucaccgacauaauggaacccgagcacgcacugcuggccacuagcaucuucaaauuaacguaccagaacaaagugguccgcgugcagcgcccagccaagaacgggaccgugauggacgugaucucccggcgcgaucaacggggguccggucaggugggcaccuacgggcugaacaccuuuaccaacauggaggugcaacugauccgccucauggagagcgaaggcaucuucuugccgagcgaguuggagaccccgaaccucgcggaacguguccuugacuggcuggagaagcacggagccgagcgacucaagaggauggcuaucucgggugacgacugcguugugaagccaaucgacgaccgcuucgccaccgcauugacagcgcugaacgacauggggaaaguaagaaaggacauaccacaaugggagcccucaaaaggcuggaacgacuggcagcaagugccguuuugcucucaccauuuccaucaguugaucaugaaggauggccgcgagaucgugguucccugcagaaaccaagacgagcuggugggccgcgcccgggucagccaaggcgcuggguggucgcuucgggagaccgccugccucggcaagucauaugcccaaauguggcaacugauguacuuccaccggcgcgaccugcgauuagcggccaacgccauaugcuccgccgucccuguggacugggugcccacgagccgcaccaccuggagcauccacgcgcaccaccaguggaugacgacggaggauaugcugucugucuggaaccggguguggaucgaggagaauccguggauggaagauaaaacacacgugagcagcugggaggaggugccuuaccuagggaaacgcgaagaccaauggugcggcagucucaucggccugaccgcccgagcgaccugggccacgaauauccagguggccaucaaccagguccggcgucugaucgggaacgagaacuaucuugacuacaugaccuccaugaagcgguucaaaucugagucagacccugagggagcauuaugguaa

SEQ ID NO: 23946 - RNA, 9879 nt, Artificial Sequence
  derived and/or modified CDS sequence (opt11) from DENV-1__JF937635__SS-prME
ucggugaccaugcugcucaugcuuaugcccaccgcccuggccuuccacuuaaccaccaggggcggcgagccccacaugaucgucaguaagcacgagagaggcaaggcgcugcuauucaagacgagcaccggggugaacaugugcacccucaucgccauggaccucggcgagcugugcgaagacaccaugacauacaagugccccaggauaacugaggccgagcccgacgacguggacugcuggugcaacgccaccgacacaugggugaccuacgggaccugcucccagacgggggagcaucgucgcgacaagcguaguguggcccucgcgccccacgucggccuggggcuugaaacccgcaccgagacauggauguccagcgagggcgccuggaagcagauccaacggguugagacgugggccuuacgccaccccggauucacagucaucgcccuguucuuagcgcacgccaucggcacuucaaucacccagaaggggaucaucuucauccugcugaugcuggugacgccuagcauggccaugcggugcgugggcauaggcaaccgcgauuucguggagggcuuguccggugccacauggguggacguagugcuggagcacggguccugcguaacgacaauggccaagaauaagccuacucuggauaucgagcuccugaagaccgaggucaccaacccugcagugcuacggaagcucugcaucgaggcuaaaauauccaacaccacgaccgauagccgcuguccgacccagggcgaggcgacccugguagaagaacaagacgcuaacuucgucugccggcggacguucguggaccggggcugggggaacggcugcgggcuguucggcaaggggucgcuccugaccugcgccaaguucaaaugcgugaccaaauuggagggcaagaucguccaguacgaaaaccucaaguacagcguaaucguuacuguccacacgggcgaccagcaccagguggggaacgagaccacggagcacggcaccaucgcaaccaucacgccccaagccccgacaagugagauccaacugaccgacuacggggcccugacccuugacugcagcccucgcacgggccuggacuuuaacgagaugguucugcucacaaugaaggagaaauccuggcuggugcacaagcagugguuccuggaccuuccgcuccccuggacaaguggggcuuccaccucgcaggagacguggaaccggcaggaccugcucgugaccuucaagacugcccacgcgaagaagcaggagguagucgugcugggcagccaggaaggcgccaugcacaccgcacugacgggggccaccgagauacagacuuccggcaccacgacaauauucgcgggacaccucaagugucgccugaagauggacaagcugacccucaagggcaccaguuaugucaugugcacgggcuccuucaagcuggagaaggagguugcggagacucaacacggcacaguucuaguccaaguuaaguacgagggcaccgacgcgcccugcaaaauucccuucagcacgcaggacgagaaggggguuacucagaacgggcgacugaucaccgccaacccgaucguuaccgacaaagagaagcccgucaacaucgagacagagccgcccuucggggagagcuauaucguugucggcgcgggcgagaaggcucucaaguuaagcugguucaagaaaggguccagcauagguaagauguucgaggcgaccgcgagaggggcucgucgcauggccauccuaggugauacagcgugggacuucgguuccaucggcggcguguuuaccagcguugguaaauuagugcaccagguguuuggaacggcguacggggucuuguucuccggggucagcuggaccaugaagaucggcaucggcauccuacugaccuggcugggccugaacucccgcagcaccucccucagcaugacgugcaucgcugugggaauggucacccuauaccugggcguuauggugcaggccgacagcggcugugugaucaacuggaagggccgagagcuuaagugcgggagcggaaucuucgucacaaacgagguccacacuuggaccgagcaguacaaguuccaagcagacuccccaaagcgccugagcgcggccaucggcaaggcuugggaggagggugugugcgggauccggagcgccacucggcucgagaacaucauguggaagcagaucuccaaugagcucaaccacauacuguuagagaacgacaugaaguucaccguuguggugggggacgccaacggcauccucgcgcaggggaagaagaugauccgcccccaaccgauggagcacaaguauagcuggaaaagcuggggcaaggccaagaucaucggcgccgacauucagaacaccacauuuaucauagacggacccgacacgccggaaugccccgacgaccagcgcgcguggaacaucugggaggucgaggacuacggcuucgguaucuucaccaccaacaucuggcugaaguuacgggacucuuacacccagaugugcgaccacagacucauguccgcggccaucaaggacagcaaagccgugcacgccgacaugggcuacuggauugaguccgagaagaacgagacguggaagcuggcccgggcgagcuucaucgaaguaaagacuugcacauggccgaagucccauacccuguggagcaacggcguccuugaauccgagaugaucauccccaaaaucuaugggggcccgaucagccaacacaacuauaggccuggguacuucacucagacugccggacccuggcacuuagggaaacuggagcuugauuucgauuugugcgagggcaccaccguuguggucgacgaacacuguggcaaccgagggccgucucugcgcacgaccaccgugacaggcaagauuauccacgaauggugcugccgaagcugcacucugccgccucuccgcuuccgcggcgaggacggcugcugguacgggauggagauccgccccgugaaagagaaggaggagaaccugguccggaguaugguuagcgccggcagcggugagguggauagcuucagcuuggggauccuuugugucuccaucaugaucgaggaggugaugaggagccggugguccagaaagaugcuuaugaccggcacacucgccguauuccugcugcucaucauggggcaguuaaccuggaaugaccuaauccgccucugcauaauggucggcgccaaugcaagcgaucggauggggaugggcacgacguaccuggcacugauggccacguucaaaaugcgcccgauguucgccguaggcauucucuuccggcgccucaccucccgugaggugcugcuucugacgaucgggcuaucguuggucgccucuguggagcugcccaauucucuugaggagcucggagaugggcucgcgauggguaucaugauguugaagcuccugaccgaguuucagccgcaccagcuguggacgacccuccuauccuuaacguucaucaagaccacucucagccuggacuacgcguggaaaaccacggccauggcccugucaauagugagccucuuuccccugugccuguccaccacuucgcagaagacaaccuggcuucccguauugcuuggguccuucgguugcaagccccucaccauguuucugaucaccgagaacaagaucugggggcguaagagcuggcccaucaacgagggaaucauggcgaucggcaucguguccauucugcugagcucccugcugaagaacgacguccccuuggccgggccucugaucgccggcggcaugcugauugcaugcuacgugauuagcgguagcagugcagacuugagccuggagaaggcggccgagguguccugggagcaggaagccgagcauagcggcacaucacauaauaucuuagucgaggugcaggacgacgggacuaugcggaucaaggacgaggagaaggacgacacgcucaccauccugcugaaggcaacccuccuggccgugagcggcgucuacccgaugucaauccccgcgacccuuuucgugugguacuuuuggcagaaaaagaagcagcgcagcggggugcucugggacacgcccuccccucccgaggucgagagagcuguguuggacgacggaaucuaccgcauccugcagagaggcuuacuggggcgcagccaggugggcgucgggguguuccaggacgggguguuccauacaauguggcacgugacucgcggggccguucugauguaucaggguaagcgccuggagcccuccugggccagcgugaaaaaggaccucauauccuacggcgggggcuggagguuccaggggagcuggaauaccggcgaggagguccagguuaucgcugucgagcccgguaagaauccuaagaacguccagacgaccccagggaccuucaagaccuccgagggggaggugggggcgaucgcccuagacuucaagcccggcacgagcgggucccccaucgugaaccgcgaagguaagaucguaggucucuacggcaaugguguggugaccaccagcgggacauacgucuccgccaucgcccaagccaagacgucacaggagggcccgccgcccgagaucgaggacgagguguucaagaagcggaaccucacgaucauggaccuacacccggggucgggcaagacccgccgguaccuacccgcgauagugcgcgaggccaucaagcggaagcuccgcacccugauccuggccccuacgcgcguaguggcguccgagauggcggaagcauuaaagggcaugcccauccgguaucagaccaccgcagugaaaagcgagcacacaggccgugagaucgucgaccugaugugccacgcuacguucacgaugaggcuccuauccccggugcgcgugcccaacuacaacaugauuaucauggacgaggcccauuucaccgacccggcgucgaucgccgcacgggguuauauuuccacucgcguugggaugggcgaggcggccgcaaucuucaugacggcaaccccacccggaucgguggaggcauucccccagaguaacgccgugauccaggacgaggagcgcgacauccccgagagaucauggaacucaggcuacgacuggaucacugacuucccgggcaagaccgucugguucgugcccagcauuaaguccgggaacgauaucgccaacugucugcggaagaacgggaagcgcgugauccagcuaagccggaagacguucgacaccgaguaccagaagaccaagaacaacgacugggacuacgucgugaccacggauaucuccgagaugggagccaacuuccgugccgaccgggugaucgacccaagacggugccucaagccaguaauccugaaggauggucccgagcgcguaauucuggccgggccgaugcccgugaccguugccagcgcggcacagcggcgcgggcggaucggccgcaaccagaacaaagagggggaccaguacguguacaugggccaacccuuaaacaacgacgaggaucacgcccacuggaccgaggccaaaaugcugcuggacaacaucaauacccccgaggggaucaucccggcgcucuuugaacccgagcgugagaaguccgcggcgaucgacggcgaguauaggcugcgcggggaggcgcggaagaccuucgucgagcuaaugcggcggggcgaucuacccguguggcugagcuauaagguggccuccgagggcuuccaguauagcgaccgccguuggugcuucgacggggagcgcaacaaccaaguccuggaggagaacauggacguggaaauauggacgaaagagggugagcggaaaaagcuccguccucgguggcuggacgcccgaaccuauuccgauccgcuggcccugcgggaguucaaggaguucgccgccgggcgccggagcgugagcggcgaccugauucuggagauuggcaagcucccucaacaccugacccugagggcccaaaaugcacucgacaaccucgugaugcugcauaacagcgagcaaggagggaaagcguaccgccacgcgauggaggagcuccccgacaccauagagacgcugaugcuacucgcccugaucgccguacugaccgggggcguuaccuuguucuuccuguccgggaagggccugggcaaaaccuccaucgggcugcugugcgucacggcaagcagugcucugcucuggauggccagcguugagccccacuggaucgccgccuccaucauacuugaguuuuuccugauggugcugcugaucccggagcccgaccggcagcguacaccccaggacaaccagcuggcguacgucgugauaggucugcuguucaugauccuuaccgucgccgccaacgagauggggcuccuggagaccacgaaacgugaccugggcaucgggcacgucgccgcggagaaccaccagcacgcgaccaugcucgacguggaccugcggccagccagcgcauggaccuuauacgcuguggccaccacggucaucacaccgaugaugcgccacaccaucgaaaacaccacggcgaauaucagucuaaccgccaucgccaaccaagcagccauacugaugggccuggacaagggcuggccuaucucgaagauggacaucggggugccccuccuggcgcuggggugcuacucgcaagugaacccacuaacccugaccgcugccguccugaugcucguggcccacuaugcgaucaucggccccggccugcaggccaaggcgacccgcgaggcucaaaagcggaccgcagcggggaucaugaaaaacccuaccguggacgggaucgucgccauugaccucgaucccgucguguacgacgccaaguucgaaaagcagcuugggcagaucaugcugcugaucuuguguaccagccaaauccugcugaugcgcacuaccugggcccucugcgaguccaucacccuggccaccgggccgcugacgacacugugggagggcagcccugggaaguucuggaacaccaccauugcggucuccauggccaacauauuccggggcucauaccuggccggcgcggggcuugcauucucccucaugaagucauuaggcgggggucgccgugggacgggcgcgcagggcgagacguuaggagagaaguggaagcgccagcuuaaccagcuguccaaaccugaguucaacacguacaagcgcagcggcaucauggagguugaccgcagcgaggccaaggagggacugaagcggggcgagaccacuaagcacgccgugucccgggggacggcuaaacuccggugguucgucgagcgcaacuuaguaaagccagaggguaaggugauagaccugggcugcggucggggcggcuggagcuacuacugugcuggccucaagaaggucaccgaagucaagggguauaccaagggcggccccgggcacgaggaacccauccccauggccaccuacggcuggaacuuagugaagcuccacuccgggaaggacgucuucuucaugcccccggaaaaaugugauacgcugcucugcgauauuggcgagagcagucccaauccgaccaucgaagaggggcgcacccugagaguccugaagaugguggagcccugguuacgcggcaaucaguuuuguauuaagauucugaauccguauaugcccagcgucguugagacgcuggagcagaugcagcggaagcauggcggaaugcucgugcgcaaccccuuaucccggaacuccacgcacgagauguacugggucuccugcggcaccgggaacaucguaucggccguuaauaugaccucccgcaugcuccuuaacagauucaccauggcccaccggaaacccacuuacgaacgcgauguugaccugggcgccggcacucggcacguggcggucgagccggaggucgccaaccuggacaucaucgggcagcgcaucgaaaauaucaagaacgagcacaagagcaccuggcacuacgacgaggauaaccccuauaagaccugggccuaccacggcuccuacgaagugaagccuagcgggagugccagcuccauggugaacggcguuguucggcuccuaacgaaaccuugggauguaauccccauggugacccagaucgcuaugaccgacaccacacccuucggccagcagcggguauuuaaggaaaagguggauacccggacaccucgggcaaaacggggcacuacacaaaucauggaggugaccgcuaaguggcuauggggauuucucagcagaaacaagaagccccggaucuguacccgcgaggaguucacccggaaggugcgcucgaacgcggccaucggcgcuguauuuguagacgaaaaccaguggaacagcgcgaaagaagccguugaagacgagcgguuuugggaccuaguccacagagaacgggaacugcacaagcaggguaagugcgcuacgugcguguacaacaugauggggaagcgcgagaagaagcucggcgaguucgggaaagcaaagggcagccgcgcgauuugguacauguggcugggcgcccgcuuccuggaguuugaggcucucggguucaugaaugaggaucauugguucucacgggagaacagccuguccggcguggaaggggagggccugcacaagcucggguacauucugcgagauaucaguaagauccccggcggcaacauguacgccgaugacaccgcaggaugggacacccgcaucaccgaggacgaccuucagaacgaggcgaagaucacggauauuauggaacccgaacacgcgcuccuggccaccuccaucuuuaagcugaccuaucagaacaagguagugcgggugcaacgacccgcgaagaacggcacuguaauggacgugaucagccggcgcgaccagcgggggaguggccagguggggacguacgggcugaauaccuucaccaacauggagguccagcugaucagacagauggagagcgaggguaucuucuuaccguccgaacuagagacccccaaccuggccgagcgggugcuggacuggcucgagaagcacggggcagagcgccugaaacggauggcuauuagcggcgacgacugcgucgugaaacccaucgaugaccgcuucgccacugcccugaccgcccucaacgauauggggaaaguccggaaggacauaccccaaugggaaccgucgaaaggcuggaacgauuggcagcaggucccuuucugcucucaucacuuucaccaacucaucaugaaagacggccgcgaaaucguugugcccugccggaaccaggacgagcuggugggccgcgcgcgugucucccagggcgccggguggucucuucgcgagaccgccugccugggcaaaucuuacgcccagauguggcagcugauguacuuccaucgucgcgaccuacgguuagccgcgaacgccauaugcucagccgugccaguggacuggguaccgaccucccgcaccacguggucgauccaugcacaucaccaguggaugaccaccgaagacaugcugucuguguggaaccgaguguggaucgaggagaaccccuggauggaggacaaaacacacgucuccagcugggaggagguaccauaccucggaaagcgcgaggaccaaugguguggcucccugaucggucugacggcgcgugccaccugggcuacgaacauccagguggcuaucaaccagguacggcgccucaucggcaacgagaauuaccuggacuacaugacuagcaugaagcguuucaagaaugaguccgaccccgagggcgcccugugguga

SEQ ID NO: 23947 - RNA, 9879 nt, Artificial Sequence
  derived and/or modified CDS sequence (opt11) from DENV-1__FJ024483__SS-prME
agcgugacuaugcugcucaugcuccuccccaccgcgcucgccuuucacuugacuacccgcggcggugagccgcacaugaucgucagcaagcaagagcgggggaagagccuacuguucaagaccagcgcgggagugaauaugugcacuuuaaucgcaauggaccugggggagcucugcgaagacaccaugacauacaagugcccccagaucacagaggccgaacccgacgauguggauugcuggugcaacgccaccgacaccugggucaccuacgggaccugcagccagaccggcgagcaccggagagacaagagguccguggcccuagcgccccauguaggacugggccuagagacgagaaccgagacuuggaugucaucggagggcgccuggaagcagauccagcgcgucgaaacgugggcgcugcggcacccgggguuuacggugauugcccucuuccuagcucaugccaucggcaccagcaucacccagaagggaaucaucuucauccugcugauguuagugacccccuccauggcaaugcgcugugucggcaucggcaaccgggacuucguggaggggcucuccggcgccaccuggguggacgucgugcuggagcacggguccugugugaccacgauggccaagaacaagcccacccuagacauugagcugcuaaaaacggaggucaccaaccccgcuauccuucgcaaacugugcaucgaggccaagauuagcaauaccaccacggauucccgguguccgacccagggggaggccacccugguagaggagcaagacgccaacuucgugugccgcagaaccuucguggaccgcgggugggggaacggcugcggccucuucggcaaagggucacugcugacgugugccaaguucaagugcgugaccaagcucgagggcaaaaucguccaauacgagaaccugaaguacucugucaucgugacugugcacaccggcgaccagcaccaggucgggaacgaaacgacagaacacggcaccaucgcuaccaucacuccccaagcaccaacgucagagauccaacugaccgauuacggugcccucacccuggauugcagcccccgcaccggccuggacuuuaacgagaugguucuccugacgaugaaggagaaguccuggcugguccacaagcagugguuccuggaccugccguuacccuggacuuccggggccagcaccagccaggaaaccuggaaccgccaggacuugcuggucacguucaagaccgcccacgcgaaaaagcaggaaguggucgugcuggguucccaggagggcgcaaugcacaccgcauugacuggggccacggagauacagacgagcggcaccaccacgaucuucgccgggcaucugaagugccggcugaagauggacaagcuuacccucaagggaacuuccuacgugaugugcacggggagcuucaagcuggaaaaggaggucgcggaaacgcaacacggaaccgugcugguucaggucaaguacgagggcaccgaugcacccuguaagauacccuucucgacgcaggacgagaaggggguuacgcagaacgggcgucucaucacagcgaaccccauugugaccgacaaggagaagccuguaaacauugagacagagccgcccuucggggagagcuacaucguggugggagccggugagaaggcgcugaagcuguccugguuuaagaaggggagcuccaucggcaagauguucgaagccacggcccgcggggcucgccggauggcaauacuaggggacacggcaugggauuuugggagcaucgggggcgucuucaccagcgugggcaaacuggugcaccagguguucgggacggccuacggggugcuguucagcggcgucucuuggacgaugaagaucgggaucgguaucuuacugacuuggcugggccucaacucacgcuccacaagccuuuccaugaccugcauagcagugggaauggucacgcuguaccucggcgugaugguucaggcagauagcgggugcgucaucaacuggaagggccgcgaacugaagugcgggaguggcaucuucgugacgaacgagguacacaccuggaccgagcaguacaaguuccaggccgauucaccgaagcgucugagcgcggcgaucggcaaggccugggaggagggggugugcggcauccgcuccgccacccggcucgagaacaucauguggaagcagaucagcaaugaauuaaaccauauccugcucgagaacgacaugaaauuuacggucgucgugggggacgccaacggcauucuagcacaggggaagaagaugauacgcccgcagcccauggagcacaaauacucauggaaguccugggguaaggcuaaaaucaucggugcugacauccagaacaccacauucaucaucgacgggcccgacacuccggagugccccgacaaccagcgggccuggaacaucugggagguggaagacuauggauucgggaucuucacgaccaacaucuggcugaagcuccgcgacuccuacacccagaugugugaccaccggcugaugucggcggcuaucaaggacuccaaagcgguccacgccgacaugggcuacuggaucgaaagcgaaaaaaacgaaacguggaaguuagcccgugcguccuuuauagaggugaagacgugcaccuggcccaagucacacacccuaugguccaacggggugcuggagagcgagaugauuauccccaagaucuacgggggcccgaucucccagcacaauuaccggcccggguacuacacccagacggccggacccuggcaccuggggaaauuggagcuggauuuugaccugugcgagggaacuacagucgugguggacgagcacugcggcaaccgcgggccaagccuucggacuacgacggucaccgggaagaucauucacgaguggugcugccgcuccugcacccuaccgccguugcgguuccgaggggaggacggcuguugguacgggauggagauccggccugugaaggaaaaggaggagaaccuagugcgcucuauggucuccgcaggcagcggcgagguggacucuuucucccugggaauccucugcgccagcauuaugauagaggagguaaugagaagucgcuggagccggaagaugcucaugacuggcaccuuggcaguguuccuacuccugaucauggggcagcuaaccuggaacgacuuaauacgccugugcaucauggugggcgccaacgccagcgaccgaauggggauggguaccacguaccuggcacuuauggcuaccuucaagaugcggccgauguuugccguggggcugcuguuccgccggcuaaccagccgcgagguccuguugcucaccaucggguugucccugguggcgucaguggagcuccccaacucccuggaggaacugggagacgggcucgcgauggguaucaugaugcugaaguugcuaacggaguuccagccucaccagcuguggaccacccuucucucucucacuuucaucaagacgacccugucacucgacuacgccuggaagaccaccgccauggcguugagcaucgucucacuguucccccuuugccucaguacgaccucccagaagaccacguggcugcccgugcuccugggcagcuuuggcugcaagccacugaccauguuccuuauaaccgagaacaagaucuggggccgaaagaguuggcccuugaacgagggaaucauggccaucggcauagucagcauucuauugucaagucugcugaagaacgacgugccccuggccggaccccugauugccggcggcaugcugaucgccugcuacgugauuagcggguccagcgcggacuugucccuggagaaggcagccgaggucagcugggagcaggaggccgaacacuccggaaccagccacaauauacucguggaggugcaagacgacgggacuaugaagauuaaggacgaggagcgcgacgacaccuuaaccauucuccugaaggccacacuccuggcggucuccggcguguacccuaugagcauccccgccacccuauucgugugguauuucuggcagaaaaagaagcagcguuccgguguccucugggacacccccagcccgcccgaggucgagagagcggugcuggacgacggcaucuaccggauccugcagcgcggccugcucgggcggucccaggugggcgucggggucuuccaagauggcguuuuccacacgauguggcacgugaccaggggggcgguucugauguaccagggaaagcgguuagagccaagcugggccuccguaaagaaggaucugaucuccuauggcgggggcuggagguuccagggguccuggaacaccggggaggaagugcaggucaucgcagucgaacccgggaagaauccgaagaaugugcagaccacgccgggcaccuucaagaccccugagggcgaggugggagccaucgcgcuggacuucaagcccgggaccagcggguccccgaucgucaaccgcgaggguaagaucgugggccuguacggcaacgggguggucacgacuagcgggaccuaugugucagccaucgcccaggcgaaggccagccaggagggcccucuccccgaaaucgaggacgaaguguucaagaagcgcaaccugacaaucauggaccugcacccugggucaggcaagacacggagauaccucccggccaucguccgggaggccaucaagcgcaaacuccggacacuuauacuggcgcccacccgagucguggccuccgagauggccgaggcgcugaagggcaugcccaucagauaccagaccacugccgucaagagcgagcacaccgggcgggagaucguggaucugaugugccacgcgaccuucaccaugcgccuccuauccccugugcggguccccaauuacaacaugaucaucauggacgaggcccacuucacggacccugccucuaucgcugcccgcggcuauauauccacccgcguggggaugggcgaagccgccgcuaucuucaugacagcuacgcccccggggagcguggaggcauucccccagucgaacgcggucauccaagacgaggagcgcgacauacccgagcggagcuggaacuccggcuacgacuggaucacggauuuccccggcaagacaguuugguuugugccaagcaucaaauccgggaacgauaucgcuaauugccugaggaagaacgggaagcgggucauccaguuaagccgcaagaccuucgacaccgaguaccaaaaaacaaagaacaacgacugggacuacguugucaccaccgacaucuccgagaugggggcaaacuuccgggccgaccgcgucaucgaccccaggaggugccugaagcccgugauucuaaaggauggccccgaacgggugauccuugcgggcccgaugccggucacagucgccagcgccgcccagcgccggggccgcaucgggcggaaccaaaacaaggaaggcgaccaguacguguacauggggcagccccucaauaacgacgaggaccacgcccacuggacggaggcuaaaaugcugcucgacaacaucaacacccccgagggcaucaucccggcccuguucgagcccgagcgcgagaaauccgccgccaucgacggcgaguaccgucugcgcggggaggcucggaaaaccuucgucgagcuuaugcgccgcggcgaucucccgguguggcucagcuacaaagucgcgucggagggcuuucaguauagcgaccggcguuggugcuucgacggggagcggaacaaccagguccucgaagaaaacauggacguagagaucuggaccaaggagggugagcgcaagaaguuacgaccccguuggcuagacgcccggaccuauuccgacccucucgcucugcgcgaguucaaagaguuugccgcgggccggcgcucagucagcggagaucugauccucgagaucgguaagcugccccagcaccugacucuacgggcucagaacgcucucgacaaucucgugaugcuccauaauuccgaacagggcgggaaagcauaccgccacgcaauggaggagcugcccgacacgaucgagacccuuaugcuccuagcccugaucgccgugcucaccgggggcgucacguuauucuuccugagcgggaagggccucggcaaaaccuccaucgggcugcugugcgugacggcguccuccgcccuccuguggauggccagcguggagccucacuggaucgcugcguccaucauccuggaguucuuccucauggugcuguugauacccgagcccgaccggcagcguacgccccaggacaaccagcuugccuacguggugauaggacugcuguucaugauccuaacggucgccgcuaacgagauggggcugcuggagacgaccaaaaaagacuuaggcaucgggcacguggcggcagaaaaucaccagcacgccacgauguuagacguggaccugcggccggcgagcgccuggacgcucuacgcgguagccaccaccgucauuacucccaugaugcgccauacaaucgaaaacaccacggccaacaucucccugaccgcuaucgccaaucaggcagccauucugaugggucucgauaaggguuggcccaucagcaagauggacaucggggugccgcuccuggcccugggaugcuacagccaggucaacccacugacgcugacggccgcggugcucaugcuaguggcccacuacgccaucaucgguccgggccugcaggccaaggcaacccgggaggcgcaaaagcgaacggcagcugggauuaugaagaaucccacggucgacggcaucguggccauugaccucgaccccgugguauaugacgccaaauucgagaagcagcugggccagauaaugcugcuuauucugugcaccucccagauccugcucaugcgcaccacgugggcgcugugcgaaucuaucacgcuggccaccgggccgcucacuacccuuugggagggaucucccgggaaguucuggaacacgaccauagccguauccauggccaacaucuuccggggcagcuaucuggcuggagcagggcuugccuuuucccuaaugaagucccugggugggggccgacgugggacuggcgcacagggagagacccucggggagaaauggaagcgccaguugaaccagcucuccaagagcgaauucaacacguacaagcggagcggcaucauggaggucgaucgguccgaagcuaaggaagggcucaagcggggcgagaccaccaaacaugcgguaucgcgcgggaccgcaaaacugcggugguucguggaacgcaaccugguaaagcccgagggcaaagugaucgacuugggcugcgggcggggcggcugguccuacuacugcgcaggguugaagaaggucaccgaggugaagggguacacaaagggcggccccgggcaugaggagccgauacccauggcuaccuaugguuggaaccuuguuaagcugcacagcgggaaggacguuuucuucaugccgccugagaagugcgauacacuacugugcgacauaggagaauccagcccgaaccccaccaucgaagaggggcgcacauugcgggugcucaagauggucgagccguggcugcgcggcaaccaguucuguaucaagauccugaaccccuauaugccgucggugguugagacucucgaacagaugcagcggaagcacggggggaugcugguucgcaauccccugagccggaacagcacucaugagauguauugggugagcugcggcaccgggaacaucguguccgccgugaauaugacuagccgcaugcuccugaaccgguuuaccauggcacaccgcaagccgacauacgaacgcgacguggaccugggcgccggcacacggcauguggccgucgagcccgagguggccaaccucgacaucaucgggcagcggaucgaaaacaucaagaacgagcacaaguccacguggcauuacgacgaggauaacccguacaaaaccugggccuaccacggcagcuacgaggugaagccuucggguagcgcguccagcauggucaauggcguggugcggcuuuuaaccaagcccugggacgucaucccuauggugacccagaucgccaugacggacacaaccccguucggacagcagcgcguauucaaggagaagguggauaccaggacgcccagggccaagcggggcaccacccagauaauggaggugaccgcuaaguggcuuuggggcuucuuaucccgcaacaaaaagccccggaucugcacccgcgaggaguucacccggaagguccgcagcaacgccgcaaucggggcgguguucguggacgagaaucaguggaacuccgcgaaggaggccguggaggacgagcguuucugggaccuggugcaccgcgagcgggagcuccacaaacagggcaagugcgcgaccugcguguacaacaugauggggaaacgcgagaagaagcuaggcgaguucgggaaggccaagggcucucgggccaucugguacauguggcuaggcgcccgauuccuggaauucgaggccuuaggguucaugaacgaggaccacugguucagccgggagaauaguuucagcggcgucgagggggagggccuacacaaguugggauacauacugcgcgacaucucgaagaucccgggcgggaacauguacgccgaugacacggccgggugggacacgcggaucaccgaggacgaccugcagaacgaggccaagauaaccgacauaauggagcccgagcacgcucugcuggccacaucgaucuucaaacugacguaccagaacaagguggugcgcguccagcgccccgcgaagaacggcacugugauggauguaaucuccagacgcgaccagcgugggagcggccaggucggcaccuacggauuaaacacuuuuaccaacauggaggugcagcugauucgucagauggaguccgagggcauuuuccugcccagcgagcuggagaccccgaaccuggccgagcggguguuagauuggcucgagaagcacggggccgagcgccuaaagcggauggccauuuccggggacgacugcgucgugaagcccauagacgaucgauucgccaccgcgcugacugcucucaacgacauggggaaggugagaaaggauauuccacaaugggagccaagcaagggcuggaacgauuggcaacaagucccguucugcucgcaccacuuucaccagcucaucaugaaggacggccgcgagauugucgugcccugcaggaaccaagacgagcuggucgggcgcgcccgggugagccagggcgcaggguggucccucagagagacagccugccucggcaagagcuaugcgcagauguggcagcuaauguacuuccaucggcgcgaccucaggcuggcggccaacgccaucugcucugcagugccagucgauugggugccaacaagcaggacuaccuggucgauccacgcccaucaccaguggaugaccacggaagauaugcuguccguguggaaucgggucuggaucgaggagaacccguggauggaggacaagacccaugugagcuccugggaggaaguucccuaccuagggaagcgcgaggaccaguggugcggcaguuugaucggcuugaccgcccgcgccacgugggccacgaacauccagguggcaaucaaccaggugcggaggcucaucgggaacgagaacuaccuggacuacaugacuuccaugaagcgguucaagaacgagagcgaccccgagggcgcccugugguga

SEQ ID NO: 23948 - RNA, 9879 nt, Artificial Sequence
  derived and/or modified CDS sequence (opt11) from DENV-1__EU596504__SS-prME
agcgucacaauguuguuaaugcugcuccccacagcauuagccuuucaccugacuacgcgagguggagaaccgcacaugauagucagcaaacaagaacgugggaaaucccuguuauucaaaacuuccgcgggagugaauauguguacacucaucgcaauggaucugggagaauuaugcgaagacacaaugacauacaaaugcccacaaaucaccgaagccgaacccgacgacguagacugcuggugcaaugcaacggauacgugggucaccuacggaaccugcagccaaaccggcgaacaucguagagacaaacgguccguagcguuagcuccccacgucggucuagggcuugaaacacgaacagaaaccuggaugagcuccgaaggagccuggaaacaaauccaacgcguagaaacuugggcccuacgccaccccggauuuacgguaauagcccuguuccuugcucacgcaauagggacguccaucacccagaaaggcauuaucuucauacuacugaugcuuguaaccccgucuauggcaaugcgcugcgucggcauagggaaccgugacuucgucgaagggcugaguggcgcaaccuggguagacgugguccuagaacaugguucgugcgugaccacaauggccaaaaacaagccaacuuuagacauugagcuccugaagacagaggucacaaaucccgcaauacuacgaaaguuaugcauagaggccaaaauauccaacacgaccacagacagucgaugcccaacucagggggaagcgacuuuagucgaggagcaggaugcaaauuuugugugcaggagaacauucgucgaccgaggauggggcaacgggugcggacuguucggcaaggggucacuccuaacgugcgcaaaauucaaaugcgucaccaaacucgaaggcaaaaucguacaauacgaaaaccugaaauacagcgugauugucacaguacauaccggugaucagcaucagguaggcaacgaaaccaccgaacacgguaccauagcuaccauaaccccgcaagcaccuaccucagagauacaacugacagacuacggggcacucacacuugacugcucgccuagaaccggacuagauuucaacgagaugguacuauugaccaugaaagaaaaaucauggcucguccacaagcagugguuccuagaccucccccuucccuggacguccggagcgagcacaucccaagaaacauggaacagacaagaccuccucguuacauucaaaaccgcccacgcaaagaaacaggaaguaguagucuugggcucccaggagggagcaaugcauacggcgcucaccggagcuaccgaaauccagacuucgggaaccacgacaaucuucgcaggacaucugaaaugccggcuaaagauggacaagcucacccucaagggaacaagcuacgucauguguacaggcucuuucaaauuggagaaagaaguggccgaaacucaacaugggacaguccucguccagguuaaauaugaaggaacagacgcgccaugcaagauucccuuuagcacacaagacgagaagggggugacucaaaacgggaggcuaauaacggcaaauccuauugugacagacaaagagaagcccguuaacauagagacggagccgccauucggggaaagcuacaucguaguaggagcaggagaaaaagcacucaagcucagcugguuuaagaaaggaaguuccaucgggaaaauguucgaagccacagcacgcggggcgcgacgcauggcaauccucggggacaccgcaugggauuucgguaguaucggagggguguucaccuccguuggaaagcucgugcaccagguuuuugguaccgccuacggcgugcuuuucucgggcguaucguggacaaugaagauuggaauuggcauucugcugacuuggcucggacucaacagcaggaguacaucccuuaguaugaccugcuucgccguggggauggugacucucuaccugggcgugaugguacaagcggacuccgggugcgugaucaauuggaaaggacgggagcugaagugcggaagcggaaucuucguaaccaacgaagugcacacauggacggaacaauacaaauuccaagcagauagcccgaagcgguuaagcgccgcgauaggcaaagcaugggaagaaggugucugcggcauucgaagcgcuacaaggcucgagaacauaauguggaaacaaauauccaacgagcuaaaccacaucuugcuagaaaacgacaugaaguuuaccgucguagugggcgaugccaacgggauucucgcgcaaggcaagaaaaugaucaggccgcaacccauggaacacaaauacagcuggaaaucauggggaaaagcgaaaaucauaggagcggacauccaaaacacgaccuuuauuauagacgggcccgacacaccagaaugcccggacaaucaacgagcguggaacauuugggaaguggaagacuauggcuucggcauauuuaccacaaacaucugguugaaguuacgugauagcuacacacaaaugugcgaccaucggcugaugucggccgcgauaaaagacagcaaagccguacaugcggacaugggauauuggauugagucggagaaaaaugagacauggaagcucgcuagagcuagcuuuauagaaguaaaaacguguacauggccaaaaagccacacccucugguccaacggcguucucgaguccgaaaugauaauaccgaaaaucuacggcggaccaaucagccaacacaauuaccggccgggguacuuuacgcagacagcaggaccauggcacuuaggcaaguuggaacuggacuuugaucugugcgaggggacaaccguagucguagacgagcacugcgggaaccgaggaccgucgcuaagaacaacaaccgucacuggaaagauuauacacgaguggugcugccgaagcuguaccuugccgccccucagauuucgaggagaggauggcugcugguauggaauggagauaaggcccgucaaggaaaaggaggaaaaccuggugcgauccauggugagugcgggaucaggcgaggucgauuccuucucucuaggcauccuaugcgcaagcauaaugaucgaggagguaaugcggagccgcuggaguagaaagaugcuaaugacaggaacuuuggcagucuuccuuuuacuaaucaugggacagcuaacuuggaacgaccugauaagacugugcauuauggucggagcaaacgcauccgauaggauggggauggguaccacguaccuggcccugauggcaacauucaagaugagaccgauguucgccgucggucuacuguuccgaagguugacaucacgugagguucuguugcuaaccauagggcucagccugguggcuucuguggaacuaccgaauagccuugaagaacuaggggacggacuagcaaugggaaucaugaugcuaaaacuccuaacggaguuccagccccaccaacuuuggacgacacuacuaucccucaccuucauaaagacuacacugucacuagauuacgcauggaaaacgacagccauggcccuguccaucguaagccucuucccacugugcuuaaguacaacgucacagaagacaacuugguugccuguacugcucggaucauucgggugcaaaccucucacaauguuccuaauaacggagaauaaaauauggggucgaaagagcuggccgcuaaacgagggcaucauggcgauaggcaucguaucgauacuacucaguucacuccucaagaacgauguccccuuggcaggcccccuaaucgcaggcggaaugcuaaucgcauguuacgucauaagcggauccuccgcagaccucucacuggagaaggcggcagaggucuccugggaacaggaagccgaacauuccggaacaucacauaacauauuagucgaaguacaggaugauggaacgaugaagauuaaagacgaagaacgagacgacacccuaaccauccuucuaaaggccacacuacucgccguaucuggcguauaccccaugagcauaccggcuacccuguucgucugguacuucuggcagaaaaagaaacaacgaucugguguccuaugggacaccccuagcccaccggaaguagaacgggcgguauuagacgauggaaucuaccgcauccuccaacgcggauugcucggcaggucccagguaggagucggggucuuccaggacgggguuuuccacacuauguggcacgugacccggggugcgguccuaauguaucaggguaaaagauuggaaccuucaugggcgagcguaaagaaagaucuaauaagcuacgguggaggauggcgcuuccagggcucuuggaacaccggcgaagaagugcaagugauagcagucgaaccaggaaagaaccccaagaacgugcaaaccacaccggguaccuucaaaacgcccgaaggggaggucggggcaaucgcccucgacuucaagccugggaccucuggcagucccauugugaacagagaaggaaaaauugucggccuguacgggaacggugucguaacaaccucagggaccuacgucagcgcgauugcccaggcuaaggcaucacaggaagggccacuacccgagauagaagacgaaguguuuaagaaacgaaaccuaacgauaauggaccuacaucccggaagcggcaaaacacgacgcuaccuuccagcuauaguacgagaagcgauaaagaggaaguuacgaacacuaauacuagcccccacaaggguggucgcaucagaaauggccgaggcccucaagggcaugccgauucgauaccaaacaaccgcgguuaaaagcgaacacacaggccgagaaaucguugaccuaaugugccacgccacauuuacgaugcgacuucuaagcccagugagaguaccaaacuacaacaugauuauaauggacgaagcacacuucacugaucccgcaagcaucgcagcacgugguuacaucucgaccagaguggggaugggggaggcggcagcuauuuucaugacugcaacgccacccggauccguagaagcguucccacaauccaacgcugucauacaagacgaagagagagacauaccugaaagaucguggaacucaggcuacgauuggaucacugauuuuccgggaaagaccguaugguuuguacccaguauaaaaagcgggaaugauauagccaacugccuucguaagaauggcaaaagaguaauucaauuaagccgcaaaaccuuugauaccgaauaucagaaaacaaagaacaacgacugggacuauguagugacaacggauaucucggagaugggagcaaauuuccgggcagaucgagucaucgacccuagacggugccuaaaacccguaauacucaaagacgguccggaacgcguaauucucgcaggaccuaugccggucaccguggcaucagccgcacagcggaggggccgaauuggacgaaaccaaaacaaggagggagaccaguauguauacaugggucaaccacugaacaacgaugaagaccaugcucacuggacugaagccaagaugcuacucgauaacaucaacacacccgaaggaauaauaccagcgcuguucgaaccggaacgggaaaagucggcggcaaucgauggugaguacagacugcgcggagaagcuagaaagacauucguugagcuaaugagaaggggcgauuugccgguuuggcuguccuacaagguagcaucagagggguuucaauacucagacaggcgauggugcuucgacggagagcggaacaaccagguauuggaggagaacauggacguugaaaucuggaccaaggaaggagaaaggaaaaagcugaggccccgcuggcuagacgcacgcacuuacagugauccacuggcucuccgcgaguuuaaggaguucgcggcgggcagacgaagcguguccggugaucuaauccucgagauuggcaaacucccacagcauuuaacgcuucgcgcgcaaaaugcguuagauaaccugguaauguuacacaacagcgaacaaggggguaaggccuaucgacaugcgauggaagaacucccagauacgauagagacacuuaugcuacuggcacuuaucgccguacucacaggcgguguuacccucuucuuccuaagcggaaaaggauuaggcaaaacgucgaucggccugcugugcguaaccgcaagcuccgcccugcuauggauggcgagcguagagccgcacuggauagcagcuagcauaauauuagaguuuuuccugauggucuugcuuauaccagagccugaucgccagcgaacaccccaagauaaucaacuagcguacgugguaauaggucuauuauucaugauccucaccguagccgcgaacgaaaugggccuucuugaaacuaccaagaaagaccuagggauaggccauguagcagcagagaaccaccagcacgcaacaaugcuagacgucgaucuaagaccagcuuccgcauggaccuuauaugccguggccaccaccguaauaacuccaaugaugagacacacgaucgaaaauacaaccgcuaacauaagucugaccgcuaucgccaaucaagcggcaauccugaugggucuagacaaaggauggcccauauccaaaauggacauaggcgucccacuacuggcacuuggaugcuacucccagguaaacccacuuacucugacagcagccgucuugaugcucguagcgcauuacgcaaucaucgggcccgggcuccaggccaaagccacccgcgaggcacaaaagaggacagcugccggcaucaugaaaaauccaacggucgacggcauagucgcaauugauuuggaccccgucguauacgacgccaaauucgagaagcaacuuggacagaucaugcuccuaauacugugcacgucacaaauccugcucaugcgcacgacaugggcccuuugcgaaagcaucacgcuagcgacagguccccucaccacguugugggaggguucgcccggaaaauucuggaacacuacgaucgcgguaagcauggcuaacauauucagaggcuccuaccuagcaggagccggccucgccuucagcuuaaugaaaagucucggaggagggaggcgaggcaccggcgcacagggcgagacccuaggcgagaaauggaaaagacaacuaaaccaacuaaguaagagcgaguucaacacguacaagcgcucugggauuauggaggucgaccgaucggaagcgaaagagggccuaaagaggggcgaaacgaccaaacacgccguaagccgaggcaccgcaaaacuccgaugguucgucgagcgcaacuuagugaagccagaaggcaaaguaaucgaccuuggcugcggacggggcggguggagcuacuacugugccgggcucaagaaaguaacugaggugaagggguacacaaagggcggccccggccacgaagaacccauuccgauggcgacauacggguggaaucuuguuaaacuguacagcgggaaagacguuuucuuuaugccacccgaaaagugcgacacgcuacuaugcgacauaggggaaaguagcccuaauccaacaauagaagaagggcgaacucuccgcauucuaaaaauggucgagccauggcuaagagggaaccaauucugcaucaagauacugaacccauacaugccuucagugguagaaacucuggagcagaugcaacgaaaacauggcgggauguuggucaggaacccgcuaucccggaacagcacccacgagauguauuggguaucaugcgguacggguaacauugucuccgccguaaacaugaccucacgaaugcuccuaaaucgcuuuacuauggcgcaccgaaagccgacauacgagcgggacguagaccuaggggcuggcacacgucaugucgccgucgaacccgaaguagccaaccuggauaucauuggccagagaaucgaaaacaucaaaaacgaacacaaaucgacauggcacuacgacgaggacaaucccuacaagaccugggcguaucacggguccuacgaagugaagcccuccgggagugccucauccaugguaaauggggucguacgccugcuaaccaagccaugggacgucauccccaugguaacccagaucgccaugaccgacacgacccccuucggacagcaacggguuuuuaaagaaaaaguagacacucggacaccacgagcaaaacgcggcaccacgcaaaucauggaaguaaccgcgaaauggcuauggggauuccuaucaagaaauaagaaaccgcgcaucuguacacgggaggaguucacccguaaaguacgaucaaacgcggcuaucggagccguuuucguggacgaaaaccaguggaacucagccaaagaagcgguggaagaugagagguucugggaucucguccaccgcgaacgggagcuccacaagcagggcaagugcgcaacauguguuuacaauaugaugggcaagagggagaagaaauuaggagaauuuggaaaagcgaaaggcagucgagccauaugguauauguggcuuggagcgcgauuccucgaguucgaggccuuaggguucaugaaugaggaccacugguuuucaagagaaaauucauuaucggggguggaaggugaaggacugcacaaacuaggcuacauacuucgcgacauuuccaagauccccgguggcaacauguaugccgaugacacggccggaugggacacccggaucaccgaagacgaccuccaaaacgaagccaaaauuacagauauaauggaacccgaacacgcccuacucgcgaccaguaucuucaaacuuacauaccaaaauaaggucgugcggguacaacgcccagccaagaacggaacagugauggaugucauaucacgacgcgaccagagaggcagcggucaaguaggcaccuacggccucaacacuuucaccaauauggaaguacagcuaauccgacaaauggaguccgaaggaaucuuccuaccguccgagcucgagacaccaaacuuagccgagcgaguacuugauuggcuugaaaaacauggugcugaaagacugaaacggauggccauauccggagacgauugcguggugaagccaauagacgaccguuuugcaaccgcccugacagcguugaacgacaugggcaaaguccgaaaagauaucccccaaugggagcccagcaagggauggaacgacuggcaacaaguccccuucugcucccaccauuuccaucaauugauaaugaaagauggcagagaaauagucguaccguguagaaaccaggacgagcugguaggcagagcucgcgugagccagggcgccggguggagucuacgagaaaccgcauguuuaggaaagucguacgcucagauguggcagcuaauguauuuucaucgcagagaccugcgccuggcagcuaacgccauaugcagcgcagugccaguagacugggucccgacgucccgcacaacuuggagcauacacgcccaucaccaguggaugacgacggaggacauguuaagcguauggaaccgagucuggauagaagaaaacccguggauggaggacaagacucacguaucaucaugggaagaggugccguaccuuggcaaaagggaagaccaguggugcggaucccuuaucggacuuaccgcccgagcuacgugggcaaccaacauucaaguagcuaucaaucagguccgccgcuuaauagggaaugaaaacuaucucgauuacaugacgagcaugaaacgauucaaaaacgaaucagauccggaaggcgcacuuugguag

SEQ ID NO: 23949 - RNA, 9879 nt, Artificial Sequence
  derived and/or modified CDS sequence (opt11) from DENV-1__FJ024481__SS-prME
agcguuacgauguuacucaugcugcugccaaccgcccucgcguuccaccugaccacccguggcggggagccccacaugaucgugagcaagcaagagcggggcaagagccuccuguuuaagaccagcgcuggugugaacaugugcacacugaucgccauggaccuuggugagcucugcgaggacaccaugaccuacaagugcccgcagaucacagaagccgagccagacgauguagacugcuggugcaacgccaccgacaccugggugaccuaugguaccugcucucaaaccggugaacacagaagagacaagcgcuccgucgcgcuggcaccacacguggggcuggggcucgagacgcggacggagaccuggaugagcucggagggggcauggaagcagauucagcgcgucgagaccugggccuuacgucaucccggauucacugugaucgccuuguuccuggcccacgccaucggaaccagcaucacccagaaggggauaaucuuuauccugcugaugcucgugacaccauccauggccaugcgcugugucgggaucggaaaccgugacuucguggaggggcugagcggugccacguggguggacgucgugcuggagcacgguuccugugugacgacaauggccaagaacaagcccacccucgauauugagcugcuaaagacagaggucaccaaccccgcgauucuccggaagcucugcaucgaggcaaagaucagcaacacaacaacggacucaagaugcccgacccagggcgaggccacccugguggaggagcaggacgccaauuucgugugccgccggaccuucgucgaccgcggaugggggaacggcugcgggcuauucgggaaggggagccugcugacuugcgccaaguucaagugugugaccaagcucgagggcaagaucguacaguacgagaaccugaaguacuccguaaucgugacagugcacaccggugaccagcaccaaguugggaacgagacaacugagcacggcaccaucgcuacaaucaccccccaagccccgacaagcgagauccagcuaaccgacuacggugcccucacccuggacuguagcccacgcaccggccuggacuucaaugaaaugguucuauugacgaugaaagaaaaguccuggcugguccacaagcagugguuccucgaccugccucugccauggacuagcggggcaagcacaagccaggagaccuggaaucgccaagaccuacuggugacguucaagaccgcccacgcgaagaagcaggaagugguagucuuggggucccaagaaggcgcgaugcacaccgcacucaccggggcaacggagauccagaccagcgggaccaccaccaucuucgcaggucauuuaaagugucggcugaagauggacaagcucacgcugaaagguaccaguuacgugaugugcaccgggagcuuuaagcuggagaaggaagucgcggagacgcagcacggcaccgugcuggugcaggucaaguacgaaggaacugacgcccccuguaagauccccuuuuccacacaggacgagaaaggggugacgcagaacggccgccucaucaccgccaacccgaucgucaccgacaaggagaagcccguaaacaucgagacggagccgccguucggggagagcuacaucguggugggggccggcgaaaaagcgcuuaagcugaguugguuuaagaagggaagcucuaucggcaagauguucgaagcaaccgcccgcggggcucgucggauggccauacucggcgacaccgcgugggacuucgggagcaucggcggggucuucaccuccguggguaagcuggugcaucagguuuucggaaccgccuauggggugcuguucagcggggugucguggacgaugaaaaucggcaucggcauucuacugaccuggcugggucuuaacagccgcuccaccucccucuccaugaccugcaucgcgguuggcauggucacgcucuaccucggcgugaugguccaagcggacagcgggugcguuaucaacuggaagggccgagagcugaaauguggguccggcaucuucguaaccaacgaaguucacaccuggaccgagcaguacaaguuccaggccgauagcccaaaacggcugagcgcggcaaucggaaaggccugggaggaaggggugugcggcauccgcucggcuacgaggcucgagaacaucauguggaaacaaaucagcaacgagcugaaccacauacugcucgagaacgacaugaaauucacgguaguggugggagaugccaacggcauccuggcucaggggaagaaaaugauccgcccccagccaauggagcacaaauacuccuggaagaguugggguaaggccaaaaucaucggggcggauauccaaaacaccaccuucaucauugacgggccagacaccccggaguguccugacaaccaacgggccuggaauaucugggaaguggaggacuacggcuucgggaucuucacgaccaauaucuggcugaaacucagagacucauacacccaaaugugcgaucaccggcugaugagcgcggcuaucaaggacucgaaggccguccacgccgacaugggcuacuggaucgagagcgagaagaacgagaccuggaagcuggcccgcgcguccuuuauagaggugaaaacgugcaccuggccaaagucucacacccucugguccaacggcgugcuugagagcgagaugaucauccccaagaucuacggcgguccgaucucgcagcacaacuacagaccgggguacuucacccagacggccggaccauggcauuuggggaaacucgaguuagacuuugaucugugugagggcaccaccgucgugguggacgagcacugcggaaaccgagguccgagucuacggacgaccaccgucaccggcaagaucauucacgagugguguugccgauccugcaccuugccgccucuccgguuccgcggugaggacggcugcugguaugggauggagaucagacccguaaaagagaaggaggagaaccucguucgcagcauggucuccgccggcagcggcgagguggacagcuucagucugggcauacuaugcgccagcaucaugauagaggaggugaugcggagccgcuggagccggaaaaugcucaugacgggcacacuggccguauuuuugcuccucaucauggggcagcugacguggaaugacuugauccgccucugcaucauggucggcgcgaacgccucggacagaauggggaugggcaccacguaccuggcccucauggccacuuucaaaaugcggccgauguuugccguugggcuacuguuccgccggcugaccagccgcgagguccugcugcucaccaucggacugucccuuguggcgucuguggagcuacccaacucgcucgaggaguugggcgacggguuagcaauggggauuaugaugcugaaguuguugacggaguuccagccccaucagcuguggaccacccugcugagccugaccuucaucaagacgaccuuaucccucgacuacgccuggaagacaacagccauggcucuaagcaucguuucacuguuuccccucugccuuucaacgacgucccagaaaaccacguggcugccggugcuccugggcucuuuugggugcaagccucugaccauguuccucaucacugagaacaaaaucugggggcggaagagcuggccccugaacgagggcaucauggccauaggcauugucucuauucugcucuccagccuacugaagaacgacgucccccucgccgggccacuuaucgccggaggcaugcucaucgccugcuacgugauuucaggguccagcgcagaccucucacuagagaaggccgccgaggucagcugggaacaggaagccgagcacuccggcacgagccauaauauccugguggagguucaggacgacgggaccaugaagauaaaggacgaggaacgagacgacaccuugacgauacuguuaaaggcuacacuccuggcugucucgggcguguacccaaugucgauccccgccacccuguucgugugguacuucuggcagaagaagaagcagcgguccggaguacucugggacacccccagcccgccagagguggaacgcgcuguccuggacgacggcaucuaccggauccuccaacgcggccugcuagggcggucccaggugggugucgguguguuccaggauggaguguuccauacgauguggcacgugacaagaggggccguacugauguaucaggggaagcggcuggagcccagcugggcauccguaaagaaggaccucaucucuuacggagggggcuggcgcuuccaagggucauggaacaccggugaggagguccaggugaucgcgguggaacccggcaagaacccgaagaacgugcagaccacgccgggcaccuuuaagacccccgagggcgaggugggggcaaucgcccuagacuucaagcccgggaccucgggguccccuaucguuaaccgggaggggaagaucgugggccucuacgggaacggugugguuacgaccaguggcaccuacguguccgccauagcccaagccaaggcaucucaggagggcccccuucccgagaucgaggacgagguuuuuaagaaacgcaaccugaccauuauggaucuacauccggggagcggcaaaacacggcgcuaucuacccgcgaucguccgagaggccauaaagcgcaagcuccggacacugauccuugcccccacccgcguaguggcguccgagauggccgaggccuuaaagggcaugcccauucgcuaccagacaacggccgucaaaagcgagcauaccgggagggaaauaguagaccugaugugccacgcaacauucaccaugaggcucuuauccccaguccggguuccuaauuacaacaugaucaucauggacgaggcccauuucacggacccugccaguaucgccgcucggggcuacaucagcacccgcguggggaugggcgaggcggcugccauauucaugacagcgacaccgccugggagcguggaggcauuuccccaaaguaaugcggucauccaggaugaggagcgcgauaucccagagagaucuuggaauuccggauaugacuggaucacggacuuccccggaaagaccgucugguucgucccgagcaucaaguccggaaaugacaucgccaauugccugagaaaaaacggcaaacgggucauucaacuaagccgcaagaccuucgacaccgaauaccagaagacaaagaauaacgacugggacuacguggucaccacggacaucuccgagaugggggccaacuuccgggccgaucgcgucaucgacccccggaggugccucaaacccgucauccuaaaggauggcccugagcgggucauacucgcggggccgaugcccgucaccguggcaagcgccgcccagcgccggggccgaaucggccggaaccagaacaaggaaggggaccaguacguguauaugggccagccucugaauaacgacgaggaccacgcgcacuggacggaggcgaagaugcugcuagacaauauuaauacucccgaggggaucaucccggcgcuauucgaaccggagcgcgaaaaguccgccgccaucgacggggaauaucgucuacgcggggaggcgcgaaagacguucgucgagcugaugcggcgcggggaccugcccguguggcugucauacaaggucgcguccgaggguuuucaguauagcgacaggcguuggugcuucgacggggagcggaauaaucaggugcucgaggagaacauggacguggagaucuggacgaaagagggcgagcgcaagaaguuacggccgagguggcuggaugcgcggacguacucagacccguuggcacugcgggaguucaaagaguucgccgccgguagacgcucagugagcggcgaccugauccuugagaucggcaagcugccccaacaccuaacccuucgggcccagaaugcccuagacaaccuggugaugcuccacaacuccgagcagggcgguaaagccuacaggcacgccauggaggagcugcccgacacuaucgaaacccuaaugcuuuuggcgcuaaucgccguguuaacgggaggcguaacgcuguucuuuuuaagcggaaagggucucggaaagaccaguaucggucugcugugcguaaccgcaagcucggcccuauuguggauggccagcguagagccccacuggaucgcggccagcaucauuuuagaauucuuccuaauggugcuucugaucccggaaccagaccgccagcgcaccccccaagacaaccagcucgccuacguagugauaggccuguuguucaugauccucacggucgcagccaacgagaugggucuacuagagaccaccaagaaggaccucggcaucgggcacguagccgcugagaaccaccagcacgccacaaugcucgauguggacuuaaggccagcuagcgcuuggacgcucuaugcagucgccaccacagugaucacaccuaugaugcgccacacgaucgagaauaccaccgccaacaucucccugaccgccaucgccaaucaggcugccauccugaugggccucgacaaggguuggcccaucagcaagauggacauugguguaccccugcuggcccuggguugcuauucccagguuaauccgcugacgcugaccgccgcgguacucaugcugguggcccacuacgccaucauaggucccggauuacaggccaaagccacccgggaggcccagaagaggaccgccgccggaauaaugaagaaucccacuguugacgggauuguggccauagaucuugaccccguggucuaugacgccaaauuugagaaacaguuaggccagaucauguugcugauccugugcaccagccagauacugcucaugcguaccacgugggcgcuaugcgagagcaucacgcuggccaccgggccgcucaccacucugugggaaggaagcccugggaaauucuggaacaccaccaucgccguguccauggccaacauauuccgaggaagcuaccuggcuggcgcggggcucgccuucucccugaugaagucguuaggcgggggccgccggggaaccggcgcccagggcgagacccugggggaaaaguggaagcgccagcugaaucagcuguccaagagcgaauucaacacguacaagcgcagcggcaucauggagguggaccgguccgaggccaaggagggacuuaagcggggcgagaccaccaagcacgccgucagcagagggaccgccaagcugcggugguucguggagcgcaaccuagugaagccagagggcaaggucaucgaucugggaugcgggcguggcggguggagcuacuauugcgccggucucaaaaaggugacggaggugaagggguauacgaagggcggccccggccacgaggagccgauccccauggccacuuacggcuggaaccuugucaagcuguacaguggaaaggacguguucuucaugccgccugagaaaugugacacccuccugugcgacaucggagagucaagcccgaaccccacuaucgaggagggacggacgcucagaauccucaagaugguggaaccuugguugcgcggcaaccaguucugcaucaagauccugaauccauauaugccuuccgucguggagacccucgagcagaugcagagaaagcauggcggaauguuagugcgcaacccccuaagccguaacuccacccacgaaauguauugggucucaugcggcaccggcaacauuguuuccgccgugaacaugaccagccguauguugcuaaaccgguucaccauggcgcaucguaagccaaccuacgagcgugacgucgaccucggcgccggaacccggcacguggccguggagcccgaagucgccaaccucgacaucauugggcagcgaaucgagaacaucaagaacgaacacaaguccacguggcacuacgacgaagauaacccauauaagaccugggccuaccacggcagcuacgaggugaaaccguccgggucugcgucgagcauggugaacggggucgugcggcugcugaccaaacccugggacgugauucccauggugacccaaaucgccaugaccgauaccacaccguuugggcagcagcgcguguucaaggagaaggucgacacccggacgccaagagccaagcguggaacgacucagaucauggaggucacggccaagugguuguggggcuuccugagccgcaacaagaagccccggaucugcacgcgugaagaguuuacgcggaagguccgcagcaacgccgcgauaggggcgguuuucguggaugagaaccaguggaauuccgccaaggaggccguggaggacgaacgguucugggaccugguucaucgcgagcgcgaacuccacaagcagggcaagugugcgacuugcguguacaacaugauggggaagcgcgagaagaagcugggcgaguucgggaaggcaaagggcucccgcgccaucugguacauguggcugggcgccagauuccucgaauucgaagcacuaggguucaugaacgaggaccacugguucagccgggagaacagucugagcggaguggagggggagggccuccacaagcugggguacauacucagggacaucuccaaaaucccgggcggcaauauguacgccgacgacaccgccgggugggauacgcggauuaccgaagacgaccuacagaacgaggcuaagauaaccgauaucauggagccggagcaugcccuauuagcuacuucgauauucaagcucacuuaucaaaacaagguggugcgcgugcagcgccccgcaaagaacgguaccgucauggaugugaucucccggcgcgaccaacgggggagcggccaagugggcaccuacgggcugaacacguucacgaauauggagguacaguuaauccgacagauggaauccgaggggaucuuccuccccagcgaacuugagacccccaaccuggccgagcgcgugcucgacuggcuggagaagcauggcgcagagagauuaaagcggauggccauauccggcgacgacugcguggucaagcccaucgacgaccgcuucgcgaccgcgcucaccgcucugaacgacaugggcaaggugcggaaggacauaccccaaugggagcccucuaagggcuggaacgauuggcagcaaguaccguucugcagucaucacuuccaccaacugauaaugaaggauggccgcgaaaucgucgugcccugucggaaucaggacgagcuuguggggcgagcccgggucucacagggcgccggguggucccugcgcgagaccgcaugccugggcaaaagcuaugcacaaauguggcaguuaauguacuuccaccgacgcgaccugaggcuggcugcgaacgccauuuguucugcggugcccguggacugggucccgaccucucgaaccacauggagcauccacgcucaccaccaguggaugaccacggaagacauguuguccguguggaaccggguguggauugaggaaaacccguggauggaggacaagacccacgugagcuccugggaggaggugccauaucuggggaagcgcgaagaccaguggugcggcagccugaucggacucaccgcaagggccaccugggccacaaacauucagguggcgauuaaucagguccggcgccugaucgguaacgagaacuaccuggacuacaugacauccaugaagcgcuucaagaacgagucagaccccgagggcgcccucugguga

SEQ ID NO: 23950 - RNA, 9879 nt, Artificial Sequence
  derived and/or modified CDS sequence (opt11) from DENV-1__GQ199872__SS-prME
agcguaaccaugcuguugaugcugcuacccacagcgcucgccuuccaccugacaacccggggcggggagccccacaugaucgugagcaagcaggaacggggcaagucucucuuauucaagaccucggcugggguuaacaugugcacccuaaucgccauggaccuuggcgaacuaugcgaggacacuaugaccuacaagugcccccaaaucaccgaggccgaacccgacgacguugauugcugguguaacgcaacagacaccuggguaaccuacggcaccuguagccagaccggggagcauagacgggacaagcgcucaguugcccuggcgccccauguuggucucgggcucgaaacccggaccgagacauggaugagcuccgagggcgccuggaagcagauucagcgggucgagaccugggcccuucgacaccccggauucacggugauugcccuauuccucgcgcacgcaaucgguaccagcaucacccaaaaggggauuaucuucauccuacugauguugguuaccccuucgauggccaugcgcugugugggcaucgggaaccgugacuucguggagggccuuagcggcgcgacguggguggacgucguucucgagcacgggucgugcgucacgacgauggcaaagaacaagcccacccucgacauugagcuguuaaagacggaaguuacaaacccugcgaucuuacguaagcugugcauagaagccaagaucucuaacaccaccacggacucccggugcccgacccagggcgaggccacccugguggaggaacaagacgccaacuucgugugccgccgaaccuuuguagaccgcggguggggcaacggcugcggccucuucggcaaggggagccugcugacgugcgcgaaauucaagugcgucacuaagcuagaaggcaaaaucgugcaguacgagaaucuaaaguauuccgucaucgugaccguccacaccggcgaccaacaccaggucgggaaugagacgaccgagcacgggaccauagcgaccaucaccccccaggcccccacgucugagauccaguuaaccgacuacggugcccucacccuggacuguagcccccgaacaggccuggacuucaaugagaugguucugcugaccaugaaggagaagucuuggcugguccauaagcaaugguuucucgaccugccgcuuccuuggaccucaggggccucaacaagccaggagaccuggaaccgccaggacuugcuggugaccuucaagaccgcucacgccaagaagcaggagguggugguguuaggcucccaggagggcgccaugcacaccgcucuaaccggugccacagagauacagaccagcgggacaaccacgaucuuugccgggcaccugaaguguagguugaagauggacaagcucacccucaaggggaccucuuacgugauguguaccgguagcuuuaagcuggaaaaagagguagcggaaacgcagcacggcacugugcuggugcaggucaaguacgagggaaccgacgcccccugcaagaucccguucuccacccaagacgagaaaggggugacgcagaacggccgccucaucaccgcuaacccaaucguaaccgacaaggaaaagcccgucaacauagagacagagccgcccuucggggagucguauaucguagugggcgccggcgagaaagcgcuuaagcucuccugguucaaaaaggggagcuccauuggcaagauguucgaggccacggccagaggggcgcgccggauggccaucuuaggagacaccgcgugggacuucggaagcauuggcggcguauucacuuccguggggaagcugguucaccaaguauucggcacugcuuacggaguucuguucagcggcguguccuggacaaugaagaucgggaucgggauccuccugaccuggcugggccugaacaguagaaguaccagccuuuccaugaccugcaucgcagucgggauggucacgcuguaucuuggcgugaugguccaggccgacagcggaugcgugauaaacuggaaaggucgggaacugaagugcgggagcggcaucuucguaacaaacgagguccacaccuggaccgagcaguacaaguuccaggccgacagcccgaagagacugagcgcagcgaucggcaaggccugggaagagggggugugcggcaucaggucagccacccgacucgagaacauaauguggaagcagauuucuaacgagcugaaccacauccugcucgaaaacgauaugaaguucacaguaguagugggcgaugccaauggcauccuggcucaggggaagaaaaugauccgcccgcagcccauggagcacaaguacuccuggaaguccuggggaaaggccaaaaucaucggcgccgacauccaaaacaccaccuucaucaucgacgggccggacaccccggagugccccgauaaccagagggcauggaacauaugggagguggaagauuacggcuuuggcaucuucacaacaaacaucugguugaaauugcgugacucauacacccagaugugugaccaccgccucaugucugcggcaaucaaggauucgaaggccguccaugccgacaugggcuacuggaucgagagcgagaagaacgaaaccuggaagcuggcccgcgcguccuucaucgaggugaagacgugcaccuggcccaagagccacacccucuggaguaacggagugcucgaaucugaaaugauaaucccuaagauauaugggggcccgaucucacaacacaacuaccggcccgguuacuucacccagaccgccggcccguggcaccuggggaagcucgagcuggacuucgaccugugcgagggcaccacaguugugguggacgagcacugcggcaaccgcgggccgagccuccggaccacgaccguaacaggaaagaucauacaugaguggugcugccgauccugcacccuuccgccccugcgguucagaggggaggauggaugcugguacgggauggaaauacggccagucaaggaaaaagaggagaaccuagugcgcagcauggucuccgccggcagcggugagguggacagcuucucccuaggaauccugugcgcaucaauaaugaucgaggaggucaugagaucccgcuggagccggaagaugcuuaugacggguacccuggcggucuuccugcuccuuaucauggggcagcuuaccuggaacgaccucauacgcuuguguaucaugguuggcgcgaaugccuccgaucgcauggguaugggcaccacguaccuagcccucauggcuacauuuaaaaugcggccuauguucgcagugggccugcuuuuccgccggcucaccagcagagagguccugcugcucaccaucgggcugucccucguggcuagcguggaguugccgaacucccuggaagaacugggcgacggguuagccaugggcauaaugaugcuuaaacuguuaacggaguuucagccccaccagcuguggacuacccuguuaagccuaaccuucaucaagacaacccugucccucgacuaugccuggaagaccacggccauggcacuuucuaucgucucccuguuccccuuaugccuuagcacaacaucacagaagacaaccuggcugccggugcuucugggcagcuucgggugcaagccccuuaccauguuucucaucacagagaacaagaucuggggccggaaguccuggccccugaacgaagguauaauggccauaggcauagugagcauccuucucuccagccuguugaagaacgacguuccgcucgcuggaccgcugaucgccggcgggauguuaaucgcaugcuaugugaucagcgggucuucugcggaccucucccuugagaaggccgccgaggucuccugggagcaggaggccgagcauuccggcacgagccacaacauccugguugaggugcaggacgacggaaccaugaagaucaaggacgaggagagagacgauacacuaacgauccugcugaaggcaacccucuuagcggucuccggcguguaccccaugagcauccccgccacacuguuugugugguacuuuuggcagaagaaaaagcagcgguccgggguccucugggacacccccagcccgcccgagguggaacgcgccgugcuggacgaugggaucuaucggauacugcagcgcggcuugcuagggcggucucaggucggcguaggcguguuucaggacggcguguuucacacaauguggcacgugacccgcggggccguucugauguaccagggcaagcggcuggaaccgagcugggccuccgugaagaaggaucuaaucagcuacgggggggguuggcgcuuccagggguccuggaacaccggcgaagagguacaggugaucgcggucgagcccgggaagaauccgaagaacguacagacgacccccgguaccuuuaagacccccgagggggaagugggggcgauugcacuggauuucaagcccgggaccagcggguccccgauaguuaaccgggaggguaaaaucguaggccuguacgguaacggcgugguaacuaccagcgggacauauguauccgccaucgcgcaggcgaaggccagucaggaaggcccauugccugagaucgaagacgaagucuucaagaagcgcaaccuaacuaucauggaucugcacccagguagcggcaagacgcgucgcuaucuccccgccaucguacgggaggccaucaagcgcaagcuucgaacccuuauacucgcacccacccgcgugguggccuccgaaauggccgaagcccugaagggcaugcccauacgcuaccaaaccacagcaguaaagagcgaacacaccgggcgggagaucguggauuugaugugccacgcuacuuuuaccaugcgccuccuguccccagugcggguccccaacuacaauaugaucaucauggaugaggcacacuucacagacccugcgucuauugcagcccgcggcuacaucucgaccagaguggggaugggcgaggcagccgccauuuuuaugacugcaaccccccccggguccguggaggccuucccucaaucaaacgcggucauacaggacgaggaacgcgacauaccagagcggucauggaacaguggcuacgacuggaucacggacuuccccggcaagacagucugguucguccccucuauaaaguccgggaaugacaucgccaacugccugcggaagaacgguaagcggguuauccagcuaucacgaaagaccuucgacaccgaguaccagaagacgaagaacaacgacugggacuacguagugaccaccgacaucuccgagaugggagcgaauuuccgggccgaccgggucauugacccccggcgcugccucaagcccgugauccuaaaggacggcccggagcgggucaucuuagcgggaccgaugccagucaccguugcuagcgccgcccagcgccggggccgcaucggccggaaucagaacaaggaaggcgaccaguauguguacauggggcagccacuaaacaacgaugaggaccacgcccacuggacggaggcgaaaaugcugcuggacaacaucaauacccccgaggggaucaucccggcucuauucgaaccagagcgcgaaaaguccgcagcgaucgauggcgaauaucgacugcgcggcgaggcccgcaagaccuucgucgagcucaugcgccgcggcgaccugccuguguggcugucguacaaggucgcaucggagggcuuccaguacagugaccggagguggugcuucgacggugagcgcaacaaucaaguccuugaggagaacauggacguggagaucuggaccaaggagggcgagcggaagaagcuacguccccguuggcucgacgcacggaccuacuccgacccguuagcccugcgcgaguucaaggaguucgcugccgggcgccgcagcguuucgggcgaccugauccucgagaucggcaagcugccacagcaccugacacugcgggcgcagaacgccuuggacaaccuggugaugcuccauaacuccgagcagggcgggaaggcauaucgacacgccauggaggagcugccugacacgaucgagacccuuaugcugcuggcgcugaucgccgugcucacagggggagugacgcuguuuuucuuaagcgggaagggucucggcaagaccaguaucgggcugcugugcgugacagcgagcuccgcgcuccuguggauggccagcguugagccccauuggauugcggccucgaucauccuggaauucuuccucaugguucugcugauuccggagcccgaccggcagcgcacgccccaggacaaucagcuugccuacguaguuaucggccugcuauucaugaucuugacgguggcggccaacgagauggggcugcuggagacaaccaagaaggaccucggaauugggcauguugcggccgagaaccaccagcacgccaccaugcucgacgucgaccugcgaccugccagugccuggacgcucuacgcgguggccaccacggucaucaccccaaugaugcgccacacgaucgaaaacacaaccgcuaacaucucccugaccgcgaucgccaaccaggccgccauucuuaugggccucgacaagggcuggcccauaucaaaaauggacauaggcgucccucuacuggccuuaggauguuauucccaggucaauccucugacucugacugccgcggugcucaugcugguagcgcauuacgccaucauugggcccggccugcaagccaaagccacccgggaggcacagaaaaggaccgcagccgguauuaugaagaacccuacuguugacggcaucguugcuaucgaucucgaccccguggucuaugaugccaaguucgagaaacaguugggccagaucaugcuccucauccugugcacuucgcaaaucuugcucaugcgcaccacuugggcgcugugugaauccaucacgcuggccaccgggccguuaaccacacugugggagggcucgcccgggaaguucuggaacacaaccaucgcaguguccauggccaauaucuuucguggcaguuaccuggcgggcgcagggcucgccuuuucccugaugaagucccugggcggcggucgcagggggaccggcgcacagggcgaaacccucggggagaaguggaagcgccagcugaaucagcuguccaaaucagaguucaacacguacaagcgaaguggcaucauggagguggaccgcuccgaggccaaggaaggguugaagcggggcgaaaccacaaaacacgcgguaucccggggcaccgccaagcugcggugguucguggagcgcaaccuggugaagcccgagggcaagguuaucgacuuaggcugcggucggggcgggugguccuacuauugugcgggccucaagaaggugaccgagguuaagggguacacuaagggcggucccgggcacgaggagccgaucccuauggccaccuacggguggaaucuagugaaguuacacagcggcaaagacguuuucuucaugccgcccgagaagugugacacacuccugugcgauaucggcgaguccagccccaaucccacgaucgaggaggggcggacgcuucgggugcucaagaugguugagccuuggcuacgggggaaccaauucugcaucaaaauccucaaucccuauaugccgaguguuguggagacccucgagcagaugcaacggaagcauggcgggaugcugguacgcaacccccugagcagaaacagcacccaugagauguacugggugucgugcggaaccgggaacaucgugucagcugucaacaugacgagccggaugcugcugaaccgguucaccauggcgcaucgcaagcccacuuacgagcgagacguggaccugggcgccggcacucggcauguggccguagaacccgagguggcgaaccuugacaucaucggucagcgcauugaaaacaucaaaaacgagcacaagaguacuuggcacuacgacgaagacaacccguacaagaccugggccuaucacgggagcuacgaggugaagcccuccgguagcgccagcuccauggucaacggugugguacggcuccuuaccaagccaugggacguaauucccauggucacacaaauagccaugacggacaccaccccguuugggcagcagagggucuucaaggagaagguggacacccggacgccccgcgcgaaacggggcaccacccagaucauggagguaacugccaaauggcucuggggcuuccugucccggaacaagaagccgcggauaugcacgcgcgaggaguuuacccgcaaaguccgcagcaacgcagcgaucggugccguauuuguggacgagaaccaguggaacagcgccaaagaagccgucgaggacgaaagguuuugggacuuagugcaccgcgagcgggaguuacacaagcaagggaagugcgcgaccugcguuuauaacaugaugggaaagcgcgagaagaagcugggcgaguucgggaaggccaagggcucccgggccauuugguauauguggcucggugcucgcuuccuugaguucgaggcccugggguucaugaacgaggaucacugguucagccgggagaauucccugucaggcgucgaaggggaggggcuccacaagcugggguacauccugcgcgauaucaguaagauaccuggggggaacauguaugcggacgacaccgccgggugggauacgcggaucaccgaggacgacuuacaaaaugaggccaagauaacagacauuauggagcccgagcacgcccuacuggcuaccucaaucuuuaagcucacguaucagaacaagguggugcgcguccagcgcccugcuaagaacgggaccgugauggacgugaucucccggcgcgaccagagaggauccggccaaguaggcacauauggccugaacacguuuacgaauauggagguccagcuuauccgccaaauggagucagagggcaucuuccuccccagcgaacuggagaccccaaaccuagcugagcggguccucgacuggcuagagaagcacggcgccgagcggcugaagaggauggccauauccggcgacgacugugucgugaagccgaucgaugaucguuucgccaccgcgcucacagccuugaacgacauggggaaagugcggaaggacaucccacagugggaacccagcaaggguuggaacgacuggcaacaggucccguuuugcucccaucacuuucaccagcugaucaugaaggacgggcgcgaaaucguuguucccugccggaaccaggacgagcuaguagggagagccagagugagccaaggcgccggauggucccuacgcgagaccgcgugccugggcaagagcuacgcgcagauguggcagcucauguacuuccaccggcgcgaucugcgauuggccgccaacgccaucugcuccgcggugcccgucgauuggguaccaacgucgcgcaccacguggagcauccaugcacaccaccaauggaugaccacggaggacaugcucuccguuuggaaccgggucuggaucgaagagaacccguggauggaggacaagacccacgugaguuccugggaggaggugccuuaccuggggaagcgagaggaccaguggugcggcucuuuaaucgggcuaaccgcgcgcgcaacuugggccacuaacauucaagucgcgaucaaccaggugcggcgucugaucgggaacgagaacuaccuggaccacaugaccucuaugaagcgguucaagaacgagagcgaccccgagggugccuugugguga

SEQ ID NO: 23951 - RNA, 9879 nt, Artificial Sequence
  derived and/or modified CDS sequence (opt11) from DENV-1__FJ410290__SS-prME
agcgugacuaugcugcucaugcugcugcccaccgcccucgccuuccaccugaccacccgagggggugaaccccacaugaucguguccaagcaggaacggggcaagagccuacuauucaagaccuccgccggggugaacaugugcaccuugaucgccauggaccugggggaguugugcgaggacaccaugaccuacaagugcccccagaucaccgaggcagaacccgacgauguggacugcuggugcaacgcgaccgauacaugggucaccuacggcacuugcagccagaccggggaacaccggcgggagaagcgguccguggccuuagcgccccacgugggucuggggcucgagacgcgcaccgagaccuggaugagcuccgagggcgccuggaagcagauccagcgcguagagacgugggcucugcggcaccccggguuuacggugauagcccuguuccucgcccacgccaucggcaccagcauuacccagaaggguaucaucuucauccuguugaugcuugugacccccagcauggccaugaggugcgucggaauagggaaucgggacuucguggagggacugucgggcgccacguggguggaugucguucuggaacacgguaguugcgugaccaccauggccaagaacaaaccaacccucgacaucgagcugcugaaaacugagguuacuagcccagcgauccuccgcaagcugugcaucgaagccaagaucuccaacaccaccacggacucgcggugcccaacccagggagaggcaaccuugguggaggagcaggacgccaacuucgugugcagaaggaccuuuguggaccgcggaugggggaacggcugcggacucuucggcaaagggagccuccugacgugcgccaaguucaagugcgugacaaaacucgagggcaagauugugcaguacgagaaccuuaaguauagcgucauugugaccgugcacaccggagaccagcaccaggucgggaacgagacgaccgagcacgggaccaucgcuaccaucacgccccaggcccccacguccgagauacagcugaccgacuauggggcccucacacuggacugcagcccgcgcacaggccuggacuucaacgagaugguguuacugacaaugaaggagaagaguuggcuaguccacaagcagugguuuuuggaccugccguuacccuggaccagcggggccaguaccucccaggagaccuggaaccggcaggaccucuuagugacguucaagacugcccaugcgaaaaagcaggaaguggugguauuaggcucucaggagggcgccaugcacaccgcacucaccggcgccacugagauacagaccuccgggaccaccacgaucuucgccgggcaccuaaagugccgccugaagauggacaagcucacccugaagggcacuagcuacguaauguguacgggguccuucaagcuggagaaggagguugcggaaacgcagcacgguaccgugcuggugcaagucaaauacgagggcaccgacgcgcccuguaaaauccccuuuagcacccaggaugaaaagggggugacucagaacggccgcuugauuacggccaacccaauagugaccgacaaagagaagcccgucaacauugagaccgaaccacccuucggggaaaguuacaucguggucggggccggcgagaaggcgcugaagcucucgugguucaaaaaggguuccagcauuggcaagauguucgaagccacggcgcgcggggcgcgccgaauggcgauccucggugacaccgccugggacuuugguuccaucggcggcgucuucacaucuguggggaaguuagugcaccaggucuucggaaccgccuacggggugcuguucuccggcgugagcuggacgaugaagauagggaucggcauccuccugacuuggcugggccucaacucgcgcuccaccucccugucgaugacaugcaucgccgucgggauggucacccuguaccucggcgugaugguccaggcugacucugggugcgugaucaacuggaaaggccgcgagcugaagugcggcagcggcaucuucgugacuaacgagguccacaccuggacagaacaguacaaauuccaggccgauagcccgaagagacugucagcggccaucggcaaggccugggaggaggggguaugugggaucagaagcgccacccggcucgagaacaucauguggaagcagaucuccaacgagcugaaccacauacugcucgagaacgacaugaaguucacuguggucgugggggacgccaacggaaucuuagcgcaagggaagaaaaugauucgcccccagcccauggaacacaaauacagcuggaaguccuggggcaaggccaagauaauuggcgcugacauccagaacacaaccuuuaucaucgacggaccagacaccccggaaugccccgacaaucagcgggcuuggaacauuugggagguagaggauuacggcuucgggaucuucacgaccaacauuuggcugaagcuccgcgacagcuacacccagaugugcgaccaccgguuaauguccgcggccauuaaggacucuaaagcuguccacgccgauaugggcuauuggaucgagucugagaagaacgagaccuggaagcuggcccgcgccuccuuuaucgaggugaagacgugcaccuggcccaaaucccacacacucuggucgaacggcgugcuggagucagagaugaucauucccaaaauauacgggggcccgauaagccagcacaauuaccggcccggguacuuuacccagaccgccggccccuggcaccuggggaaacuagaauuggacuuugaccuuugcgagggcaccaccgucgugguggacgagcacugcggcaaccgcgggccaucucucagaaccacgaccgucaccggcaaaaucauccacgaguggugcugucgcagcugcacccugccgccacugcgguuucgcggcgaggacggcugcugguacgggauggagauccggcccgugaaggagaaagaggagaaccucgugagguccauggucagcgccggcagcggcgagguggacuccuuuucccugggcauccugugcguaagcaucaugauagaggaggucaugcggagccgcuggucgcggaaaaugcucaugaccggcaccuuaguaguguuccugcuccugaucauggggcaacugaccuggaaggaccucaucagacuuugcaucauggucggcgccaaugccagcgaccgaauggggaugggcaccacguaccuggcacugauggccaccuucaagaugcggccgauguucgccguuggccuccuguuccgucguuugaccucucgcgagguucugcuguugaccaucggccugagccuggucgccuccguggagcucccgaacagccuggaggagcugggcgacgggcucgccaugggcauuaugaugcuaaagcugcucacagaguuccagccccaccagcuguggaccacccugcucagccugaccuucauuaagacgacgcugagccucgacuacgcuuggaagaccacggccauggcccucucaauagucagccuguucccccucugucuguccacaaccucucagaaaaccacuuggcugccaguguuauuaggcucuuucggaugcaaaccccugacgauguuccucaucacggaaaauaaaaucuggggacgcaagagcuggccccugaacgagggcaucauggccauagggauuguguccauccugcucagcucgcugcugaagaacgacgucccccucgcggggccucugauugccggcgggaugcugaucgcaugcuacgugaucuccgggagcucugccgaccucagccucgaaaaggccgcugaggugucuugggagcaggaggcggagcacuccggcaccucccacaacaucuuagucgaagugcaggacgacgggacuaugaagaucaaagacgaggagagggacgacacccucacgauccuguuaaaagccacgcuccuugccgugagcggcguguaccccauguccaucccggccaccuuauucgugugguacuucuggcagaagaagaagcagcggagcggaguacucugggauaccccuuccccgcccgaggucgagcgcgcgguucuggaugauggcaucuaccggauacugcagcgcggccugcucggccgcagucaggugggcgucgggguguuccaggacggcguguuccacacaauguggcacgucacucgcggggccguucugauguaccaggguaagcggcuggagccauccugggccagugugaaaaaggaccucaucuccuacggcgggggcuggcgcuuucagggguccuggaacaccggcgaggagguacagguuaucgccguggagccagggaagaauccgaaaaacgugcaaaccacgccuggcaccuuuaagacccccgagggggagguaggggcuaucgcgcuggauuuuaagcccggcaccuccgggagcccgaucguaaaucgggagggcaagaucguaggacuguacgggaacggcguggugaccaccuccgggaccuacgucagcgccauagcccaggccaaggccagccaagagggcccccucccugagauagaggacgagguguuuaagaagcgcaaccugaccauaauggaucuccacccgggguccggcaaaacgcggcgcuacuuacccgcgauagugcgggaggcaaucaagcgcaagcugcggacacugauccucgcccccacuagagucguggccagcgagauggcagaggcacugaaaggaaugcccauccgcuaccaaacgacggccgugaaauccgagcacacggggcgggagaucgucgaccucaugugccacgccacauucaccaugcgccuccucagcccggugcggguacccaauuacaacaugaucauaauggacgaggcccacuucacggacccugccucgaucgccgcacguggguacaucaguacccggguggguaugggcgaggcggccgcgauauucaugaccgccacgccgcccgggagcguggaggccuucccccagucuaacgccguuauccaagaugaggagcgcgacauucccgagcgcuccuggaacucuggcuacgacuggaucacggacuucccuggcaagacggucugguucgugccaagcaucaaguccgguaacgauauugcaaacugccuucgcaagaacgguaaacgaguuauccagcucucucgcaagaccuucgacaccgaguaccagaaaacgaagaacaaugacugggacuacgucgugaccaccgacauuagcgagaugggggcgaacuucagagccgaccgagugaucgauccgcggcgcugccucaagcccgucauccuaaaagacggccccgagcgggugauacucgccgggccaaugcccgugaccgucgccuccgcggcccagcgccggggcagaauugggcggaaccagaacaaggagggggaccaguacguguacaugggccagccccuaaacaacgacgaagaccacgcucacuggacggaggcuaagaugcugcucgauaauaucaacaccccggaggggaucauaccggcacuguuugagcccgagcgcgagaaguccgcggcaaucgacggugaguaucgacugcgcggggaggccagaaaaaccuucgucgagcucaugcggcgcggcgacuugccgguguggcuauccuauaagguugcgagcgagggcuuccaguacuccgaccggcgcuggugcuucgacggggagcggaacaaucaaguccucgaggagaacauggacguggagaucuggaccaaggagggcgagcgcaagaaacugcgcccccgcuggcuggaugcgagaaccuacagcgacccgcucgcccugagggaguucaaggaguucgcggccgggcggcgcagcgucuccggcgacuuaauucucgagaucgggaagcugccccagcaucugacguuacgagcccaaaacgcccuggacaacuuagucauguugcacaacagcgagcagggcgguaaggcguaccgccacgcaauggaagaacuucccgauaccaucgagacccugaugcuccuggcccugaucgcaguccucacugggggcguuacgcuguucuuccugagugggaaaggucucggcaagaccucgaucggguuauuaugugugaccgcguccagcgcccuacuguggauggccuccguggaaccccauuggaucgccgccagcauaauuuuggaauuuuuccuaauggugcugcugauucccgagcccgaccggcagcggacaccccaggacaaccagcucgcguacguugugaucggccuguuauuuaugauucucacgguggccgccaacgagauggggcuccuggagaccaccaagaaagaucucggcaucggacaugucgccgcggagaaccaucagcacgcgaccaugcuagauguggaccugcggccggccuccgccuggacgcuguacgcgguggccaccaccgucauaacccccaugaugagacacacgaucgagaauacgaccgcgaacaucagccugaccgccaucgccaaccaggccgccauccugaugggucucgacaaggguuggcccaucuccaagauggacauugggguaccccugcuggcgcucggcuguuacagccagguuaacccccugacacugaccgccgccguccucaugcugguggcacacuacgcuaucaucgggcccggccuccaggccaaagccacacgggaggcccagaagcgcacggcagcggggaucaugaagaauccgacuguggacgguaucgucgcuaucgaccucgaccccgugguguacgaugcuaaguuugagaagcagcugggccagaucaugcugcugauccucugcaccucccagauccugcuaaugaggaccacaugggcccugugcgagucaaucacgcuggccacugguccgcucaccacccucugggagggcuccccugggaaguuuuggaauacgaccaucgcggucagcauggccaacauuuuccggggaucguaucuggccggggccgggcucgcauucagccugaugaagucccuuggcgguggcagacggggaaccggggcccaaggcgagacgcuaggggagaaguggaagcgccaacucaaucaacugucaaaaagcgaguucaacacguacaagcgguccggaaucauggagguggaccgcuucgaagccaaagagggguuaaagcggggcgagaccaccaagcaugcagugagccgcgggaccgccaagcugagaugguucgucgagaggaaucuggugaagcccgagggcaaggugaucgauuuggguugcgggcggggcggguggagcuacuauugugcaggucuaaagaaagucaccgaggugaagggguacacgaagggaggucccggucacgaggagccgauccccauggccaccuacggcuggaaccuagugaaguuacacagcgggaaggacguguucuucaugccaccggagaaaugcgauacccuccugugcgacaucggcgaguccagcccgaaccccaccaucgaagaggggcgcacguuacguguguuaaagaugguggagcccuggcugcgcgggaaccaguucuguaucaaaaucuugaaccccuacaugccguccguuguggagacccuagagcagaugcaaaggaagcacggcggcaugcuggugcgcaacccccugucaagaaauuccacccacgagauguauuggguuagcuguggcaccggaaacauaguuuccgccgugaacaugacgagucgcaugcuguuaaaccgguucacaauggcucaucgcaagcccaccuacgaacgcgacguagaccugggcgcugguacccgacauguggcgguagagcccgaagucgccaaccucgacaucaucggccaacgcaucgagaacauaaagaacgagcacaaguccaccuggcacuacgaugaagacaacccguacaagaccugggccuaccacgggucuuacgaggugaaaccauccgggagcgcaucuucaauggugaacggcguaguaaaacuucugaccaagccuugggacguuaucccuauggugacucagaucgccaugacagacaccaccccguuugggcagcagagaguuuucaaggagaaggucgacacgcgcacgccacgggcgaagcguggcaccacccagaucauggaggugaccgcuaaguggcucuggggcuuccugagucggaacaaaaagccccgcauaugcacgcgggaggaguucacccguaaagugcguucaaacgccgccaucggggccgucuucguagacgagaaucaguggaacucagcgaaagaggcagucgaggacgagcguuucugggaccugguccaccgggagcgcgagcuccacaagcagggcaaaugcgcgaccugcguguacaacaugauggggaagcgugagaagaaacugggugaguucgggaaggccaaggggagccgugcgaucugguacauguggcugggcgcccgguuccucgaguucgaggcccugggguucaugaaugaggaccacugguucagucgcgagaacuccuuaagcggugucgagggggagggcuugcauaagcugggcuacauacugcgggacaucuccaagauaccgggcggcaacauguacgcggaugacacagccgggugggauacccgcaucacagaggacgaccuccagaacgaggcgaaaauaaccgacaucauggagccagagcacgcacuguuagcuaccagcauuuucaaacuuacguaccagaacaaggucgugcggguacagagacccgccaagaacgggaccgucauggacgugaucucgcgccgggaucaacgcgggucuggccagguuggaaccuacggguuaaacaccuucacgaacauggagguccagcugauacggcagauggagagugagggcauuuuucuccccucugagcuggagaccccgaaccuggcugagcgcgugcucgacuggcuggggaaacacggcgcugagagacugaagcgcauggccauuaguggugaugacugcguggucaaacccauugacgacagguucgccaccgcccucaccgcacuuaacgacaugggaaagguucgcaaggacauuccacaaugggagccaagcaagggcuggaacgacuggcagcagguuccguucugcucccaucacuuccaccagcugauaaugaaggacgggcgggagaucguugugcccugccggaaucaggacgagcucgugggccgggcgcgagucucgcagggggccggcuggucccuacgggagacugcuugccucggcaaauccuacgcacagauguggcaacuuauguauuuccaccgccgugaccugcgccuggccacgaaugcgaagugcuccgccgugccaguggauugggucccgacuagccggacgacauggucgauccacgcgcaccaucaauggaugacgaccgaggacaugcucuccguguggaaucggguguggaucgaggaaaacccguggauggaagacaagacccacgucucguccugggaggaaguucccuaccugggcaagcgagaagaccaauggugcggcagucuaaucgggcucaccgcccgcgcgacaugggccacuaacauccagguggcuauuaaccagguucgccggcugaucgguaaugaaaacuaccuggauuauaugaccuccaugcgccgguuuaagaacgaguccgaccccgagggggccuuaugguaa

SEQ ID NO: 23952 - RNA, 9879 nt, Artificial Sequence
  derived and/or modified CDS sequence (opt11) from DENV-1__FJ024423__SS-prME
agcgugaccaugcugcuuaugcugcugcccaccgcguuagccuuccaucugacaacacggggcggagaaccccacaugaucgugagcaaacaggagcgaggcaaaagccuccucuucaagaccagcgcgggggugaacaugugcacccuuaucgccauggaccugggcgaacucugcgaggacacgaugacuuacaagugcccacagaucaccgaggccgagcccgacgacguggacuguugguguaacgcuacugauacuugggucacguaugggaccugcucucagaccggcgagcaucggcgggacaagcgcuccguggcccuugcaccgcacgugggccuggggcucgagacccggaccgagaccuggaugucaagcgagggcgccuggaagcagauccagcgcgucgagacgugggcccugcggcaccccggauuuacggugguggcguucuuccuggcccaugccauugggaccagcaucacccagaaggggaucaucuuuauucuccugaugcuggucacacccuccauggccaugcggugcgugggcaucgguaaccgggauuuuguggaggggcucagcggcgcgacgugggucgacgugguucuagagcacggguccugcguuaccacgauggccaagaacaagccgaccuuggacauugaguugcugaagacggaggugaccaaccccgcgaucuugcgcaagcucugcaucgaggccaagauuagcaacaccaccacggacucccggugcccgacccagggcgaggccaccuugguagaagagcaggacgccaacuucguuugccgccgaacuuuuguggacagaggcugggguaacggaugcgggcuauuuggcaagggcagccucuuaacuugcgccaaguuuaagugcguaaccaagcuagaggggaagaucguccaguacgaaaaccucaaguacuccgucaucgugaccguccacacuggcgaccagcaccaaguggggaacgagacgacggaacacggcaccaucgcgaucaucacgccgcaggcacccaccagcgaaauacagcugacggacuauggggcccugacacucgacugcagcccccggaccggcuuagacuucaaugaaaugguccugcucaccaugaaggagaagucuuggcuagugcacaaacagugguuccuggaccucccacugccuuggacguccggggcuagcacuucucaagaaacguggaaccgacaggaccuacucguaaccuucaagacggcccacgccaagaagcaggaagucgugguacuggguucgcaggagggcgcgaugcauacggcccugacuggagcaaccgagauccagacgagcggcacgaccaccaucuuugccgggcaucucaagugucgacugaaaauggacaagcugacguuaaagggcaccagcuacgucaugugcaccgggucguucaagcuggaaaaggagguggcagagacccaacacggcacggucuuaguccaggugaaguacgaggguaccgacgcaccaugcaaaauccccuuuuccacacaggacgaaaagggggugacccagaauggcagacugaucacggccaacccaaucgucaccgacaaagaaaagcccgugaacauugagacagagccacccuuuggggaaagcuacaucgugauuggagccggagagaaagcucucaagcuuaguugguucaagaaggggucguccauuggcaaaauguucgaggccaccgcccgcggagcccgccggauggcgauccugggcgacacggcgugggacuucggguccaucgguggcgucuuuacaagcguggggaagcuagugcaccaggucuucggaaccgcauacggggugcuauucucgggcgugagcuggaccaugaagaucgggaucgggauucugcucacuuggcugggucuaaauagccgcucuaccagcuuaucaaugaccugcauugccguggguaugguuacccuuuaccugggggugaugguccaggcagauagcggcugcgucauuaauuggaaaggccgcgagcucaagugcgguuccggcaucuucguaacgaacgagguacacaccuggaccgaacaguacaaguuccaggccgacagcccuaagcggcugucagcggcgaucggcaaggcuugggaggaggggguuugcggcauacgcuccgccacccggcuggagaacaucauguggaagcagaucaguaaugagcuaaaccacaucuuacucgagaacgacaugaaguuuaccguggucgugggggacgccaauggcaucuuggcgcaggggaagaagaugauacgcccccaaccaauggaacacaaguacucguggaaguccuggggcaaagccaagaucaucggugccgacauccagaauacaaccuucaucaucgacgggccagacacuccugagugccccgaugaccaaagagccuggaacaucugggagguggaggauuacggcuucggcaucuucacuaccaacauuuggcugaagcugcgagauuccuauacccagaugugugaccaccgucucaugucggcggcaaucaaggacuccaaagccguccaugccgacaugggcuacuggauagagagcgagaagaacgagaccuggaaguuggcucgcgcgaguuucauagagguuaagaccugcacguggcccaagucccacacuuuauggucuaacggcgugcuggagagcgagaugaucauccccaaaaucuacggaggaccaaucucccagcacaauuaccggcccggguauuucacccagacugccgggcccuggcaccuggggaaauuggaguuagacuuugacuuaugugagggcacgaccgucguaguagacgagcacugcggcaaucgggggccuucacuucggaccaccacggucacaggcaaaaucauucacgaguggugcugccgcuccuguacccuaccgccccugagauuucguggggaggacggcugcugguacgggauggagauccgucccguaaaggagaaggaggagaaccuggugaggagcaugguaagcgccggcagcggcgagguggauagcuucucgcucggaauccugugcgccagcauuaugaucgaggaggugaugcggucccgcuggagccggaagaugcugaugaccggcacacucgccgucuuccugcugcucaucauggggcagcucacguggaacgaccugauacgccucugcaucaugguaggcgccaacgcuucugaucgcauggggaugggcaccaccuaucuagcucugauggccacguucaaaaugaggccuauguucgccgugggccucuuauuccgucgacuaacaucaagagagguucuccuucugaccaucggucucucccugguggcaucaguggaacugcccaacucccucgaggagcugggcgacgguuuggccaugggcaucaugaugcucaagcugcugacugaauuccagccccaccagcucuggacuacacugcugagccucaccuuuaucaagaccacccugucccuggacuacgccuggaagaccaccgccauggcgcucagcaucgucuccuuauucccccucugccuaagcaccacuucccagaagaccacauggcugccgguucugcucggcagcuuugggugcaagccccuaaccauguuccugaucaccgaaaacaagaucuggggccggaaguccuggccauugaacgagggcauuauggcaaucggcaucgucagcauccugcuguccuccuugcugaagaaugaugucccccuagcggggccgcucaucgccggcggcaugcugaucgccugcuacgucaucagcggguccagcgcggaucuaaguuuagagaaagccgcggaggucagcugggagcaggaggccgagcauuccggcaccucacacaacauccugguugaggugcaggacgacgggacaaugaagaucaaggacgaggagaaggacgacacccucacuauccuccucaaggccacgcuccuagcggucuccggcguguaccccaugucuauuccagccacgcuguucgugugguacuucuggcagaagaagaaacagcgcuccgggguccugugggacaccccaucgccaccugaagucgagcgggccgugcuagaugacgggauuuaccggauccuacagcgggggcugcugggacgcucccaagucggcgucgggguguuccaggacggcgucuuccauaccauguggcacgugacgcgcggggcuguucucauguaccagggcaagcgccuggagcccagcugggccuccgucaagaaggaccuuaucagcuacggcgggggcuggcguuuccagggguccuggaacaccggcgaggagguccaggugaucgccguugagcccgggaagaacccgaagaacgugcagacgacccccggcacguucaagacucccgagggcgaggugggggccaucgcccucgacuucaagccgggcaccagcgggaguccgauagucaauagggaaggcaagaucguaggacuuuacgggaauggcguggucaccacgagcgggaccuacguauccgccaucgcacaggcgaaggcgagccaggagggcccacuaccggagaucgaggacgagguguucaaaaagcggaaccucaccauaauggaccugcaccccgggagcggcaagacacgucgauacuuacccgccauuguccgcgaagccauuaagcgcaagcuccgcacacugauccuggcgccaacccgggugguggccuccgaaauggcggaggccuuaaagggaaugccuaucagauaccagaccaccgccgugaagagugagcacaccggaagagagaucguggacuuaaugugccacgcgaccuucaccaugcgacugcucuccccuguacgcguccccaacuacaacaugauaaucauggacgaggcgcacuucaccgaccccgcuaguaucgcagcccggggcuacaucaguacgagaguagggaugggcgaggcggcggcgauauucaugaccgccacgccgccagggagcguggaggcauucccacaguccaacgcugucauccaggacgaggaacgggacauccccgagcgcucuuggaacucgggcuacgauuggaucaccgacuuccccggcaagacggugugguucgugcccucuaucaaauccgggaacgacauugccaauugccugcguaaaaauggcaagcgcgucauacagcugaguaggaagaccuucgacaccgaguaccagaaaaccaagaacaacgacugggacuacguggugacgaccgacaucuccgaaaugggggcgaacuuccgcgcugaccgggucaucgacccccgccgauguuugaagcccgucauccugaaggacggucccgagcgcgugauccucgcggggccgaugccugucaccguggccagcgccgcccaacgccgcggccggaucggccgcaaccagaacaaagagggggaccaauacguguacaugggccagccccucaacaacgaugaggaccacgcccacuggaccgaggcgaagaugcugcuugacaacaucaacacgccagaggggaucaucccggcccucuucgagcccgagcgggagaaguccgcagcuaucgacggcgaguaccgccugcgcggcgaggcccggaagacguucguagagcugaugagaagaggcgacuuacccguuuggcuuaguuacaagguugcgucggagggcuuccaguacagcgaccgccguuggugcuucgauggcgagcgcaacaaccaggugcucgaagagaacauggacguagagaucuggaccaaagagggcgagcggaagaagcuucgcccccggugguuagacgcgcgcaccuacuccgacccccuggcccuacgggaguucaaggaguucgccgccgggcgccggucggucagcggcgaucugauccuggagaucggcaaacucccccagcaccugaccuugagagcacagaacgcccucgacaaccuggugauguuacacaacuccgaacagggcgggaaggccuacaggcacgcgauggaggagcuccccgacacgaucgagacacugaugcugcucgcguugaucgccgugcugaccgggggcgucacccucuucuuccuaagcgggaagggcuugggaaagacuucuaucggguuacuguguguaaccgccagcuccgcccuccucuggauggccagcguggagccgcacuggauugcggccuccauuauucuggaguucuucuugaugguccuccugauccccgagcccgaccgccagagaacuccccaggauaaucagcucgccuacguagugaucggacuccuguuuaugauacugaccgucgccgccaacgagauggggcuccuggagacgacaaagaaggaccugggcaucggccauguggcggccgagaaccaccagcacgccaccauguuagacguggacuuacgcccggccagcgccuggacccuguacgcggucgcgacgaccgugauuaccccuaugaugcggcacacuaucgagaacacgaccgccaacaucagccugaccgccaucgccaaccaagcggccaucuugaugggccuggacaagggauggcccaucagcaaaauggacaucggcgugccccuccuggcacugggcugcuacucccaggucaacccgcuaacgcugacggcggcagugcugaugcugguggcacacuacgcuaucaucgggcccggucugcaagccaaggcgacccgcgaggcgcagaagcggaccgcugccgggaucaugaagaaccccaccgucgacgguauuguggccaucgaucuggauccaguggucuacgacgcgaaguucgagaagcaacucggccagaucaugcugcugauuuugugcaccagccagaucuugcugaugaggacuaccugggcgcucugugaguccaucacccuggccacggggccgcugacaacccucugggaaggcagccccggcaaguucuggaacaccacgaucgccguguccauggccaacaucuuccgcggcagcuaccuggccggcgcggggcuggcguucuccuugaugaagucccuaggagggggcaggcgggggaccggggcccaaggcgaaaccuuaggugagaaguggaaacggcagcucaaccaguuaaguaagagcgaguuuaauaccuacaagcggagcggaaucauggagguggaccguagcgaggccaaggaggggcugaagcgcggggagacgacuaagcacgcgguuucgcgggggacggccaagcuccgcugguucguggagcggaaucuggugaagcccgaaggcaaagucaucgaccugggcugcgggcgcggcggaugguccuacuacugcgccggccugaagaaggucaccgaggugaaaggguauacgaagggcggacccgggcacgaggagccgauccccauggccacguacggcuggaaccucgucaagcugcacucagggaaggaugucuucuuuaugccgcccgagaagugcgacacccuccucugcgacauaggcgaguccagcccgaaccccacgaucgaggaggggagaacccuccguguacugaagauggucgagcccuggcuccgcggcaaccaauucugcaucaagauccugaacccuuacaugccguccgugguggagacgcuagagcagaugcagcgcaagcacggcgggauguuaguccgcaacccacugagccgcaacuccacacacgagauguacugggugagcugcggaaccggaaauaucgugucagcggucaacaugaccagccggaugcuacucaaccgcuuuacgauggcccaccguaagccaaccuacgagcgugacguggacuugggugccggcacccgccacguggccgucgaaccggaaguggccaaccuagacaucauugggcagagaaucgaaaauaucaagaaugagcacaaguccaccuggcauuacgaugaagacaauccguacaagacgugggcguaccacggcagcuacgagguuaagcccuccgguagcgcaucgucgaugguuaacggcguggugcgucuccugaccaagccuugggacgucauccccaugguaacgcagauugccaugaccgacacgaccccguucgggcaacagcgggucuucaaggagaaaguggacacucgcacgccccgggccaagcgcggcacgacccagaucauggaggugaccgccaaguggcuguggggcuuccucagccggaacaagaagccccgcauuugcacgcgcgaggaguucacgcgcaaagugcggagcaacgccgcgaucggggccguuuucguggaugaaaaccaauggaacagcgccaaggaggcggucgaggacgagcguuuuugggaccuggugcaccgggaacgcgagcugcauaagcaagguaagugcgcgaccuguguguacaacaugauggggaagagagagaagaagcucggcgaguuuggcaaggccaagggaucccgcgccauaugguacauguggcugggggcccgguuccuggaguucgaggcgcucggguucaugaaugaggaccauugguucagucgcgagaacucccugagcggcgucgagggggaggggcugcacaaguugggguacauccuacgugacaucuccaagauaccgggcggcaacauguacgcggaugacacugccgggugggacacgcggauuacggaggacgaccugcaaaacgaggccaagauaacggacaucauggaacccgagcacgcccuacuggccaccagcauuuucaagcugaccuaccagaacaaggugguccgcguccagcgccccgcgaagaacggcacggugauggacguaauuucacgcagggaccaacgcgggaguggccaggucgggaccuacggucucaacacuuucaccaauauggaggugcaacugaucaggcagauggaguccgagggcaucuuccugccgucugagcucgagacgccgaaccuggcgaagcgcgugcuggauugguuggagaagcacggggccgaacgguuaaagcgcauggccaucuccggcgacgacugcguagugaagcccauugaugaccgguuugccacagcgcugaccgcccucaacgacauggggaaggugcgaaaagacauuccccaaugggagcccagcaagggguggaacgacuggcagcaggucccguucuguucccaucacuuccaccagcuaauaaugaaggacggccgggaaaucguggugcccugccguaaucaggacgaguuggucgggcgagccagagugagccagggcgccggguggucccuccgggaaaccgccugccugggcaaaagcuacgcccagauguggcagcugauguauuuccaccgccgggaccuccgccucgccgccaacgccaucugcuccgcgguacccgucgacugggugcccacaucgcggacgacguggucgauccacgcacaucaccaauggaugaccacagaagacaugcuguccguguggaaccgcguguggaucgaggagaacccguggauggaggauaagacgcaugugucuuccugggaagaagugcccuaucucgguaagcgcgaggaccaguggugcggaucacugauuggccuuaccgcccgggccaccugggccaccaacauccaggucgcaaucaaccagguccgccggcucaucggcaacgaaaacuaccuggacuauaugacguccaugaagcgcuucaagaacgagucggaccccgagggggcccuaugguag

SEQ ID NO: 23953 - RNA, 9879 nt, Artificial Sequence
  derived and/or modified CDS sequence (opt11) from DENV-1__FJ547089__SS-prME
uccgugacgauguugcucauguugcuucccaccgcucuagccuuccaccucacgacccggggcggggagccccauaugaucguaucgaagcaggagaggggcaagucacuccuguucaaaaccagcgccgggguuaauaugugcacacuaauagcgauggaucugggugaguuaugcgaggacacgaugaccuacaagugcccccagauaacagaggccgagcccgacgauguggauugcuggugcaacgcaaccgacacguggguuaccuaugggacgugcagccaaacaggagagcauagacgggacaagcgcucggucgcccuggcuccgcacgugggacuggggcuggagacgcggaccgaaacguggaugaguucggaaggcgcguggaaacagauacagcgcguagagaccugggcccugcggcaccccggguucacagugaucgcccucuuucucgcucacgcuaucggcaccucaauaacccaaaaaggcaucaucuucauacugcugaugcucgugacccccucgauggccaugcgcugcguuggcaucgguaaccgggacuucgucgaggggcugucgggcgccaccuggguagauguggucuuagagcacggguccugcgugaccacaauggcuaagaacaagcccacccuugauauagagcugcuaaagacggaggucacuaacccugcgauccuccgcaaacuaugcaucgaagcaaaaauuucaaacaccaccacggacucccggugcccaacacagggcgaggccacccugguggaggagcaggacgccaacuucgugugccgccggacauucguggaccgcggcugggggaauggcugcggccuauucggcaaggggagccugcugacgugugccaaguucaaaugcguaacuaagcucgaggguaagaucguucaguaugagaaccugaaauacucagucaucgugacggugcacaccggcgaccagcaccaggucgguaacgagacgaccgagcacggcacuaucgcgacaauaacgccccaagcucccacgagcgagauccagcugaccgacuacggggcacucacccuggauuguucaccuagaacaggccuggacuuuaaugagauggugcugcuaaccaugaaggagaaaagcuggcugguccacaagcaaugguuucuagaccugccccuaccuuggacauccggggcaucuaccagccaggagaccuggaaucgccaggacuuacuggugacguuuaaaaccgcacacgcaaaaaagcaggaggugguggugcuagggucccaggagggggccaugcacaccgcccucacaggagccacagaaauccaaacuagcgguaccaccacgauuuucgcagggcaucugaagugucggcugaagauggacaagcuuacacugaaggggacguccuacguuaugugcaccggcagcuucaagcuggaaaaggagguugcggagacccagcacggaaccgugcugguacagguaaaguaugaaggcaccgacgcccccugcaagauccccuucuccacccaagacgagaaaggcguaacgcagaacggccgccucaucacugccaauccuauagugaccgacaaggaaaagcccgucaauaucgaaaccgaaccgcccuuuggcgagagcuacaucguggugggcgccggcgagaaggcgcucaagcuguccugguucaaaaagggcagcuccaucggcaagauguucgaggccacggcacguggagcccgcagaauggccauucucggcgacacagcgugggacuucgggagcaucggcggcgucuuuacaucaguagggaagcugguccaccaggucuuuggaacagccuacggggugcuguucagcgguguguccuggacgaugaagaucgggauagguaucuuacuaacguggcugggacucaacagcagguccacaagccuguccaugacuugcaucgcggucgggauggugacguuauaucucggcgugaugguccaggccgauagugggugcgugauuaacuggaaaggccgcgagcuaaagugcgggucgggcaucuucgucaccaacgagguacacaccuggacugagcaguacaaguuccaggccgauucaccgaaacgguuaucagcugccaucgggaaggccugggaggaggggguuugcggcaucagaucggcaacccggcuggagaauaucauguggaagcagaucucaaacgagcugaaccacauccuacucgagaacgacaugaaguucacugugguggugggcgaugcuaacggcauucuggcacaagguaaaaagaugauacgcccacagcccauggaacacaaguacaguuggaagagcugggggaaggcuaagauaaucggcgccgacauccaaaacacgacuuucauaaucgacgggcccgacacaccggagugccccgauaaccaacgggccuggaacauaugggagguggaagacuacggcuucgggaucuucaccaccaacaucuggcugaagcucagagauuccuacacccagaugugcgaccaccgucugaugagcgcggcuauuaaggacucuaaagcaguccacgccgauaugggcuauuggauagaaagcgagaagaacgagacuuggaaacucgcccgcgcguccuucauagagguaaagacgugcaccuggccaaagagccacacccucuggaguaacggggugcuggagagcgaaaugauuauccccaaaaucuacggugggccgaucucgcagcacaacuaccggcccggguacuucacccaaacggccggccccuggcaccuagguaagcucgaacuggacuucgaucucugcgaagggacgaccgucgugguggacgagcacuguggcaacagaggcccaagccuccggaccacgaccgugacaggcaaaacgauucacgagugguguugucgcagcugcacccucccuccccuacguuuccgcggugaggauggcugcugguacggaauggagauccggcccguaaaggagaaggaagaaaauuugguucguaguaugguuuccgcugguagcggcgagguugacagcuucucccugggaauucuaugcgccucgaucaugaucgaagaagugaugcguagucgcuggagccggaaaaugcucaugaccgguacucuggccgucuuucugcuacugauaauggggcagcugacauggaacgaucugauucgccugugcaucauggugggcgcgaacgcuuccgaccgcauggggaugggaacgaccuaccuggcccucauggccaccuucaaaaugagaccgauguucgcggugggcuugcuauuccggcggcucacgagcagagaggugcugcugcucacgauugggcuuucccuaguggcguccguggaguugcccaacucccuggaggaacugggcgaugggcucgcuaugggcaucaugaugcuaaagcuucuaacggaguuucagccgcaucagcuguggaccacccugcucucccugacguucauaaagacaacccugucccuggacuacgccuggaaaaccaccgccauggcucugagcaucguuucccuguuuccacucugccugagcacaacuucccagaagaccaccuggcugccggugcuccuaggaucauucgggugcaaaccccugacaauguuccuaaucaccgagaauaagauaugggguagaaaauccuggccccucaacgagggcaucauggccauuggcaucgugucaauccuucuguccucgcuacuaaagaacgacgugccccucgccgggccgcugauagccggcggcauguuaaucgccugcuacgucauuagcgggucaucggcggacuugucccuugaaaaggccgcagaaguaagcugggagcaggaagccgagcacuccggcacgucucacaacauccuggucgaggugcaggaugacgguacgaugaagauaaaggacgaggaaagggaugacacuuugaccauccuccuuaaggccacccucuuggcagucuccggcguguaucccaugagcauccccgcaacacuguuugugugguacuucuggcagaagaagaagcagcggagcgggguccucugggacacuccaagcccgcccgaaguugaacgcgccgugcuggacgacggcaucuaccguauacuacagcguggccugcucgggcggagucagguuggcguggggguauuccaggacggcguauuccacaccauguggcacgugaccagaggggcagugcugauguaccagggcaagcgucucgagcccagcugggcauccgucaaaaaggaccucaucagcuacgguggaggcuggcguuuccagggcuccuggaacaccggcgaagagguccaggugaucgcagucgagccugguaagaacccgaaaaacguccagacgacgcccggaaccuucaagacccccgaaggggaggugggggccaucgcuuuagacuucaagcccgguacaucagggagcccgaucgucaaccgggagggcaagaucguggggcuguacgguaacggcguggucaccaccagcgggaccuacguguccgcaaucgcccaggccaaggcuagccaggagggcccccuccccgagaucgaggacgaaguguucaagaagcgaaaccugacgaucauggaccuccacccugguagcggaaagacgcggcgguaccuccccgccauuguccgcgaggccaucaagcgcaagcuacggacuuuaauacucgcgccuacacgcguuguagccagugaaauggcagaggcccuaaaaggcaugcccauccgcuaccaaacgaccgcugucaagucggaacacaccgggagagagaucgucgaccugaugugccaugcaacguucacuaugcgccuccuguccccgguucggguccccaacuacaauaugaucauuauggacgaggcccacuucaccgaucccgcuagcaucgcggcaaggggauacaucuccacccggguggguaugggcgaggcggccgcgaucuucaugacugcaacgcccccgggguccguugaggccuucccccaauccaacgcggucauucaagacgaggagcgggacauccccgagcggucguggaauaguggauacgacuggauuacugacuuccccggcaagaccgucugguucgugccgucaaucaaguccgggaaugacaucgcuaauugcuugcgcaagaacggcaagcgggugauccaguugagcagaaagacguucgauacggaguaccagaagaccaaaaacaacgauugggacuacguggugaccaccgacaucucugaaaugggagccaacuuccgggcggacagagucaucgacccccggcgcugccugaaaccagugaucuugaaagacggccccgagcgggugauucucgccgggccgaugcccgugacgguggcaagcgccgcucagagacggggccgcaucgggcggaaccagaauaaagaaggggaccaguacguguauaugggacagccacugaauaacgaugaggaccacgcccacuggaccgaggcgaagaugcugcuugacaacaucaauaccccugaagggaucaucccggcucuguucgagccggaacgcgagaaguccgccgccaucgacggagaguaccgccugcgcggugaggcccguaagacauuuguugagcucaugcggcguggggaucugcccguguggcugagcuauaaggucgcguccgagggauuccaguacuccgaccgacguuggugcuucgacggggagcggaacaaccaggugcuugaagagaacauggacguggaaauuuggaccaaggagggugaacguaagaagcugaggccuagauggcuggacgcccggaccuauuccgacccucuugccuugcgcgaauucaaagaauucgcagccggcaggcgcagcgugagcggagaccugauucucgaaaucggaaagcugccccaacaccugacccuccgggcgcaaaacgcgcuugauaaccuggugaugcuccacaacagugaacagggugguaaggccuaccgccacgccauggaggaacugccggauacuaucgagacccugaugcugcuggcgcuaaucgcaguguugacgggcgggguuacuuuguucuuccuaagcgggaagggucugggcaagaccuccaucgggcugcucuguguuaccgcuagcuccgcgcucuuguggauggccucgguggagccgcacuggauagcggcgagcaucauccuagaauucuuucucaugguguuacucaucccggagcccgaccggcagcgcacgccccaagacaaucagcucgcuuacguggugaucgggcuucuauucaugauccucaccgucgcugccaacgagaugggccugcuggaaacaaccaagaaggauuugggcaucgggcacguggccgccgagaaccaccagcacgccacaaugcuagacguggaccugcgcccggcgucggcguggaccuuauaugcggucgccaccaccgugaucacgccuaugaugcggcacaccaucgagaacacgaccgcgaacaucucccugacugccauagcuaaucaggcggccauccugaugggccucgacaaaggcuggcccaucucuaaaauggacaucggggugccacuacuggcccugggcuguuacucucaggucaaccccuuaacucucaccgcagcggugcucaugcugguggcccauuaugcgauuaucgggccuggccugcaggccaaagcuacccgggaggcgcagaagcgcacggcugccgggauaaugaagaauccgacgguagacggcaucguggcgaucgaccucgaccccguggucuacgacgccaaguucgagaagcagcugggacagauaaugcuguuaaucuuaugcaccagccagaucuuacucaugcgcacgaccugggcccugugcgaaucaaucacccuggccacgggcccgcucacaacguugugggaaggaagcccagggaaguuuuggaacacaaccaucgccgugucaauggccaacauauuccggggcagcuaccuggccggcgcaggguuagccuucucccuaaugaagucccugggcggcggcagacgcgguaccggugcccagggcgaaacgcucggggagaaguggaagcgccagcugaaccagcuuagcaagagcgaguucaacaccuauaagcggagcggcauuauggaggucgaccgcuccgaggccaaggaaggccucaaacggggcgagaccacgaagcaugcagucucacgcgguacugccaagcugcggugguucguggagaggaaucugguaaagcccgaagguaaggucauagaucugggcugcggcaggggcggauggucauacuacugcgccggccucaagaagguuacugaggucaaggguuacaccaagggcgugcccgcucgugaggaaccuauccccauggccaccuacggcuggaaccugguaaaguugcacagugggaaggacguauuuuucaugccgccagaaaagugcgacacucuccuuugugacauaggggaguccucgccuaaccccacgaucgaagaaggacgaacacugcgcguccucaagaugguggagccuuggcuccggggcaaucaauucugcaucaaaauuuuaaaccccuacaugccgucaguggucgagacauuggagcagaugcagcgcaaacacggggguaugcuggugcguaaccccuuaagccgcaacuccacccaugaaauguacugggugagcuguggaaccgggaacaucgucuccgcgguaaauaugaccucucggaugcuccugaaccgcuuuaccauggcacaccgcaagcccaccuacgagcgggauguggaccucggcgccgggacgcgccacgucgccgucgagcccgagguggcgaaccuugacaucaucggacaacggaucgaaaacauaaagaaugaacacaaauccacauggcacuaugacgaggacaauccguauaaaacaugggccuaucacgguuccuacgagguaaagcccucagguucagcguccagcauggugaaugggguuguuaggcuguugacgaagccuugggacgugaucccgauggucacgcaaaucgccaugaccgacaccaccccguucgggcaacagcggguguucaaggagaagguggacacgcgcacuccccgugcaaagcgggggaccacccagaucauggaggucacggccaaguggcucuggggguuucugucacggaauaagaagccccgcauauguacacgggaagaguucacgcgcaagguacggagcaacgcggcaaucggcgccguguucauugacgaaaaccaguggaacuccgcaaaggaggcggucgaggacgaaagguuuugggaccuugugcaccgggagagagaacuccauaagcagggcaagugcgcuaccuguguguauaacaugaugggaaagcgugagaaaaagcuaggggaguuugggaaagccaagggcucgcgagccaucugguacauguggcugggggcucgguuucuagaguucgaggcgcugggcuucaugaacgaagaccauugguuuagccgcgagaacucccuuucaggcgucgagggggagggucuucauaagcugggguacauacuccgggacaucucaaagaucccgggcggcaacauguaugcugaugacacggccggcugggauacgcgcgugaccgaagacgaccuccagaacgaggccaagaucaccgacaucauggaaccggagcaugcccuccuggcgacuagcaucuuuaagcucacuuaccagaacaaggugguacgcgugcaacggcccgcgaaaaacggcaccgugauggauguuauuucacggcgggaccagcgcgggagcggccaggugggaaccuacggccugaacacauucacuaacauggaggugcagcuuauccgacaaauggaauccgagggcauuuuucuaccuucagaacuggaaaccccaaaucuggccgagcgcguucucgauuggcuggagaaacauggggcagaacggcugagacggauggccaucucuggcgaugauugcguugugaagcccauugacgauagguucgcgaccgcacucaccgccuugaacgacauggguaagguccguaaagacaucccccagugggagcccaguaagggauggaacgacuggcagcaggucccguucuguucccaccacuuccaccagcugaucaugaaagacggccgcgagauaguaguucccugccggaaccaggacgaguuagugggccgcgccagggugucucagggggccggauggucucugagagaaacggccugccuggguaagagcuacgcacagauguggcagcuuauguacuuccaccgucgcgaucugcgccuggccgccaacgccaucuguuccgccguccccguagacugggugccuaccucacgcaccaccuggucgauucacgcccaccaucaauggaugacgaccgaggacaugcuaucggucuggaaccgcgucuggaucgaggagaacccguggauggaggauaagacccaugugucauccugggaggaggucccuuaucuggggaaacgcgaggaccaguggugcggcagccugaucggucucacugcccgcgccacgugggcaaccaacauacagguggccauaaaucagguucggcgucugaucggcaaugaaaauuaccuggacuacaugacuaguaugaagcgguucaagaacgagagcgacccugagggcgcccugugguga

SEQ ID NO: 23954 - RNA, 9879 nt, Artificial Sequence
  derived and/or modified CDS sequence (opt11) from DENV-1__FJ024484__SS-prME
ucaguaacgaugcugcucauguugcucccuaccgcccucgccuuccaucugacaacgcgaggcggggagccccauaugaucgugagcaagcaggagcguggcaaaagccuccuauucaagacaagcgccggggugaacaugugcacccugaucgccauggaccuuggugaacuuugcgaagacaccaugacauacaagugcccccaaaucacugaagccgagccggacgacguggacugcuggugcaacgccaccgacacuugggugaccuacgggacaugcagccagaccggcgagcaccggcgggacaagcgcucgguggcccuggcuccccacguuggccuggggcuggaaacgcggaccgagaccuggaugaguagugaaggcgcguggaagcagauccagcgcgucgaaaccugggcgcugcggcauccgggguucacugugguggcauucuuccuagcacacgcgauuggcaccucuaucacacagaaggggauaaucuucauccuccugaugcugguuacccccuccauggccaugcgcugcguuggcaucggcaaccgagauuucguugaagggcugaguggcgcaacguggguggacguggugcuggagcacgguuccugcgucaccacgauggcgaagaacaagcccacguuagacauugagcuccugaaaaccgaagugaccaaccccgcgauccuccggaaguugugcaucgaggcgaagaucagcaacacgacuacagauucccggugcccgacccagggcgaagccacgcugguggaggaacaggacgccaacuucguaugcaggcggaccuucguggaccgcggcugggggaacggauguggacuguucggcaaagguucccuccuaacgugcgccaaguucaagugcguuaccaaacuugaaggcaagaucguucaguacgagaaccucaaguacucagugaucgucaccguccacaccggcgaccagcaccagguggggaaugagacgacagagcacggcaccaucgcaacgaucaccccccaggccccgacaucugagauccaauuaacugacuacggagcccugacccuggacugcaguccacggaccgggcuggacuuuaacgaaaugguucuccuuacgaugaaggagaaguccuggcugguacacaaacagugguuccuggaccucccgcugcccuggacguccggggccagcaccucacaggagacauggaacagacaggauuuguuggugacguucaagaccgcccaugcaaagaagcaagaggucguggugcuggguucucaggagggcgccaugcacaccgccuugaccggggcaacggaaauccagaccucuggcaccaccacuaucuuugccgggcaccuaaagugccggcugaagauggacaaacugacccucaagggcaccagcuacgucaugugcaccgguagcuucaaacuggagaaggagguggcggagacacaacacggcaccgugcugguucaggugaaguaugagggcaccgacgccccuugcaaaauccccuuuuccacccaggacgaaaagggggugacgcagaacggccgccuaaucacugccaaccccauagucaccgacaaggaaaagcccgugaauaucgagaccgagccgcccuuuggcgagagcuacauagugaucggcgcaggagaaaaagcccugaaguuauccugguucaagaaaggcagcuccauaggcaagauguuugaggcuaccgcccgcggggcccgcagaauggccauucugggcgacaccgcgugggacuucgggaguaucggcgguguuuucaccuccgugggcaaguugguccaccaaguauucggcacagccuacggggugcuguuuagcgggguguccuggacgaugaagaucgggauaggcauucuucuaaccuggcucggccugaacucccgcucaaccagccucagcaugaccuguaucgcaguugggauggugacgcuguaucucggggugauggugcaggccgacagcgggugcgucauuaauuggaaagggcgcgagcucaagugcggguccggcauauucgucaccaacgagguccacacauggaccgagcaguacaaguuccaagccgacuccccgaagcggcugagugcggccaucggcaaggcuugggaggaggggguauguggcauccgcuccgccacccggcuggagaacaucauguggaagcagaucagcaacgagcucaaccauaucuuacuggagaacgauaugaaguucacggugguuguaggggacgccaacggcaucuuagcgcagggaaagaagaugaucaggccucagcccauggagcacaaauacucguggaagucguggggaaaagccaagaucaucggcgcagacauucagaacaccaccuucaucaucgacgggcccgauaccccggagugcccugacgaucagcgugccuggaacaucugggagguggaggacuacggguucgggaucuucacgaccaacaucuggcugaaacugcgcgacuccuacacccaaaugugcgaucaucggcuaaugagcgcagcuauuaaggacuccaaggcaguccacgccgacaugggcuacuggaucgaaagcgagaagaaugagacuuggaagcuggcacgcgcuuccuucauagaggucaagacguguaccuggccuaagagucacacccugugguccaacggcgugcucgagucagagaugaucauccccaaaaucuacgggggcccuauuucccagcacaacuacagacccggguacuucacacaaacggccggucccuggcaccuuggcaaacuggagcuugacuuugaccugugugagggcacgaccgucgugguggacgaacacugcgguaaccgggggccuagucugcgaacuacgaccgucaccggcaagaucauccacgaguggugcugucgguccuguacacuaccgccuuugcgguuccgcggggaagacggcugcugguacggaauggagauucggcccgugaaggagaaggaagaaaaccuggugcgcagcauggucuccgccgggagcggcgaaguggacuccuucucucucgggauccugugcgccagcauuaugaucgaggaggugaugcggucucgcuggagccggaagaugcugaugacuggcacccucgccguuuucuuacuguuaauuaugggacaauuaaccuggaacgaccugauccgccucugcaucaugguaggcgcgaacgcguccgaccgcauggggaugggcaccacauaccuggccuuaauggcaaccuucaagaugcguccaauguuugccguaggccuccuguuuagacggcugacaagcagggaaguccuacuacugaccaucggccugucauuaguggccagcguggagcugccgaauucccucgaggagcucggagacgggcuugccaugggcauaaugaugcucaagcuguuaacggaguuccagccccaccagcucuggacgacccugcugucgcucaccuuuauaaagacgacccugucccuugauuacgccuggaagacuaccgccauggcgcucagcaucgugucgcuguucccucugugccucagcacgaccucccagaagaccacauggcugccgguccugcucggcucuuucggauguaagccccugaccauguuccugaucacggagaauaagaucuggggcaggaaauccuggccccucaacgaggggaucauggccaucggaauagugaguauccugcugaguagccuccucaagaacgacgucccgcuugccgggccguuaaucgccgguggcaugcugaucgccugcuaugugaucagcgggucaagcgcggaccugucccucgagaaggccgccgaaguuagcugggagcaggaggccgaacacuccggcaccucgcauaauauccugguagaagugcaagacgacgggaccaugaagauaaaggaugaggagaaagacgacacccugacuauccuccugaaggccaccuuacucgcggucuccggaguguacccgaugagcaucccagccacccuauuugugugguacuucuggcagaagaagaagcagcgcagcggcguccugugggacacccccucuccgcccgaaguggaacgggcagugcucgacgacggcaucuaccgcauccuacagcggggcuuguuagggcgcucccaggucgggguggggguguuccaagacgguguguuucacacgauguggcaugugacccgcggagccgugcucauguaucagggcaagcggcuagagcccagcugggcaagcgugaaaaaggaucugaucucauacgguggcggcuggcgguuccagggauccuggaacaccggcgaagagguccagguuauugcgguggagcccgggaagaacccgaagaacgugcagaccacgccggggaccuuuaaaacccccgagggcgaggugggggcaaucgcccucgauuuuaagcccggaaccaguggguccccgaucgucaaccgcgagggaaaaaucguuggguuguaugggaacggcguaguaacgaccaguggcacguacgugucagccaucgcccaggcaaaagccagccaggagggcccccugccggagauugaagaugagguguucaagaaacggaaccucaccauuauggacuugcacccggggaguggcaaaacccgccgguaccugccugccaucgucagagaggccauaaagcggaagcuccgaacgcugauacuggcgcccacccgggugguggcauccgagauggccgaggcccucaagggcaugccaauccgcuaccagaccacggccguuaagucggagcacacuggccgcgagauuguggacuugaugugccacgcgaccuucaccaugcgguuguuguccccggugcggguccccaauuacaauaugaucaucauggacgaggcacacuucacggaccccgccucuauagccgcccgcgguuacauuucuacgcgcgucgggaugggcgaagcggcggcuaucuucaugacugcuacuccgccggguagcguggaggccuucccacaguccaacgcgguuauacaggacgaggagagagacauccccgagcguagcuggaacuccggcuacgacuggaucacggacuuucccggcaagaccgugugguucgugccgagcaucaaguccgggaacgacaucgccaacugccugcggaaaaacgguaaacgcguaauccaguugagccggaagaccuucgacaccgaguaccagaagacgaagaacaacgacugggacuacguggugacuaccgacauauccgagaugggggcuaacuuccgagccgcgcgggucaucgacccacgacggugccucaagcccgugauucugaaagacggcccagaacgcgugauccuggccgggccgaugcccgucaccgucgccucugccgcacagcggcguggcaggaucgggcgcaaucagaacaaggagggggaccaauacguguacaugggacagccccuaaacaacgacgaggaccacgcgcacuggacggaggccaaaaugcugcuggacaacaucaacacccccgaggggaucauacccgcccucuucgaacccgaacgggaaaaguccgccgccauagacggcgaauaccgucuacggggggaagcgaggaagaccuucguugaguuaaugcgacgcggcgaucucccgguauggcugagcuacaaggucgcauccgagggcuuccaguauucugaccgacgaugguguuucgacggggagcgcaacaaucaggugcuggaggagaacauggauguugagaucuggacgaaggagggcgagcggaagaaguugaggccccgguggcuggacgccaggaccuacagcgacccgcuggcacuccgagaguucaaagaguuugccgcgggccgccggagcgucucgggggaccugauacuggagaucggcaaguugccccaacaccucacgcugcgcgcccaaaacgcgcucgacaaccuggugauguuacacaacuccgagcaaggcgggaaggccuaccggcaugcgauggaggagcuccccgacacaaucgagacccugaugcuccucgcccugauagccguucugacagggggcgucacucucuucuuccucagcggcaagggccucggcaaaacaagcaucgggcuccugugcgugaccgcaagcuccgcacugcucuggauggcgagcguggagccccacuggaucgccgccuccaucauccuggaguuuuucuugauggucuugcugaucccggagcccgaccgccaacggacaccacaggacaaccagcuggccuacguggugaucggccuccuguucaugauccugacggucgccgcgaacgagaugggacuccuagagaccaccaagaaggaccuuggcaucgggcacguggccgccgagaaccaucagcacgccacaaugcucgacguggaccuucgaccggccucagccuggacgcuguacgccgucgcgaccacagugaucacccccaugaugaggcauacgaucgagaacacgaccgccaacaucucccuuacggccaucgcgaaccaggccgcuauacuaaugggauuggacaagggcuggcccaucagcaaaauggauauaggcgugccacuccuggcgcugggaugcuacucccaggucaacccgcucaccuuaaccgcagcagugcuuaugcucguggcacauuacgccauaauugguccaggccuccaagccaaggcgacccgcgaagcccagaagcgaacggcggccgggauaaugaaaaaccccaccguugacggcaucgucgcaauugaccuggacccugucgucuacgaugcgaaauucgagaaacagcucggccagaucaugcugcugaucuuaugcacgucccagauccugcugaugcgcacaacuugggcccucugugaguccaucacgcuggccacugggccguuaacaacgcucugggaaggcagccccgggaaauucuggaacacgaccauagccgugucuauggcgaacaucuuccgcggcagcuaccuggcgggcgcgggccuggcauucagcuugaugaagagccugggcgggggccggcgcgggaccggagcucagggcgagacccugggcgagaaguggaaacgccaacugaaucaguuaaccaaauccgaguucaacacauauaagagaagcggcaucauggaaguugaccgaucugaggcgaaagaggggcuaaagcgcggcgagaccaccaagcacgcagucucccgcgggaccgcgaagcuuaggugguucguugagcgcaaccuagugaagcccgagggaaaggucaucgaccuuggcugcgggcgcggcggcuggagcuacuacugcgcaggccugaagaaggugacggaagugaagggguacaccaagggcggcccggggcaugaggagccgauccccauggcgacguacggcuggaaccugguaaagcuacacuccgggaaggacggguucuuuaugccgcccgaaaagugugggacuuugcucugcgauaucggagagagcuccccgaaccccacaauugaggagggccgaacccuccgugugcugaaaaugguagaacccuggcuccgcgguaaccaguucugcauaaagauccugaaccccuacaugccgagcgugguagagacacuggagcagaugcagcgcaagcauggcggaauguuggugcggaacccgcugucacguaacagcacccacgaaauguauuggguauccugcgggacaggcaauaucguauccgcgguuaacaugacgucacgaaugcugcucaaucgcuucacgauggcccaccggaaaccgacguacgaaagggacgucgacuugggcgccggcacgcgccauguggccguggagcccgaggucgccaacuuggauauuauaggccagcggaucgaaaacaucaagaacgaacauaagagcaccuggcacuacgacgaggacaaccccuacaagaccugggcuuaccauggauccuacgaggugaagcccucugggucggcgagcucuauggugaacggagucgugcggcuccugaccaagccuugggaugucauccccauggucacgcagaucgcgaugaccgacacgacaccguucggacaacagcggguguucaaggagaaggucgacacgcgcacgccccgggccaagcgcgggacuacucagaucauggaagugacagccaaguggcucuggggcuuccucucacggaacaagaagccccgcaucuguacccgggaggaauucacacguaaaguucgaucaaacgcagcuauuggggccgucuucguggaugagaaucaguggaacucagcuaaggaagcaguggaggacgagcguuucugggaccugguacaucgagagagagagcuacauaagcagggcaaaugcgcgaccugcguauacaacaugauggggaaacgcgagaagaaguugggcgaguucgguaaggccaaggggagccgcgccaucugguacauguggcugggcgcgcgguucuuggaguucgaggcucuuggguucaugaacgaggaccacugguucucacgcgagaacucgcugaguggcguggaaggggagggccugcacaagcucggauacauccuacgggacauaagcaagauuccuggcgggaacauguacgccgacgacacggccgggugggacacccgcauaacugaggaugaucugcagaacgaagcuaaaaucaccgacaucauggagcccgaacacgcccuccuggcgacgaguaucuucaagcugacuuaccagaacaagguaguucggguccagcgacccgccaaaaacggcaccgucauggacgucaucagccgccgagaccagcgcggcucgggacagguaggcacguacggucucaauacguuuacuaacauggaaguccaguugauccggcagauggaaucagaggguaucuuccugcccuccgagcucgagaccccuaacuuagccaagcgcgugcuggacuggcucgaaaagcacggggccgagcggcugaaacgaauggccaucucuggcgacgacugcguuguaaagcccaucgacgaccgauucgcgaccgcccugaccgcccucaaugacaugggaaaggugcguaaagacaucccccagugggagccuagcaagggguggaacgacuggcagcaggucccguuuugcagccaucauuuccaucagcugauuaugaaggacggccgggagauaguugugccaugccgcaaccaagacgagcuggugggucgggcccgcgucucccagggcgccggauggagcuugcgggaaacggcaugccuggggaagucauaugcccagauguggcagcugauguacuuccaccgccgggaccuucgccuggccgccaacgcuauuugcagcgcggugccaguggacuggguccccaccucgcguaccaccuggaguauccacgcccaccaccaauggaugacgaccgaagacaugcuguccguuuggaaccgcguuuggaucgaggaaaacccguggauggaggacaagacacacgucuccagcugggaggagguucccuacuuaggcaagcgggaggaccaguggugcggcucauuaaucggccuuaccgcucgcgcuacgugggccacaaacauccagguggccauuaaccagguacgccgucugaucgggaacgagaauuaucuugauuacaugacgagcaugaagcgcuucaagaacgaguccgaccccgaaggcgcgcugugguga

SEQ ID NO: 23955 - RNA, 9879 nt, Artificial Sequence
  derived and/or modified CDS sequence (opt11) from DENV-1__EU596503__SS-prME
agcgugaccaugcuccucauguuacugcccacugcccucgccuuucaccugaccaccagaggcggggagccccacaugaucguaagcaagcaggagcggggcaagagccuccuguucaagaccagcgcgggggugaacaugugcaccuuaaucgccauggaccuaggcgaacuuugcgaggacaccaugaccuauaagugcccccagauuacggaagccgagcccgaugacgucgacugcuggugcaaugccaccgacaccugggugaccuacgggaccugcagccagacgggcgagcaccggcgagacaagcgcuccguggcccuggccccccacgugggccuaggccucgagacgcggacagagaccuggaugagcuccgagggcgccuggaagcagauacagcgcgucgagaccugggcccugcggcaccccggguuuacggugaucgccuuguuccucgcgcacgccaucggcaccagcaucacccagaaggggaucaucuuuauucugcugaugcuugugacccccuccauggccaugcgcugcgucggcauuggcaacagagacuucguggaggggcugagcggcgccacguggguggacgucgugcuagagcacggguccugcgugacaaccauggccaagaacaagcccacccucgacaucgagcugcugaagacggaggucaccaaucccgcgauccucagaaagcugugcaucgaggccaagaucagcaacaccaccacagacucccgaugcccgacccagggagaggccacccuuguggaggagcaggacgccaacuucgugugccgccggaccuucgucgaccgcggcugggggaacggcuguggccucuucggcaaggggagccugcugacgugugccaaguucaagugcgugaccaaacucgaagggaagauagugcaauacgagaaccugaaguacagugucaucguuaccgugcacaccggcgaccaacaccaggucgggaacgagacgaccgagcacggcaccauagcgaccaucacgccacaggcccccaccucagagauacagcugaccgacuauggggcccucacccuggacuguagccccagaaccggccuggacuucaacgaaaugguacuccugacgaugaaggagaaguccuggcugguucacaagcagugguuucucgaccugccgcugcccuggaccuccggggccagcaccagucaggagaccuggaaccgccaggaccuccuggugacguucaagacggcccacgcuaagaagcaggagguggucgugcuggguagucaggaaggcgccaugcacaccgcucucaccggggccacggagauccagaccagcggcaccaccaccaucuucgccgggcaccugaaaugccgcuuaaagauggauaaguugacccugaagggcaccagcuaugugaugugcauagggucuuucaagcucgaaaaggaggucgcggaaacccagcacggcacggugcuggugcaggucaaguacgagggcaccgacgccccuugcaagauucccuucuccacccaggacgagaagggggugacucagaacggccgccuuaucacggccaacccgauagugaccgacaaagagaagcccgucaacaucgagaccgagccgcccuucggugagagcuauaucguugugggcgccggcgagaaggcgcugaagcuguccugguucaaaaaggggucuuccaucgguaaaauguucgaggccaccgcccgcggcgcccgccggauggccauacucggcgacacugcgugggacuucgggagcaucggaggcauguucaccuccgucgggaagcuggugcaccagguguucggcaccgcuuacgggguccuguucagcggcguguccuggacaaugaagaucgggaucggcauccuccugacguggcugggccucaacagcagguccaccaguuuguccaugaccuguaucgcugugggcauggucacccuguaccucggcgugauggugcaggcugacagcgggugcgucauuaacuggaagggucgcgagcugaaaugcggguccgggaucuucgucacgaacgaggugcacaccuggaccgagcaguacaaguuccaggccgacagcccgaaacgucugagugcggcgaucggcaaggcaugggaggagggggugugcggcauccgcuccgccacccggcucgagaacauaauguggaagcagauuuccaacgagcugaaucacauacuguuagaaaacgacaugaaguuuaccgugguggucggggacgccaacgggauucuggcgcaggggaaaaagaugauccgcccccaacccauggaacacaaguacuccuggaaguccugggguaaggcuaagaucaucggugccgacauccagaacacgacguucaucaucgacgggcccgacaccccggagugccccgauaaccagcgggcauggaacaucugggaaguggaggauuacggcuucgggaucuucaccacgaacaucuggcugaaguugcgcgacuccuacacccagaugugcgaccaccggcugaugagcgcggccaucaaggauucgaaagccgugcacgccgacaugggcuacuggaucgagagcgagaagaacgagaccuggaagcuggcacgagcuucauucaucgaggucaagaccugcacguggcccaagucucacaccuuaugguccaacggugugcuggagucagagaugauaauccccaagaucuacgggggcccuaucucgcagcacaacuacaggcccggguacuucacacaaacugccggccccuggcaccuggguaagcucgagcuggacuucgaccugugcgagggcacuaccguggucgucgacgagcacuguggcaaccgcgggccgagccuucggaccaccacggugaccggcaagaucauccaugaauggugcugccgcuccuguacccugccgccccugcgguuccgcggggaggacggcugcugguacgggauggagauccggcccgucaaggagaaggaagagaaccucgugcgcagcauggugucggccgggagcggcgaggucgacucguucuccuuaggcauacugugcgcuagcaucaugaucgaggaggugaugcggucccgcuggagccggaagaugcucaugaccggcacacuggccguguuccugcuccuuauaaccgggcagcugacguggaacgaccucauccgccugugcaucaugguuggcgcgaacgccuccgaccgcauggggaugggcacgacauaccuggcgcugauggcgaccuuuaagaugcggccgauguucgccgugggacugcuguuccgccggcucaccucacgcgaggugcugcugcucaccaucgggcugucccuggucgccagcguugagcuccccaacucccuagaggagcugggcgacgggcucgcgaugggcaucaugaugcucaagcugcucacggaguuccaaccucaccaacuuuggaccacccugcucagccugaccuucauaaagacgacccugucccucgacuacgccuggaagacuaccgccauggcgcugucgauugugucccuguuccccuugugccuaagcacgaccucccagaaaaccacauggcugccugugcuccuuggcagcuuuggaugcaagccccugaccauguuccucaucacggagaacaagauuuggggccggaaauccuggccccugaaugaggggaucauggcaaucggcauugugucgauccugcugucgucgcugcugaagaacgacgucccccucgccggaccgcugaucgcuggcggcaugcuuaucgccugcuacgugaucagcggguccagcgcggaccucucccuggagaaggccgccgaagugagcugggagcaggaggccgagcacuccggcaccagccacaacauccuagucgagguacaggacgacgggaccaugaagaucaaggacgaggagcgcgacgacacccucacgauccuucugaaggccacccuccuggcggugaguggcgucuaccccaugagcauccccgcgacccuuuucgugugguacuucuggcagaagaagaaacagcguuccgggguccucugggacacccccagcccgccugaggucgagcgcgccgugcuugacgauggcaucuaccggauccugcagcgcggccugcucgggcggucccaaguuggcgucgggguguuccaggacggcguguuccacacgauguggcacgucacgcgcggggccgugcuaauguaccagggcaagcggcuggaacccagcugggcguccgugaagaaggaucucauuagcuacggcgggggcuggcgcuuccaggggagcuggaacacgggcgaagagguucaggugaucgcgguggagcccgguaagaacccgaagaauguccagaccacgcccgguaccuucaaaacccccgagggcgaggugggggccaucgcccuagacuucaagcccggcaccagcgggucgccgaucgugaaucgggagggcaaaaucgucggccuguacgggaacggagugguaacgaccagcgggacuuacgucuccgccaucgcccaggcgaaggccagccaggagggcccccuccccgagaucgaggacgagguguucaagaagcgcaaccugaccaucauggaccugcacccggggagcggcaagacacggcgcuaccucccagccaucgugcgggaggccaucaaacgcaagcugcggacccugauccuagcgcccacccgcgucguagccuccgagauggcagaggcccuaaagggcaugcccauccguuaucagaccacggcggucaagucggaacacaccgggcgggagaucgucgaucugaugugccacgcgaccuuuacaaugaggcuccuguccccggugcgggugccaaacuacaacaugaucaucauggacgaagcccacuucacggaccccgccagcaucgcagcccgcggcuauaucuccacccgggucgggaugggcgaagcggcugcgaucuucaugaccgccacgccgcccgggagcguggaggccuucccccaguccaacgcgguuauccaggacgaggagcgagacauacccgagcggagcuggaacuccgguuacgacuggaucacugacuuccccggcaagaccgucugguucgugcccagcaucaaauccgggaacgacaucgccaacugccugcgcaaaaacgguaagcgggugauccaguugagccgcaagacauucgacaccgaguaccagaagacgaagaacaacgacugggacuacguaguaaccacugacaucagcgagaugggggccaacuuccgggccgaccgcgugaucgacccccgccgcugccugaagcccguaaucuuaaaggacggcccagagcgggugauccucgcggggccgaugcccgugaccgucgccagcgccgcccagagacggggccgcauaggcagaaaccagaacaaggagggggaccaguacguguacaugggccagcccuuaaacaaugacgaagaccacgcccacuggaccgaggcgaagaugcugcuggacaacaucaacacucccgaggggaucaucccggcccuguucgagcccgagcgcgagaaguccgccgccaucgacggcgaguaccgccuccgcggggaggcccguaagaccuucguggagcucaugcgccgcggcgaccugccagucuggcugagcuacaaaguggcguccgagggcuuccaguacucagaucggcgauggugcuucgacggggagcggaacaaccagguccucgaagagaacauggacgucgagaucuggaccaaggagggagagcgcaagaagcuccggccccgcuggcuggacgcccggaccuacuccgacccguuagcccugagagaguucaaggaguucgcggccgggcggcguagcgugagcggcgaccugauccuggagaucggcaagcugccucagcaccugacgcuccgggcgcagaacgcccuggacaaccuugugaugcuccacaacuccgaacagggcgggaaggcuuaccgccacgccauggaggagcugcccgacaccaucgaaacccuuaugcuccuggcucugaucgccgugcucaccgggggcguuacgcuguucuuucugagcgggaagggucucggcaagaccuccaucggguuguugugcgugaccgccagcuccgcccuccuguggauggccucuguggaaccccacuggauugcggccuccaucauccuggaguucuuccucauggugcugcugauaccggagcccgaccggcagcggacgccccaggacaaucaacucgccuacgucgugauuggccugcuguuuaugauucucacgguggccgccaacgaaauggggcugcuggagaccaccaagaaggaccucggcaucgggcaugucgcggcggagaaccaccagcacgccaccaugcuggacguggaccuccggccggccagcgccuggacccuuuacgcuguggccaccaccgugaucaccccuaugaugcgccacacgaucgaaaacacgacggccaauaucucccuaacagccaucgcaaaccaagccgccauccugaugggccucgacaagggguggcccaucagcaagauggacauaggggugccucugcuggcguugggcugcuacucccaggugaacccgcucacgcugaccgccgcgguccucaugcugguggcccacuaugcaaucaucgggccuggacuccaggccaaggcuacccgggaggcgcaaaaacgcaccgcggccgguaucaugaagaaccccacgguggacggcaucguggccaucgaucucgauccagugguguacgacgccaaguucgagaaacagcugggccagaucauguugcuuauccugugcaccagccagaucuugcucaugcgcacuaccugggcacugugcgaguccaucacucuggccacggggccgcucacgaccuuaugggagggaagccccgggaaguucuggaacacgaccaucgccgucuccauggccaacaucuuccggggcagcuaccuggcaggcgcggggcucgccuucucccugaugaagucccucggcggaggccgccgggggaccggagcccagggcgaaacccucggggagaaauggaagcgccaacugaaccagcuguccaaaagcgaguucaauacguacaagcggucuggcaucauggagguggaccgcuccgaggcuaaggaggggcucaagagaggcgaaacaaccaagcacgcugucagccgcgggaccgccaagcuucggugguuugucgagcgaaaccugguuaaacccgagggcaaggugaucgaccucggaugugggcggggcgggugguccuacuacugcgccggccucaagaaggucacugaggugaaaggguacacgaagggcggccccggccacgaggagccgauucccauggccaccuacggguggaaccuggugaaacugcacagcgggaaggacgucuucuucaugccgccggagaagugcgacacccuccugugcgacaucggcgaauccagcccgaaccccaccauagaggaggggcgcacgcuacgggugcucaagaugguggaaccguggcugcgcggcaaucaguucugcaucaagauccuaaaccccuacaugccguccgucguggagaccuuagagcagaugcagcggaagcacggugggaugcuggugcgcaacccccugagccggaacuccacucacgagauguacugggucagcugcggcaccggcaacaucguguccgccgugaacaugacgagucgcauguugcuaaaccgguucacuauggcgcaccgcaagcccaccuacgagcgcgacgucgaccugggagcgggcacaagacacguggccguggagcccgagguggcaaaccucgacaucaucggucagcgcaucgaaaacaucaagaacgagcacaaguccacguggcacuacgaugaggacaacccguauaaaaccugggccuaccacggcucuuacgaggugaagcccuccgguagcgcgaguagcauggugaacggcgucguacggcugcugaccaagcccugggacgugauccccauggucacccagaucgccaugacggacaccaccccguucgggcagcagcgcguuuucaaggaaaaggucgacacccggacgccccgcgccaaacggggcaccacccaaaucauggagguaaccgccaaguggcucuggggcuuccugucccgcaacaagaagccccggauauguacgagggaggaauucacccggaaggugagaagcaaugccgcuaucggggccgucuuuguggacgagaaccaguggaacagcgccaaggaggccgucgaggaugagcgguucugggaccugguccaccgcgagcgggagcuccacaagcaaggcaagugcgcgaccugcguguacaacaugaugggaaagcgcgaaaagaagcugggcgaauuugggaaggccaagggcucacgugccaucugguacauguggcugggcgccagauuccucgaguucgaggcccugggguucaugaacgaggaucacugguucagccgggagaacucccugagcggcguggagggggagggcuugcauaagcuaggguacauacuacgcgacaucuccaagauaccgggggguaacauguacgccgaugacaccgccgggugggacacgcggaucaccgaggacgacuuacagaaugaggccaagauaaccgacauaauggagcccgagcacgcccuguuagcuaccucgaucuucaagcucacguaccagaacaaggucguucgcgugcagcgccccgcgaagaacggcaccgucauggaugugaucucccggcgcgaucagcgcgggagcggacaggugggcaccuacggacugaacaccuucacgaacauggagguccagcuaauacgccaaauggaauccgagggcaucuuccuucccagcgagcuggaaaccccuaaucuggccgaacgggugcuggacugguuagagaagcacggggccgaaagguuaaagcggauggccaucuccggcgacgacugcgucgucaagcccaucgacgaccgcuuugccaccgcacuaaccgcucugaacgacauggggaagguccggaaggacaucccccaaugggagcccagcaagggcuggaacgacuggcagcaggucccguucugcucccaccacuuccaccagcugaucaugaaggacggacgcgagaucgucgugcccugccguaaccaagacgaacucgugggccgcgcacgugucucccagggcgccggguggucgcugcgcgagaccgccugccugggcaagagcuacgcccagauguggcaguugauguacuuccaucgucgcgaccugcggcuggccgccaacgccaucugcuccgcggugcccguggauugggucccuacgagccgcaccaccuggagcauccacgcccaccaccaauggaugaccacggaggauaugcuuuccguauggaaccggguguggaucgaggagaacccuuggauggaggacaagacccacgucagcucgugggaagaggugcccuaccuggggaagcgcgaggaccagugguguggcagucugaucggccucacggcccgcgcgaccugggccacgaauauccagguggcgauuaaccaggugcggcgccugaucgggaacgagaacuaccuggacuacaugaccagcaugaagcgguucaagaacgaguccgacccugagggcgcccucugguaa

SEQ ID NO: 23956 - RNA, 9879 nt, Artificial Sequence
  derived and/or modified CDS sequence (opt11) from DENV-1__FJ024479__SS-prME
agcguaacgaugcuccuuauguugcucccgaccgcacuggcauuccaccugaccacacgcgggggagaaccccauaugauugugagcaagcaggaaagaggcaaaucgcugcucuuuaagacaagcgcaggagucaacaugugcacacucauugcgauggaucucggggaacuaugcgaagacacaaugaccuacaagugcccacaaaucacagaagccgaaccggacgaugucgacugcuggugcaacgcuacggauaccugggugaccuacgggacauguagccaaaccggagaacaccggcgggacaagaggucgguagcccuagcgccacauguagggcugggacucgaaacgcgaaccgaaacauggaugagcucggaaggcgccuggaaacaaauccaacgaguagaaaccugggcccuccggcauccgggguucacggugaucgcccuguucuuagcccaugcaaucggaacgagcauaacacaaaagggaaucauuuucauccuccucauguuggucacgcccaguauggcaaugagguguguggggauagggaaccgcgauuucguugaaggccugucaggagcaacauggguagaugucguacuggaacacggcucaugcgugacuacgauggccaaaaacaaaccaacucucgacauagaauuauugaaaacggaagucacaaacccagcaauuuuacgcaaacuauguauagaagccaaaauaucaaacaccaccaccgacagccguugucccacacaaggggaagcgacccucguagaagaacaagacgccaacuucgucugccgucgaacauucguagaucgcggcugggggaaugggugcgggcuauucggaaaggggagccuacuaaccugcgccaaauucaagugcguaaccaagcuagaagggaagauaguccaauacgaaaaccuaaaguacuccguaauaguaaccguacauacuggagaucaacaccagguggguaacgaaacaacagagcacggcaccaucgcaacaaucaccccgcaagcucccaccucggagauucaacugacugauuacggagcccuaacgcuugacugcucuccaagaaccggguuagacuuuaacgagaugguacugcugacgaugaaagaaaagaguuggcuaguccauaaacaaugguuccucgaccuaccccucccguggacgagcggagcgucaaccucacaagaaacguggaaccgccaagaccugcuggucacuuuuaaaacagcccaugcuaagaaacaggaagugguaguacuaggaucccaagaaggugccaugcacacugcgcucacgggggcgaccgaaauccaaaccucgggcacgacuacaaucuucgccggacaccugaagugccguuuaaaaauggacaagcuaacacugaaaggcaccucguacgugaugugcaccggcucguuuaaacuggagaaagaagucgccgagacucaacacgguaccguacucguccaaguuaaguacgagggcacugacgcaccgugcaaaauaccuuucucaacucaggacgaaaagggggucacgcagaaugggcggcucaucacagcaaacccuauugucacagacaaggagaaaccggucaacaucgaaaccgaaccgccguuuggcgagucauacauaguggugggcgcaggagaaaaagcgcucaaacuuucaugguucaaaaagggcuccagcauagggaaaauguucgaagcaacagcacggggagcacgaaggauggccauacugggugauacagcgugggacuucggcaguauuggcggaguauucacaagcgugggcaagcugguucaccaagucuucggaaccgcauacggaguacucuucucgggggugagcuggacaaugaaaaucggcaucgguauacuccuaacguggcuaggacugaacuccagaagcacgucccugagcaugacaugcauugccguaggcaugguaacccuauaucucggagugaugguccaggccgacaguggaugcgugauuaauuggaaaggcagggagcucaaauguggcucaggaauuuucgucacgaacgaaguucacacguggacagaacaauacaaguuccaggccgacagcccgaagagacucuccgccgcaauuggaaaagcgugggaggagggcguaugcgggauacgaagcgcaacuagacucgagaacaucauguggaaacaaauaagcaacgaacugaaccacauauuacuugaaaacgacaugaaguucacagucguaguaggggaugcaaacggcauacuagcccaaggcaagaaaaugauuagaccacaaccuauggaacauaaauacaguuggaaaagcuggggaaaagcaaaaaucauaggugcagacauccagaacacuaccuucaucaucgacggaccagacacuccggagugcccggacaaucagcgagcauggaauaucugggagguggaagacuacggguucggauucuuuaccacgaacaucuggcuaaagcugcgugacagcuacacucaaaugugcgaucaucgacuuaugagugcggcaaucaaagacagcaaggccgugcacgcugacaugggauauuggaucgaaucagagaaaaacgagacuuggaaauuagcacgagcgaguuucaucgaggugaagacguguaccuggccuaaaucccacaccuuauggucgaacgggguacucgaaucggagaugauaauccccaaaauauacgggggaccgauaucucagcauaacuaccgcccugguuacuucacccagacagcaggcccauggcaucuaggcaaacucgagcuagauuucgaucugugcgaaggaacaacugucguaguagaugaacauuguggaaaucggggcccaucacucagaacaacgaccgucacaggaaagauuauacacgaaugguguugccguucuugcaccuugccuccacuccguuuccgcggagaagacggcuguugguacgguauggagauaagacccgucaaggaaaaagaggaaaaucucgugcgaucaauggugagcgcgggcagcggagaaguugauucuuucagccucggaauacuaugcgcuaguaucaugaucgaggaagucaugcgaucacgcuggucucggaaaaugcugaugaccggcacacuggccguauuucuccuucuuauaaugggacaacugacauggaacgaccuuaucaggcuaugcauuauggucggcgccaacgcaagcgaccgaauggggaugggcaccacuuaccucgcacuuauggcgaccuucaagaugcggccgauguucgcggugggcuuacuuuuccgacgacuuaccucgcgggaaguacuccuccuaaccaucggucugucccucgucgcauccgucgagcuaccaaacagucucgaagaacucggcgacggacuagcaaugggaauaaugaugcuuaagcuacucacggaguuucagccgcaccaauuauggacaacccuguugucacucaccuucaucaaaacgacauugucccuagacuaugcauggaagaccgcggcgauggcucugagcauaguaucacuguucccacuaugccucucaaccacaucgcagaaaacgaccuggcugccaguauuauuaggcucauucggcugcaagccauugaccauguuccugauuacagaaaacaaaauuuggggcaggaagaguuggccgcuaaacgaagggaucauggcaaucgggaucguaagcauacuacugucuucucuccugaagaacgacgugccuuuagcuggaccccuaaucgcugggggcaugcugauagccugcuauguaaucagcggcucaagugcggacuuaagccucgaaaaagccgcggaagucucgugggaacaggaggcggaacacagcggcacaagucauaacauacucguggaggugcaagacgacggcacaaugaagaucaaagacgaggagcgagaugauacacuaaccauacuucucaaagcuacuuuacuugccgucuccggcgucuauccgaugagcaucccagccacgcuauucguaugguacuucuggcagaagaaaaagcaaaggagcggcguacugugggacacccccaguccaccagaaguagaacgagccguccuagacgacggaaucuauaggauccuucagcgaggccuacuggggagaagccaagucggcgucgggguuuuccaggacgggguguuucacacaauguggcauguaacucgcggcgcaguucucauguaucaagggaagcgacucgaaccgagcugggccagcgucaaaaaggaccuaauuuccuacgguggugguuggcgauuccaaggauccuggaacaccggagaagagguacaaguaauagcaguagaacccggcaaaaacccgaagaacguccagacgacaccagggacguucaaaacccccgaaggggagguuggagccaucgcgcucgacuucaaaccggguaccagugguucgccuaucgucaaccgcgagggaaaaauugucggccuguauggaaacggggucguaacuacuucuggaacauacgugagcgcgaucgcacaggcaaaggcgagccaggaaggaccacuccccgaaauugaagacgagguauuuaagaaaagaaaccugacaaucauggaccuccaccccggaucaggcaaaacacgucgauaucuacccgccaucgucagagaagcaauaaaacgaaagcucagaacgcucauacuagccccuacgcgagucguagcaucggaaauggcugaggcgcuuaaaggcaugccuauaagguaccagacuaccgcagugaaguccgaacacacuggaagagaaauaguggauuugaugugccacgccaccuucacgaugcgccuccugagcccaguccgcgugcccaacuacaacaugauaaucauggacgaagcacacuucacagaccccgcaagcauagcugcacgcggcuacauaucuacccgaguaggaaugggcgaggcugccgccauauuuaugaccgccaccccuccgggcaguguggaggcauucccucaaaguaacgcaguaauccaagacgaggagcgcgauaucccagagcgcagcuggaacucaggcuacgacuggauuacugauuucccuggcaagaccgugugguucguuccauccaucaaaaguggaaacgauauagccaauugucucaggaaaaacgggaaacgcgucauucaacuaagcagaaaaacguucgacaccgaguaucagaaaaccaaaaacaacgacugggacuacguaguuacaacggacaucuccgaaaugggugcaaacuucagagccgcgagagucaucgacccgcgacgcugccugaaaccgguaauccucaaggaugggccggaaagggugauauuagcgggcccaaugccaguaacaguagcgucggcagcgcaacgacgaggaagaauuggaagaaaccaaaauaaagaaggugaccaguacgucuacaugggucaaccgcuuaacaacgacgaagaccaugcccacuggaccgaagcaaaaaugcuccucgacaacaucaccacaccagaagggauuauuccggcgcuguucgaaccagaacgggaaaaaucagccgcgaucgacggugaaagccgcuuacgcggagaaccaagaaagacuuucguagaacucaugcgccgcggggaccugccaguguggcuaagcuacaaaguggcaagcgagggguuccaauacuccgauagacgauggugcuuugacggagaacgaaacaaccaagugcuagaagagaacauggaugucgaaauauggccgaaggaaggcgagaggaagaagcuacgaccaagauggcuagacgcacgcaccuacagugauccgcuagcgcuaggggaguuuaaagaguucggagccgggcggagaagcggcucgggagcccugauccucgagauaggaaaacucccccaacaccucccgcuacgggcacagaacggccuugacaaccuagucaugguucacaacagcgaacaaggcggaaaggcuuaccgacacgccauggaggaacucccugacaccauagagacacucauguugcuagcguuaaucgcggucuuaacaggaggcguuacccuguucuuccuguccggaaaaggacuaggcaagacguccauagggcuccuaugcguaaccgcaaguucagcccuucuauggauggccagcguagaaccccacuggauagcggccucgauaauacuugaguucuuucuaaugguacuacuaaucccagagcccgaccggcaacguacaccccaagauaaucagcuggccuacgugguaauaggucuacuuuucaugauccugacgguugccgcgaaugagaugggacuccuugaaacaacgaagaaagaccucgguauaggucacguagcugcagaaaaccaccaacacgcaaccaugcuggacguagaccuaagaccugcgagugcguggacccuauaugcgguggcaacgacggucaucacuccaaugaugcgacauacaauagaaaacaccacagccaacauaucgcucacggcgauagcaaaccaagcggccauacugaugggccuagcgaagggcuggccaaucucaaaaauggacauaggaguaccacugcuugcauugggaugcuauagccagguaaacccacugacacugacagccgcaguacugauguuaguagcacacuaugcuauaaucggacccggacuccaggcaaaggcgacaagggaagcccaaaaacggaccgcugcaggcauuaugaaaaaccccacaguugacggaaucgucgcgauagacuuagacccaguugucuaugaugcaaaauucgaaaagcagcugggacagaucaugcuacugauucuguggacaagccaaauauugcuuaugcgaaccacaugggcccucggggagagcaucacgcuggcgacuggcccuuuaacuacucugugggaaggcagcccggggaaguucuggaacacgacaauugcggugagcauggccaauaucuuccgugguagcuaccuggcgggagccggguuggcuuucucucuuaugaaaagccuagggggcggacgcagaggaacaggggcacagggagaaacgcucggcgaaaaauggaaaaggcaauuaaaccaacugucgaagucggaguucaauacguacaagcgcagcggcaucauggaagucgauaggucggaggccaaagaaggacuuaaacggggagagacaacaaagcaugccgugucccgaggaacggccaaacuccggugguucguugagagaaaucuaguaaauccugaaggcaaggugaucgaucuaggcugcgggagaggcggauggaguuauuauugugcaggacucaaaaaggucaccgaagugaaaggguauacaaaaggcgguccaggacacgaggaaccaauuccgauggccaccuacggauggaaccuugucaaacuccauuccggcaaagacgucuucuucaucccacccgaaaaaugcgacacccuccuaugcgauauaggagaaucaagcccaaaccccacgauugaggaaggccgcacccuacgcggccucaaaaugguggagcccuggcuccggggcaaccaguucugcauuaaaauccuaaacccauauaugccaagcguuguagagacauuagaacaaaugcaacguaagcacggcgggaugcucguaaggaacccgcugagccgaaacucaacacacgagauggacugggucuccugcgguaccgguaacauaguuagugccgugaacaugacaucacgcaugcuacucaaccgguucacaauggcgcauagaaaaccuacguacgaacgggacgucgaccuaggagcugguacccgccauguggccguggagccggagguggccaaucuagacaucaucggccagcgaaucgagaacauaaagaacgagcauaaaucaaccuggcacuacgaugaggacaauccauacaagaccugggcuuaccacggcagcuacgaaguuaagccuucagggucggccagcuccauggugaacggagugguccgacuccuaacgaaaccaugggacguuauaccuaugguaacacagaucgcaaugacggacacgacgccauucggacaacaaaggguuuucaaggaaaaaguugacacccgaacucccagagcaaaacgaggcacaacacagauaauggagguaacagcaaaguggcuguggggauuccucucucgaaauaagaaaccacgcaucugcacucgcgaagaauuuacccgaaaaguccgcucuaacgcggcuauuggcgcgguuguagucgaugaaaaccaauggaacagugccaaagaagcaggggaggacgaaagaguaugggaccugggcgacagagagcgcgagcugcauaagcaagggaaaugcgcaacaugcggguauaacaugaugggcaagagggagaagaaacucggcgaguucggcaaagcaaaagggucgcgcgccauuugguacauguggcugggcgcacgauuucuggaguucgaagcgcuaggguucaugaaugaagaucauugguucucgagagagaauagccucuccggggucgaaggagaaggccuacacaaauugggauacauauuaagggauaucucaaagauccccggcgggaacauguaugccgaugacacagcgggcugggacacacggauuacggaagaugaccuacaaaacgaggccaagauaacagauaucauggaaccugaacacgcccuccuugcuacauccauauucaaacugacguaccagaacaagguugugcgcguccaacgaccagcaaagaaugguacagugauggacguaaucagcagacgugcucaaagaggcagcggccaggucgggacguauggccuuaauacuuucaccaauauggagguacaacucauccggcagauggagucggagggcaucuuucuaccgucagaacuugagaccccgaaucuagcggaacggguacucgacuggcucgaaaaacacggagcagagaggcuaaagcgcauggcgauaucaggggacgacugcgucguaaagcccaucgacgauagguucgcaaccgcccuaaccgcccugaacgacaugggaaaagugagaaaggacauuccccaaugggagcccagcaaaggguggaaugauuggcaacaaguggcauuuuggucacaucauuuucaccaacuaauaaugaaggacgggcgggaaauuguagucccauguagaaaccaagacgagcuagggggaagggcccgcgugucucaaggcgcaggcuggucccuacgagaaacggcaugccucggaaaauccuaugcacagauguggcaauuaauguacuuccaccgaagagaccuccgccuagcagccaaugcaauaugcucagccgucccaguggacugggucccaacgagccgcaccaccuggagcauacaugcgcaccaccaguggaugacgacagaagacaugcucuccgucuggaaccgaguguggauugaagagaauccauggauggaagauaaaacgcaugugagcagcugggaagaaguaccauaucuugggaagcgcgaagaccaaugguguggcucacuuauagguuuaacggcacgcgccacaugggccacaaacauccaagucgcgauaaaccaaguccggagacuuauugggaaugaaaacuaccucgacuacaugacgucaaugaaacgauucaaaaacgagucagaucccgaaggagcgcucugguaa

SEQ ID NO: 23957 - RNA, 9879 nt, Artificial Sequence
  derived and/or modified CDS sequence (opt11) from DENV-1__FJ182002__SS-prME
ucggucacuaugcuauuaaugcugcuccccacggcgcuggcauuccaucuuacaacucgaggcggugaaccccauaugauaguauccaaacaagaacgugggaaaagccuacuuuucaaaacauccgcggggguaaacaugugcacacuaauagccauggaccuaggcgaacuaugcgaagacaccaugacuuacaaaugcccccagauaacagaagcagaaccugacgacguagacuguuggugcaaugcgacugauaccuggguuaccuacggcacaugcagucagacgggggaacaccgccgggacaaaaggagcguagcuuuagcaccccacguaggccuggggcuggaaacacgaacggaaacauggaugagcagcgaaggcgcguggaagcaaauacagcgaguagaaacuugggcacugcgucacccuggcuucacggugauagcucuauuccuggcacaugcuaucggcaccucaauuacacaaaaagggaucauauucaucuuauuaauguugguaacacccagcauggcgaugcgaugcgucgggaucgggaaccgcgacuuuguagagggacugaguggggcuacauggguggacgugguauuggagcacggaagcugcgucacaacaauggccaaaaauaaacccacccuagauauagaauuacuaaaaaccgaagugacaaacccggcaauuuuaaggaagcuguguaucgaagcaaaaauaucgaacaccaccaccgacucuagaugccccacccaaggcgaggcgacccuaguggaagaacaggacgcaaacuuugugugccgacggacuuucguagaccggggauggggaaacgguuguggauuauuugggaaaggcagcuuacuaacuugcgccaaauucaagugcgucacaaaacuagagggcaagauuguucaguacgaaaaccuaaaauacagcguaaucgugacaguccacacaggcgaccaacaccaaguagggaaugaaaccaccgaacacggaacgaucgccacgauaacaccucaggcaccaaccucggagauccaacucacggauuacggagcgcucacacuagacugcucaccgaggaccggacuggacuuuaacgagaugguauugcuuaccaugaaagaaaaauccuggcugguacauaagcaaugguuucuugaccuaccguuacccuggacaagcggcgccagcaccucccaagagacguggaaccggcaagaucuacuuguaaccuuuaaaacggcacacgcuaagaaacaggaaguggugguacuggggagucaagaaggagcaaugcauacggcucuaacaggcgccacagaaauacagaccagugggaccacaaccauauuugcgggacaccuaaagugccgacuaaaaauggacaaacuaacucucaaaggaacuagcuacguuaugugcacgggcaguuucaagcuagagaaggaaguggcggaaacccagcacggcacggugcucguucagguaaaauaugaaggcacagaugccccauguaagauccccuucucuacgcaggacgaaaagggaguaacacaaaaugggcgccucauuaccgccaacccgaucguaacggacaaagaaaaacccguaaacauugaaacagagccacccuucggagagaguuacauugucguaggugccggagagaaggcacugaagcucagcugguucaagaagggcaguuccauaggcaagauguucgaagcaaccgcccgaggggcaagacgcauggccauucuaggugauacagcgugggacuucggguccaucggagggguauucacuucagugggaaagcuaguacaccagguguuugggaccgcuuacggggugcuauucucuggcgugucguggacaaugaaaaucggaauugggauuuugcucacuuggcucgguuuaaacucccgcagcaccagccugagcaugacaugcaucgcgguaggaaugguaacccuauaccucggaguaaugguacaagccgacucugggugcguaaucaacuggaagggaagagaauugaaaugugguucugggaucuuuguuacuaacgagguacauacguggacggagcaauacaaauuccaagccgacucgccaaaacgccugagugccgccauaggcaaggcaugggaggaagggguaugcggaauacgauccgcgacgaggcuggaaaacauaauguggaaacaaaucucuaaugagcucaaccauauccugcuggaaaacgacaugaaauucaccguagugguuggugacgcgaacggaauccucgcccagggcaaaaagaugauacgcccacagccaauggaacacaaauauucguggaaaagcugggggaaagcaaaaauaauaggcgcugacauacagaacacaacauucauuauugauggcccggauacgccagaauguccggacaaucaacgggcauggaacauaugggaggucgaggauuacggcuuugggauauucacgacgaauauuuggcucaaacugcgagacuccuacacacaaaugugcgaucauaggcucaugagcgcggccaucaaggacagcaaagcaguacacgccgacaugggauacuggauagaguccgaaaagaaugaaacuuggaagcuggcucgggcgagcuucauagagguaaagaccugcacauggccaaagucacacacccuauggagcaauggaguacuggaaagcgaaaugauaauacccaagauauauggcggacccaucucucagcacaauuauagaccuggcuacuucacgcaaacugcgggccccuggcaccucggaaagcuggagcuagacuucgaccuuugcgagggaaccaccguaguaguugacgaacauugcgggaaucgcgggcccagucuaaggacgacgacagugacagguaaaauaauacacgaguggugcugucgcagcugcaccuuaccgccccuacgauuccgaggcgaggacggcugcugguauggcauggagauacgucccgucaaagaaaaggaggaaaacuugguacgaucaauggugagcgcaggaagcggggaaguagacagcuucucguuggggauacugugugcaucgauaaugauugaagaagugaugcguagccgauggucaagaaagaugcucaugacaggcacacuagccguauucuuguuacuaauuaccggacaacuuacuuggaacgaccugauacgucuauguauaauggugggggccaacgcaagcgauaggaugggcauggguacaacguaccuggcacuaauggcaacguucaaaaugaggccaauguuugccgugggacuguuauuccggcggcucaccuccagggagguacugcuucuaacaauugguuugagccuaguggccuccguagaacuaccaaauucacuagaggaauuaggcgacggucuugccaugggcaucaugauguuaaaacuccucacagaauuucagccccaucaguuauggacgacccuacuuagccugacuuuuauuaagacgacccuaagccuggacuacgcguggaaaacaacugcaauggcccucaguaucguuagccuuuuuccccuuugucuguccacuacaucacaaaagacaacauggcugccgguccuccuaggaucuuuuggaugcaagcccuuaacaauguuccuaaucacggaaaacaaaauuugggggcgaaaaucuuggcccuuaaacgaaggcauaauggcgauaggaaucgucuccauacucuuaucgagucuccucaagaacgacguaccguuagcuggaccgcuaauagcgggagggaugcuaauagcauguuacguaaucucgggaagcucggccgaccuaagccuagaaaaagccgccgaggugucaugggaacaagaggcagagcauuccggaaccagccauaacauccucgucgagguacaagacgaugggaccaugaaaauaaaggaugaggaacgagacgacacgcugacaauacugcuuaaagcaacacuacucgcagugucaggaguauaccccaugucuauccccgcgacccuauuugugugguauuucuggcagaagaagaaacagcguuccgggguacucugggacacgccuagcccacccgaaguagaacgcgcagucuuggacgauggcauauaccggauccuccaacggggacuacuaggccgaagccagguaggaguaggaguuuuccaagacggcguguuccacacaauguggcaugucacccgaggcgccguacucauguaccaggggaaacguuuggaacccagcugggcgagcgucaagaaagaccuuaucucuuauggagggggcuggagauuucaaggcagcuggaacacgggcgaagaaguacaaguaauagcggucgagcccggcaaaaaccccaaaaacguccaaacgacgccgggcaccuucaaaacuccagagggcgaggugggagcaaucgcacuagacuuuaagccaggcaccucgggaucgccaaucgucaaccgcgaggguaagaucgugggacuguacggaaacggcguggugacaaccucgggcacauacguaagugcaaucgcacaggcgaaagccagucaagaagguccacuacccgaaaucgaagaugaaguguucaagaaaagaaauuuaacgauaauggaccuacaccccggcuccgggaaaacaagaagauacuugccagccaucguuagagaagccauaaaacgcaaacuacggacccuuauccuggcccccacaagggucgucgccagcgagauggcagaagcucuaaagggaaugcccauccgauaccaaacgacggcggugaagucggaacacaccggcagagagauaguggaccuaaugugucacgcgacauucacgaugagacuccugucaccagugaggguaccgaacuacaauaugauuaucauggacgaggcacacuucacagacccggcauccauugcagccagagguuacauaucuacacgaguaggaaugggugaagccgcggcaauauucaugacggcaacuccgcccggcucagucgaggccuuuccgcagagcaacgcagugauacaagacgaagaaagagacauccccgagcgaaguuggaacagcggcuacgacuggaucaccgauuucccagggaaaacugucugguucgucccaagcauuaaaagcgggaacgacauagccaacugccuccgcaagaacgggaaaagggugauccaacugucaaggaaaaccuuugacacagaguaccagaaaaccaaaaauaacgacugggacuacguaguaaccaccgacaucagcgaaaugggagccaacuucagggcagaucgggucaucgacccgagaagaugccucaagcccgugauccucaaggacgggccggagcgagucauacuagcgggcccgaugcccgugaccguugcgagcgccgcgcagagacgggggagaaucggacgaacccagaccaaagaaggggaccaauauguauacaugggccaaccccuaaacaaugaugaggaucaugcacauuggacugaggcuaagaugcuccuagccaacauuaauacccccgaggggaucaucccggcccuguucgagcccgaacgagaaaagucuccagccaucgauggagaauacagacuccggggugaagcacgcaagacauuuguagaacucaugcgacgaggagaccuacccgucuggcugagcuacaaggucgccagcgaaggauuucaauauucagaucgaagguggugguucgauggggaacguaauaaucaaguacucgaagaaaacauggacguugaaauuuggaccaaggagggcgaacgaaagaaacuuagaccgagauggcuggacgcacguacauacagugacccgcuggcuuuaggcgaguucaaagaguucggagcuggucgccgaucugguagcggcgaucuaauuuuggagaucggaaaauuaccgcagcaccucacucuacgagcacaaaacggccuggauaaucucgucaugguacauaacagcgaacaaggaggcaaggccuaccgucacgcuauggaggaacugccggacaccauagaaacauuaauguuguuagcgcugauagcuguccucacagggggcguaacccuguucuuucucuccggaaaggggcucggcaagaccaguauaggauuacuaugcguuacugccucuucugcgcuacucuggauggcguccguagagccccacuggauugcagcgagcauaauucuggaguucuuuuugauggugcugcuaauacccgaacccgacaggcaacggacaccccaagacaaucagcucgcuuacgucguuaucggcuugcuguucaugauacugaccguugcagcaaacgaaaugggccuccuggagacgaccaagaaagaccucggcauagggcacguggcggcagaaaaccaccaacacgcaaccaugcuggacgucgaucuccggcccgcaagugcuuggacgcuauacgcuguagcaacgaccgucauaacacccaugaugcgccacaccauagagaauacgacagcaaacauuucccuaacggcuaucgccaaccaagccgcgaucuuaauggggcuggacaaaggcuggccaauaaguaaaauggacauaggagucccacuacuagcacuaggaugcuacucccagguaaacccacucacuuuaaccgccgcgguauugaugcucguagcacacuaugcgauaauuggaccagggcuacaagcaaaggcgaccagagaggcccagaagaggacagcagcagggauuaugaagaacccaacgguugacggaauaguggccaucgauuuagacccgguugucuaugacgcgaaguucgaaaagcaacuaggccagaucaugcuacuaauacugugcacaagccaaauacuccucaugcggaccacaugggcccuuugugaaucaaucacacuugcaacagggccccucacaacauuaugggaagguagcccaggaaaguucuggaacaccacgauagcggucucgauggccaauaucuucagaggcucguacuuagcaggggcaggccuagccuucucccucaugaaauccuugggaggaggacgccgaggaacuggggcccaaggcgaaacucucggggagaaguggaaacgccaacucaaccaauuaagcaaaucagaguucaacacuuacaaacggagcggaaucauggaaguugaucguagcgaggccaaggaggguuuaaagcguggagaaaccaccaaacaugcugugucucgaggaaccgccaaacugcguugguucgucgagaggaaucuaguaaagcccgaaggcaaaguaauagaucucgggugcggcagaggcggauggucguauuauugcgcaggccucaagaaaguaaccgagguaaagggauacacuaaagguggcccgggucaugaagaaccaauccccauggcgaccuacggguggaaccucguaaaacuucacagcggcaaggacguauucuuuaugcccccggagaaaugcgacacgcuccucugugauauuggagaaaguagcccaaaccccaccauagaggaggggcgcacucuucggguacuaaaaaugguagaacccugguuacgcgggaaccaauucugcaucaagauacucaacccguacaugccaaguguggucgaaacacuggaacaaaugcaacguaaacacggcggaaugcuagucagaaacccauugagccgcaauagcacccacgaaauguauugggugucauguggaaccgggaacauaguuagugccguaaauaugacaucaaggauguugcucaauagauucacuauggcccauagaaaaccgacauacgagcgagaugucgaccucggcgcaggaacaagacacguagcugucgagcccgaaguagcuaaccuagacaucaucggccaacgcaucgaaaacaucaaaaacgaacauaagucaacguggcacuaugaugaggacaaccccuacaagaccugggccuaccacggaagcuaugaggucaaacccagcggguccgccucuucgauggugaacggggucguacgucuucuaacaaaacccugggacgugauacccauggugacucaaaucgcuaugaccgacacaacgccauucggacagcagcgggucuucaaagagaaaguagauacacgcacaccaagggccaaacguggaacaacccaaauuauggaagucacugcaaaauggcuguggggauuccuuucccgcaacaaaaagccgcguaucugcacgagagaggaguucacacgaaaagugcgcucuaacgccgcgaucggagcugucuucguagacgagaaccaauggaacuccgccaaggaagccggugaagacgagagagugugggaccuuguugaucgagaaagagaguugcacaaacaagguaaguggggcacuggagguuacaacaugauggguaaacgagagaagaaacucggagaguucggcaaagccaaggggucacgcggcaucugguacauguggcuaggcgcaagguuccuagaguucgaagcgcuaggguucaugaacgaagaccacugguucagcagggaaaacucguugucuggaguagaaggggaaggacugcacaaacuuggguacauucuccgcgacaucagcaaaauaccugggggcaacauguacgcagacgacacggcagguugggacacaaggauaaccgaggaugaccuccaaaacgaagcaaaaauaacagacauaauggaaccggaacacgccuugcuugcaacgagcaucuucaagcuaacauaccaaaacaaaguaguaagagugcagcgacccgcgaaaaauggaaccgucauggacguaauaucaagaagggaccaaaggggguccggccaagucgggacauacggccuuaacacuuucaccaacauggaagugcaacuuauacgacaaauggaguccgagggcaucuuccucccgagcgaacucgagaccccgaaucucgcugaacgcgucuuagacuggcuggaaaaacacggagcagaaagguugaagcgcaugccaaucagcggggaugacugcguaguaaaaccgauagacgacagauucgcaacagcgcuuaccgcauuaaacgacauggguaaaguacguaaagacauaccccaaugggagccaucuaaaggguggaacgauuggcaacaagucccauucuggucacaucauuuccaccaacucauaaugaaggauggcagagagauagugguaccgugccgcaaccaggacgaauuaguaggcagagccagagugagccagggagcaggcuggucauuaagggaaaccgcauggcuagguaagucguacgcacagaugggucagcucauguacuuccaccggcgggaucuuagacuagcagccaacgccauauggagugcaggaccaggcgauuggguccccaccaguaggacuacauggucuauccacgcgcaccaucaauggaugacgacugaggacaugcugucgguauggaaccgagucuggauagaagagaacccguggauggaggacaagacccauguaucaagcugggaagaagucccauaccucggcaaacgcgaggaccaauggugcgggagccucauuggccuaacggcgagagcaacaugggcaacgaacauccagguggcaauaaaccaagugcgcaggcucauaggaaacgagaauuaucucgacuacaugacuagcaugaagcgcuucaaaaaugagagcgaucccgaaggagcucugugguaa

SEQ ID NO: 23958 - RNA, 9879 nt, Artificial Sequence
  derived and/or modified CDS sequence (opt11) from DENV-1__FJ024482__SS-prME
ucagugaccaugcugcugaugcugcugcccaccgcccucgccuuccaccugacuaccagaggcggggaaccccacaugauugugucaaagcaggagcgaggcaagagccuccuguucaaaacuuccgccgggguaaauaugugcaccuugaucgccauggaucuuggcgaguuaugcgaagacaccaugaccuauaaguguccccagaucaccgaggcugagcccgacgauguggauugcuggugcaacgccaccgacacgugggugacauaugggacuugcagccagacaggugaacacaggcgggacaagcgcucuguggcucuggcaccacaugugggccucgggcuagagacgcggaccgagaccuggaugagcuccgaaggcgcuuggaagcagauccaacguguggagacuugggcccugcggcaccccggguucacggugaucgcucuguuccucgcucacgccaucgggaccucaaucacgcaaaaggggaucaucuucauccugcuuaugcucgucacccccagcauggccaugcgcugugucggcaucgggaaccgcgauuucguggaggggcuuagcggcgccacuuggguggacgucguuuuagagcacggaucaugcgugaccaccauggcaaagaacaagccaaccuuggacaucgaguuacugaagacggaagucaccaacccagcgauccuacgcaagcugugcaucgaagccaagauaagcaacacgaccacggauuccagaugcccgacccagggagaggccacccugguggaggagcaagacgcuaacuucgugugccgccggaccuuugucgaccgcggcugggguaacggcugcggacuguucggcaaggggagccugcugacgugcgccaaguucaagugcgugacaaagcucgaaggcaagaucgugcaguacgagaaccugaaguacuccgucaucgugaccgugcacaccggggaccagcaucagguugggaacgagacgaccgagcacggcacgaucgcuaccaucacgccccaagcccccacgagcgagauucagcugaccgacuacggggcccucacucuggacugcagucccagaaccggccuggacuucaacgagaugguguuacugacgaugaaggagaaguccuggcugguccauaagcagugguuccucgaccugcccuuacccuggaccaguggcgccagcaccagccaagagaccuggaaccgucaggaccuccuggugacguucaagaccgcacacgcgaagaagcaggaggugguuguucugggcagccaggagggcgccaugcacaccgcgcuuaccggggccacggagauccagacgagcggcaccaccacgaucuucgcggggcauuuaaagugucggcugaagauggacaagcucacccugaaggguaccucuuacguaaugugcaccgggagcuucaagcuggagaaagagguugcggagacgcagcacggcacagugcuggugcaggucaaguacgaaggaaccgacgcccccugcaagauccccuucuugacgcaggaugagaaaggugugacgcagaacgggcgccugaucacggccaacccgauagugaccgacaaggaaaagccugugaacaucgaaaccgagccacccuucggggaguccuacaucguggugggggcaggagagaaggcgcugaagcucucaugguucaagaagggguccagcaucggcaagauguucgaggccacggcgcgcggggcccgccggauggccauucuaggggacaccgcuugggacuuuggguccaucggcggcgucuucacgagcguggggaaacuggugcaccaggucuuuggcaccgccuacgggguccucuucuccgggguaagcuggacaaugaaaaucgggauugggauccugcugaccuggcuuggccuaaauucccgcagcaccucccugagcaugaccuguauugccgucgggaugguuacguuguaccugggcguaaugguccaggccgacuccgggugcgugauaaacuggaagggccgagagcucaagugugggucuggcaucuucgugaccaacgagguacauaccuggacagagcaguacaaguuccaggccgacuccccgaagcggcucagcgcggccauaggcaaggccugggaggagggggucugcggcauccgcagcgccacccggcuggaaaacauuauguggaagcagauuuccaacgagcugaaccacauccuccuugagaacgauaugaaguucacuguuguugugggggacgcaaaugguauccuggcucaaggcaagaagaugaucaggccgcagccgauggagcauaaguauagcuggaaguccuggggcaaagccaagaucauaggcgccgacauccagaacaccaccuucaucaucgaugggcccgacacacccgagugccccgacaaccagcgggccuggaacaucugggagguggaggacuacggcuucgguauuuuuacaacgaacaucuggcucaaacugcgagacaguuacacacaaaugugcgaccaccgucugaugagcgcagccauaaaggacagcaaggccguccacgccgacauggguuacuggauagaauccgagaagaaugaaaccuggaagcucgcccgcgccagcuucauugaggugaagacuugcaccuggcccaagucccacacccuguggagcaacggcgugcuggagagugagaugauuauuccuaagaucuacggcggcccgaucagccagcacaauuaccggcccgguuacuuuacccagacugccggccccuggcaccucgggaagcuggagcuagacuucgaccucugcgagggaaccaccgucgucguggacgagcacuguggcaaccgcgggccgucacugcggacuacaaccgucacuggaaagauaauccacgaguggugcugucgcucgugcacccugccgccccuccgguuucgaggggaggacggcuguugguacgggauggagauucggcccgugaaggagaaggaggaaaaccuggugaggucgauggucagcgcaggcuccggcgagguugauagcuucagccucgggauucucugcgccagcaucaugaucgaggagguuaugcggucgcgcuggagccggaaaaugcugaugacgggcacccuggcugucuuccuccugcugauuauggggcagcuaacuuggaaugaucugauacgucugugcauaauggugggugccaacgcaagcgaccgcauggggaugggcaccacguaccuagcgcugauggccacuuucaaaaugcggccgauguuugcuguggggcuacucuuccgccgguuaaccucccgggagguucuucugcucaccauagggcugucacucgucgccuccguggagcuucccaacucacuugaggaacucggugacggucuggccaugggcaucaugauguuaaaguuguuaacggaguuccaaccccaccaacuguggaccaccuuacuaagucugaccuucaucaaaacuacccucagccuggacuacgccuggaagaccaccgccauggcccuguccaucgucagccucuucccccugugccuuuccacgaccucucaaaagaccaccuggcuccccguacugcugggcuccuucgggugcaaaccccucacaauguuucugaucacggaaaacaagaucuggggccgcaagucguggccgcuaaacgagggaaucauggcuaucggcaucgucucaaucuuacucagcucacugcucaagaacgaugugccccuggccggcccgcugaucgccgguggcaugcucaucgccugcuacgugaucucggggagcuccgcggaccuuucacuggagaaagccgcggaggucuccugggaacaagaggcagagcacaguggcacaucgcacaauauccucguggagguccaggacgacggcaccaugaagauuaaggacgaggagcgcgaugacacccugaccauauugcucaaggccaccuugcuggcggucagcgggguguaccccaugucgauccccgcgacccucuuugugugguacuucuggcagaagaagaaacagcggagcgggguccugugggacacgcccuccccgcccgagguggagcgcgcugugcuugacgauggcauuuacagaauccugcagcguggucuccuggggcggagccaggucggcguggggguuuuccaggacggugucuuccacacgauguggcacgugacacgcggggccgugcucauguaccagggaaagcggcucgagccuuccugggccucggucaagaaggacuugauuuccuacggcgggggauggcgcuuccaggggagcuggaacaccggcgaggagguucaggugaucgcggucgagcccggaaagaacccgaaaaacgugcagaccacgccaggcaccuuuaagacccccgagggagaggugggcgcgaucgcccuggacuucaagccgggcaccagcggguccccgaucguuaaccgggaaggcaagaucguuggucucuacggaaauggcgugguuacgaccucgggaacguacgugagcgcaaucgcccaggcgaaggccagccaggagggcccccugcccgaaauugaggacgaaguguucaagaagcgcaaucucaccaucauggaucuucacccggggaguggcaagacgcggcgcuaccugccugcaaucguccgagaagcaauuaagcgcaagcugagaacucucauucuggcccccacccgcgugguggcaucggaaauggcugaggcccugaagggcaugccgaucagauaccaaaccacggcggucaaguccgagcacaccggucgggaaauuguugaccucaugugccacgcgaccuucacaaugcgccugcugagcccugugcgugucccaaacuacaacaugauaaucauggacgaagcacacuucacggaccccgccucgaucgccgcccgcggcuacauuucaacucggguagggaugggcgaggcugcagccaucuucaugaccgccacgccgcccggguccguggaagccuucccccagagcaacgcagucauccaggacgaggagagggacauccccgagcgguccuggaacucugguuacgacuggauaacggacuuccccgguaagaccgugugguucgugcccuccaucaagagcgggaacgacauugccaacugccuccgcaagaacgggaaacggguuauccagcucucccgcaagacguuugacaccgaguaccagaaaacgaagaacaacgauugggacuacguggugaccaccgacaucagcgagaugggcgccaacuuccgggccgaccgcguaaucgacccgcggcgcugccugaagcccgugauccugaaggaugggcccgagcgggugauccuggcggggccgaugccugucaccguagcauccgcugcccagcgccggggccgaaucggccggaaccagaacaaggagggggaccaauacguuuauaugggacagccccugaacaaugacgaggaucacgcccacuggacggaagcgaagaugcuccuggacaacaucaacacccccgaaggaaucaucccggcgcuguucgagcccgagcgcgagaaguccgccgccauagacggcgaguaccgccucaggggcgaagcccgcaagaccuucgucgagcugaugcggcgcggcgaucugcccgucuggcucuccuacaaggucgcuagcgagggguuccaguacuccgaccgacgcuggugcuucgacggggagcggaacaaccagguccuggaggaaaacauggaugucgaaaucuggcccaaagagggcgagcgcaaaaagcugcggccgcgcuggcucgacgcccggaccuauagcgacccccuggcccugcgggaguucaaagaguucgcggcagggcggcgauccgucagcggugacuuaauccuggagaucgggaagcugccgcagcaucucacgcuaagggcgcagaaugcccuggacaaccucgugauggugcacaacagcgaacagggagggaaggccuaccgccaugccauggaggaacugcccgacacgaucgagacccugaugcuccucgcccugaucgccguccuuacuggaggagugacccuguuuuuccuguccgggaaaggccucggaaagacgucaauugggcuacugugcgugaccgccaguagcgcccuacuguggauggccuccgucgaaccgcacuggaucgcggccuccaucauccuggaguuuuuccucaugguguugcugauucccgagcccgaccggcagcguaccccucaggacaaccagcuagcauacguggucauuggccugcuguuccucauacugaccguggccgccaacgagauggggcugcuagaaacgacuaagaaggaccugggcaucggccacguggcggccgagaaccaccagcacgccacgauguuagacgucgaccuccggccugccucagcauggacacuauacgcgguggccacgacggucaucaccccuaugaugagacauaccaucgagaacacgaccgccaacaucagccugaccgcgauagcgaaccaggcagcaaucuugaugggccuggauaagggcuggcccauaucgaagauggacauaggggucccgcuucuagcccuggguuguuacagccaggugaacccccugacgcucacggccgcagugcuaauguuggucgcccacuacgcaaucaucggacccggucugcaggccaaggccacacgggaggcgcagaagcgcaccgccgccgggauaaugaaaaaccccacgguagacggcaucguggcaauagaccuggacccaguaguguacgacacuaaguucgagaagcaacugggccagaucaugcuccugauccugugcaccagccagauucuccuaaugcgcaccaccugggcacugugcgaguccaucacgcuugccacugggccgcugaccacccugugggagggaucccccgguaaguucuggaauacgaccaucgcgguguccauggcgaacaucuuccggggaucuuaccucgccggcgccggacuggcguucagccugaugaagucccucggaggagggcgccgggggacuggcgcccagggcgagacccugggggagaaguggaagcgccaauugaaucagcucagcaaguccgaguuuaacacuuacaagcgguccggcaucauggaggucgaccgcagcgaggccaaggagggccugaagcggggugaaaccaccaagcacgcggugagucgcgggaccgcgaaacuacggugguucguggaacgcaaccugguuaaacccgagggaaaggugaucgaccuaggcugcgggcgcgguggcuggagcuacuacugcgccggcuuaaagaaggugaccgaggucaagggcuacacaaagggcggcccgggccacgaagaaccuauccccauggcaaccuauggcuggaacuuggugaagcuccauuccgggaaagacguguuuuucaugcccccggagaagugcgauacccugcugugcgacaucggcgagagcucccccaacccgacuaucgaagaggggagaacgcuccggguccugaagaugguggagcccugguuacgcggcaaucaguucugcaucaagauccucaauccauacaugcccagcguggucgagacccuggagcaaaugcagcggaagcacggcgggaugcugguuaggaaccccuuaagucggaacagcacacaugaaauguauugggucuccuguggcaccgguaacauugucuccgccgugaacaugacgucccgcaugcugcugaaccgguucaccauggcgcaccgcaagcccaccuacgagcgagauguggaccugggugcgggcacucgucauguagccguggagccggagguggccaaccuggauauuauugggcagcgcaucgagaacaucaagaacgagcacaagucuacguggcacuacgaugaagacaacccuuacaagaccugggccuaccacggcuccuacgaggugaagcccuccggcagcgccagcuccauggugaacggaguaguaaggcuacucaccaaaccgugggacgugaucccuaugguaacccagaucgcgaugacggacaccacccccuucggccaacagcgcguguucaaggaaaagguugacacacguacgccacgggccaagcggggcacgacccaaaucauggaagucacagccaaguggcuguggggcuuccugagccgcaacaagaagccgcgaaucugcacgagggaggaguucacccggaaggugagauccaacgccgccaucggugcgguguuugucgaugagaaccaguggaacucagccaaggaggccguggaggacgagcguuucugggaccuggugcaucgcgaacgggagcugcacaagcagggcaagugcgcgaccugcguguacaacaugauggggaaaagagagaagaaacuuggcgaguucgggaaagccaagggcagccgugccaucugguacauguggcucggcgcccgcuuccuggaguucgaggcccugggguuuaugaacgaggaccauugguucucccgagagaacucuuucuccggcguggagggggaaggcuugcacaagcucggguacauacugcgcgacaucagcaagauccccgguggcaauauguacgccgacgacacagccgggugggacacgcggaucacagaggacgaccuccaaaaugaagcgaaaaucacagacaucauggagcccgagcacgcccuccuugccaccuccaucuucaagcucacguaucagaacaaggugguccgcgugcaacgccccgccaagaauggaacugugauggacgucaucagcaggcgcgcucagcgggguucgggccagguuggcaccuauggguugaacacuuuuacaaacauggaagugcagcugauacgccaaauggagagcgagggcaucuuccucccguccgagcuggagaccccuaaccuggcggagcgagucuuagacuggcuggagaagcauggggcagagcggcugaagcggauggccauuagcggugacgacugcguggugaagcccaucgacgaccgcuucgccaccgcguuaacggcccugaacgccauggggaagguccggaaggauaucccccagugggaaccgucgaagggcuggaacgauuggcagcaaguccccuucugcagccaccacuuccaccagcuuaucaugaaggacggccgcgagaucguugucccaugccguaaccaagacgagcucgugggacgcgcccggguaucccaaggcgccggguggagccuacgcgagaccgcgugccuuggcaaguccuacgcccagauguggcagcucauguacuuccaccgccgcgaucugagguuggccgcgaacgcgaucuguagcgcuguccccguugacuggguuccgacgucucgcaccaccuggucgauccacgcccaucaccaguggaugacuacagaggauaugcucagcguguggaaccggguguggaucgaggaaaacccauggauggaggacaagacccacguguccucgugggaagagguuccauaccuggggaagcgcgaggaccaguggugcggcucccuaaucggccucaccgcccgagccaccugggcgacgaauauccagguggccaucaaccaagugcggcgccugaucgguaacgagaauuacuuggacuacaugacuagcaugaaacgguucaaaaacgagucugacccggagggcgcccucugguga

SEQ ID NO: 23959 - RNA, 9879 nt, Artificial Sequence
  derived and/or modified CDS sequence (opt11) from DENV-1__EU596501__SS-prME
agugugaccauguuacucaugcuguugcccaccgcccucgccuuucaucugaccacccgggguggggaaccccauaugauagugagcaagcaggaacggggcaagagcuuacuguucaaaaccagugcgggggugaacaugugcacccugauugccauggaccugggugagcucugugaagauaccaugaccuauaagugcccucagauaacagaggcagagcccgaugacguagacugcuggugcaacgccaccgacaccugggucacuuacgggacgugcagccagacaggggagcaccggcgggacaagcgcuccguagcccuagcgccccacgugggccuggggcuugagacgcgcaccgaaaccuggaugagcuccgagggcgccuggaaacagauccagcgcgucgagacuugggcccugcggcaccccgguuucacgguuaucgccuuauucuuggcgcaugccaucggcacuucgaucacccagaaggguaucauuuucauccuucuaaugcucgugaccccgucuauggcaaugagaugugucgguauaggcaaccgggacuucguggagggacugaguggcgcuacguggguggaugucgugcuggagcacggguccugcgucacgaccauggccaagaacaagcccacacucgacauugagcugcugaagacggaggucacaaaccccgccauucuccgcaaguugugcauagaggccaagaucagcaauaccaccaccgacuccaggugcccgacccagggugaggccacccugguagaggaacaggaugccaacuucgugugccgccgaacauucgucgaccgaggcugggggaauggauguggccuuuuuggcaaggggagccuacugacgugugccaaguucaagugcgugacuaaguuagagggcaagaucgugcaguacgaaaaccugaaguauuccgucauagucacugugcacaccggcgaucaacaccagguagggaacgaaacgacagagcacggcaccaucgcgacgaucacgccacaggcccccacgucugagauacaguugaccgacuacggggcccucacccuggacugcucuccccggaccggccuggacuucaacgagauggucuuacugacgaugaaagagaaauccuggcuuguccacaagcagugguucuuggacuugccccuacccuggaccucgggggcuagcaccucccaggagaccuggaaccgucaggaccuccuaguuacguucaaaacugcacacgcgaagaagcaggagguggucguacugggcucccaggagggggccaugcacaccgccuugaccggggccacggagauccagaccagcggcaccaccacgaucuucgccggacaccugaagugccggcugaaaauggacaaguugacccuaaagggcaccuccuacgugaugugcacagggagcuucaagcuggagaaggagguagcugaaacgcagcacggcaccguguuagugcaggucaaguaugagggaaccgacgcccccugcaagauccccuuuucaacccaggaugagaagggggugacgcagaacggccgccucauuaccgccaauccgaucgugaccgacaaggaaaagcccguuaacaucgagaccgagccgcccuucggggagagcuauaucguggugggcgccggggagaaggcguuaaaacuguccugguucaagaaggggucaucuaucggcaagauguucgaggccacggcccgcggggcccgccggauggcaauccucggcgauaccgcgugggacuucgguaguaucgguggcgucuucacuuccguggggaaacuugugcaccaggucuucggcaccgcguacgggguguuguucucgggcgugucuuggacgaugaagaucgggaucggcauccuccugaccuggcugggccucaauagccgcucuaccagccugucuaugaccugcauagcagucgggauggugacgcuguacuuaggcgugaugguccaggccgacucagggugcgugaucaacuggaagggccgugagcuuaaaugcggguccgguauauuugugacaaacgagguccacaccuggaccgagcaguacaaguuccaggcggacagcccuaagcggcuguccgcggccaucggcaaggccugggaggagggggugugcggcauccgcuccgccacacggcucgagaacaucauguggaagcagaucagcaacgaacugaaccacauccuacucgagaacgauaugaaguucacgguggucguuggcgacgccaauggaauccuggcgcaggggaagaagaugauccgcccucagccuauggagcacaaauacuccuggaaguccuggggcaaggccaagaucauuggcgccgauauccagaauacaacuuucaucaucgacgggccagacacaccggagugucccgauaaccagcgggcuuggaacaucugggaaguggaggauuacggcuuugggaucuucacgaccaacaucuggcugaagcuccgugacucguauacgcaaaugugcgaccaccggcugaugagcgccgccauuaaagacuccaaggccguccacgccgacaugggcuacuggauugagucugagaagaaugagaccuggaagcuggcccgcgcaucauucaucgaggugaagacgugcaccuggccgaaaagccauaccuuaugguccaacggcguguuagagagcgaaaugauaauccccaaaaucuacgggggcccgauuucccagcacaauuaccggcccggauacuucacucagacggccggccccuggcaucuggguaagcucgagcuggacuucgaucuaugcgagggcaccaccguagugguggacgagcacugcggcaaccgcgguccgagcuuacggaccacgaccgucaccggcaagauuauccaugaauggugcugccgcuccuguacccucccgcccuugcgguuccgcggggaggacggaugcugguacgguauggagauccggccagucaaggagaaggaggaaaaccucgugcgcaguauggucuccgcuggaagcggcgagguugacagcuucucccuggggauacugugugcaagcauaaugauugaagaggugaugcggucccgcuggagccggaagaugcucaugacgggaacccuggccgucuuccuguugcugaucauggggcaacugacauggaacgaccuuauccgccugugcaucauggugggcgcuaaugcguccgaccgcauggggaugggcaccacguaccuggcauuaauggcaaccuucaagaugaggccgauguucgccgugggcuuacuguucagacggcuuaccucucgcgaggucuugcugcucaccaucgggcugagccugguggcgagcguggagcuccccaacagccuggaggagcugggggacgggcucgccauggguauuaugaugcugaagcugcuuacugaguuccaaccccaucagcuguggaccacucuguuaagccugaccuucaucaagacaacccugucccucgacuacgccuggaaaaccaccgccauggcacuaucuaucguaucccugcucccccuaugcuugucgacgaccucccagaagaccaccuggcucccuguguugcugggcagcuucggaugcaagcccuugaccauguuccugaucacggagaauaagaucuggggccggaaauccuggccacugaacgaagguaucauggccauaggcaucgucagcauccugcuauccagccugcucaagaaugaugugccccucgccggcccgcugauugccggcgggauguugaucgcuugcuacgugauuucagguuccagcgcggaccuaucccuggagaaggccgccgaggucucgugggaacaggaggcagagcacuccggaaccagccauaacauccucgucgaggugcaggacgauggcaccaugaagauuaaggacgaggaaagagaugacacccugacgauucugcucaaggccacccugcuggcggucuccggcguguacccgaugagcaucccggccacgcuuuucgugugguacuucuggcaaaagaagaagcagcgcaguggaguccuuugggacacccccagcccccccgagguggaacgcgccguucucgaugauggcauauaccggaucaugcaacgcggccugcucgggcggagccaggucggcguggggguguuccaggacgggguguuccacacuauguggcacgugacccggggggccgugcugauguaucaggggaagcggcuggagccgagcugggccuccguuaagaaggaccucaucagcuacggagggggcuggcgcuuccaggguuccuggaacaccggcgaggaaguccaggugaucgcggucgagcccggaaaaaacccgaagaacguccagaccaccccgggaaccuucaagacgcuggagggcgagguaggagccaucgcccucgacuuuaaaccaggcacaucagggucccccaucguaaaccgugaagggaagaucgugggccucuacgggaauggcguagucacgaccagcgggacguacgugucugccauagcccaggcgaaggccucccaggaaggaccgcugcccgagaucgaggaugagguguuuaagaagcgcaaccugaccaucauggaccuccaccccgggagcggaaagacgcggcgcuaccugccggccaucguccgggaagccaucaagcgcaagcugcguacgcuuauccuugcgcccacucggguaguagccucggagauggccgaggcccugaaggguaugccgauccgcuaucagacgacggcugucaagagcgagcacaccgggagggagaucguggaccucaugugccacgcaacguuuaccaugcgccuccuauccccaguccggguccccaacuacaacaugaucaucauggacgaggcccacuucacggaccccgccagcauugccgcccgcggcuacauuuccacgcgggugggcaugggagaagccgccgcuaucuuuaugaccgccacuccgcccgggagcguugaggccuucccgcaguccaaugcggucauccaggacgaggagcgcgauauaccagagcgcagcuggaacuccggcuacgacuggaucacugacuuccccggcaagacugugugguucguccccucaaucaaguccgggaaugauaucgccaacugccuccgcaagaacggcaaacggguaauccaacugagccgaaaaaccuucgauacggaguaccagaagacaaagaacaaugacugggauuacguagugacuaccgacauuuccgagaugggcgcgaacuuccgagcugaccgcgucaucgacccgcggagaugccugaagcccgugauccucaaggauggccccgagcgggugauccuggcgggacccaugccggucacuguggccucugccgcccagcgccggggccgcauuggccgcaaccagaacaaggagggggaccaguacguauacaugggccaaccccugaacaacgacgaggaucaugcccacuggacagaggcgaagaugcuccuggacaacaucaacacccccgaagggauaauaccggcccuguuugagccagagcgcgaaaagagcgcggcuaucgacggagaguaccgccuccgcggggaggcccgcaaaaccuucgucgagcugaugcgacgcggagaccugcccgucuggcuaagcuacaaggucgcgucagaaggcuuccaguacagcgaccgccgcuggugcuuugacggagagcggaacaaucagguucuugaggagaacauggacguagagaucuggaccaaggaaggagagcgcaaaaaguugaggccacgcugguuggacgcacggaccuacuccgacccacuggcccuucgggaguucaaagaguucgccgcagggcggcgcagcgucuccggcgaccuuauccuggagaucggaaaacugccgcagcacuugacacugagggcucagaacgcccuggacaaccuggucaugcugcacaacuccgagcaggguggcaaggccuaccgccacgccauggaggaguugcccgacaccaucgagacccuuaugcugcuggcgcuaaucgcugugcugaccgggggcgucacgcuguucuuccucagugggaaaggccugggcaagaccuccaucggacugcuauguguaaccgccucuuccgcccuguuauggauggccagcguggagccccacuggaucgcggcuucaaucauacucgaauucuucuuaaugguccugcucauccccgagccggacagacagcgcacgccccaggacaaccagcuggccuacguggugaucggcuuacucuucaugauccugacggucgcagccaacgagauggggcuguuggaaaccaccaagaaggaccuuggcaucgggcacguggcggccgaaaaccaccagcacgccacuaugcuggacguggaccuccgacccgccagcgcguggacgcuguacgcggucgccaccaccgugaucaccccgaugaugcgccacacgauugagaacacgaccgccaacauuucccugacagccauagccaaccaggcggcgauccucaugggcuuggacaagggcuggcccaucagcaagauggauaucggggugccccuacucgcccugggguguuacucccaggucaaccccuugacacucaccgccgcggugcugaugcugguggcccacuacgccaucauuggcccgggacuacaagcuaaggcuacccgggaggcucagaagcguaccgccgccgggaucaugaagaacccaacggucgacggcauaguggccauagaccuggaucccguggucuacgacgccaaguucgagaagcagcugggccagaucaugcuccugauccugugcaccagccaaauacuccugaugcgcacgaccugggcguugugcgagucgaucacguuggcgacgggcccgcugaccacccugugggaaggaagcccggggaaguuuuggaacacgaccaucgcaguguccauggcuaacaucuuccggggcagcuaccuugccggcgcggggcuggcauucucccugaugaagucucugggagguggccgccgggggacaggagcccagggcgagacccugggggagaaguggaagcgccagcugaaccagcucuccaaaagcgaguucaacacuuacaaacggagcggcaucauggagguggaccgcuccgaggccaaggaggggcugaaacggggggagacaacaaagcaugcagucagccgggggacugccaaguugcggugguuuguggaacgcaaucuggugaagcccgaaggcaagguuaucgaccucggaugcgggaggggcgggugguccuacuacugcgcgggccugaagaaagugaccgaaguaaagggguacacgaagggaggucccgggcacgaagagcccaucccgauggccaccuacggcuggaaccuggucaaacuacauuccgggaaggacguauucuucaugccgcccgagaagugcgacacucugcuaugcgauaucggcgagucgagcccuaacccgaccaucgaggaaggacgcacguuacgggugcucaagauggucgagcccuggcugcgcggaaaccaguucuguauaaagauccucaacccauauaugcccuccguuguggaaacccuggagcagaugcagcggaaacacggcgggauguugguccgcaacccguugagccguaacuccagccacgagauguauuggguguccugcggcaccgggaacaucgugagcgccgucaacaugaccucucgcaugcuguuaaaccgguuuacgauggcgcaccgcaagccgacauacgagcgcgauguggacuuaggcgcuggaacuagacacguggccgucgaacccgagguggccaaucuggacaucaucgggcagcggaucgagaauaucaagaacgaacacaagaguaccuggcacuacgacgaggacaauccauacaagacgugggccuaccacggcuccuacgaggugaagccguccgguuccgcgaguagcaugguaaacggcguagugagacuauuaacgaagcccugggacgucauccccaugguaacccagauagccaugaccgacacaacccccuucggacagcaacgcguauucaaggagaagguggacacacggaccccgcgcgccaaacgggggacgacccagaucauggaaguaacagccaaguggcuguggggcuuccugagucgcaauaagaaaccccggauaugcacccgcgaggaguuuacgcggaaaguucgcagcaaugccgcgaucggagcuguauucguugacgagaaccaauggaacucggccaaggaggcagucgaggacgagcgguuuugggaccuagugcaccgcgagagggagcuucacaagcaggggaagugcgcgaccugcguguacaauaugauggggaaacgcgagaagaaguuaggcgaauucgguaaggccaagggcagccgugccaucugguauauguggcucggugcccgauuccuggaguucgaggcuuuaggguucaugaacgaggaccacugguucucccgggagaacagccucuccgggguugagggagagggccuucacaagcugggguacauccuucgcgacaucagcaagauccccggaggaaauauguacgccgacgacacugccggcugggacacccgcaucaccgaagacgaccugcagaacgaagcgaagaucaccgacauaauggagccggagcacgcccugcucgcaaccucaaucuucaaacuuaccuaccaaaacaagguggugagaguccagcgccccgcgaagaacggcacggugauggacgugaucagccggagggaucagcggggguccggucaggucggcaccuacggucugaauaccuuuacgaacauggaggugcagcucauacgccaaauggagagcgagggcauauucuuaccaucagaacuggagacgcccaaucucgccgagagggugcucgauuggcuggagaagcauggggcugagcgccucaagaggauggccaucucaggcgaugacugcguugugaagcccaucgacgaccgcuuugcgaccgcccugaccgcccuuaacgacaugggcaaggugcggaaggacaucccccagugggagcccuccaagggcuggaacgacuggcagcagguccccuuuuguagccaccacuuccaucagcucaucaugaaggauggccgcgagaucguggugccgugccggaaccaggacgagcuggucgggcgugccagagugucccaaggagccggguggucccugagggagaccgcuugccucggcaaaaguuacgcucaaauguggcagcugauguacuuccaccggcgcgaccugcggcucgcggcaaacgccaucugcagugcggugccagucgacugggugcccaccucgcgaacgacuugguccauccaugcucaccaccaguggaugaccacggaggacaugcugagcguguggaaccgggucuggaucgaggagaaccccuggauggaggacaaaacucacguguccagcugggaggaggugccguaccuggggaagcgcgaggaccaguggugcggcucccucaucggucugaccgcccgcgccaccugggcaaccaacauccaggucgcgauuaaccaggugcggcgccugaucggcaaugagaacuaccucgacuacaugacuagcaugaagcgcuuuaagaacgaauccgacccugaaggcgcccugugguga

SEQ ID NO: 23960 - RNA, 9879 nt, Artificial Sequence
  derived and/or modified CDS sequence (opt11) from DENV-1__FJ898437__SS-prME
agcgugacgaugcugcucaugcuacugcccaccgcccuggccuuccaucugaccacuagaggcggggaaccccacaugaucgucucuaagcaggagagaggcaagagcuugcucuucaaaacgucagcaggaguaaauaugugcacacugauagccauggaccugggcgagcucugcgaagacacaaugacauacaaguguccacaaauaacggaggcagaacccgaugacgucgacuguuggugcaacgcaaccgauaccugggugacuuacggcacgugcagccagaccggcgagcaccggcgggacaagcgcucaguggcccuggcgccgcauguggggcuggggcucgagacccggaccgaaaccuggaugagcagcgaaggugcguggaagcagauucagagggucgagaccugggcccugcgccacccgggguuuaccgugaucgcacuguuucucgcccacgccaucggaacgucaaucacccaaaaggggaucaucuucauauuauuaauguuggugaccccuagcauggccaugcgcuguguggguaucggcaaccgugauuucguugaggggcugucaggcgcaacguggguggacguuguacuggaacacggguccugcguaaccaccauggcaaagaacaagcccacccucgacaucgagcugcugaaaacggagguuaccaacccagcgaucuugcgcaagcuguguauugaggcaaaaaucaguaauaccaccacggacagucguuguccgacccagggcgaggccacccugguggaggagcaggaugcgaacuuuguaugccgccggaccuucgucgaccgcggcugggggaauggcuguggcuuauucggcaagggaagccugcucacgugcgcgaaguucaagugcgugaccaaacucgaaggcaagaucgugcaguacgagaaccugaaauacuccgucaucguuaccgugcacaccggcgaccaacaccaggucgggaacgagacaaccgaacacggcaccauugcgacaauaacgccccaggccccuacgucugagauccaacugacagacuacggggccuugacccuugacugcucgcccaggaccggccuagacuucaacgaaauggugcuacucacgaugaaggagaaguccuggcugguccacaagcagugguuucucgaucuuccgcugcccuggaccuccggggccagcaccagccaagaaacauggaaucgccaggaccuccuggugaccuuuaagacagcccacgcgaagaaacaggaggugguuguacuggggucccaggagggcgcuaugcacaccgcccucacgggcgccacggagauacagaccagcggaacaaccacgaucuucgccgggcaccuaaagugccgccugaagauggauaaacucacgcuuaagggcaccuccuacgucaugugcaccgguagcuuuaagcuggagaaggaggucgcggagacgcagcauggcaccguguugguccaggucaaguacgaggggaccgacgcccccugcaagauccccuucucaacccaggacgagaagggagucacgcaaaacggccgucucauuaccgcaaacccgauagugaccgacaaggagaaacccgugaacaucgagaccgaaccacccuuuggugagagcuacauaguggucggcgccggagagaaagcacucaagcugucuugguucaaaaaggggucgaguaucggcaagauguucgaggcaacugcccgcggggcgcgccggauggcgauccucggcgacaccgcuugggauuucggcagcauaggcggcgucuuuacuucggucgggaagcuggugcaccaggucuucgggaccgccuauggcgugcuguucagcggcguuucuuggacgaugaaaaucgguaucgguauccuccuuaccuggcucggguuaaacucucguaguaccagccuauccaugaccugcauagccgucggaaugguuacacuguaucucggcgugaugguacaggcagacuccggcugcgugaucaacuggaaaggccgcgagcugaagugcggauccggcaucuuugugaccaacgagguccacaccuggaccgaacaauauaaguuccaggcugauucuccaaagaggcugagcgcagcgauugggaaggcuugggaagaaggggugugcggcauacgcagugccacccggcucgaaaacaucauguggaagcagaucagcaaugagcugaaccacauccuguuggagaacgacaugaaauuuacuguggucguaggcgaugccaacggcaucuuagcgcaggggaaaaagaugauccgcccccagcccauggagcauaaguacaguuggaaaucguggggcaaagccaagaucaucggcgcagacauccagaacaccacuuuuaucaucgacgggccagacaccccugagugccccgacaaccagcgggcuuggaacaucugggagguggaagauuacggcuucggaaucuucacuacaaacaucuggcugaagcuccgcgacaguuacacacagaugugcgaccacagacuaaugagcgcagccauuaaggacuccaaggccguccacgcggacaugggcuauuggauagagagcgagaagaacgagaccuggaagcuagcccgcgcgaguuucaucgaggugaaaacaugcaccuggcccaagagccacacccucugguccaacggugugcuugaguccgagaugauuauccccaagaucuacgggggaccuaucucccaacacaacuaccggccgggguacuuuacccagacggcaggccccuggcauuuaggcaaacuggaguuggacuuugaccugugcgagggcaccaccguagugguggacgaacacugcgguaaccgcgggccgagccuccggacgaccaccgucaccgguaagauuauccacgaguggugcugccgcuccuguacacuuccgccccugcgguuccgcggggaagauggcugcugguacgguauggagauacggccugugaaagagaaagaggaaaaccugguucggagcauggucuccgcuggcagcggcgaggucgauagcuucucccuagggaucuugugcgcauccaucaugaucgaggaggugaugcggucccgcugguccagaaagauguugaugaccggcaccuuggccguuuuccugcuccugaucauggggcagcuaaccuggaacgaccucauccgccuaugcaucauggugggcgcgaaugccucugaccgcauggguaugggcaccacguaccuugcccuuauggcuaccuucaagaugcggccaauguucgccguggggcuguuauuccgccgccucaccucgcgcgagguccugcugcucacuaucgggcugucccugguggcaagcguggagcuacccaacucccuggaggagcugggcgacgggcucgcaaugggcaucaugaugcugaagcuacucacggaguuccagccccaccaacuguggaccacccugcucagccuaacauucaucaagacuacccuaucccucgauuacgcuuggaagaccacggccauggcacugucgaucgucucccuguucccgcuaugcuuaagcacgaccucccagaagacaacuuggcugccggugcucuuaggcucuuucgggugcaaaccccugaccauguuccuaaucacagagaauaagaucuggggccggaaauccuggccgcucaacgaagggaucauggccaucggcauagucagcaucuugcuauccucgcugcugaagaacgaugugccgcucgcagggccgcugauagccggcggcauguugaucgccugcuacguuaucuccggaucaagcgcggaccucucccuggagaaggccgccgaggugagcugggaacaggaggccgaacacucaggcaccagccauaacaucuugguggaggugcaggaugacgguaccaugaagauuaaggacgaggagcgcgacgacacccucacaaucuuguugaaggccacacuccucgcggucuccggcguguaccccaugucgaucccggcuacccucuucgugugguacuucuggcaaaagaagaagcagcgauccgggguccucugggauacccccucgccccccgaaguggagcgcgccgugcuggacgacggcaucuaccgcauccugcagcggggccuguuagggcggucccaggucggaguggggguguuucaggacggagucuuccacacgauguggcacgugacccgcggggccguacugauguaucagggaaagagacuggagcccaguugggccuccgucaagaaggaccucaucagcuauggcgggggcuggcgcuuccaaggcuccuggaacaccggugaggaaguccagguuaucgcugucgagcccgggaagaauccgaaaaacguccagacuacgcccgggacuuucaagacccccgagggcgaggucggagccaucgcccucgacuuuaagcccggcacgagcggguccccgaucgucaaccgggagggaaagaucguugggcuguacgggaacggcgucgucacgaccucugggaccuacguuuccgcuauugcccaggcgaaggccucacaggagggcccgcuccccgagaucgaggacgaaguguuuaagaagcgcaaccugaccaucauggaccugcacccggggucuggaaagacgcggcguuaucuccccgcgaucgucagggaggccaucaagcgcaaacuucgaacgcugauccucgcgcccacucgcgugguggcuuccgagauggccgaagcccuaaaagggaugccaauacgcuaccagaccaccgccgucaaaagcgaacacaccgggagagagaucguggaucugaugugccacgcgaccuuuacaaugcgguuguugucccccgugcgggucccgaacuacaacaugaucaucauggacgaagcccacuuuacugacccagcgagcauugccgcucgaggcuauaucaguacccgcguagggaugggcgaggcggcggccaucuucaugacugccaccccgccugggagcguggaggcauucccccagagcaacgcugucauacaggacgaagagagagacauccccgaacggucuuggaacuccggcuacgauuggauaacggacuuccccggcaagaccgugugguucgugcccucgaucaaauccgggaacgauaucgccaacugccugcgcaagaacggcaagcggguuauccagcucucacggaagaccuucgauaccgaguaccagaaaaccaagaacaacgacugggacuaugucgugaccacagacaucuccgagaugggugccaauuuccgggccgaccgcgucauugacccccggcgcugccuaaagcccgugauccugaaggauggccccgagcgagugauccucgcggggccgaugccggugaccguggccagcgcagcccagagacggggccgcauuggucggaaccagaacaaggagggggaccaguacguguauaugggccaaccgcuuaacaacgacgaggaucacgcccacuggacggaggcaaaaaugcuucuagacaacaucaacacccccgagggaauuauuccggcgcuguucgagccugagcgggagaagagcgccgcuaucgacggagaguaccgccugcgcggggaggcccgcaagaccuucgucgagcucaugcggcgcggagaccugccuguguggcuaaguuacaagguggcgucagaaggguuucaauacagcgacagacgguggugcuucgacggggaacggaacaaccagguccuggaggaaaacauggacgucgaaaucuggaccaaagagggcgagcgaaaaaaguuacggccccgguggcuggacgcucggaccuacuccgacccgcucgcccugcgcgaguucaaggaguuugcugccggacggcgcagcguuaguggcgaucuaauccucgagauagguaagcuuccccagcaccugacccuccgagcgcagaacgcucuggacaaccuggugaugcuccacaauuccgagcagggugguaaggcuuaccgucaugcgauggaggagcugcccgacacgaucgagacucugaugcuccuggcgcugaucgccgugcucaccgggggcgugacguuguuuuuucuguccggcaagggccucggcaaaaccucuauuggcuuacucugcgugaccgccagcuccgcccucuuguggauggcgagcguggagccucacuggaucgcugccucuaucaucuuagaguucuuccucauggugcuucuaauaccggagcccgaucggcagcgcacgccccaagacaaucaauuagccuaugugguuaucggccugcuguucaugauccugacggucgccgcuaacgagauggggcuccuugaaacgaccaagaaggaccucggcaucgggcacguggcggccgagaaccaccagcacgugaccaugcuggaugucgaccugagaccggccagugcauggacuuuauacgccguggcaaccacggugaucacaccaaugaugcgucacacuaucgaaaacaccaccgccaacaucucacugaccgcuaucgccaaucaggccgcgauacugaugggccucgacaagggcuggcccauuagcaagauggacaucggggucccccuguuggccuugggcugcuacucgcaagugaacccgcugacgcugaccgccgcaguguuaaugcuggucgcgcacuacgcuaucaucgggccaggccugcaggccaaggccacccgggaggcgcaaaagcgcacagcggccgggaucaugaagaacccgacgguggacggcauaguggccaucgaccucgacccgguaguguacgacgcgaaguucgaaaagcagcugggccagauaaugcugcucauacuguguaccagccagauucugcugaugcgcaccaccugggcgcugugugaauccauaacacuggcgacuggcccgcucaccacccugugggaaggcagcccaggcaaguucuggaacacgacaaucgcaguguccauggccaacaucuuccgggggagcuaucuggcaggcgcggggcucgcguucucgcuaaugaagagucuuggagggggcaggcgcgggaccggcgcccagggggagacucugggggagaaguggaagcgccagcugaaccagcuguccaagagcgaauuuaacacguacaagcgaagugguaucauggaagucgaccguucagaggccaaggaggggcucaagcggggugagaccaccaagcacgcagugagccgcggcaccgcgaagcugcggugguuuguggagcgaaaucuggucaagcccgagggaaagguaaucgaccugggcugcggaagaggcggguggucuuacuacugcgcgggccucaagaaggugaccgaagucaaaggauacaccaaaggcggccccggacacgaggagccgauucccauggcgacguacggcuggaaccucgugaagcugcacagcgggaaggacguguucuuuaugccacccgaaaagugugacacccuccugugugacauuggggaguccucuccuaaccccaccaucgaagagggacgcacgcugcgggugcucaagaugguggagcccugguugcggggcaaccaguucuguauuaaaauucugaauccauacaugcccuccgugguugagacccucgaacaaaugcagcguaaacauggagguaugcuggugcguaacccccugagccgcaauuccacucacgaaauguacugggugagcuguggcaccgggaacaucgucagcgccgugaacaugacgagccgcaugcuccugaaccguuucacuauggcacaucgcaagcccaccuacgagagggacguggauuuaggcgcgggcacccggcacgucgccguggagcccgagguggccaaccucgacaucaucggucagaggaucgagaacaucaaaaacgagcacaaguccacguggcauuaugacgaggacaaccccuacaaaaccugggcauaucacggcuccuacgaggucaagccuuccgggagcgccucauccauggugaacggcgugguccggcuauugaccaagcccugggacgugauaccaauggugacccagaucgcaaugacggauaccaccccguucgggcagcagcguguauucaaggaaaaggucgauacccggacaccgcgcgccaagcggggcaccacccagaucauggaggucaccgccaagugguuauggggcuuccugagccgcaacaaaaaaccccgaaucugcacgcgcgaggaguucacccguaagguucgcucaaacgcagccaucggugcuguguucaucgacgaaaaccaguggaauagugcaaaggaagccgucgaagacgaacgguucugggauuugguacaccgcgagcgggagcuccacaagcagggaaaaugcgcgaccugcguguacaacaugauggggaagcgcgagaaaaagcugggcgaguucggaaaggcgaaggggucccgggccauaugguacauguggcuaggcgcccgcuuccucgaguucgaggcucugggguucaugaacgaggaccacugguucagccgggaaaauucucugagcggcgucgagggggaagggcuccauaagcucggcuacauucuucgcgauauaagcaagauaccaggugguaacauguacgccgacgacaccgcggggugggacacacgcgugaccgaagacgaccuucagaacgaggccaaaauaaccgacaucauggagcccgagcacgcccugcucgccacgagcaucuucaagcucacguaccagaauaaggugguacgcgugcagcgcccagccaaaaacgggaccguaauggacgucaucucgcgccgcgaucagcgggggagcggccaagugggcacguacgguuuaaacaccuucacgaacauggaggugcagcucauccgccagauggaguccgagggaaucuuucuccccagcgagcuggagacaccgaaccuggcugagcggguccuagacuggcuggagaagcacggggcggaacgccugcgccgaauggcgaucuccggcgacgacugcguggugaagccaauugacgaucgguucgcuacagcccucacugcgcuuaacgacauggggaaaguaaggaaggacaucccccagugggagcccagcaaggguuggaacgauuggcagcaggucccguucuguucccaccacuuccaccaacuaaucaugaaggacgggcgggaaaucgugguaccuugccgcaaccaggacgaacucguggggcgggcacgcguaagccagggcgccggguggagccugcgagaaaccgccugccucggcaagagcuaugcccagauguggcaguuaauguauuuccaucgcagggaccugcgcuuagcggcaaacgcaaucuguuccgcuguccccguggacugggugcccacgagccggaccaccuggaguauacacgcccaccaccaguggaugaccacggaggauaugcucuccgucuggaaccgcguguggaucgaggagaacccguggauggaggacaagacccacgugagcagcugggaagagguccccuaccuggggaaacgagaggaucagugguguggcucacugaucggccucaccgcccgggcuaccugggccacuaauauccagguggcuaucaaccaagugcgccggcugaucggaaaugaaaacuacuuagauuacaugaccagcaugaagcgcuucaaaaaugagagcgacccagagggcgcgcucugguag

SEQ ID NO: 23961 - RNA, 9879 nt, Artificial Sequence
  derived and/or modified CDS sequence (opt11) from DENV-1__FJ024480__SS-prME
uccgugacgaugcugcucaugcuauuaccaaccgcccucgccuuccaccugacgacccgaggcggggagccccacaugauugugagcaagcaggagcggggcaagagccuccuguucaagaccagcgcggggguuaacaugugcacgcugauugccauggacuuaggagaacucugcgaagacacaaugaccuacaagugcccccagauuacugaggccgagcccgacgauguggacugcuggugcaacgccaccgacaccugggugaccuacgguacaugcucucagaccggggagcaccggcgagacaagagguccguggcccuggcgccccacgugggacugggauuggagacgagaacggagacguggaugaguuccgaaggggccuggaagcagauccagcgagucgagaccugggcccugaggcacccaggguucacggugauagcccuguuccucgcgcacgcuauaggcaccucgaucacccagaaggggaucaucuucaucuuacucauguuagucacccccuccauggcuaugcgcugcgucggcaucggaaaccgggacuucguggagggucugagcggcgcgacgugggucgacgucgugcuggagcacggguccugcguaaccaccauggccaagaauaaacccacccucgauauagagcugcuuaagacggaggucacaaaccccgcuauccuccgcaagcugugcauugaggccaagauaagcaauaccaccacggacucccggugccccacccaaggagaggccacauugguggaggagcaggacgccaacuucgugugucggcggacguucgucgaccggggcugggggaacggcugcggccucuucggaaaagguagcuugcugacgugcgccaaauucaaaugugugaccaaacucgagggcaagaucguacaguacgagaaccugaaguacagcguaaucguaacagugcauaccggugaccagcaccaggucgggaacgagacaaccgagcacggcaccaucgcgaccaucaccccccaggcaccaacuagcgagauccagcugaccgacuacggugcccucacccuugacugcagcccccguaccggccucgacuucaacgaaauggugcuccuuacgaugaaggagaaguccuggcuggugcacaagcagugguuucucgaccugccgcugccguggaccuccggagccagcacaagccaagagacguggaaccgccaggaccuuuuggugaccuucaagaccgcacacgcgaagaagcaggaggugguagugcuaggaucccaggagggcgcuaugcacaccgcccucaccggggccacugagauccaaacuagcggcaccaccacgauuuucgcggggcaucugaaaugccggcugaagauggacaagcucacacugaaaggcaccucguacguuaugugcaccgggagcuuuaagcuggagaaggaggucgcggagacgcagcacgguaccguucuggugcaggucaaguaugagggcacggacgcaccuugcaaaauaccuuucuccacgcaggaugagaagggggucacgcagaacggucgccugauuaccgccaacccaaucgucaccgacaaggagaagccgguaaauaucgagaccgagccgccuuucggggagagcuacauaguugugggcgcgggugagaaggcuuugaagcuguccugguucaaaaagggcagcuccaucgguaagauguucgaggccaccgcacgcggggcccgccggauggccauccucggcgacacagcgugggacuucgggaguaucggcggcguguucaccuccgugggcaaacuggugcaccagguguuuggaaccgccuacggcguguuauuuucaggcgugucauggacuaugaagaucgggaucggcauccuccugacuuggcugggccucaacucacgcuccaccagcuuauccaugaccuguaucgcagucgggauggugacucuguaccucggcgucaugguccaggccgacagcggcugugugaucaacuggaagggccgcgaauugaagugcggcuccggcauuuucgugaccaacgagguucacacauggaccgagcaguacaaauuccaggccgacucaccaaagcggcugucggcggccaucggcaaggccugggaggagggcgucugcggcauccgguccgccacucggcucgaaaacauaauguggaaacagaucagcaaugaguuaaaccacauccugcucgagaacgacaugaaguucacgguggucgugggugacgccaacggaauccucgcgcaggggaagaaaaugauacgcccucagcccauggagcauaaguauuccuggaaaagcuggggcaaggccaaaauaauuggugccgacauacagaacaccaccuuuaucaucgacgggcccgacacgccggagugccccgacaaccagagggccuggaauaucugggagguggaggauuauggguucgggauauucacgaccaacaucuggcugaagcuccgcgauaguuauacccagaugugcgaccacaggcugaugucagcggccaucaaggacuccaaggcuguccaugcggacauggguuauuggauugaaagcgagaaaaacgagacguggaaacuggcccgcgcgaguuucaucgaggugaagacaugcacuuggcccaagagccacacacucuggaguaacggcgugcuggagagcgagaugaucauccccaagauauacgggggaccgauuucccagcacaacuaccggcccggguacuucacgcagacggccggccccuggcaucuggggaaguuggaguuggacuuugaccugugcgaagggacaaccgucgugguggaugagcacuguggcaaccgcgggccgagccugaggacaacgaccguaaccggcaagauaauccaugaguggugcugccgaucaugcacccugccgccccugagguucagaggggaggauggguguugguaugggauggagauccggcccgugaaggaaaaggaggagaaccucgugcgcagcauggucagugccggcagcggcgagguagacucguucucauuaggcauccugugugccagcaucaugaucgaggaaguaaugcggucccguuggagccggaagaugcucaugacgggcacccuggccgucuuccugcuccuaaucauggggcaacugacguggaacgaucucauacgccugugcaucauggugggcgcgaacgccucggaccgcaugggcaugggcaccacguaccuagcccucauggccacuuucaagaugcggccgauguucgcuguggggcugcucuuccgaaggcuuaccagccgcgaggucuuacuccucacgaucggccugucccugauggcaagcgucgagcuccccaacagucuggaagagcugggugacggucucgccaugggcaucaugaugcucaagcugcucacggaguuccagccucaccaguuguggaccacccuccucagccucaccuucaucaaaacaacucugucccucgacuacgccuggaaaaccacugcaauggcgcugucuauuguauccuuguuuccccucugccuaagcacgaccucccagaagaccacauggcugccggugcuccugggcucuuucgggugcaagccucugaccauguuccugauuacggagaacaagaucuggggccggaaguccuggccucugaacgaagggauaauggcuauuggaauuguuagcauucugcucuccucgcugcugaagaacgacgucccccucgcggggccgcugaucgcaggcggcaugcugauagcuugcuauguaaucagcggguccagcgcggaccucucccuggaaaaagccgccgaggugagcugggaacaggaggccgagcacucgggcacuagccacaacauccuggucgagguucaggacgacgguacgaugaagaucaaggacgaggagcgagacgauacccugacgauccugcugaaagcgacacuccuggcgguguccggcgucuaccccaugucuauacccgccacccuguucgugugguacuucuggcagaaaaaaaaacagcgguccgggguucucugggacacgcccuccccgcccgagguugagcgcgccgugcuggacgacggcaucuacagaauacuccagcgcggccugcucggccggucccaagugggggucgggguguuucaggacggcguguuccacacgauguggcacgucacccguggggccgugcuuauguaccaggggaaacggcuagagcccucaugggccucggucaagaaggacuuaaucaguuaugggggcggauggcgcuuucaggggucuuggaacacaggcgaggagguccagguaaucgcaguggagcccggcaagaacccgaagaacguacaaaccacucccggcaccuucaagacccccgagggcgaagugggggccaucgcccuggauuucaagccugguaccagcgggucuccgaucgugaacagagagggcaagaucgucggccuguacgggaacggcguggucacgaccagcgggacguacgucuccgccauugcacaggccaaggccagccaggagggcccccugccugagaucgaggacgagguguucaaaaagcgcaaccugaccaucauggaccugcaccccggguccggcaagacgcggcgcuaccugcccgccaucgugcgggaggcuaucaagcgcaagcugcggacccugauccucgcgcccaccagagucguggcauccgagauggccgaggcccugaaagguaugcccauccgcuaccagacuacggccguuaaaagcgagcacaccgguagagagaucguggaucucaugugccacgcgaccuuuaccaugcgccuccuguccccggugcgggugccuaacuacaacaugaucaucauggacgaggcccauuucacugaccccgccagcaucgcggcccgcggcuacaucuccacgcgggucgggaugggugaggcggccgccaucuucaugaccgccacuccgccgggcagcguggaggccuuuccgcaguccaacgcagugauccaggaugaagaaagggauauacccgaacggucguggaacuccggcuacgacuggaucacggacuuccccggcaagacggucugguucgucccuagcaucaaguccgggaacgacauagccaacugccugcgcaagaacggcaaacgagugauccagcucucgagaaagacguucgauaccgaauaccagaagacgaagaauaaugauugggacuacgucgugaccaccgacauaucggagaugggggccaacuucagggccgaccgcgugauugauccaagaagaugucuuaagcccgucauccucaaagacggccccgagcgugugauccucgccgggccuaugcccguuacggucgcgucugccgcccagcgccggggccguaucggccgaaaccagaacaaggagggagaucaguacguauacaugggccagccccugaacaaugaugaggaccacgcucacuggacggaggcgaagaugcugcuagacaauaucaacaccccggaggggauuaucccggcccuuuucgagcccgagcgcgaaaaguccgccgcuaucgauggcgaguaccgccugcgcggggaagcccgcaagacuuucguggagcucaugcggcgaggcgaccuacccgucuggcugaguuacaaggucgcgucggaaggauuccaguacagcgaccggcgcuggugcuucgacggggagcggaacaaccagguacuagaggagaauauggacguagagauauggacaaaggagggugagcgcaagaaacuccggccccgcuggcuagacgcccggacuuacuccgacccgcucgccuuacgcgaguucaaggaauuugccgcaggacggcgaagcguuagcggugaccugauacuagagaucggcaaacugccccagcaucucacgcuccgggcgcagaaugcacuggacaaccuggucaugcuccacaauuccgaacagggcgggaaagccuaccgccacgccauggaggagcugcccgauaccaucgaaacccugaugcuccuggcgcuuaucgccgugcucaccggaggcgugacgcuguucuuccuguccgguaagggccucggcaagaccaguaucgggcugcugugcgucaccgccagcuccgcccuccuauggauggcuagcguagagccccacuggaucgcagccuccaucauccucgaguucuuucucaugguuuuacugaucccggagccugaccggcagcgcacgccccaggauaaccagcucgccuaugucguaauugggcugcuguucaugauucucacgguggccgccaacgagaugggacugcuggagaccaccaagaaagaccugggaaucgggcacgucgcggccgagaaucaccagcacgccaccaugcuggacguggaccugcggccggccagcgccuggacgcucuacgcgguggccaccaccgucauaaccccaaugaugcgucauacgaucgagaauacgacggcgaacaucucccuuaccgccaucgccaaucaggcggccauucugaugggccucgacaaaggcuggcccaucucuaagauggacaucggggugccccugcuggcuuuaggcugcuauucccaggugaauccgcugacgcugaccgccgcgguccucaugcucguggcccacuaugccaucaucgggcccggacugcaggccaaggccacccgcgaggcgcaaaagcgcaccgccgcaggaaucaugaagaaccccacgguggacggaaucgucgccaucgaccucgaccccgugguguaugacgccaaauucgagaagcagcugggccagaucaugcugcucauccugugcacuagccagauauugcuaaugagaaccaccugggcguugugugaguccaucacgcuggccacaggcccccuaaccacccuuugggaagguucgcccgggaaauuuuggaacaccacaaucgccgucuccauggcgaacauuuuccggggaagcuaucuggccggugcugggcuagccuucucccuuaugaagucccuaggcgggggccgucgaggcaccggcgcgcagggcgaaacgcuaggagagaaguggaagcgccagcugaaccaacuguccaagucugaguucaauacguacaaacggucaggcaucauggagguggaccgcucugaagccaaggagggucucaagaggggcgagaccaccaagcacgccgugagccgcggaaccgccaagcugcggugguucguggagcgaaaccuggugaagccugaggguaaggugaucgaucuggggugcgggcgggguggguggucauacuacugcgccggccucaagaagguuacagaggugaagggauacacgaaagggggcccggggcacgaggagccgauccccauggcaaccuacggcuggaaccuagugaaacugcacaguggcaaggacgucuucuucaugccgccggaaaagugcgauaccuugcugugcgauaucggcgagucaagcccgaaccccacaaucgaggagggacgcacgcuacgggugcucaagaugguggaacccuggcugaggggcaaccaguucugcauuaaaauccugaaccccuacaugccauccguuguggagacgcuggagcagaugcaacggaaacacggcgggaugcuggugcggaacccccugucccggaacuccacccacgagauguacugggucagcugcggcacagggaacaucgugucagccgugaacaugacgagccgcaugcuauuaaaccgauucacgauggcucaccgcaagcccacguaugagcgcgacgucgaccugggcgccggcacccggcacguggccguggagccggagguugccaaccucgacaucaucgggcagcgcaucgagaacaucaagaacgagcacaagaguacguggcacuacgacgaggauaacccguacaagaccugggccuaucauggcagcuacgaggugaaaccaucagggagcgcguccuccauggugaauggcguaguaaagcuguugaccaaaccuugggacguuauccccauggucacccagaucgccaugacggacacaaccccguucgggcagcagcgcguguucaaggagaaggucgacacccgcacuccccgggcgaagcgcgguaccacccagaucauggaagugaccgccaagugguuauggggcuucuuaagucgcaacaagaagcccaggaucugcacucgggaggaguucacucgcaaagugcggagcaacgccgcgauaggggccgucuucgucgacgagaaucaguggaacagcgccaaggaagccguugaggacgagcgauucugggacuuggugcaccgagagagggaacuacacaaacagggcaagugcgcgaccuguguguacaacaugauggggaagcgggagaagaagcugggcgaguucgggaaagccaagggcuccagggcaauaugguacaugugguuaggcgcccgguuccucgaguucgaggcgcucggguucaugaaugaggaccacugguucagccgcgagaacuccuugagcggcguggagggggagggccuucacaagcugggcuauauccugcgggacaucuccaagaucccgggcggcaauauguacgcggacgacaccgcugguugggacacgcgcaucacugaggacgaucuacagaacgaagccaaaaucaccgacauaauggagcccgagcacgcccugcuugccaccagcaucuucaagcucacauaccagaacaagguaguccgggugcaaaggcccgcgaaaaauggcacggucauggacguaaucucccgccgggaccagcgagguagcggccaggugggcaccuacgggcugaacaccuuuacgaacauggagguccagcuaauccggcaaauggaguccgaagguaucuuucuccccagcgagcuggagaccccuaaccuggccgagagaguucucgacuggcuggagaaacauggggccgagcgccugaagcgaauggccaucuccggcgacgauugcguggucaagcccaucgacgaccgguucgccaccgcccucaccgccuugaacgacauggggaaagugaggaaggacauaccccagugggagcccucuaagggcuggaacgauuggcagcaggucccauucugcucccaccacuuccaccaacugaucaugaaggacggccgggagaucguugugcccugccgcaaccaggacgaacugguggggcgggcgagggucagccagggcgccgggugguccuuaagagagaccgcaugucugggaaaaaguuaugcgcagauguggcagcucauguacuuccaccgccgugaccugcgccuggccgcgaacgccauaugcuccgccguucccguggacuggguccccacgagccggaccaccuggaguauccacgcccaccaccaguggaugaccacggaggacaugcucagcguguggaaccgggucuggaucgaggagaacccguggauggaggauaagacucacgucagcagcugggaggaggugccuuacuuagggaagcgggaggaccaguggugcggcucauuaaucggcuugaccgcccgcgccaccugggccacgaacauccaaguagccaucaaccaaguccgccggcucaucggcaaugagaacuaccuggacuacaugaccucaaugaagcgcuucaagaacgagagcgacccggagggagcccuuugguga

SEQ ID NO: 23962 - RNA, 9879 nt, Artificial Sequence
  derived and/or modified CDS sequence (opt11) from DENV-1__FJ873814__SS-prME
agcgugacuaugcuucucaugcugcuaccaaccgcccucgccuuccaccucaccacucgaggcggggagccgcacaugaucgugagcaagcaggagcggggcaagagcuugcucuucaagacguccgcgggggugaacaugugcacccugauugccauggaucuuggcgagcucugcgaggacaccaugaccuacaagugcccccaaaucaccgaggccgagcccgacgacguggacugcuggugcaacgcgacggacaccugggugaccuaugggaccugcagccagacuggcgaacaccgacgggacaagcgauccguggcccuggcgccccacgugggccuagggcuggagacgcggacagaaaccuggaugagcuccgagggcgcguggaagcagauccagcgcguugagaccugggcccuacggcaccccggguuuacggugguggccuucuuccuugcgcacgccaucgggacaagcaucacucagaaagggaucaucuucauccuacuaaugcugguaacccccuccauggccaugcggugcgugggcauaggcaaccgcgacuuuguggaggggcucagcggcgcuacgugggucgacguggugcuggaacacggguccugugucaccaccauggccaagaacaagcccacccuggacaucgaguugcugaagacggaggugaccaacccggcgauccugcgcaagcucugcaucgaggcuaagaucucgaacaccaccacggacucccggugcccgacccagggcgaggcuacucugguggaggagcaggacgccaauuucgucugccgcagaaccuucguggaccgcggcugggggaacggaugcgggcuguucggcaaagguagccuccugacaugcgccaaguuuaagugcgugacaaagcuagagggcaagauuguccaauacgagaaucugaaauauuccgugauagucacgguccacaccggcgaccagcaccaggucgguaacgagacgacagagcacggcaccaucgccaucaucacgccacaggcccccaccagugagauccaacuaacggacuauggggccuuaacccucgacuguagcccacggacgggccuggacuucaacgaaaugguccugcucaccaugaaggagaaguccuggcuggugcacaagcaaugguuccuggaccucccgcugcccuggacgucuggugccagcaccagucaggagaccuggaaccgacaggaccugcucgugaccuucaagacugcccacgcgaagaagcaagaggucguugugcucggcucgcaggagggcgccaugcacaccgcccugaccggggccaccgaaauccagacaucaggcaccaccaccaucuucgcagggcacuuaaagugccgucugaagauggacaagcugacgcucaagggcaccuccuaugucaugugcaccgggucguucaagcuggaaaaggagguugcggaaacccagcacggcacagugcuggugcagguaaaauaugaagguaccgacgcccccugcaagaucccguucuccacccaggacgagaagggggugacccagaacggccgccugaucacggccaacccgaucgucacagacaaagagaagcccgugaacaucgagaccgagccgcccuucggggagaguuacauagugauaggcgccggcgaaaaagcgcucaagcuguccugguucaaaaaggggucguccauuggcaagauguucgaagccaccgcccgcggggcccgccggauggccauccuuggcgacacggcgugggacuucgggucaaucggcggcgucuucacguccguggggaaguuggugcaccaggucuucggaacugccuacggcgugcuguuuucgggcguguccuggacgaugaagaucggcaucggcauccugcucacguggcuaggccucaauagccgcucuaccucguugucuaugacaugcaucgccgucgggaugguaacgcuuuaccugggggugaugguccaggccgacaguggguguguaaucaauuggaagggccgcgagcucaagugugguuccggcaucuuugugacaaacgagguccacaccuggaccgagcaguacaaguuucaggccgacucgccgaaacggcugagugcggcgauuggcaaggccugggaggagggggugugcggcauuagauccgccaccagauuagagaacauaauguggaagcaaaucaguaacgagcucaaccacauuuugcuggaaaacgacaugaaguucaccguggucgugggggacgccaacggcaucuuagcgcaggggaagaagaugauacguccccagccgauggagcacaaguacuccuggaaguccuggggcaaagccaaaaucaucggugcagacauacagaacacuaccuucaucauagacgggcccgauaccccagaaugcccugaugaucagcgggcguggaacaucugggagguggaggacuacgguuucggcaucuucacgacgaauaucuggcugaaacugagggacuccuauacccagaugugcgaucaccggcucaugagcgcggccauaaaggacucaaaggccguccacgccgacaugggauacuggaucgagagcgagaagaaugagaccuggaagcuggcccgcgcgagcuucaucgaggugaagaccuguaccuggccaaagagccacacccucugguccaacgggguucucgagagcgagaugaucauucccaagaucuacgggggcccgaucucccagcacaacuaccggcccggauacuucacucaaacugccggccccuggcaccuggggaagcuggaacuagacuucgaccugugcgaggggacgaccguagugguugacgagcacugcgguaaccgcggaccgucucugcgaaccaccacugucaccgguaagaucauccacgaguggugcugccgguccugcacccugcccccccugcgguuccgcggggaggacggaugcugguacgggauggaaauccggcccgugaaagagaaggaggagaaucuggugcgcagcauggucuccgcaggaagcggcgagguggacagcuucucccucgguauccugugcgccagcaucaugauugaagaggugaugagaucccgcuggagcaggaagaugcugaugaccgguacgcucgccgucuuccugcugcucauaaugggccagcugacauggaacgaccugaucagacugugcaucauggugggugcuaaugccuccgaucgcaugggcaugggcaccaccuaccuggcgcucauggccaccuucaagaugcggccgauguucgcggucggccuccuuuuucgccggcugaccagccgcgagguccuccugcugaccauagggcucucccuggucgcgagcguggagcugccuaacucccucgaggagcuaggagacggguuagcuauggguaucaugaugcucaagcuccugaccgaauuccagccccaccagcucuggacgaccuugcucaguuuaacauucaucaagaccacgcugucuuuagacuacgccuggaagacuaccgcaauggcgcucagcaucguuuccuuguuccccuugugccucagcaccacgucccagaagacgaccuggcuuccggugcuccucgguaguuucggauguaagccacugaccauguuccugaucaccgagaacaagauuuggggccggaaguccuggcccuugaacgaggggaucauggccauaggcauugucagcauucugcugucgucgcuacugaagaacgaugugccccuggcuggcccgcucaucgccgguggcaugcugaucgcuugcuacgugaucagcggguccagcgcggaccugucccuagagaaagccgccgaggucagcugggagcaggaggccgagcacucuggcaccagccacaacauccugguggaggugcaggacgaugggaccaugaagaucaaggacgaggagaaggacgauacccugaccauccuacugaaggcaacgcugcucgcggucuccggcguauacccaaugagcauccccgccacccuguucgugugguacuucuggcagaagaagaaacagagauccgggguccugugggacacccccagcccgcccgagguggagcgggccgucuuggacgacggcaucuaccgcauccugcagcggggccugcuggggcgcucccaggucggcguggggguguuccaggauggcgucuuccacaccauguggcacgugacacgcggggccgugcucauguaccagggcaagcgacuggagcccagcugggcgagugucaagaaggacuugaucagcuacggcgggggcuggcgguuccagggcuccuggaacaccggggaagagguccagguuaucgcgguagagcccgggaagaaccccaagaacgugcagaccacccccggcacguucaaaacccccgagggcgaagugggggccaucgccuuagauuucaagcccgguaccagcgguuccccgauuguuaaucgcgaggggaagaucgugggccuguacgggaacgggguggucaccacgagcgggaccuacgugucggccaucgcccaggcgaaggcaagccaggaggguccccugcccgagauagaggacgagguguucaagaagcggaaccucacaaucauggaccugcacccggggagcggcaagacccgacgguaccugcccgccauuguccgcgaagcgaucaagagaaagcuccgaacgcugauccuggcgcccacccgcgugguggccuccgagauggcagaggcccucaaaggcaugccgauccgcuaccagaccaccgccgucaagagcgagcacacggggcgcgagaucguugaccuaaugugccacgcuaccuucacgaugcggcugcucuccccagugcgcguccccaacuacaacaugaucaucauggacgaggcccacuuuaccgaccccgcaagcaucgcggcccggggguacaucuccacccguguugguaugggcgaagcggcagcuaucuucaugaccgcgacgccgccggggagcgucgaggccuuuccccagucuaacgcggucauccaggacgaggaacgggacauacccgagagaagcuggaacucgggcuacgacuggaucaccgacuuccccggcaagacggugugguuugugcccagcaucaaguccgggaacgacaucgccaacugccugcgcaagaacggcaagaggguaauucagcugagccggaagaccuucgauacugaauaccaaaagaccaagaacaacgacugggacuauguggugacgaccgacaucuccgagaugggagccaacuuccgcgccgaccgggucaucgauccacgccggugccucaaacccgugauucuuaaggacggccccgagcgcgugauccuggcggggccgaugcccgucaccguggccagcgccgcccaaagacgcggccgaaucggccgcaaccagaacaaagaaggugaccaguacguguacaugggccagccccucaacaaugacgaggaccacgcccacuggaccgaggcgaaaaugcuccuggacaacaucaacacgcccgaggggaucaucccggcccucuucgagcccgaacgcgagaaguccgcagccaucgacggcgaguauaggcugcgcggugaggcccggaagaccuucgucgaacugaugcgucggggcgaccuccccguguggcugaguuacaagguagcguccgagggauuccaguacagugaucgccgaugguguuucgacggggagcgcaacaaccaggugcuggaggagaacauggacguggagaucuggaccaaggagggcgaacggaaaaagcuccguccacgguggcuggacgccaggacuuacucggauccucuggcccuccgggaauucaaggaguuugcugccgggaggcggagcgucagcggcgaccuuaucuuagagaucggcaagcucccccagcaccuuacccugcgcgcgcagaacgcccucgacaaccuggugaugcugcacaacuccgagcaggggggaaaggcuuaucgacacgcaauggaagaacuccccgacacgaucgagacccugaugcugcucgcacugaucgccgugcugaccgggggcgugacccucuucuuccuuagcgggaagggccucggcaagacguccaucggccuauuaugcgugaccgccagcagcgcccugcucuggauggccagcguggaaccccauuggaucgcggccuccaucauccuggaguucuuucugaugguauugcugaucccugagcccgaccgccagcggacgccccaggauaaccagcuggccuacguugugaucgggcuccuguucaugauacugacagucgccgcuaacgaaauggggcuccuggagacgaccaaaaaggaccugggcauagggcacguggcggccgagaaccaccagcaugcuaccaugcucgacguggaccugcgaccggccagcgccuggacccucuacgcggucgcaacgaccgugauuacgcccaugaugagacacaccaucgaaaacacgaccgccaacaucucacucaccgccaucgccaaucaggcggccauccugaugggccuugacaagggcuggcccaucagcaagauggacaucggugugccucucuuagcccugggcugcuauucccagguaaacccgcucacccucacggccgcgguacucaugcucguugcccacuacgccaucaucgggccgggccugcaggcgaaggccacccgggaggcgcagaagcggacugccgccgguaucaugaagaacccuaccgucgacggcaucguggccaucgaucuggaccccgugguauacgacgcgaaguucgagaagcagcucggccagauuaugcugcugauucucuguacgagccagauacugcugaugcgcaccaccugggcgcuuugcgaguccauuacccuggccacuggaccgcugaccacccucugggagggcagccccgggaaauucuggaauaccacgaucgccguuuccauggccaacaucuuccggggcagcuaccuggccggcgcggggcuggccuucucccucaugaagucacugggcgggggccggcgcgggaccggcgcccaaggagagacccugggggagaaauggaagcgacagcucaaccagcuauccaagagcgaguuuaacaccuacaagagaucaggcauuauggagguggaccggagcgaggccaaagaggggcugaagcgcggcgagacgaccaagcaugcggucagccgggggaccgcaaagcuccgcugguucguggagcgcaaucuggugaagcccgagggcaaggucaucgacuuaggaugugggcgcggcggguggucauacuauugcgccggccucaaaaaggugaccgaagugaaaggauacaccaaggggggucccggccaugaggaaagcauacccauggccacguaugcuuggaaccucguuaagcuacacucgggcaaggauguguuuuucaugccgccagaaaagugugacacccugcucugcgacaucggggaguccagucccaacccgaccaucgaggaaggccggacccugcgcgugcugaagauggucgagcccugguuacgggggaaccaauucugcaucaaaauccugaaccccuacaugccuagcgugguagaaacgcuggagcagaugcagcgcaagcacgggggcaugcuuguccggaacccgcugucccgcaacagcacccaugagauguacuggguguccugcgggaccggaaacaucguuagcgcggucaauaugaccucccggaugcugcucaaccgcuucacgauggcccaccggaagccaacauacgagcgagauguggaucugggggccggcacccgccacguggccgucgagcccgagguugcaaaccuggacauuaucggccagcggaucgaaaacaucaagaaugagcacaaaagcaccuggcacuacgacgaagacaacccuuacaagacgugggcguaccacggguccuacgaggugaagccgagcggcucagccagcuccauggucaacgggguggugcgucugcugacaaagccuugggacguuauaccaauggugacccaaauugccaugaccgacacgaccccguucggccaacagcgggucuucaaagagaagguggacacccgcacuccgcgggccaagcgcgggacgacccagaucauggaggugaccgccaaguggcuguggggcuuccucagccggaacaagaaaccgcgcaucugcaccagagaagaauucacgcgcaagguccggagcaacgcugccaucggcgccguguucguggacgagaaccaguggaacuccgccaaggaggcgguggaagacgagcgcuucugggaucucgugcaucgggagcgcgagcugcauaaacaggggaaaugcgcgacaugcguauacaacaugaugggcaagcgggagaaaaaacucggggaguucggcaaggcgaaagggagccgcgccaucugguacauguggcugggcgcucguuuccuggaguuugaagcgcugggcuucaugaacgaggaccacugguucucccgagagaacagccugaguggcgucgagggcgaggguuuacacaagcucggcuacauccuccgggacauuagcaagauacccgggggcaacauguacgcagacgacaccgccggcugggacacccgcaucacggaggacgaucugcagaaugaggccaaaaucaccgauauuauggagccggagcacgcccuccuggcgacguccauauucaagcugaccuaccagaacaagguugugcggguccagaggccugccaagaacgguacagugauggaugugaucucucgcagggaccagcguggcuccgggcaagucgguaccuacggucugaacacguucaccaacauggagguucagcucauccggcagauggagagcgagggcaucuuccugccguccgagcucgagacgcccaaccuggcaaagcgcgugcuggacuggcucgagaagcacggcgccgaacggcugaagcgcauggccaucagcggggaugacugcguagugaagccuaucgacgacagguucgcgaccgcucugacagcacucaacgacaugggcaaagugcggaaggacaucccccagugggagcccagcaaggguuggaaugacuggcagcagguccccuucugcagccaucacuuccaccaacugaucaugaaggacggcagggagaucguggugcccugcaggaaccaggacgaguuggucggacgggcccgcgugucccagggggccggcuggagccuccgggagacagcuugcuuggggaaguccuacgcccagauguggcagcuaauguacuuccaccgccgggaccuccgccuggccgcgaacgcgaucugcagcgccgugccugucgacugggugcccacuagcaggacuaccuggaguauccacgcccaccaccaguggaugaccaccgaggacaugcugagcguguggaaccgcgucuggaucgaggagaacccauggauggaggacaagacgcacguguccucaugggaagagguuccguaccucggcaagagagaagaucaguggugcgggucacugaucggccugacagcccgcgccaccugggcgaccaacauccaagucgccaucaaccaagugcggcggcuuaucggaaacgagaacuaccuggauuacaugacgucuaugaagcgcuucaagaacgaguccgaccccgagggggcccugugguga

SEQ ID NO: 23963 - RNA, 9879 nt, Artificial Sequence
  derived and/or modified CDS sequence (opt11) from DENV-1__JN819403__SS-prME
agcguuaccaugcuccucaugcuccuccccacugcucucgcuuuucaucucacgacccgggguggggaaccccacaugaucguaagcaaacaggaacgggguaaauccuuguuauucaagaccagcgcaggggugaacaugugcacccuuaucgccauggacuuaggggagcucugcgaggacacuaugaccuacaaaugcccccagaucaccgaggccgagccugaugacguggauugcuggugcaaugcuacagacaccugggucaccuacgggacaugcagccagacgggcgagcaucgccgggacaagcgcucugucgccuuagcgccccacgugggucuggggcucgagacccgcacagagaccuggauguccuccgagggcgcguggaagcagauccaacgcguugagaccugggcccugcgccaccccgguuuuacagucauugccuuauucuuagcacacgccaucggcacuagcauaacgcaaaaggggauuaucuucauccugcugaugcucguaaccccguccauggccaugcgcuguguaggcaucggcaaccgggacuucguggaaggccucagcggggcgacuuggguggacgucguacuugagcacgggucuugcgugacuaccauggccaagaacaaacccacccucgauaucgagcugcugaagacggaaguaaccaaccccgcgaucuuacgcaaacucugcauagaagcgaaaauuagcaacacaacuacagacagucggugcccgacccagggcgaagccacccugguugaggaacaagacgccaacuuugugugcagacgcacuuucgucgaucgcggcugggggaacggcugcggccucuucggcaaagggagucugcucacgugcgccaaguucaaaugugugaccaagcucgagggcaagaucgugcaguacgaaaaucugaaguauucagucauagugaccguucacaccggcgaccagcaccaggucgggaacgagaccaccgagcacggcaccauagcuacaauuacaccccaggccccuacgagcgagauacaauugacggacuacggggcccugacccuggacugcucaccccggaccggccuggacuuuaacgagaugguacuccugacgaugaaggagaaguccuggcugguacacaagcagugguuccucgaccugccauugcccuggacuucaggggccaguaccagucaagagacauggaaccgccaggaucuccucgugacuuuuaagaccgcccacgcgaagaaacaagaggugguagugcuggggagccaggagggcgccaugcacacugccuuaaccggagccacagagauucaaacuagcggcaccaccaccauauucgccgggcaccugaaaugccgguuaaagauggauaagcucacgcuaaaggggacaucauacgugauguguaccggaucuuucaaacuggagaaagaggucgcagagacgcagcacgguaccguacuggugcaggucaaguaugaagguaccgaugcccccuguaagauaccauucuccacucaggacgagaaggggguaacccaaaacgguagguugaucacagccaauccgaucgugacggacaaagaaaagcccguuaacauugagaccgaaccucccuucggggaguccuacauaguagugggggccggugaaaaagcccugaagcuguccugguucaaaaagggaagcuccaucgguaagauguuugaggcaacggcaagaggggcacgccgcauggccauccucggggacaccgcgugggacuucgggagcaucggcgguguuuuuaccuccguagggaaacuggugcaccaagucuucggcacggccuacgguguacuguucagcggcguguccuggacaaugaagaucgguaucggcauauugcugacguggcuggggcugaacucccgcaguaccucuuuaagcaugacuuguauugcuguagggaugguaacgcuguaccucggcgugaugguacaggccgauagcggguguguuaucaacuggaagggccgcgaguuaaagugcgguuccggcaucuucgugacaaacgaaguacacaccuggaccgagcaguauaaguuccaggcggauuccccgaagcggcuuucggcugcaaucgguaaagccugggaagaaggcgugugcgguauccgcuccgccacccgucucgagaacauuauguggaagcaaaucucuaacgaacugaaccacauccuguuagagaacgacaugaaguucacgguggucgugggagaugccaacggcauucuggcccaggggaagaaaaugauccgaccacaaccaauggagcacaaauauuccuggaaaaguugggguaaggccaagaucauuggcgccgacauccaaaauaccaccuucauuaucgauggccccgacaccccggaaugccccgacaaucaacgagcuuggaacaucugggagguggaggacuacggcuucgggaucuucacuaccaacaucuggcugaagcucagggacaguuacacccaaaugugugaccacagacugaugagcgcggccauaaaggauucaaaggccgugcaugccgacauggguuacuggauugagucugaaaagaacgagacuuggaaacuggcucgcgcgagcuucauugaggugaagacguguaccuggccaaagucacacacacuguggucaaauggcguguuggagagcgagaugauaauaccaaagaucuacgggggaccgaucucccagcacaacuaccgacccggguacuucacccaaacggccggucccuggcaccucgggaaacuagagcuggauuucgaucugugcgaaggcaccaccgucguuguagacgaacacugcggcaaucgcgguccgagccuccgcaccacaacgguuaccggcaagaucauacacgaguggugcugucgcucaugcacucuaccgcccuuacgauuccgcggggaagauggcugcugguaugggauggaaauucgucccguaaaggagaaggaggagaaucucgugcgcucgauggucuccgccgggagcggcgagguagauucguucagucuggggauccugugcgccaguauuaugaucgaagaggugaugaggucucgauggagcaggaagaugcucaugacagguacgcuggccguauuucugcuccuaauaauggggcagcugaccuggaacgaccucauacgccuauguaucauggugggcgcgaaugccuccgaucgcaugggaaugggcacuacguaucuggcccugauggccacuuucaagaugcggccaauguuugcggugggucuccuuuuucgccgauugacgagccgagagguccugcucuuaacuauugggcucucccugguggcgaguguggagcugcccaacucccucgaggagcugggagacggucucgccaugggcaucaugaugcugaaguugcucaccgaguuccagccgcaccagcucuggaccacccuguugucgcugaccuucaucaagacgacucuaucccucgacuacgccuggaagaccaccgcaauggcguuguccaucgucucacuuuucccccugugccuuagcacgaccucccagaaaacgaccuggcugccggugcuucugggcucguuuggcugcaaaccguuaacaauguuuuuaauaacggagaacaagauaugggguagaaaguccuggccccugaacgagggcaucauggccauuggcaucgucagcauucugcucucaucgcuucucaaaaacgacguuccccuagccgggccguugaucgcaggcggcaugcugauagccugcuacgugaucagugggaguagcgcggacuuaaguuuggagaaagcagccgaggucucuugggaacaagaggcagagcacaguggcacuagccacaacauccugguggaggugcaagaugacgggacgaugaagaucaaggacgaggagcgugacgacaccuugacgauuuuacugaaggcuacccuccucgcggugucgggcguguauccuaugagcaucccagccacucuguuugugugguauuucuggcagaagaagaagcaacgguccggaguccucugggacacccccucaccgccagaaguagagcgcgccgugcuagacgauggcauuuaucguauucugcagcgcggccugcucggccgaucccaggucggagugggcguguuccaagacggcguuuuccacacgauguggcacgugacccgcggggccguguuaauguaucagggcaaacggcuggagccuuccugggcuuccgucaagaaagaucuuaucaguuacgggggaggcuggagguuccaggggagcuggaauaccggcgaagagguccagguuaucgcggucgagccaggaaagaacccgaagaacgugcaaaccacaccaggcacauucaaaacccccgagggcgaggugggggccaucgcucuugacuucaagccuggcacauccgggucccccaucguuaacagggagggcaaaaucgugggccucuauggaaacggcguggugacaaccucugggaccuacgugucagccaucgcccaggcgaaggccucgcaggagggcccccuacccgagaucgaggacgagguauuuaagaaacgcaaucugaccauuauggaccuucauccagggagcgguaaaacgcgucgcuaccuccccgcgaucguccgagaggcuaucaagcggaagcugcggacacuuaucuuggcgcccacgcgcgucgucgccuccgagauggccgaggcccugaaggguaugccuauccgauaucagacuaccgcuguuaagagcgagcacacugggcgagagauaguggacuuaaugugccaugcgaccuucaccaugcgccuacuguccccggugagaguucccaacuacaacaugauuaucauggacgaggcgcacuucacggaucccgcaagcaucgcagcacgagguuacauuagcacccgcguggggaugggugaggcggccgccaucuucaugacugccacgccucccgggucaguggaggccuucccccaguccaaugcggucauccaggacgaggagcgcgauauccccgagcggagcuggaacaguggcuaugacuggauaacggacuuccccgggaagacggugugguucgugccuuccaucaaguccggcaacgacauagcgaauugccuacgcaagaacggcaagcgggucauccaguuaucgcgaaaaaccuucgacacagaauaucagaagacuaagaacaacgacugggacuacguggugaccaccgauaucucggagaugggugccaacuuccgggccgaccgagucaucgacccccguaggugucugaagccagucauacuuaaggauggacccgagagagugauccuggcaggucccaugcccgucaccguggcgucugccgcccagagacggggccgcauuggccggaaccaaaacaaggaaggggaucaguauguauauaugggccagccccugaacaacgaugaggaucacgcccacuggacggaggccaagaugcugcucgacaacaucaauacccccgaagguaucaucccugccuuauucgagcccgaacgcgagaagucggccgcgaucgacggcgaguaucgccugcgcggagaggcacgcaagaccuucguagagcuaaugaggcgcggugaccugccuguuuggcuguccuacaaaguugcauccgagggcuuccaguauagcgaccggcguuggugcuucgacggugagcguaacaaccaagugcucgaggagaauauggauguggaaaucuggaccaaagagggugagcguaagaaauugcggcccagauggcuggacgcccgaacguacucugacccguuagcacugcgcgaguucaaagaguucgccgcagggcggagauccgucaguggugaccugauccuagagauugggaaguuaccccaacaccuuacguugcgggcgcaaaacgcacuggacaaccuggugaugcuacauaacuccgagcagggcggaaaagccuaccgccacgcaauggaagaauuacccgacaccaucgaaacccugauguugcucgcguugauagccguuuuaacagggggcgucacgcuauuuuuccuuucagggaaaggccucgggaagaccucgaucgggcuacugugugugaccgccaguagugcguuauuauggauggcaucagucgagccgcacuggauagcggcgaguauuauucuagaguucuuccuuaugguauugcugauuccggagcccgaccgccagcguacaccgcaggacaaccagcuggccuacgugguaaucgggcuguuauuuaugauccuuaccgucgcugcgaacgagaugggauuacuggaaaccaccaagaaggacuuaggaauagggcacguggcugccgagaaccaccaacacgccacgaugcuggaugucgaccugcggccggccucugccuggacacucuaugcggucgccaccacagugaucacucccaugaugcgucacacgauugagaacaccacggcaaacaucagccugaccgccaucgccaaucaggcagcgaucuuaaugggacucgacaagggcuggcccauaagcaaaauggacaucggagugccccugcuggcccucgggugcuacucccaagucaacccgcugacccugacagcggcggugcucauguuagucgcccauuacgccauaauagggcccggcuuacaggcuaaggccacccgugaggcacagaagcgcaccgccgcuggaaucaugaagaaucccacagucgacggcaucguggcgaucgaccuugacccuguaguguaugacaccaaguuugagaagcaguuaggccagaucaugcuucucauacuaugcacaagucagauccuucuaaugcgcaccacgugggcccugugcgaauccauaacacuggcgaccgggccccucacuacguuaugggagggcagucccgggaaauuuuggaauaccaccauagcgguuuccauggcaaacauuuuccggggcagcuaccuggccggcgcaggcuuagcguucuccuugaugaagucccuagggggaggccggaggggaaccggggcucaaggcgagacacucggcgagaaguggaagcgucaguugaaucagcuguccaaaagcgaguucaacaccuacaagcgguccggcaucauggagguggacagguccgaggccaaggagggccucaagcggggcgagaccaccaagcacgccguuucucgcggcaccgcgaagcuacgaugguuuguagagcggaaccuagugaagcccgagggcaaaguuauagaucuuggcugcggacguggcggguggucauacuacugcgccggccugaagaaggugaccgaagugaagggguauaccaaaggcggucccggacacgagggcccgauccccauggcgaccuacggcuggaauuuaguaaaauuacauucuggcaaggaugucuucuucaugccgccggagaaaugcgauacucuccugugcgacauaggggaguccagcccaaauccuacgaucgaggagggccgcacucuacgcgugcucaagauggucgagcccuggcugagaggcaaccaauuuugcauaaaaauuuuaaaucccuacaugccguccguggucgagacccucgaacaaaugcagcgcaaguauggcgguauguuagugcgcaauccucugucccgcaauuccacccacgaaauguacugggugucuugcgguacugggaacaucguauccgcuguaaauaugaccagucgcaugcuucugaaccgguuuacaauggcgcaucgcaagccaacauacgaacgcgacguggaccuuggcgccgggaccaggcacguagcagucgagccagagguggccaauuuagacaucauuggucagcgcaucgagaacauaaagaacgagcauaagucgacuuggcacuaugaugaggacaacccguacaagaccugggcuuaucacggcucguacgaggugaaacccagugggagcgcuuccagcauggucaacggcguagugcggcugcugaccaagccgugggacgucauuccgauggugacccagaucgcgaugaccgacaccacccccuuuggccagcagcggguguucaaggaaaagguggauacgcgaacgccacgggcgaagagaggcacuacccagaucauggaagugacagccaagugguuguggggauucuugucaagaaauaagaaaccacggaucugcacccgcgaggaguucacaagaaaaguccggagcaacgccgccaucggagcgguguucguggacgaaaaccaguggaacagcgcgaaggaggccgucgaggacgagcgguucugggauuuggugcaccgggaacgggaacuccacaagcaaggcaagugugcaaccugcgucuauaacaugauggguaagcgcgagaagaagcugggggaguucggcaaggcuaaggggucgagagccaucugguacauguggcugggggcccgcuuuuuggaguucgaagccuuaggguucaugaacgaggaccacugguucagucgggagaacucccuguccggugucgagggcgaggggcuccauaagcugggguacauccuacgcgacaucucgaagaucccgggcggaaacauguaugccgaugacaccgcgggcugggacacccggaucaccgaggacgaucuccagaaugaagcgaagaucacugauauuauggaaccggagcacgcccuccuggccacgagcaucuucaagcuaacauaccaaaacaaaguuguuagaguccagcgcccagcgaaaaacggaaccguuauggacgucaucucccgacgcgaccagcgcggcucagggcagguagggaccuauggucugaauacguucaccaacauggaggugcagcugauacgccagauggaauccgaagggauuuucuugcccucugagcuugagacccccaaccuugcggagcgggugcuugacuggcuugagaagcacggggcagagcgccugaagcggauggcaaucuccggugacgacugcguuguuaagcccaucgacgaccgcuucgccacugcccuuaccgcgcuuaaugacaugggcaaagugcggaaagauaucccacaaugggagcccagcaagggguggaacgauuggcaacaagucccguucugcucccaccauuuccaucagcugaucaugaaggaugguagggagaucguggugccuuguagaaaccaggaugaauuggucgggcgcgcccgggugagccaaggagccggcuggucccugagggaaacagcaugccuuggcaaaucauacgcgcagauguggcagcucauguacuuccaucgucgcgaccuccgguuggcugcgaacgccaucuguuccgccgugccgguagacuggguucccaccagccgcaccaccuggagcauccacgcgcaccaccaguggaugacgaccgaggauaugcucucuguguggaaccggguguggaucgaggagaaccccuggauggaagacaagacccacgugagcucgugggaggaggugcccuaccuaggaaagcgcgaggaccaauggugcggcucucuaaucgggcucaccgcccgcgccacgugggcgaccaacauccaggucgccaucaaucagguucggcgcuuaaucggcaacgagaacuaccuggauuacaugaccucuaugaagcgguucaaaaacgagucugacccggagggggcgcucugguag

SEQ ID NO: 23964 - RNA, 9879 nt, Artificial Sequence
  derived and/or modified CDS sequence (opt11) from DENV-1__KF973453__SS-prME
agcgugacgaugcugcugaugcuguuacccaccgcgcuugccuuccaccugaccacccgggguggcgagccccacaugauagugagcaagcaggagcggggcaagagccuccuguucaagaccucggcuggggugaacaugugcacucucauagccauggaucugggcgaacucugugaggauaccaugacguauaaguguccucaaaucaccgaggccgagcccgacgacguggacugcuggugcaacgcgaccgacaccugggugaccuacgggaccugcagccaaaccggcgagcaccgccgggacaagcgcuccguggcuuuggcgccccacgugggccuggggcucgaaacgcggacggagaccuggaugagcuccgaaggcgccuggaagcagauccagcgcgucgagaccugggcccugcggcaccccggguucacagugauugcccuuuuccucgcgcaugccaucggcaccaguauuacccagaaagggaucauuuucauccugcuuaugcucgugacccccuccauggccaugcggugcguaggcauaggcaaccgggacuucguggaggggcugagcggcgccacuuggguggacguagugcuggagcacggguccugcguuaccaccauggccaagaacaagcccacccuagacauagagcugcugaaaacggaggucaccaacccggcuauucucagaaagcugugcauugaggccaagaucuccaacacuaccacggauucccggugcccgacccagggcgaggcgacccugguagaggaacaggacgccaacuucgugugccgccgaaccuuugucgaccgcggcugggguaacggcugcggccucuucggcaaggguagccugcugacgugcgccaaguucaaaugcgucaccaagcucgagggcaagaucgugcaguacgagaauuuaaaguacuccgucauaguaaccgugcacaccggcgaccagcaccagguugggaacgaaaccaccgagcacgguaccaucgcgaccaucacgccccaagccccuacgagcgaaauccagcuuaccgacuacggagcucugacccuggacuguagcccccguaccggcuuggacuucaacgagauggugcuccugacgaugaaggagaaguccuggcugguccacaaacaaugguuucucgaccugccccugcccuggaccaguggggccagcaccucucaggagaccuggaauagacaggauuugcuggugacuuuuaagaccgcccacgcgaagaagcaggaggucguugucuuagggagccaggagggcgccaugcacacagcccucacuggggccacggagauccaaaccagcggcacuaccacgaucuucgccggacaccugaagugccgccugaagauggacaagcugacccugaaaggaacauccuacgucaugugcaccgggagcuucaaacuggagaaggaggucgcagagacgcagcacggcacugugcugguucaggucaaguacgaaggcaccgacgcacccugcaaaauucccuucucuacccaggacgagaaggggguuacgcagaacggcaggcugaucaccgcgaacccgaucgugaccgacaaggagaagcccgucaacaucgaaaccgagccgccuuucggggagagcuacaucgugguuggcgcaggggaaaaggcccugaaacuuucaugguucaaaaagggcagcaguaucggaaagauguuugaggccacagcccgcggcgcccgccggauggcgauacucggcgacacugcgugggacuucgggagcauaggcggcgucuucaccuccguggggaagcugguacaccaggucuucgguaccgccuauggggugcuguucagcggcguauccuggacgaugaagaucgggaucgguauccugcuaaccuggcucggcuugaacagccguuccaccagccucuccaugaccugcaucgcagucggaauggugacguuguaccucggagugaugguccaggccgacagcgggugugugauaaacuggaaaggccgcgagcugaaaugcgggucagguauuuucgugaccaacgagguccacacguggaccgagcaguacaaguuccaggccgacagcccgaagcggcugagcgcggcuauaggcaaagccugggaggaaggggugugcgguauccgcagcgccacccggcuugagaacaucauguggaagcagaucaguaacgaacugaaucacauccugcucgaaaaugacaugaaguucacagugguggucggggacgcgaacggcauccuggcccaagggaagaagaugauccgcccccagccuauggaacauaaguauagcuggaagaguuggggaaaggccaagaucaucggcgccgacauccagaacaccacguucaucaucgacgggccugacaccccugagugucccgacaaccagcgggcauggaacaucugggagguggaggacuacggcuucgggaucuuuacgaccaacaucuggcugaagcuccgcgacucguacacccagaugugcgaccaccgacugaugucggcggccaucaaggacuccaaggcaguccacgccgauaugggcuacuggaucgagagcgagaagaacgagacguggaaacucgcacgcgcguccuucauugaggugaagacgugcaccuggccaaagagccacacccucuggucaaacggugugcuggaguccgagaugaucauccccaagaucuacgggggcccgaucucccagcacaacuaccggcccggguacuucacccaaacggccggccccuggcaucuggggaaguuagagcuugacuucgaccuuugcgagggcacuaccgucgugguggacgagcacugcggcaaucgcgggccaagucuccggacgaccacggucacuggcaagaucauccacgaguggugcugccgcuccugcacccucccgccccugcgguuccgcggggaggacggcugcugguacgggauggagauccggcccguaaaggaaaaggaagagaaccucgugaggagcauggucucggccggcucaggcgagguugauagcuucucccugggaauccugugcgcgagcaucaugaucgaggaggugaugcggagccgcuggagccggaagaugcucaugacgggcaccuuggccgucuuccuucuccuuaucauggggcagcugaccuggaacgaucucauccgccugugcaucauggugggcgcgaacgccuccgacagaauggggaugggaaccacuuaccuggcccucauggccaccuucaagaugcggccgauguucgccguggggcugcuguuccgccgguugacaucucgcgagguccugcugcucacuauagggcuguccuugguggcgagcguggagcucccuaauuccuuagaggagcugggcgacggguuggccaugggcauuaugaugcugaagcugcuuacggaguuccagccccaccaguuguggacgacccugcuaagccugaccuucaucaagacgacccucucuuuggacuacgccuggaagaccaccgccauggcgcugucaaucaucucccuguucccccucugcuuaagcacgaccucccagaagaccacauggcugccgguccuccugggcagcuucggaugcaagccgcugaccauguuccucauuacggagaacaagaucuggggacggaagucguggccccugaacgaggggaucauggcuauuggcaucgucaguauccugcucuccagccugcugaagaacgacgucccccucgcagggccgcugaucgcuggcggcaugcuaauugccugcuacguaaucucaggcuccuccgcggaccucucccuggagaaagccgcugagguaagcugggagcaagaggcagagcacuccggcaccagccacaacauccuggucgaggugcaggacgacgggaccaugaagaucaaggacgaggagcgcgacgacacccugacuauccugcugaaggccaccuugcuggcgguguccggugucuauccaaugagcauccccgccacccuguuugugugguacuuuuggcagaagaagaagcagcgguccggggugcugugggacacccccagcccucccgaagucgagcgcgccguucuggacgauggcauauaccguauccugcagcgcggacugcucgggcggagccaggugggcgucgggguguuucaggacggcguguuccacacgauguggcacgucacucgcggggcugugcugauguaucaaggcaagcgguuggaacccagcugggcuucagugaagaaggaccuaaucagcuacggcgggggcuggcgcuuccagggguccuggaacaccggcgaggagguccaggugaucgcgguggagcccgggaagaaccccaagaacguccagacgacgcccggcacguuuaagacacccgagggcgaggugggggccaucgccuuggacuucaagcccgggacaagcgguuccccgaucgugaaccgggaggguaagaucgucggccucuauggaaacggcgucgucacgaccagcggcaccuacgucuccgccaucgcccaggcgaaagccagccaggagggcccuuugcccgagaucgaggaugagguguucaagaagaggaaccuuaccaucauggaccugcacccggggagcggcaagacccggcgcuaccuccccgcgaucguccgggaggccaucaagagaaagcuccggacacuaauacucgcgcccacccgugucguagcuucggagauggccgaggcccugaagggcaugcccauccgguaucagaccacggccgucaagucggagcacaccgggcgggagauugucgaucugaugugucacgccaccuuuaccaugcgccuccugagcccugugcgggugccgaacuacaacaugaucaucauggacgaggcccacuucacggauccggccaguaucgccgcccgcggcuauauaagcacccgggucgggaugggcgaggcggcggccaucuucaugaccgccacgccacccgggaguguggaagccuucccccaguccaacgcggugauccaggacgaggagcgcgacauccccgagcguucuuggaacucuggguacgacuggaucaccgacuucccaggcaagaccguaugguucguucccagcaucaaguccgggaaugacauagccaacugccugcgcaaaaacgggaagcgggugauccaacucagccgcaagaccuucgacacggaguaucagaagacgaagaacaacgacugggacuacgucgugaccaccgacaucagugagaugggggccaacuuccgggccgacagggugaucgacccacggcgcugcuuaaaacccgucauccugaaggacggccccgagcggguuauuuuggcggggccgaugcccgucacggucgccagcgcagcccagcgccggggccgcaucggccgcaaccaaaacaaggagggggaucaguacguguacaugggccagccucugaacaacgaugaggaucacgcccacuggaccgaggcgaagaugcugcuugacaacauaaacacccccgaggggaucaucccggcacuguucgagccagagcgcgagaagagugccgccaucgacggagaguaccgucuccgcggggaggcccgcaagaccuucguugaacucaugcggcgcggugacuugcccgugugguugucguacaaggucgcguccgagggcuuccaguacagcgaccggcgcuggugcuucgauggggagcggaacaaccagguucucgaagagaauauggacguggagauauggaccaaggaaggagagagaaagaaacugaggcccagguggcuggacgcccggacauacagugacccgcucgcccugcgugaguucaaggaguucgcugcugggcggcgcuccguaagcggcgaccuaauucucgaaaucggcaagcugccccagcaccugacgcuccgggcgcagaacgcccuagacaacuuggucaugcuccacaacuccgagcagggcgguaaggccuaccgccacgccauggaggagcugcccgauaccaucgagacucugauguuacuggcgcugauugccgugcucaccgggggcgugacgcuguucuuccugagcgggaagggcuuaggcaagaccuccaucggguuacugugcgucacggccagcuccgcucuccuguggauggccagcguagagccccacuggaucgcugccuccaucauccuggaguucuuccucauggugcugcucauccccgagcccgaucggcagcgcacaccccaggacaaccagcuagccuacgucguuaucggccuccuguuuaugauccuaacgguggccgccaacgagaugggccugcucgagaccaccaagaaggaccucggcaucgggcacguagcggcggagaaccaccagcacgccaccaugcuggacguggacuugcggccugcuagcgccuggacgcucuacgcgguggcaaccacagucauuacccccaugaugagacacacgaucgagaacaccacggccaacaucucacuuaccgccauagcgaaccaagcggccauccugaugggacuggacaagggguggccuaucaguaagauggacaucggugucccgcugcuggcccucggcugcuauucccaggucaauccacugacucuuaccgccgcgguccucauguugguggcacacuacgcgauaaucggaccaggacugcaggcuaaggccacccgggaggcgcagaagaggaccgccgccggcaucaugaagaaccccacaguggacggcaucgucgccaucgaccucgaccccgugguauacgacaccaaguucgagaagcagcugggccagaucaugcugcucauccucuguaccucccagauccugcucaugcgcacgacgugggcccugugcgaguccaucacccuggcgaccgggccgcucaccacgcugugggaagguucuccggggaaguucuggaacaccacaauagccgucuccauggccaacauauuccgcggcagcuaccuggccggcgccgggcucgcguucucccugaugaagucccugggagggggcagacgggggaccggcgcccagggcgagacacuuggggaaaaauggaagcgucaguuaaaccaacuguccaaguccgaguucaacaucuacaagagaagcggcauuauggagguggaccgcuccgaggccaaggagggucucaagcggggcgagaccaccaagcaugccgugagccgcgggacggcgaagcuccggugguucguugagcgcaaccuagugaagcccgagggcaaaguaaucgaucucggcugcgggcggggcgggugguccuacuacugugccggccucaagaaagucacagaggugaagggguacacgaagggcggccccgggcacgaggaaccgauccccauggccacuuacggcuggaaccugguaaaguugcacagcgggaaagacgucuucuucaugcccccugagaaaugcgacaccuuacugugugacaucggagaguccagcccgaaccccaccaucgaagaggggcgcacucugcguguacucaagaugguggagcccuggcuccgcggcaaccaauucugcaucaagauucuuaacccguacaugccauccgucguggagacccucgagcaaaugcaacggaaguacggcgggaugcuggugcgcaacccccugagccggaacuccacccacgagauguacugggugucgugcggcaccgggaacauuguaucggccgugaacaugacgucuaggaugcuccugaaccgguuuaccauggcccaccgcaagcccacauacgagcgcgacgucgaccuuggggcuggcacccggcacguggccguggagcccgaagucgccaaccuggacaucaucgggcagcgcaucgagaacaucaaaaaugagcacaagucgacguggcacuacgacgaggacaauccguauaagacuugggccuaccacggcuccuacgaagugaagcccuccgggucggccucaagcauggugaacgggguagugcgucugcugacuaagccaugggacguuauucccauggucacccagaucgcgaugacugacacuacucccuucgggcagcagcgcguguucaaggagaagguagacacccggacaccccgcgcgaaaaggggcaccacccagaucauggaggugaccgccaaguggcucuggggcuuccuuucccguaacaagaagccacggaucugcacgcgcgaggaguucacccgcaaggugaggucaaacgccgcgauaggggcagucuucguggaugagaaccaguggaacagcgcuaaggaagccguggaagacgagcgauucugggaccuaguccaccgagagcgggagcuccacaaacaggguaagugcgcgacaugcguuuacaacaugauggggaagcgagagaagaagcugggcgaguucgggaaggcuaaggguucucgggcuauuugguauauguggcugggcgcccgcuuucuggaguucgaggcccuggguuucaugaaugaggaucacugguucagccgggagaacucccugagcggcguggagggggaaggccuccauaaauuaggguacauccucagagacaucucgaagaucccgggcggcaacauguacgcugacgacaccgcgggcugggacacacggaucaccgaggacgaccuccagaacgaggccaagaucaccgacaucauggagcccgaacacgcccugcuagccaccaguaucuucaagcugacguaucaaaacaaggucgugcgcgugcagcggcccgccaagaacggcaccgucauggacgugaucuccagacgugaccaacgggggucaggccaagugggcaccuacgggcuaaacaccuuuaccaacauggagguccagcugauucgccagauggaguccgaaggcaucuuccuccccagcgagcuggagaccccgaaccuggcugagcgagugcucgacuggcuggagaagcacggagccgaaaggcugaagcggauggccauauccggcgacgacugcguggugaagccuaucgacgaucgcuucgccacagcccuaacagcgcugaaugacauggggaaggugcggaaggacaucccccagugggagcccagcaagggcuggaacgacuggcaacaggucccguuuuguucccaccacuuccaccagcuuauaaugaaagaugggcgcgagaucgucguucccugccgcaaucaggacgagcucguggggcgcgcccgggucagccaaggcgccggguggucccuucgagagaccgccugccugggaaagagcuacgcccagauguggcagcuuauguacuuccaccggcgcgaccuucgguuagcggccaacgcgaucugcuccgcugugccuguugacuggguccccacgagcaggaccaccuggucuauccacgcccaucaccaguggaugaccaccgaagacaugcuguccguguggaaccggguguggaucgaggagaacccguggauggaggacaagacacacgucagcuccugggaagagguccccuacuuaggcaagcgcgaggaccaguggugcggcagcuugaucggccugaccgcccgagccaccugggccacgaacauccagguggcgauaaaccagguccggcgccucaucgggaacgaaaacuacuuggauuacaugacuagcaugaagcgguucaagaaugagagcgaucccgagggggcgcucugguaa
